United States Patent 9,518,277 (GENETICALLY ENGINEERED MICROBIAL STRAINS INCLUDING CHLORELLA PROTOTHECOIDES LIPID PATHWAY GENES) - sequence listing, part 15

SEQ ID NO: 46977 - DNA, 28617 bp, Chlorella protothecoides
  modified_base (250)..(259): a, c, t, g, unknown or other
  modified_base (609)..(618): a, c, t, g, unknown or other
  modified_base (710)..(719): a, c, t, g, unknown or other
  modified_base (1181)..(1190): a, c, t, g, unknown or other
  modified_base (1414)..(1423): a, c, t, g, unknown or other
  modified_base (1880)..(1889): a, c, t, g, unknown or other
  modified_base (2616)..(2625): a, c, t, g, unknown or other
  modified_base (2803)..(2812): a, c, t, g, unknown or other
  modified_base (4678)..(4720): a, c, t, g, unknown or other
  modified_base (4874)..(4883): a, c, t, g, unknown or other
  modified_base (4939)..(4948): a, c, t, g, unknown or other
  modified_base (5057)..(5066): a, c, t, g, unknown or other
  modified_base (7497)..(7506): a, c, t, g, unknown or other
  modified_base (7587)..(7596): a, c, t, g, unknown or other
  modified_base (8603)..(8612): a, c, t, g, unknown or other
  modified_base (9092)..(9101): a, c, t, g, unknown or other
  modified_base (9893)..(9902): a, c, t, g, unknown or other
  modified_base (10480)..(10489): a, c, t, g, unknown or other
  modified_base (10816)..(10825): a, c, t, g, unknown or other
  modified_base (11076)..(11085): a, c, t, g, unknown or other
  modified_base (11721)..(11730): a, c, t, g, unknown or other
  modified_base (12019)..(12028): a, c, t, g, unknown or other
  modified_base (12503)..(12512): a, c, t, g, unknown or other
  modified_base (12579)..(12708): a, c, t, g, unknown or other
  modified_base (12778)..(12787): a, c, t, g, unknown or other
  modified_base (13885)..(13894): a, c, t, g, unknown or other
  modified_base (14185)..(14194): a, c, t, g, unknown or other
  modified_base (14511)..(14520): a, c, t, g, unknown or other
  modified_base (14893)..(14902): a, c, t, g, unknown or other
  modified_base (15000)..(15009): a, c, t, g, unknown or other
  modified_base (15103)..(15188): a, c, t, g, unknown or other
  modified_base (15298)..(15307): a, c, t, g, unknown or other
  modified_base (16089)..(16098): a, c, t, g, unknown or other
  modified_base (18735)..(18744): a, c, t, g, unknown or other
  modified_base (19016)..(19230): a, c, t, g, unknown or other
  modified_base (19431)..(19551): a, c, t, g, unknown or other
  modified_base (21378)..(21387): a, c, t, g, unknown or other
  modified_base (21708)..(21717): a, c, t, g, unknown or other
  modified_base (22585)..(22594): a, c, t, g, unknown or other
  modified_base (23088)..(23097): a, c, t, g, unknown or other
  modified_base (23585)..(23594): a, c, t, g, unknown or other
  modified_base (24222)..(24231): a, c, t, g, unknown or other
  modified_base (24378)..(24530): a, c, t, g, unknown or other
  modified_base (25585)..(25594): a, c, t, g, unknown or other
  modified_base (25831)..(25840): a, c, t, g, unknown or other
  modified_base (26648)..(26657): a, c, t, g, unknown or other
  modified_base (27061)..(27070): a, c, t, g, unknown or other
  modified_base (27479)..(27488): a, c, t, g, unknown or other
  modified_base (28048)..(28057): a, c, t, g, unknown or other
  modified_base (28116)..(28125): a, c, t, g, unknown or other
ctggcgggcctgggcgacgtccagcgtgcggtggtgcgcctggcggccgcggggttgggcctggggcccgcgcgcgacgcgccgcgcgtcgtgctctacgaggacaccgcgcggcggcgggtgcggggcgtggcggccacgctgcgcggcctgcgccgcatccaggatgccgtggcgcagttccagggtgagtgtgggggagtagatttcgtggggttttgctggaaggaaggtggaggggaaggcccgnnnnnnnnnncgccgtggcgcagttccagggtgagggggggaggggagtaaacttcgtggggttgtgctggaaggaaggtggaggggaaggcccgccgtcgcgtcaaagctgccggctggagtccccagcgtactcccaatccctcaacaacactgccgcgctctcctgctctcaggcgtcgacgtcgccagccccctcctggccgacctgacccagcctggcaggcgattcccgcacctggacgggccgctgaaggagatgtgggacgccacggactgggaggccgcggaggccaccggccacatcctgcccgccgaggtgcagtggggggttttgcggtttgaccccggggggggggnnnnnnnnnncatgtgtcggggtggcggggcacaaatggctgtgctctgtgaagaccccccgccttgacccaaccctgccgcagggggtggacgcggacttnnnnnnnnnncgaggccacgggccacatcctgcccgccgaggtgcagtttggggggggttgcggtttcaccccgggcgtggggtccagggggtgtcttgcctggcatgtgttggggtggcgggcaacgaatgactgtgccctgtgtagaccccccgcctcgacctaaccctgccgcagggggtggacgcggactttgacgccgcgacgcgcgccatcgtggccgccgatgccgcgctggacgactacctcgaggtgcgtggcgttgccgggcctggacggggagggggaagggctcctgtgctggcctgggagctggcggagcgtcgggcatcttgcgttcgagctacgccctccaaatgtgccctcacatgtgctgtgaccggaaacccaagtcgccatcccaactctcgcccatgccttaggaggtgaagggcttgctgaagactcgagcgggggtgacctacgtctcannnnnnnnnngtcccaactctcacccatgccttaggaggtgaagggctcgctcaagactcgagcgggggtgacctacgtctcactcaataaggacagccacgtcctgcagctgcccgaggtgtttgtcggcgtagcggtgggggccgcactggtttgcgcgccgattgccctctgcgacgagcctggccatcccaggccagagccttgggtctgccgccaggatccccgagccnnnnnnnnnncttgtcggcatagcagtagggccgcactggtttgcatgccgattgccctctgcgacgagtctggccatcccaggccaggtccttgggtctgccgccaggatccccgagcctccccatctctgccctccatttccgcagtctgtgaccacgcccgcctcctgggagcccatgacggcgaagaagggggtgcgacgatacaccaacacccagctgagggccctggtcaagcggcgcgaggcggcgcatgaggcacgagtcgtggcccaggccggcatcctcgtggtgaggttttgaagacagggtgtgagttggtgtgctgggatggcgagggatgagctccaggtctggatactctgagaggatcccagaggaaggtggcggccacgaacccacccaccactctcggcatgcctctccccaccccccacacctcaaagcacactcctcgctccacagnnnnnnnnnncggtgtgctgggatggcgagggacgagctcccaggtctgggtactccgaggggatcccagaggaaggtggcggccacaagcccacccaccactctcggcacgcctctccccaccctcgacacctcaaagcacactcctcgctccacaggcgctgctgaggcgctttgccgagcaccagggcgtctggtcggcggctgtcgagtgctcggcgcagctggatgccctgctctcgctggcggtggctgccggctccagcgcagggccgatgtgccggcccgagatcctcccctggtccgacgtcggcggtgagaagaggggagggtccaggggtcgtagggaggggagggcaggggacattgagagagtgcgctggcagtgcacatgggggaaggccctgcagccttcctcatgatgcatagacgtcccccagaggacaccctccaaccctgcctcccctccaagtcagctcctcctgataccaacaaccttcaggccccatgtttgaggccaaggacctgcggcaccccgtctccgcggtgatggaggcggctgccatgtccagcggcggcggcggcgggtttgtgcccaacgacgtgtcgctgggagccgacgcgccgcccttcctcgtgctgacaggtcggtcggttgggtgtggtaggaagatgggggggcagcgttgctcttccgctggcggtgcgcaccaagtggtcacgtgccgaccctcatnnnnnnnnnngggttgggtgtggtaggaagatggaggggcagcgttgcttttccgctggcggtccgcaccaagtggtcacgtgccgaccctcatcccaggcccgttggcggcctctccatgacccacacggggcgccaggagcccctcgacccatcacctccccccccctcgcctcccatccccctcnnnnnnnnnntgcggcctctccatgacccacactgggcgccaggaacccctcgacccatcacctccccgccccctcgcctcccatccccctcactccccccacccctcacacaacccacgcacgcccaggccccaacatgggcggcaagtcgacgctgatgcgccagatctgcctggcggtggtgctggcccaggtgggggcctgggtccctgcggcgagcctgcgcctgacccctgccgactcgctgttcgtgcgcatgggcgcgcgcgaccgcttgctcctgggccagtccaccttcttcgtggagatggcagagacctcggccgcgctggcgcgtgccacccggcacagcctggtggccctggacgagctgggccgtggcacggcaaccagcgatggcgccgccatcgccggcgcggtgctggagcacctggcaagcgacctgcgctgccgcggcctgttcgccacgcactaccacgccgtggcggagcacgcacaggtggcgctgccggtggcggtgtgccacatggcctgccgcgtggacggcgacggcggcgaccacgtcaccttcctctacaagctcgtgccgggggcctgccccgccagctatggcgtcaacgtcgccaggtgggctgattggtgtacatgtgttcttcgaggggggaaagagggaggaaaggaggaaagtagtggtgtgctccgggctttgaatagccccacaagaatgtggtgtgtgggttgccggggttctgctagagggtgatgaggaccgcattgaggccctgttgcgacccaagcccgtgcctccattctacctgtcgcaggctggcgggcctgccggacgccgtggtgcggcgggcaagcagcatggcggcctccctggcacagggggccaccatcgacggggaggagggggcacgggagaagctgggcagcatcctggaggcctgccggcgggggcccaaggccgtgcaggcagcatggctgtccatgcgccgcccagccatatcagtgtgaaaccgacagctctgtacatgcatgtacgatcagtcagtggttgctccttgctttgccatcgcgttgccagccgttcgtcccagtgcagtgttgctacggtgcgaggaacctagggaccttgtcggaaattcaaatcgcgaaagattctcggaaagataccatgtacgacatggctagcaatggcacgagccaggcccggaggcacataccaaggccccataacacacttcagacccccaaaagaagttgtacagtgcaacactggatgccatgatgagcgacaagccagcatcaggcccggttccgtggccctggtcgggtctggaccggggatttgtatggtttgatgccgcatataccgttttgacaacagcatctagacagacccggcgcaacacgatgctgggggatctacacaggaataaaacctgagaaatcatgcgctgaagacggctttaccagcacgaccagtccgatctccctgcccaccatcccctgctcgacaccatgggcaaaggcggcgacggaagcgagaatgtgccatccctgcggcgctcctccagcctgctgcgcaggctgcagcaggccggcatatcgtccagggttggcgacatcaaggccgatctcaccgtactgaagaacatctggtgagttgcggcgcctggtggggctccggggtggcagctccattccgatctgtgcgaggtgggaaaacgtgttccaggcaggaacccctgatatattgaatgcacgcccctttcctttgtcgctccaggttcaagaagctgaggactgatgggagtcatgctcagaggctggagcagttttacggaccccaggcccatgcatgtgggtggnnnnnnnnnnnnnnnnnnnnnnnnnnnnnnnnnnnnnnnnnnncagtcagtgcaaacccctgtgagctgatccaatcccacccctgcaaatgaacacgcagacgatgccttccgctccaagttcctgtggggccgggagccgctcgtggctgcctgcgctgcacgactgaaggccaactctgacatggtctgggtcnnnnnnnnnnactcttggctgcttgcgctgcacggctgaaggccaactctgacatggtctgggtcnnnnnnnnnncgctcagaaccctggcaaagtgtacaaaaaggtcgacttcacaatccaccccacacaccaccttgcctggcgcaggagaacgtggcgctgatgtccaagttcatggatnnnnnnnnnngacctgggcggcggcacagccgtgagttgggagcttgggatcaattttcttgggattaggtacatggccacaccagcaactcaatccatacttgtttaggagtctgccatgtttgtggcgatgactgctcagaaccctggcaaagtgtacagaaaggtagacttcacattccaccccacacaacaccttgcctggcgcaggaaaacgtggcgctgatgtccaagttcatggatctgaagaggttcagccacatctatgtggtggatctgtgttcctccctgtgcagacaggtgggggcagggcttgtgaatgtggcattccagagaccgtttcagctccaaggtacacccttgatagcgaacaaccataggtggccaacaaaattctccctgccatcccattcacaggcggagcagaaggtggctcagcatggctggaccaacgtgactgtggtggaaggtgacgcctgcacctttgttccccccggcgatgttgcaaccctcgtcaccttctcctattccctctcaagtacgtgcaggggtgggaaatggggtgaaagcgctgcccttttcaggcatcgagacatgcttttcccttgctcagctgagcgtattgttgagaacgctgatgacctctcacaattgtgcccctatcctcctgaactcgctccgcattgggaccttgtcaggactcaccgtttccttgcctcggcaccttgacggtttacacaatccatcgtgctgcctgcacccatgccacgagttcctacacctcgaatcaaagcacttatccccagcctcccaaaccaacgacagtgatccccgacttcctcgcggcaatcgacgccgccgccagctacctggacccctccatcggcatcctgggcgtcaccgacttctacgtctcctccaagttcgacttcccgctgcgccagctgtcctgggtgcgccgcttcttctggcgcagcgtcttcgacaccgacaacatcgacatcggccccgagcgccgccactacctggaccacaagctgtgccgggtgtgggagcgcaacggcgagggcaccatcccctatgtccccgccccactccgctgccccttctatgtgtggttgggccgggcgcccaccctggcagcgcagctggtggagcccaaggtgggcgggtgtttcgggtgggtgcatgcacaggggtggcggagtaggtcggagcacggcctcgccctcgaaaacattctagaacgataccttttgatatcaatgctgcatggtccttcctaacttccctccgcaaacttccgttccatatctgcaggtggaggcccccccctgcttccctcccaccttcctgtatacccagtcctgggaggaccctgcggtggacgagcccatcctggacatccagcccgacgacgtctgcctcaccctcacctccggcggctgcaacacactgcacctgtgcctggccggcgccgcccaggtgcactctgtggactgcaaccccgcgcagtcggcgctgctggagctcaaggccctggccatccgtcgactgggctacgacgacgtgtggagcctctttggagagggacgccacgccgacttcccgcgcctgtatgagcgcgagctgagccccttcctgacgcagacttcgcatgcgttctggcgcgaccgcctgcactacttcaggcagggcctctactaccagggcggcatggtgagtgggagttttttgggggtggagaattggtttaacgaggagaggaggggggcagggggaggtcaataacgcccacctgctctgcacccatggagactctcctgccctgtgtggatgacctgggacgagaagtcgaagcccctggccggccacagtataatgtgctggcaatgcaccagccccagccctccattgcgcgtgagggccctctctccaaagctcaatattccgcttccctcgctggctcctcgcagggcgccgtcgtgtggatggcgcagtggctgttctgggcgctgggcctgggtggtggcatgaagcgcctggtctccgctcccacactggaggaccaagtcaaggtgtgcaggcttggctggacggggggtttggcttccaagaaaacaccaggagactggcatgccggctgttggcaaactgacaaaaacttgatgaattgtatcccctcacaatctctcttcttttcaggtctgggaaggcctctgggttgtgcgcttcctggtctatgccccggtctggctttcctccctgttcgtccagttctttgcggccctgctcttcaaccgtgtgaccctctggtgagaagcgagggggggttgtcgagtatcggttgtatgttttctgggctgtatcacgcaggcacgtgctggaggcagctgcccgtacctcagaccagcgcaagctgagccgcccccccccccccnnnnnnnnnnacgggtgaggaggagtcgtggtgtgacctggcatgatagcacgggtcacactaccctatgcgtgctcggtgccgagggcgnnnnnnnnnngagtgctggaggcagctgcccatacctcagaccagcgcaagttgagccgcccccccccccttcccctcctacccctcgcaggtttggcgccggcatcccctgcaagcaggccgccctcatccgcaaggacggcgtgcggctgagcacatacgcggcccgcgtcttcgacggcgtggtgcgagggtacagcctgagggacgacaattgcttctactacaactgcctcgcgggtgagtaggagtcgtggtgtgagctggcatgatagcacgggtcacgctaccctatgcgtgctcggtgccgagggcggacggcatgccctgctgtgcgctgtgcggctggcccaggtcatggctgtgcgtgggtttggagggtcggcctcacagcggcgcctgcaactcccacgtcagacctcccacggcccacctcccacgcctccccccgcagggcgctatgcgcgcaacaactgccccgcctacctgacgccgcacggctttgccaacctgaagcagggagccctggactccctgcagatccacacgggcttcttcctgcccaccctgaacaagcgcaagtacagcaaggtcatcctcatggaccacgtggactggctcagcctcccgcaggcagaggtaggggggctgctcagatggtgaatggcagttctgaatcgcgatctcagaccctgcaccctttgatccggcatgggcggcattggatcctggtcgtggtgttcccgtaccggggtcgaggaatgacctccccaactcaaccagctacacacgcctggaccgcaggaggtcgccgcggccctaggccggcaggtggtcaagggcggcaaggtcatctggaggtctgccgccctgtcgccgccctacgcaccgctcatcgccaaggcgggcttcaaggtcagtggcaagctgagctgagacttgtggctgtttgggcttgaggtgcgccccagctgcaggtcggggccctgggcatgccttcgtcttgcctttggggtnnnnnnnnnnatgagctgaggcctgcggctgtttgggcttgagttgcgccccagctgcaggtcggggcactgggcatgccttcgtcttgcctttggggtgtgacacaggtgtagctttgctcgatgaaacacccgcaatgccacctcttgacccaatggcccaccctccccactgcaacaggtcaagcgtgtgtcatccatcgaggagggatgcatggaccgtgtcaatatgtactcctccttctatgtggctgagaagctctgaacgagtgcgtaaccatgtcaactcctgtgacgaagcctttttgcatgacatggcacagctgttccgcctcatcccaaattccccaactgagctcgtaatgtccaaatcatttctgttttttcagcctccctatccgtacttgacacgtcaaaggagaggggtaggttacacgcaagttgatcaatcacccgataagccacatgtcaccgaagtacgaaccagatnnnnnnnnnncgagaagctctgaacgagtgcataccatgtcaactcctgtgatgaagcctttttgcatgatatggcacagctgttccgcctcatcccaaattccgcaactgagctcgtaacgtccaaatcagttctgttttttcagcctccctgtccgtacttgacacgtcaaaggagaggggcgcaatggctagtggtagggtacatggggcggtctcacgcacgttgatcaatcacccgatgagccacatgtcaccgaagtacgaaccagattgagaacgatcaatcaccccagactcttccatgcacagtcatttaatcttgaagaatatttacggagttaaacgcccaatgtcgagctcgtgagtgggactacctgcgggtgggtgccctcgccatctgtacatgtcgacagagtgtgggtccgcagcaacatatgtcgatcgccttgcgtaggttctacgatgaagtatggcgcagcaatcagatcaagctgcgcggcttgctggattgcgaactggaggcgtctagcaatgataaaaaggtcaaagagctttctggacttgacaaaccccaaagccaccagctgaggtagcatatgatgattataattatggcgaaccatctcatgatggagttcattaatacttcaacttcctctgcagcatccagagtcagagtgggccaggatgtacaatgcctacctggacattgcatcgtccttagcgggggcacacacaggactggttcagccacagaagctggagctagtagcgcagtgcctgcaggcctgcctgggannnnnnnnnnatccttaacgagggcacacacagggctggttcagccacagaagctggagctggtagcgcagtgcctgcaggcctgcctgggaagggcagtggaaatacggcagcacctggtatgtagtcatgcgtcagcagtacagctgtcgcgcccagtgctctcatgcctgattgtgtgtgtctctgctgtgttggacagagatcttgctccaactgacgtttaggtgcggctccgtgactgaccaacatggatggcctccttttgcaacaggttgatctgaaaggagggctgccaggcattgacatcccaaggggacctggcagcggcatccctgcgtttgtatgcctactccctccccattctcaaagtgaacaggggaagctgaccattccccaatgcgcggtccgaccctgggcatcagaacggattgcatgcaggaagccggcagacagggcaaccctgacaggaagcagtgaagctgatgcagcgatccgtatccaggctgtcgcccgcggctttctcgtcagacggcgccggcggctgggccaggggctgcgctccctcttgatcggcccgtcctgcannnnnnnnnntggctttctcgtcaggcggcgccggcggctgggccgggggttgcgctccctcttgatcggcccgtcctgcagtgccgccacagcgactgtggctgctgcagaagcagaaagaaagaaaatgcgcagcatgatgcaggccgacctggagaggaccatgagggaggtgcaggagcgcaaggtctcccaggaaggccccttgtggcagcaagcgattctccacgaggtgggcatgggggcccaatgcatttgactggtgtggaaggttgtgcttctagtgctttgctgctctgcaggtttgttgctccctgtgccttgccagtcatgccnnnnnnnnnnagcatggggggcccaatgcatgtgactggtgtggaaggttgtgattctagtgctttgctgctctacagagctgttgctccctgtgccttgccagtcatgccgcttcaaggaaacatgctgcatgctcccaatggcaacatcaccatccccatgcagctgcaaggcctgcaggcctcaaatcgtgccgccagtgatgtacgtacactcctcccggaccaagaccaggccttcatctccgcacacctcatgcnnnnnnnnnngcgtgccgtcgatgatgtacgcacactcctcccggaccaacaccaggccttcatctccgcacacctcatgcacctcgcgcccaagagcctccctgtgagcctggagccaggcacccctgaggcaccgcgtgcatggcgcggacccgagaggccctccagacccggacagggtgggagcggagcaccacccgggggcccacctgcggcaggcgccaggggagcagtaggtacgcctccccgctctggctccacagcaccagcaaccgcatctaagaaggatcgaaggggctctcccatccaaccacgggagtccgtgtgcctctccgttctgaagcaagtttgtagtgcaaccgaagacctgtggcagcagctggagggagagcctggggcaccatccatgccaggggccacgctcttggacgctggcatggaaggactggcccctccatttgtctcctgggaacgggacggtctgtgccttgcggtgctggagaaggaagcgggccgccgtgcctggctggcggtctgcatgcggaccttgcaggatttcagggatggtgatcctgctgaccatggagacagctgcgtcgccaaggtgcgatatggcagagtaggtctgccctgcccctctaatannnnnnnnnnattaagggatggtgatcctgctgatcatgcaggcagctgcgttgccaaggtgcgatgttgcagagtaggtctgccctgcccctctaatactgccctggaatggtgcggagttcttgctgctgccccctttctggggaaccatcattcgcagccaggccctgagactgcccgtgatcgatatcacactcaaattttgaaccaatataccacagaaaaccaacggccgcaaggcaggggccgggccaagaaaggccagcatggcccaagccagcaagaagtcaaggaagannnnnnnnnnggtgatcgatctcacactcaaattttcaaccaatacaccgcagaaagccaacggccgcaaggcaggggcagggccaagaaaggccagcgtggcccaagccagcaagaagtcaaggaagaaatgggcgcatggcaacaaagccttggggcctgtgatggtgagggagcaaggtagcattagtgatgtatgtctgagcgctgctatttatgaggggagtccccaccattggcctgaacatcctgctcccacgcgtcgccaagctcaacatgaaaccctccctacgcaagcacaggatcagacgcaaggattgccgggcctggatgcaatggcagcacaactagtggagctggggctcatgtacaacccgcctcccaccagcctggatgcctactgcccggtgcatgaaaccggtccgcccgagcctccccgtcatggcggtgccgcggccgattcggcccctgcagcaggcggcaannnnnnnnnnattgccaagctcaacatgaaaccctcccacgcaagtacaggatcagacgcaaggattgccgggcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagggtgtgtcctctggcaccaccatcccactcctgccttgttgcatgcatgcagcggagcagggttcnnnnnnnnnnggcgtccaatctggccaggtccacccgtcagggttcccatggccctcaggatgccacgcatgctgatgtcagcatgccaggggtcaagcatgcactcctcatgctgggcacgctgcccctagcgctgcccaacctgcgcacggggtaggtcacacgcggggaggctcttgaccctgggctacttgggcaaggcagagggtgtgccctctggcaccaccatcccactcctgctttgttgcatgcatgcagcggagcaggtttactgcgacccatgctgctctttggcgcacctgggagcggcaagacctgcgccgtgcatgccattgccgcctcggctggagctgtgatcgtggacctgagtcctgccaaactagacagcctgcccagtgtggcgccggcaacccttattcgcacggtgggctggagcatgcttccctggaggaaaaaatgaattgtgtgtgcctggacatgaggtttcgtgttcctgcagctccaggcaatgctttcaccctacacccgccaaactgcccaccttatctctcccaggcatttgctgtcgccaaagcctgtgcgcctgccattatcctgctggaaagcgtggaaaacatattcatcacagacctgggacgacaggccaagggacagggggcaccaagccattctgtcaccctaatcaagcgggccttgctcgaacaggtaggtgggagaggggtgtggggtccagggctgttcaatatttgagatggtattaggggtgggtttttagggagctgggcattcccatgccgtgccgccctgtagacctgtggacctccctcagcagtccctcctggccctcccctgcacgggattggccctgcaggcaaggacactgggcccaggggacggggtcctcatcctgggtacaagtgcggcgccggattcatgcacacgtcagagtctgcgtgatctccttgctttcttcacgcaccacatctacttgcctccccccagcgcgtcagtcaggtgcgctgggaagttggggcgtgcttgccagtggtgtgctgtccgatagggatgaacatcactggtaaatgcagccttgcctgtagaaatgcnnnnnnnnnnagcgccggattcatgcacacgtcagagcctgcgtgacctccttgcttgcttcacgcaccacatctacttgcctccccccagcgcgtcagtcaggtgcgctgggaagttcaggcgtgcttgcctgccagtggtgtgctgtctgatagggatgaacatcagtggtaaatgcagccttgcctgtagaaatgcttgctcatgctcacctcctttaccctctggaatgcaagtgtgcacgcctggagggacctggtgctcgggatcctctgcatgcagagctgcttgtttgcactnnnnnnnnnncaccctctggaatgcaaatgtgcacgcctggtgcgacctggtgctcgggatccctctgcatgcagagctgcttgtttgcactgagatgtcctgcccccctacccctgatcatccttgtccaggcgggcaatcctactccaagcccacccacactggcctccgagactgcttcacctcgtcactgagctcacgcggggtctgcatgccggcccgctgagggcgctgtgcccgagctgggcggcgccggtggcagcagacagagtcgaggctctgctgatggagaatttaccccaccttctggacgagcagcgggaggnnnnnnnnnntgctgggcggcgccgctggcagcagacagagtcgaggccctgctgatggagaatgtaccccaccttctggacgagcagcgggaggatgagctccggctctgggcgcgccgcctgctggaccccctcccatccatcgaccctgcaaaggcccccaaagcagctgcaaagggggaagccagaacaacaacccggaaaagctgaggtgtcaacccccccctgacgttctcgacccagcaacactcccacacctctgagggacaaagcagggcagtgcgcaaacttgtgtaaatacaggttcacaggccacggctgatggtcttacgcgccaggatcaaggcgcccgcgcccagcgctcccacagccgccgcggcgnnnnnnnnnntggggcctttgcagggtcgatggacaggaggggatcccacaggcggcgcgcccagagccggagctcctcctcccgctgctcgtccagaaggtggggtnnnnnnnnnngctgcctgacggggccccctgaccgagcggtacagggctcccgccgatgctcccgcagccagtgtcaccacctcggacggcacgacgccatccnnnnnnnnnnnnnnnnnnnnnnnnnnnnnnnnnnnnnnnnnnnnnnnnnnnnnnnnnnnnnnnnnnnnnnnnnnnnnnnnnnnnnncaggttgatcattgcatggagatgatggagtgatcccagaagatgcactcctgcacaggcaggtttcaaagaccacataatgcaatgggtcatgcacaggtcaggcatcnnnnnnnnnnactgcctggcggggtcccctgaccgagcggtacagagctcccgccgatgctcccgcagccagcgtcaccacctcggacggcacgacgccatccgacatgtagtttccaaaggattctgtcgccgcaaacatcagtccaagtgcccccagcgagttacctgcatggaaggaggcccatcagagagtgggaaagtgaggcatggaagataggttgatcattgcatggagagaatggagtgatcccagaagatgcactcatgcacaggcaggtctcaaagtccacatgatgcaatgggtcatgcacaggtcaggcatccggttctctgctcttgacagcctagagagcccaccccttccaagaccccccgatctcagcagaaacaggcagggcagcgcaccgtttgcacggccgagcttccccgaggtgttcagcagctggttcaggcgcaggcgctgggtagcaccggcgccgtccacggcaagaggggtggacagggcctggaatgcccccctgccccctccggccatggccccggcaaggtagccggccccagtgtaatagctcaggttctccgaccacgatcgcgtgtgcacggtggcatcttcgatgaagaggaactcgggctgctgggggagtcggaattgagggacgccctcgcgacggctcaccgccgcgagacctgtaaaggagagaatgaggaggttggaggagtgaggttgggggagtgtgaagggttccggccatgcatgcaatgtgaaatcgccatttaccttcgtaagggnnnnnnnnnngatgaggaggttgtgtgagtgaggttgggggaggttgaagggttccggccatgcatgccatgtgaaatcgccatttaccttcgtaagggttgtacaagcggctggtgtcctgtgcctggatatcgaatgcgttactcccggcagacgaggaggggagtgtgttgctcgacgcttcgacattaaagaggcttgggtcgttccctgctgcagcggtagcagcgtccaagctggaaacatgatccgcctcctcctggttccttcctcgaagcctgtccaggaaacccatgtctcagtgctcggccggggagggacctccgcccgaaggagttgctgccaggagagcgagcgtacagtcctcagctacacagcgcgggggcctggcgtgaccggcgtgtctgtgactttcatgaagctggtcagcgtgaatgcagccaagcgccatatgatgttcagcatcaagcgcggggttgggagaagcccagcgcgcgcctaaacccgcccttgcgaaagaaagaatgatgacccagacggaggaacttgcaaattcaatcccaatcaccagctgctcaagggctccaagcttctgtgatttatttataacgaggcgttcctttatctacccggggccaggaggaaataaaggaaccggagatggcatcaagctctgactcctgacagcactgtctgcgatcacattgctacattgtcaatgaacttgccagctccttgctccgtgtgtgctgtcccttctaaaagtccatctcagatcagacggatccatgtcacgttggagaatcctctcacttgaacaccaccttacatgaatgaaatgttggccaggcccatgcatgtgtcgaggctgggaacggcttgcacttgagcggcatcaaacacaacgaacatctgcaggggcacacctctgctcacactctcctcagcgcacgcccgaggctgcccactgctctcttccaccagctcactccgcgacgcaggtgccgttgtcgtccccgcacctctcctccgacagcgcaaacatctccccagccgacatggccagcgccgccgcggcctgcgccaccacctccctgtccagctccccgccctccaaccggttgcgccagcgccggtaccgcaccgccagcttgtcgtacgacaccggcgtctgccaggtgtcagcccctcgcagcatgcggtcctgctggccgcggaccagcaccaggtcctcgcccagcacctgcccggcgatgctgcgccagaaggcagcgatgccgggtacgaagcgcaaccacccagcaaagtccatgctcatgcggtacagcaggcgagtgtggccggggcggctgggcaggcagacgtggagctggtgcaggtggcgcttgcacgactccgcgctcagaccctggagtggtgagggggcaggggtgcttcttgggcgagggaatcgacgcgggacatggtcgcgcatgagggtgaggaaagagttgcctatcgatgagggaggggggataggagtcgagcgcatgcggcgtacttgcacggcaagccccagcccaacaccgaaaggagaggaggcgcgactcagcaaccccagcctccaaggccatcctccagctgcagtcgccccaacatcactcaccctttccaccacgcctgggcgcgataagccgatgagcgacaccaccatgtttggcggggcgaaggacatggtgatggggtagggctgccagttgcccgttagcagcttggtggcctggaacttgaccacgtctgggatctgggcacgtttgaaaataaattatagggatgaggagggggccacccactactctgatggctgcgaagagtgaggctgccggttgccaggcaccatgacccggcatggcacaagggtatgtgggttactatgcctcgtcaccggaccgctcacaccgaacaagttccattccccctaagatttggatgccacgagcgctactctccccccaccccccacctcaagaacaaagaggttccccagggccccgccgcctcaccggccaccccttggcaaaggtgctggtgtgggtgaagggggcatgcgccaggtccagcaggttctccagcagcaggccgtgctccaccggcacctccacctcgatctcagcatggcagcggaagcccagcggaacggccgaggcggtgggcggcggggtgggcgcctgcgacccgggccagacccacacgaagccgtccacctcagtgcacggcacgccacctggccagtgggtggaaagggaggcatcgtgaggtatcaagggggccaacgcctgcagctcacacagggctgtgaacctgcctggtgcctgtctgtaagccagccgtcccaaacttgcgaaacaaggaactgaacgacctctgtctcagaggtcacactcttcacgtaaagtggaagcgaggccgtgcactcctgcatgcctctactctcacctggactgcgcgatgtgcttgcagggttgccagcaggcacgcacgccacgtccccaccatcctggcggcgcagctcccacatctctccaaaaagttcaaacgaaagcgtagagtcctgcgtgacaaaggggcacgaaaggcacctcctcaatacatcaacaaggcatgctnnnnnnnnnngaaataaattatagggattaggagggggccacccactactttgatggctgcaaagagtgtggctgccggttgccaggcaccatgacccagcatggcacaagggtatgtgggttactacgcctcgtcactggaccgctcacaccggacgagttccatcccccctaagattcggatgccacgagcgctactcaccccccaccccccaccccaataaacaaagaggttccccagggccccgccacctcaccggccaccccttggcaaaggtgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctggccagtgggtggaaagggaggcatcatgaggtatcaaagtggtcaacgcctgcagctcacagggctatgtacctgcctggtgcctgtctgtaagccagtcgtaccaaacttgctaaacaagggactgaacgacctctgtctcagaggtcaactcttcacttgaattggaagcgaggccgtgcactcctgcatgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagctcaaacgaaagggtagcgccctgcgtgacaaaagggcacgaaagacacctcctcaatacatcaacaaggcatgcttccaaggcatgcagcccggccatactacggtacgatcgccgcgccgcagctgtgtccagcatccaacagcatcctcaccggctggagctggctgcaaaacgcgacgccataccagtgctccttcagccctggctccaggaacaggctggacttgaggccacgccgccgcttgacctgcggaggcggggctgccgcatggccacccatgggtggtgctgcatgcgaggaaggtcgggcgagtgcccgctcctcactcgtcaaaccaatggcggcggagctcgtaaaaggcagggcgatgggtggctctggccgtccaggtgttcccgctccgctgccctgcacttcacccaatccatgctggagcaggggtgtggcttggctcggctcgcccgcctcaaccaggttcccgccagctaccaggccctgcagagcctcggcctccaccctcaggcgctccatggcggccatgttcctggccagagcctcctgggtggcgtctaggcgcgcccgtgcgctcgcaacctccccctgcagctccaccatctggcgacgcagtgaggccacccccgcccgctcgcggtgctcttcgctgaggatgcgctgcacgcggctgttggcctcctcgatcacgctcagcgtgcacagcgcgtcgtccctgatcaccacgtcgtaaaccatctcccaggccagccgcctgcggcgcaggtagtccaggcgctggcggatggcggccgcgcgcgcgtcgtcgccgtgcatcagccgctcgttcatcacctgcggtgggcgcaagggaatgaggtgaaggaggggagagggatctggagcctgggatgccggtgtatgagggaaagcaagagatgggttggactttgacggatggtcagtgcagcccccctcctcgcccctccccctccgcagcccctaccgcgagatctgccagctgatcccgtgccctgtcgcgcgcctttcgcactcgcacgcgaggggccgtgtccacaatcgactgcagcaggtagggcttcccatatcgcgcaccgtatctgcatggcgaacgtcaagggctaagtaaggtggaggcgggtgaggcgcccgcgcatgcaaacggcatgggaaggccatgcagggtcctcacacagcgggcatcaccttcgtagctggttctcgggatcctggaactgctcatgctctgcagatgatgcgacgtagatcctcgttcggttgggcccgccgggaaggcgaccgggtgttgaacgtcgaggagaccatgtcacgcacgaaaacatgctgacactgaccatcaccgggctgcaccgaggagctcaacaaacactcgaaatagtaaaattgggtgtgattaagtctgcaagcagagacttctgacggtggttggcccagggtacagcaggcccaagcgcaggagaatcccatccgatttggattttccttgctcaggagggcgcgcgagcccttcaagctcccacactcgccgaggtggcctgcgggaagcccgagcaggggcgcaccagaggatcgcggtcgaagattggcggacgtttgccgggctagacctcggagcaggcctccaaagtcaaaagttttggcagtgcagctgccgagatcacttcctggccggctttaacaccatggaggggtcccgatcctacccatcacagcagcaggaaatcccaccaaatcgatgaaatcagtctaaaaaagagggagcaaatgctgctccgcgtggtgctgannnnnnnnnnggcagcaggaaatcccaccaaaccgatgaaatcagtctgaaatagcgggagcaaatgctgctccgcgtggtgctgagcgcatgtgagtcgtgtgctgctttttcattgctgcctgtggccaccttcctccccctcttcccccaccgacttccccacgcccgtccatgcagccctgggagggttcctgttcggctatgacctcggtctcatggtggggtagggatcggtccagggtgtacctgtggccgtcgtcatggacacgccccagccagcctcgccatacccaaaagccacatgcacggctacctggaccacagaccnnnnnnnnnntatggtggggcaggggtcggtctagggtgtacctgtggccgtcttcatggacaccccagccagcctcgccatacccaaaatccacatgcacggctacctggaccacagaccttcctgcccaccctttcacacgctctcccgccctgcctggcccaccccactgccccagggcggcgccatcctggccatccgggaggcgctgggcaccggcaccgccaccgaggagctgatcatggccggggccaagctgggcgcagtgttcggaaccttcctgggcggtgcggtgatgctgcactggggccggcgcgccgccctggcggcggacggcgtcttcttcgtcgtcgggcccctggccatggcgctgtcccccggcgtggccggcctcgtcgccggccgtgtggtggtcggcctgggcatcggcatgtcggccgtggcggtgccggcctacctgggcgagctggcccccgccgcccaccgaggggccacggtggaggtgtacgagctgctgctcaccgtcggcgccctcacggccgtggtggtggacgcggggttgcaccatgttccccacaactggcgatggatggtgggcgcacccctcggccccgccctggccctgggaggtgggtgggcagtggaagggaagaagactggagggggggggtagtagagggaggggatgatcgacattcggtgtgtgggcgcagccgcctacagcacaatttggagcggctcgtgcggcatggcacggggagcagcgcgatctccaccctgctccagcccggcagcgagtcctgaagctttcctcacttggtaagaacccaactcccccactcaatcccctggtccaggctgcgcgattctgctgccnnnnnnnnnngagactggagcgggggggtgggggggtaagggggaggggatgatcgacattcggtttgttggcgcagccgcctacagcacaatctcgagcggctcgtgcggcatggcatggggagcagcgcgatctccaccctgctccaacccggcagcgagtcctgaagcttcctcacttggtaaacacctacctcccccactcaattccctggtccaggctgcgcgattctgctgccagagtcaccccgctggctggtgatcaggggccggttggatgccgccctggccgtcatccacagaatcttcacgaagcaagcgctgacaccaggcacggggaggaggggacactcagcgcctgggcctggcaggcagtcagctgcagcaggcacagggcactgacatgcttgccggcgagcgtgatcaaccctcaatgggatgctcgtgatcgcatgcaccctaaccctcgtggctgcaggcctgcagacctccacggccgaggtnnnnnnnnnngacactcagcgcctgggcctgacaggcagtcagctgcagcaagcacagggcactgacatgctggccggcgcgcgtgataaaccctcaatgggatgctcatgattgcatgcaccctaaccctcgtggttgcaggcctgcagacctccacggccgaggtggaggcggagctcatggcgctttggtccgccgtcgagaaggaaaggacggaggtgacggcgcggcgggagcggcacgctgccgctcgcgagacgcgggccgcccccattgcacaggtgggtacctggctgggctgcaagtccctgcttcacagacacttggcagcgcaggctgtatgttccagcgcgcctggtcatagccttgaggtttatgatacccacaagtgtgaccagatgccactgccgggaagcaatgccctttctcaaccggccaccccccaaactggcattccctaccattaatgtgatgctctgcaccatgtgactaatccnnnnnnnnnnccacagacactcggcagcgcaggctgtatggcccagcgcgcctggtcatagccttgaggttaatgataccgacaagtgtgaccagatgccactgccgggaagcaatgccctttctcaaccggccaccctccaaactggcgttctctgccattgatgtgatgctctgcaccatgtgactaatcccccagttcatactcaggtcgatgtcgaggcggaggccggctcttcgcccagccactccaagtggctgccgctgcagggggctgacccggcagaggtggatctgggccacaccaagctcctgcaggagggccaagagagcagcagcttcgtgtctccgacggaggacctgcggtgcgagcaggctgccctcaaccccagtaccgccatcgaggtggacgagggcagcctggtggtcgacgcagacgggcagccgccgggcttcctacgcgtctctgccgacatgtttctggatgtgtggctcctgcccaggtcgggtcaggggcgtggggaggagaggggggaatgccagggctgggcgcctgccacccctcacggccgcactccagcatgccccgtgccgcacactgccagggcgctgccagtgcaaccccaagcagcccaaggnnnnnnnnnnttgggccacgccacgctcctgcaggagggccaggagagcagcagcttcgtgtctccgacagaggacctgcggcgcgagcaggctgccctcaaccccagcaccgccatcgaggtggccgagggcagcctggtggtcgacgcagacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgccgcactccagcatgtcctgtgccgcacactgccagggtgctgccagtgcaaccccaagcagcccaaggctttaatgcgatactctggagcagcactgcactccacctttccctccttcccaacaccttcccatcaccgacaggggcccagaccgccgcgccttccacctcgcgctgtgcctcgccttcttcaaccaggccgtggcgtccaccgccatcatcaactacgcgccctccctgctcgccagcgcgggcctggcacccgcccgcgccaccctcgcctcggccgccgtgtcggcgtgcaagctggtgggtgtggtggtgggcctggtgctggtggaccgggccggccggcgccggctgctgctcacgggctccgtgctgtgcacgctgtcgctcgcctggctggcggtggcggacgcggtcggcagcgtcggactgctgctggcgggcatgtgcctcttcgtgctcagccacaggtgagggcgagggaaaagggcgagcgtggattttccgtaccgggatgtggttggggtggagggttacctgcctgaagacgccacaggttatcgcactcgccaccggaatgtttatgatgccccacctctccctctccacaccacccttcagtgcttcctgggcgggagtcttctgggtgctcctatccgaactcttctccatggcggccaagagcccggcgacgtcggccgccaccgccaccctctttgcgactggggccgccagcgacgcgctcttcctctccttgcgtgactggctggggccgggtgcctttgcaatgtacgcctgcatcgcggcggctgggggggtgtatgtcatggccaaggtgcctgagacatccggcaagaccttggaggagatccaggcgctgctggcggggggccggcgcgacctggagctcaccgctgggtctggctgacacaagaacctcagggtatgtagatgccactcatcgagacaaagatactccacccactcgcgctgcctgccagcattgcagttcgtctgacaattggacactacagcacccatcnnnnnnnnnngctccacccactcgcgctgcctgcctgccaggattgcagcttgtctgacaattggacactacagcacccatcgggtaaggaccatccctgctggcccaccctcccctgctgaattccacaagttccatcccctggcactggacctcttgtctcaatacctctgtaccgatcaatgctgtaccccatttccctccccctcctcatggtgcacattgcaagttttgatgaagcaggtcnnnnnnnnnnttcccctactgaattccacaagttccaacccctggcactggacctcttgtctcaatacctttgtaccgatcaatgctgtaccccatttccttcccccccctcatgatgcacattgcaagttttgatgaagcaggtccataagcgggtcgtgtagagtggtgtcatgcaagcaggggtttctggaaggatcagcattggttctggccagtcttggtatatgtcaacatcgacgtgcaatgttggagaatggtgagtccgggtctcagcgcctgtcacaccaggacggggctggcggcatgggcgggcgagaccgatgtggtctgcagggacccccccggcgtcgtcccggtggatccggtggcaggtgggggcggcggcgggctggccaccccctcacccgccagggtcgtgctggtgggcgaggacggcgagggggaggcactgccgtttgaggcggagcacagggaggagcacaaggaccctgcctgcacgctgctcagcccttccacatcaacgtcctcgtcggccagagagatttgcaggccctacgtgtcgtgcgtgcgtgtgggagggggagcgtgaccggctgaatcatcttaaatctgggcaatggtagtcggtctctgaccgctgcatgctccttcaccatcctgctttcttgctatcgaaaacgggaaacatgcctgcatcacacacccaccggcccttgtagtcaacgaacccccaaacacccacacagatgctgcccaccccccttcccggaccccttttcagaatctcacagtggggcactggatgaagccctcgnnnnnnnnnntggcccttgtagtaaacgaacccctaacacccacacagatgctgcccccccctcccggaccccttttcagaaactcacagtggggcactggatgaagccctcgccggcgctgctctggccaaagccgcagccgttgtaccagtaggtggggctgggggcgcaggtccaccactggaggggggcgcaggacagcttcacgcaggcctccccgcaggtggtccccacgctggtgtccagacccacgcccagcgcgcccgccaccgcgccgcccaccagcagggccgcggcaagggcaacggccacgacgcggagccaggagctgttgtgcttggacatcacctggggaggtaatttcatttgaggggttgtcaacccgagtttgcacacccgttgcagcacatggnnnnnnnnnnctttatttttgggggttgtcaatccgagtttgcacacccgttgcagcacatggtgttgcatccccccgccctattgggcggccaactattgacctcgtcccgctcccgctcaccaaacccatgcccaccgtctggaggcccaggatgacgccggcgagcgtcgcccccgccgcaaaagccgccgcaaggtaccagaagctctgcatggggaggacgctcagtgtgcccagcacgcccgtcacgatgaataggactaggtaggagacggcgtgcagctggtagcgcgagaaattgaccgactgctccacccacatggcggctgtgtgtgagatggagagggggagtgtgggtacatgggcagggttgggcgtggttgacagggacgactatggggtactgcacgacaggnnnnnnnnnntgggggagtgtgggtatatgggcagggttgaacgtggttgagagggacgactatggggtactgcacgacaggtcaagatccccgtccaccgacgtcaaacaggcattcctttcttgtcctggcggaggcagtccacgtcaccccttgcctccccataggccaagggatatgcgacttgcagcgattcccccaacacacatgaccaatgcgaagaattctccccccccatcgcgcgcccctttcctatcaccactccaccccccccttccacacaccaagcagggcagcgaccccggccgaggcgccgctggacacgtagtagacgttcaggttggcatccgtcaccgccccgcaccaggaccccaccaggaagatggcggggatggttacggggggcagcggcagcgtccgctccaggtaccgcacaaaggtggagagcagcatgacgtttggcaccagctggatgatgcctgcgggtgggtgtgtatggggtggagggtggtgtgcatgtgtgatgggttgccggggaccccccccccccacccacccccccccccccnnnnnnnnnntgccggcacaaagggggaggtgagaacacgccagccctggccacgcgaggccacgtagnnnnnnnnnncgccggcacaaagggggaggtgagaacgcgccagccctggccacgcgaggccacgtagccgtgagactgcgcgccgactgccagcagggcgcgagggttggcccccgcccaggggttgaccgctaggtcagccaggctccagcccgcctgccagacggagaggatgtagagcgtgatccacaccgacaccagcagcaccacctggcaggtgaccacggcgcggcccagcgggccgtgccgccgcgccggcagcgggtcgaagaagggcgcgctgggctcgcgcggcgcgggcatggggatcagcgccacgccgccgccctggctctgcgcgctggcgtacgggtcagaggctggcggggcggcggagtaggaggaaagcagggccgggttggggcctgggccggccagcgagcgcagcgacccgtgcgacccggcgatggagagctgggaggcagtgaccgcccgcgacccggccgcggcggcggccgcggc

SEQ ID NO: 46978 - DNA, 61 bp, Chlorella protothecoides
tgcgctcaaggcgcaggccgccagcctgaaggccagcgaggccctgctgctgaggaccgtg

SEQ ID NO: 46979 - DNA, 61 bp, Chlorella protothecoides
gtcgcttcgctgtgcgctgtggctggtgggcgcatggcttgatctcaaaacgattcctttt

SEQ ID NO: 46980 - DNA, 107 bp, Chlorella protothecoides
ccctgtggaggaggaagatcgtgggtgagagccggagatcgggatcgggtgcatgctgcgcgaggcaaccgtcagcccgtcccacgagccgagcggccgacatgggg

SEQ ID NO: 46981 - DNA, 61 bp, Chlorella protothecoides
ctcgaggggcatggtcagcggcatcaccccaccgtccacaagggcatccgtcatggtgccg

SEQ ID NO: 46982 - DNA, 61 bp, Chlorella protothecoides
gaccctgggatgcagtcaggacgacgacggttcctccggcggcactgtggcccagggcggc

SEQ ID NO: 46983 - DNA, 61 bp, Chlorella protothecoides
gctgccctactttggctacgcgcgcgcggaccgcaagactgcggggcgcgaatccatcgcc

SEQ ID NO: 46984 - DNA, 66 bp, Chlorella protothecoides
gcgccggccgcacgccgccggcgctgacatgttttgacccctgcgcagaagaatgcttctcgaagg

SEQ ID NO: 46985 - DNA, 66 bp, Chlorella protothecoides
cccccccccccccccccccctccttggttcccctttaaaacaccatctcacagatcgtgttccagc

SEQ ID NO: 46986 - DNA, 76 bp, Chlorella protothecoides
gggtactccagatataataagcacttccaaaggttattaacatcctctccgcgtaccgaatgcgttgcgcccgggt

SEQ ID NO: 46987 - DNA, 61 bp, Chlorella protothecoides
acactctgctatctacagaagaatggcagggctgtaacacaatctgtatttcaacatttcc

SEQ ID NO: 46988 - DNA, 61 bp, Chlorella protothecoides
aatcgggacttcaagtcagtggctcgctgggaacattgcatcccatgtcctaagcataaca

SEQ ID NO: 46989 - DNA, 61 bp, Chlorella protothecoides
agagggctgccgcagcctggtggccgcggttgggggctggggcctccagggctgctgggag

SEQ ID NO: 46990 - DNA, 62 bp, Chlorella protothecoides
cgacacctcatcttgcaaacccacccttgtgttgtctaaactactatgcggctggcctgggg

SEQ ID NO: 46991 - DNA, 61 bp, Chlorella protothecoides
gcctcattccgagagaaggaggccgatgatcgcatgcaaattccgtcgagcaccccaatcg

SEQ ID NO: 46992 - DNA, 78 bp, Chlorella protothecoides
ccctgcacgggtctggcgcagggcaagggcatggggccagcgggaggggctgagcctgccccgtggcgagccagcgcc

SEQ ID NO: 46993 - DNA, 77 bp, Chlorella protothecoides
caagccaccctccatcacctctgcctcttggaggctggcccaaggtccaggtcgtcatcaaagcctgggctgagcaa

SEQ ID NO: 46994 - DNA, 62 bp, Chlorella protothecoides
atgtgggactacagtggggcaccaaggtgccagtgattggcaccatggtgctggtgattggc

SEQ ID NO: 46995 - DNA, 77 bp, Chlorella protothecoides
atctggaaagaatgctcggcgagccgagccaagccgagccgagcctcgccgcccgccccgcggcactcaccgccagg

SEQ ID NO: 46996 - DNA, 2324 bp, Chlorella protothecoides
  modified_base (102)..(131): a, c, t, g, unknown or other
  modified_base (285)..(294): a, c, t, g, unknown or other
  modified_base (466)..(475): a, c, t, g, unknown or other
  modified_base (722)..(731): a, c, t, g, unknown or other
  modified_base (1139)..(1148): a, c, t, g, unknown or other
  modified_base (1209)..(1288): a, c, t, g, unknown or other
  modified_base (1684)..(1693): a, c, t, g, unknown or other
  modified_base (1773)..(1782): a, c, t, g, unknown or other
  modified_base (1877)..(1886): a, c, t, g, unknown or other
ccagcctgccctccagcctcggcggcagcgcgcccggcgcggtggacggcccgcatgggcaccgtggcggcgtggcagacgccggcgcccggaccagggagnnnnnnnnnnnnnnnnnnnnnnnnnnnnnncttcccgcggtggcggaggggtcgcgcgagggcggcgcgcgcaccgcctccaccagcctgccctccagcctcggcggcagcgtgcccggcgcggtctacggcccgcatggggaccgtggcggtgtggcagacgccggcgcccggaccagggagnnnnnnnnnntacccagtgaggcagggcgacggggttgggtagccagcctcagggtcggggcgacggctaactgcgtggcgacacccgatgcgagagcagcctccctgcggtccgccgttcctactctcctccacccatgtcccttggcctgggcaggacgctgcgggatgtgctggatgcnnnnnnnnnntggtgggaggccagcacggcgtctgagggcacggagctcgcgccggggtcgcccgggtcctcctgggcggggcctgtggcggcgggcggcgtgccccagaccctctacatccagatggagtactgcaccaggtgggtgcagacggggaatgagagggacccagtgaggcagggcaatggggttgggtagccagcctcggggtcagggcgatggctgactgcgtggcgacacccgatgcgagagcagnnnnnnnnnngccgccgttcgtactctcatccacccatgtcccttggcccgggcaggacgctgcgggatgtgctggatgcggggccactggaggacgccgatcgctggctggtgctgcgccagattctggcggggctggcccacatccacgaccaggtgagtgcgggctgctggtagtgctgagcccctgcgattcaaggggtctgatgggacgaggatcgtccaaggaaccagatggagtgaggcctgttctaacccaaccggtatgccaaacctgcagccccacccaaacctgaaatgggatccaccacactgtcctcccagagaagccagcagtgctcagtcgcagccgcccaattttacaggctccccccccccctcctactaatagggcatcatccaccgcgacctcaagccnnnnnnnnnntcggtgtgccaagcctgcagccccacccagacctgaaatgggatccaccacactgtcctcnnnnnnnnnnnnnnnnnnnnnnnnnnnnnnnnnnnnnnnnnnnnnnnnnnnnnnnnnnnnnnnnnnnnnnnnnnnnnnnncgccaacatcttctacgacgccaagggcgagatcaagctgggcgactttgggctggccaagctggcgggctccgacccgggggctgagccgctggaagggccgccgggcgccgcggccgggccggcgcccggcagcctgggcaagatggaggcggcagagcacacgacccaggtcggcacctcctactacatcaggtgtgcgacttgagggatgggggagcggggcagttgacgtgggagggtgcagtgcttggaaacagcgggcgacctttatgttcccaatttcaatcctcggcgtgccacccaaactggcattctgtaccggtcaccttcctcccatgccccgcccctccctccttccctctgccccttgcttcctgtgccatccttcttccnnnnnnnnnntgggcgaccttgatgttcccaatttaatcctcggcgtgccacccaaaccggcattctgtaccggtcaccttcctcccatnnnnnnnnnnacccagcatccgattcccccaccccccacgccttgaccaaacaacccacagcccggagatcgcggacgggtgggcgagctacgacgagcgcgtgnnnnnnnnnntcccagtatccaatttcccgaccccccacgccttgaccaaacaactcacagcccggagatcgcagacgggtgggcgagctacgacgagcgcgtggactcctactcggtgggcgtgatcgcctttgagctgtggcaccgcttcagcacgggcatggagcgcgcggtgctcctgcgcgacctgcgcgagcgcgacgtcatgcccgccgacttcgaggcctcccagcccgcggtgtgccgcctgatccgctggatgctggcgcgcagccctgcggagcgccccaccgcccgccaggtcctggcctctgagctgttgccgcccagcgtgggcgacgaggagctggcggacctgctgcgctcgctgccggataaccccgccgcacaccagcgagtcgtggacgccgtgttcgggctggcggcgggccagggcggcgcggcggc

SEQ ID NO: 46997 - DNA, 76 bp, Chlorella protothecoides
gcggtgcgtgggcagctccttgatgtcggtgtagtccttgaactccgggtcgtctgtgtggtggaagggtgcagag

SEQ ID NO: 46998 - DNA, 66 bp, Chlorella protothecoides
aaggcggacagggaatggctgggtaggtttagtactggtgccctgctgaggtacaggggtaggagc

SEQ ID NO: 46999 - DNA, 61 bp, Chlorella protothecoides
atgcacacacgcccacaggtccacggcaagcgagccagctgctcctgtcgagatcagctgc

SEQ ID NO: 47000 - DNA, 80 bp, Chlorella protothecoides
agggcaaacgacacccagtggggcagatgcaggggggggcctggccatataaccacctgcgatggtacgccttgacaaac

SEQ ID NO: 47001 - DNA, 89 bp, Chlorella protothecoides
cgaggccgccagtccattgcgacaccaggcctgggagggcaggggatgcgttccaaggcggcactggatgagttttgggggcaaaggta

SEQ ID NO: 47002 - DNA, 61 bp, Chlorella protothecoides
gccctccaacgaccgaagcggcggccgagggaggggagatcacttcgggtccttgaccgtc

SEQ ID NO: 47003 - DNA, 62 bp, Chlorella protothecoides
gccggcgtggtccagcagcgcccctggcataagtgggtgggtgggggttgcggtgagaaatc

SEQ ID NO: 47004 - DNA, 97 bp, Chlorella protothecoides
cgccagcgcggctcggcgcgcggcgcccagcccttcaagatggcctcttgccgggctgggcgcttcgccctggctctgagcagaccctcccgccggg

SEQ ID NO: 47005 - DNA, 123 bp, Chlorella protothecoides
gctgagggctgcattggtccaggggtccactcatcgcaggctgatctcctgcatcgctcacgctgccgggcccaggtccgcccgaatctccagttccctcctctcacacacacctggagggcg

SEQ ID NO: 47006 - DNA, 61 bp, Chlorella protothecoides
cctcacgagctcgtcgaagaagtccatgtcaaagataggggccatgatctccaccagattg

SEQ ID NO: 47007 - DNA, 68 bp, Chlorella protothecoides
gtactgctgctggccgccctggtactgctgaccaccgacggcgccgtactgctgctggccgccctggt

SEQ ID NO: 47008 - DNA, 68 bp, Chlorella protothecoides
ccaccattttccccctttctcccccccccccaccccccaatcacctggacaggatggggtcggtgagc

SEQ ID NO: 47009 - DNA, 66 bp, Chlorella protothecoides
tcccccaccacgaaagagcccacctcccccgaagcggagcccacctccagtgaagaagagccctcc

SEQ ID NO: 47010 - DNA, 61 bp, Chlorella protothecoides
gggtgtgcagggtggcgtgacaggcgcagcgcagctttgatgacctgtgctcgtccaccac

SEQ ID NO: 47011 - DNA, 218 bp, Chlorella protothecoides
gggcgaggggggcctgggcaggctcgtgcaggcacgctgtgcccagtgataccccaaagcgtgtgtcttgctggctccgacccctctggcgccccctctcatcgttcagcctgtttctgcaccccattggcattgtggttaacccccagattgtcccccagcacctcttacccccctgcactccattcccccaagccccaagcaacgccacacgctcc

SEQ ID NO: 47012 - DNA, 71 bp, Chlorella protothecoides
cgaacttggaccgcgtcagggtcagctgcaagtgcttggggcccgtggcgtcggcggtgatgaagggcagg

SEQ ID NO: 47013 - DNA, 61 bp, Chlorella protothecoides
ggggaggaggggaggtcgggaacggctggggtggtggagcgtcttggtgcgggaggggatc

SEQ ID NO: 47014 - DNA, 128 bp, Chlorella protothecoides
ggcgcagctgcctggagggcctggggacagtcagaatggggagggcggggggaggggggaagaggatgggcaggtggcgaaaatgaggcctcgacgtgccagtcccagtagcagccttggtattgaag

SEQ ID NO: 47015 - DNA, 72 bp, Chlorella protothecoides
gcgcccgggatcaggggcctcggcgatgacactgtgcgcctgtgcgctgcatctcgcgacgtgatcgcctct

SEQ ID NO: 47016 - DNA, 61 bp, Chlorella protothecoides
agattgacaaacctttggttcctgtggctgctctctgcaccggcgatgcggtgctctcctt

SEQ ID NO: 47017 - DNA, 61 bp, Chlorella protothecoides
atggagggaggccatgtgggggggacagggtgtgtgcatggtcagccgtcggcgattgacg

SEQ ID NO: 47018 - DNA, 89 bp, Chlorella protothecoides
gccctgtcctgcaccagtagctcagtgccctctcccaagagcctgctgggcgcagggcggcagcctgcgcaccggatgctcgcaagtcg

SEQ ID NO: 47019 - DNA, 61 bp, Chlorella protothecoides
acgcttgccactgccggccgccacccaccccagcgaccctgtccccatcagcagccatctt

SEQ ID NO: 47020 - DNA, 61 bp, Chlorella protothecoides
caaagggtcaatctggatgcgtgagatttgattgtaatactagaacattgtataccgtgcg

SEQ ID NO: 47021 - DNA, 61 bp, Chlorella protothecoides
gagcattacatcgccaagctctcaagtcccacctgccgttcaggaacttcctctcctcgca

SEQ ID NO: 47022 - DNA, 79 bp, Chlorella protothecoides
gatacttttgtcttgcagttgggacgggggggtgggtggactgggttgggttgacattcaggcataggcgtctctcgca

SEQ ID NO: 47023 - DNA, 61 bp, Chlorella protothecoides
cctcccagtactgcaaggggcggtgggaggggggggagagggcacggtcagggccggccac

SEQ ID NO: 47024 - DNA, 61 bp, Chlorella protothecoides
ggttgcctgaggttgcgatgtggcggcagggcgcgggctatatctcggtgatgccttgcat

SEQ ID NO: 47025 - DNA, 61 bp, Chlorella protothecoides
tgtcgaggctccagatcatcgagatggaaacaggaacatccatagctgttctgcatgcgcc

SEQ ID NO: 47026 - DNA, 92 bp, Chlorella protothecoides
ggcctgcatgggggcctcatgccagccctggcattgatgcgccactctggcaggggtcacgaggccctcccatacgggcccatcaccctgtt

SEQ ID NO: 47027 - DNA, 61 bp, Chlorella protothecoides
cggtatgcaagcagcctggcaaggcacgtgaccctgccgctgcccgccctgggccacccag

SEQ ID NO: 47028 - DNA, 74 bp, Chlorella protothecoides
cacattctttcaagaccagtccagggctgagtgtatgcaggaacataagcttgcgcttctgattttaaggctgt

SEQ ID NO: 47029 - DNA, 61 bp, Chlorella protothecoides
cctcctcatcgacattatggatacagtgggggagcaccctcatgcttggcctcgcccattc

SEQ ID NO: 47030 - DNA, 61 bp, Chlorella protothecoides
gctgctggcgctgctggggtgccgggcgggacgggaggcggcgctgctgccgggcgtggcg

SEQ ID NO: 47031 - DNA, 77 bp, Chlorella protothecoides
ggcacgctgggcgctcttgcgacgtagcgggtgacatgcgtcgaggctcagctccccgcaaccagcccaggggctgc

SEQ ID NO: 47032 - DNA, 62 bp, Chlorella protothecoides
atgatgcagcactccggatcacggctggtcggggcaccctgctctgagcccccacccagccg

SEQ ID NO: 47033 - DNA, 75 bp, Chlorella protothecoides
gcgccacgtctggatccctcgagcagaccggcctcacccaccctgccccgcctcatccacacctgcggcatacgg

SEQ ID NO: 47034 - DNA, 74 bp, Chlorella protothecoides
ggaagtgagcgggtatggggcgcgaggagacccctgcgagtcctgactgtgatgctgcgtgtgaccgcctctgg

SEQ ID NO: 47035 - DNA, 424 bp, Chlorella protothecoides
  modified_base (135)..(310): a, c, t, g, unknown or other
gtctgctgagaaggagcgtggaagagggcttcgtgtgtgtttggcggacatttgcacaccagccgacaggacgtgctacagtattgctgttgaaactccagacgcaagtgcattgctttggcctcttctccatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgagtatgtggggcatggcaggtgcttgctcagcaagattggaggtctgtgtctacaaggtcttcttgcagaatgaggggcacttcagtcctttgataaacccattcactcct

SEQ ID NO: 47036 - DNA, 75 bp, Chlorella protothecoides
ggcgatggtttgagatccaggtgcagcgggattggaaggggcgggccctgtttgctcctgagtggcatgtgcctg

SEQ ID NO: 47037 - DNA, 61 bp, Chlorella protothecoides
cttcgtgacgccatatgccgtatacggaggggacttgctaccaagctgacgtatagccggc

SEQ ID NO: 47038 - DNA, 68 bp, Chlorella protothecoides
tgaaatcggcggccacggcgcccaggtggatgcgcccatcgtatggcccgacggccagcgccatgacc

SEQ ID NO: 47039 - DNA, 61 bp, Chlorella protothecoides
cgactcctccccctcgctcccgaggtcctctgagtctccggcagactcggaatccgcctcg

SEQ ID NO: 47040 - DNA, 19643 bp, Chlorella protothecoides
  modified_base (381)..(390): a, c, t, g, unknown or other
  modified_base (1690)..(1699): a, c, t, g, unknown or other
  modified_base (1878)..(1887): a, c, t, g, unknown or other
  modified_base (1955)..(1964): a, c, t, g, unknown or other
  modified_base (2174)..(2183): a, c, t, g, unknown or other
  modified_base (2271)..(2280): a, c, t, g, unknown or other
  modified_base (4081)..(4090): a, c, t, g, unknown or other
  modified_base (4643)..(4652): a, c, t, g, unknown or other
  modified_base (4950)..(4959): a, c, t, g, unknown or other
  modified_base (5318)..(5327): a, c, t, g, unknown or other
  modified_base (6840)..(6849): a, c, t, g, unknown or other
  modified_base (8192)..(8201): a, c, t, g, unknown or other
  modified_base (10218)..(10227): a, c, t, g, unknown or other
  modified_base (12563)..(12572): a, c, t, g, unknown or other
  modified_base (12986)..(12995): a, c, t, g, unknown or other
  modified_base (13150)..(13159): a, c, t, g, unknown or other
  modified_base (16060)..(16069): a, c, t, g, unknown or other
  modified_base (16281)..(16290): a, c, t, g, unknown or other
  modified_base (16791)..(16800): a, c, t, g, unknown or other
  modified_base (18070)..(18079): a, c, t, g, unknown or other
  modified_base (18172)..(18181): a, c, t, g, unknown or other
  modified_base (18275)..(18284): a, c, t, g, unknown or other
tatggccccttcactaacgaggaactcatcagtgagcggggggcgctgaggcaaatgtatcaacacctggcatgtgcgattggagaaggacagcacccccccttcgaccaaccaatttccctccaccctaccccactcaggcagggccattgcaggcattccaaggcagaaggtcatcattgctaccaagtttgggttagttttggatgcgtcctataacatgagcgtcgatggcagccggaagcatgtcaggtgagtctgaaggaggctttgggaagggtcactgccttctcggtgctgcagcaaagcatcgggaccctgtgcccgcgattgctgcgcctaatcacgttgtaccttgcccctgccagggaggcatgtgannnnnnnnnntttctcggtgctgcagcaatgcatcgggaccctgtgcccgcgattgctgtgccaaatcacatcgtaccttgcccctgccagggaggcatgtgaagcatccctcaagcgactcggggtcaattacattgacctgtactacctgcaccgcaaggacccggcaacgcccatcgaggaaaccatggcagagttaaaggtgtgcctagcgatggtggggcctgggcgtggggatccatgccaccagattgccttgcacagcttcttgcgcacagactgactccgagctccgtgttgccgctccctagctactggtggaggagggaaagatccgccacatcggcgtgagcgagcttactgccagcgatcttcgcaaggcgcatgccattcatcccctcacggccctccaactggaatggagccttttcacccgggacgcagaggttcgtgtggagagagaaggagattgaccgacatattgtcgccagggtcactcataaaagatctttcgtgtgtttagattgtggcaatgcttggcatgccacagctgattggctgcaacgcgcaggattggctgcttatcatgcacaagtcttgatcagttcattgcacggctcgcacaggatgaaatcatccctctctgccgcgagctgggcatcggcatcgttgcatgtgggtgcagggattggatgaggagggcaggaggctcgtgccagcatctgctgcagtgcatctagcctctgggggtgcagtgcgcagttgctcgcccactcgaccatctggaattcatcagcagtagactccctggctcaaaggttgcaggggttggcttaccaccctcattccactgccacagactcccccttgggccgcggcgtgttgtcggggcagatcaagagcatcgacgacctgggcgaagatgactggcggcgaacgcagcctcgcttccaggctggggcctttgagaaggtgggcgggggggtcggcgagcacggaccgcctgtgatgctgggctgagtagcagagtgtggcgcctacattatcatagagcccgatcgcttatcccacacctccattcgccctttccagaacctggaactggtcaagcaggttcatgagcgtgcagccgccaagggcctcacgccgggtaagggcaggagggacgcctggtccagtgcttgaatgtgtctggctgtcacgggcagctacctgtgcatgatcgcaggttgctggtcttcagcaccttgctccccctaatcatgtgtctccgctctaccccgtcaggccagcttgcgctcgcctggcnnnnnnnnnnttgccaagggcctcacgccgggtacgggcaggagggacgcctggtccagtgcttaaatgtgtctggctgtcactggcatccacttgtgcatgatctcaggttgctggtcttcagcagcttgctcccccaactatgtatctccgctctgccccgtcaggccagcttgcgctcgcctggcnnnnnnnnnntgtgggggagaggtacgacccggtcctcatgcaggtacgcggcgacggcagcaagccagtgggttggnnnnnnnnnntgctggcccagggggaggatgtggtgcccatcccggggacaaagcggctacagtatctcgaggagaacctggctgccaacgaggtccggctgagcccccaggagctgaaggagctcactgagctggcggatgccgcgcaggtcgtgggggagaggtacgaccccatcctcatgcaggtgcgcggcgacggcagcaagccagtgggttggnnnnnnnnnnaacggagtgatcaaatggaggtgactgggttgatgtgggagcatgggcggtgagtgtgtccttcaggcactggagacactgctgactnnnnnnnnnngacggagtgatcgtatggaggtgtctggattgatgtgggagcatgggcggtgagtgagtccttcaggcactggagacactgctgactgtgaagaacatctccagcatgcactgaaacaatcctccaacaacgtgctccctgcagagctcattcaatggttgaaggacctgctggaagtgatatcggtacagaaccccaagggcaccaggaagaacctggaaagtgctgcgagcttcagtttggaggctttgaccaaagctctcccctgtgatgtgttgcaatatcaaggctggattccaaattcttgtgaccatgaagcttcggcgtcaaagtatgtgtagattccctggacacatatttattcggtttcacccgtggagcagctggcgaaggtgccccggtcaccacaatttggggtccactcacgtcatcctgcgaccagagctaagcgaacatcgttgccattgtgcctgacagatgcttcacaaatatttgtttcaacacacaattgtttttaggagcaggcgagcgccactgcaatcgcctgagagcccacccccaaaatgtcgacccaaaagcgaagcctcggaacccaaggcttggcagtgtcaccattaggcttcggatgcatgggtgagaggggtgcagcacgctcatgacttgtagggattgaagaacaatgaaagcctgcgagatctggtttgccatggatccggcgtttggtctggagatcgcagggatgtcatggggctaccacaactccggccctcccgctgggaccgaggaggactacatcaatgtaagaccaggaaggccaggctctaggtagcattggttccatcttgaactgtgcagatactgtacacatgttcaagtggcctgaagacctcttaccctgactgcgaggcaggtgatccacaaggccattgaatcaggatgcatgctggacaccagcgacatctatggccccttcaccaacgaagagctcgtgggtgcgtggatgcttcatgcatgatggcggaagaattcagtagtcccttgtcagatatcaatttgcctcgatttctctgcaattcctcgcacatgcctcgtcctcgcagggaaagcaattgccactataccccgagagaaggtgacccttgccacaaagtttgccctttactacaaagaggatggttccatggctgtagatggcagcaggaagcatgtcaggtgaactgagtacgatacagttggtcatttaggagaaggtttatggattgcgaatgaagggacctacaccatgcgacacgccgtggcattcccactcgggcccgcagtgtcccatccattctctgatgccgcagggaagcctgtgaagcgtccctgaagcgacttggggtcgactacatcgacctgtactacatgcaccggaaagaccctggtgtgcccatcgaggatacaatggcagagctcaaagtgcgggcaggacgggggagtgggcagcattgcacgattcttatcatagaccaacgctccccatgaacacagacgtgtcacatccatagtcactggtctctgtcctgcccttccccctctcccagctgctggtggatgagggcaagatcaagtacattggcgtcagcgagaccagcccggaggacattcgcagggcacatgctgtccacccgctctcggctgtgcagctggagtggagcctgtggacgcgggagtccgaggtgaattcgaagtggaggcaatggagatggggtgtctgagcgtactggcctgaatcctgtgacacagggggcaagttgggagnnnnnnnnnnagcaatggagataagatgtgtgagcgtactggcctaaatcctgtgacacagggggcaagttgggaggttggggcctcatcgtcatgagagggagctcctacattgtaatggcatccttgcccagcacgaacccttgcacaatggttcaggaggacatcattcccttgtgccgagagctgggcataggcattgttgcatgtgagtggagaggaaggattgtcatccaggataacccaggcgctgtggcatggcatcttgggatgtgcggcgcctgctgtgccagtcactcgtagaagccagatctccagacatgtgtgatctttacaatccgtcacttactcgtattctccacaccatctccctcagactccccgctgggtcgtggcttcctgacggggcagctgaagccagaggatctcgacagcaaggattccaggaagtccttcccccgcttccaggaagcagcatttgaacaggtgaggaacattgatgcgctacttacacctgggaggaatactatatgtcgaggttcaagcgcatggtgctcactctnnnnnnnnnngtgcgctacttgcacctgggaggaattctatacgtcgaggttcaagcgcatggtgctcactctgttccttgacgtgtcactctgcagaacatgaaactggtggaagctgtgaagaagctggcagattcaaaggatgccacagcaggtgagggagggagagttggcgcattggtggcaagtgctctacccaatggaattgcttgtgctccaccaagaaggtgtcacgggccaatcttttgcgtagctcaccgtccctgtgcctcgcgctgtgcaggccagctggcgctcgcctgggttnnnnnnnnnnaatttgcatagctcaccgtccctgtgcctcgcgttgtgcaggccagctggcgctcgcctgggttctggctcagggagatgatgtggtgcccatcccggggacaaagcgcgtcaagtacttggaggagaacctgggggcgttggacgtcaccctgactgcagaggatctggccgagctggcacgcattgccgacccctccaatgtcacaggggcacgctacagcgaggcggcaatgaaggcgagtctggctcttgttcttgtttgtttgagcagaggccatccggggggccaactggtgcaaggtctttcaaggtatttgacgtcggcaatcagccgattcggatcctcctatttccaannnnnnnnnnatttgagcagaggccatcggggggggcaactggtgcaaggtctttcaagttatttgacgtcggcgatcagccgattcggatcctcctatttccaaaccacctttcacctcacagatggcttactccagaaagtgagcgtgcagcgcacgtatagtaatggcagagtccaagcctagacccttgttgggcccgttgtgtgtcctgagtcccgtgggaattgttgaaggagcagaacgaatatcttgtggcattacatgctgtaagtattacagtggaactgaaaggaaggtggaccccactatgcagtactcaggagagccattatacatccacagatcctaatacaatcaacgcagaaattattctaccgcctcagaacctggtgcagagtgttctcgctacaggtaagtatctacaatctcggcatgacatgctgtcaatcggagtggaatgtcgagcgttggggagcttgaaatgaccgcaaggggtgccccccaggtcctcattgtcacgacacactcgggaccactgcactcaataaaaaattcatcctccagaaataaaactcaagtattaaagaagaatcccgccaactgcgagctttcccgcatggccgctcgatcctcggtctctagactggtcagtggtctacgacatgggttgcatgatcacgcttctaaagccttgcgatccgctaccttcattgactgcaaaatattgcatgcatccggacatgcaggcctgtgctgtgtcgcggcgcatgcaatcgaccgcggccgtgacgcggctcaatcacctggccattgccgttcccgacgtccgggcagccgctgctcagtatcaagccgtgctgggggccagggtcagcgagccccaggccctgcctgaacacggcgtgaccgtggtctttgtgcagctggaaaacaccaagctggaacttctggagcctcttggggaggcctcccctgtggccaagtttctggaaaagaaccctgctgggggcatgcatcacatgtgccttgaagtttgcaatgtcaaggtggggtagagtctttcgttctggttgatactgggtgcagggcgtgggccccgttgtcatgctgggttgcgcagcgctggccactgtctgagtggcccccctctccctcgctggcaggcgagcatggcggccgtctccgagcgggtacgcctgctcagctcagagcccaagatcggcgcacacggtaatcccgtcgtcttcatgcaccccaaggacatggcgggggtcctcaccgagctggaggaggtgccgcggagctgaacggcgaccggcagacgactgagggttgcatctgcccggcccacaagtgggtttgcactgcgtcgctggcccgcacctggctttcccgtcaaactcaacctcagacccactttgtaagacatgaaaggttgcatcccatgtggcattgccgtcagtaatatggtcgaggggtgtcatggggaatgaggagcgtcaggaggccagggggctcgnnnnnnnnnnaggagctgaacggccaccgccagacgactgacggttgcatctgcccggcccacaggtgggtttgcactgcgtcgccggcccgcacctggctttcctgtcaaactcaacctcagacctactttgcaagacatggaaggttgcatcccatgtggcattgccgtcggtaatatggtcgaggggtgccatgggggatgaggagcgtcaggaggccagggggctcgctactgggccgtcaggcgggtgtcggtgatgcagtacctccgggctccgtctgcccggacgaaggcttgcagattcatcaccgaccacaccccgcactccctggaagaggaatggattggaggccgtgggggcgggagggcgtgcaagggcaagggatttgcttcattgccctgcagcccctccgcctgatcttgaatggtccacacccatgcacgaagcttcgccccagccaatttcacccctaagaacccccgctcctcgctcctctcctccctctcccccgacttgcacgtacgtggtgctgcaagccccagtcaggcgatccaggaggggggtgaggtcgctccccagctgggaaggggccgcgggctggccggggctggcgggcgcctcgcacaggcgcggcgagccgaaaagaaagagcagcgcgtcggagccggccagcgtcgcctccagcgtccccgtcccgtcgcgcaggaggagccgcagggcgggagctggaaagcgcggcatggaagggagggttccttgagagcagcgtggactgccggcaggcgcgggtggcacggtcagccgcccttccggcggtgacatgcagcaattcacgcagccgacaggggcgcatgctgcagctcccctgcgccccccggtgcaagctgcatgcaggctctgccgcgccgctggcgagcaccttgccccacgacactggaccctcgggtgccccactcaccgagaccctcctcctcggtgccccgctgccacatggcggtgggctcccgcgggcagaactccaccacctgcgccctgacccggtagcgcgcgggggcgggcccgacacgcagcgtgcgcagcgtgtccaggggccgttccgcgtccacgggcgtcgcgaccaccggcgcccccaggctccagtctgcgcagggtttggcttggtgcggggtctgggcatcgcgcgggcggggaccgtcgagcgagccacgcagcttccagctggcgcaggcgggagccgcctcgcctgtgcctgccaccgctgcacacccacaccccagcttgggccacgccctgccatcgccatccaccccaccaagccccaccccgtcgcgcctgcgacggcgttggcnnnnnnnnnncgggccacgccctgccctggccatccaccccgccaagctccaccccgtcgcgcctgcgacggcgttggcggccacgcgggtgtgcagggcaggcaggatgacggcctgtgcgtcccgtcgcggtgcccacttgctgcggccagtgacaaagccctggagctggccgtccacgacgcgggcacccacattgcgcagattgacccaggagcccacggaggggtagggcagggcggtggcgccggggccggcgggggcgcgggggaagatgactggcagggccgtgccgacgcacgggaagcaggcctccacctgtttgatcggggagcgcgggcagggagcatggcagcggggcacagcccccatgttcaggggagggggaccagggcgtcacatgctctgtccgtgccatgcagggcagccacgcgagcccacgatccggtatgattgccggcgtggcacatcccaggccaggttcgtgttccatcgccgaccccgacacacctccctttgcggccagtatgtctggcggggggatcggtcctcccccgtctcaaactccgtggcgtagtgcctgagcgtacaggttcgaggatgctgggtctgggtgaccagacgggcagccaggacaggcaggggaccttggagggtcgcagcctgccggcacctgcagaggctgtgcaggccctcccgccctgtgcctctgctgacaggctctcagagcatcccctgctcctggatgcagacgccccccgcccaaaacaagaggtcctcacctgggtggaaagggcatcgcatccgtgctgtcccagacgtacacgatgtccgcgccggtggcggcgtcgccctgaggagccactgcaagaatctggttgccggcatgtgcatcgagtgggagttgggggatgtgggtgggcgtaccagggcacatgggggggcaccagcggagcgaatcggcgcctggtggccatgagtgcctggcatcggccatgcaacgaggactgaacgacgtgcagtgcaccctctgctcactccagggtccaaccatctcctcctcccactacccccccaccacaccgcaccaggcagacgaggtcgaagaactcgccggggcggatgtcccggatgatgcgggagtactccgtcttggagacggtgtgagtgtccacccgcgccctccattgccgcagctcctccacgatgggctgctccgcctcggacagcgaggggttggtgtgcgaagactggtatggctggtacgatgccttggcgggggtaaaagtgggcggggaaggggtgggcggggcggagggagagtggggccgctgccattcggatgggaggggtgctgctgcgagccagaagcaagcgccggccagggtgggaacccacactacgtcgtcacgacaaaggctcagaaccccttgtcccatccccagtcaagcaggcctcaccctctccctgccgctgaagaggcagaacgagcagggggtccgggaggggccgccccccgtcaggctcccagcccgcccgctcagactcagccgccccgcaaacagttctgcctgcgggtcgcgaggagcaaggggaggtgatggcacgggccagggctcgcagagctttgcagtccgcacgcgctcatcaggacgcaggcgtggtgtgagatgccgctgtgcgccggccccctgctctcactcccaccccaagcacatgtggcaccttgactctgtgcagtctcaggatgtccccaggcttgtcaaggcacggtcctgggtttcccggggggatgaagcacctgaactccacaccatgctgcagctctgggttctcggcgcatgaggggtcgatcaccttcaggctgcagtaccgatctgttgggatacaggtctggtgggtgttgttgctggaacatttccatgcaggccagtcaaaaggaaggagatgtagcggcccaaatagggtccgcacatgtggtcacgacacgcttcgttcgtttcccaatccagcgtgcctgtacccnnnnnnnnnnagagatgcagcggcccaaataggggccgcacatgtggtcacgacacgcttccttcgtttcccaatccagcgtgcctgtacccccgcgacactggtgaacggtgctgcactccagggcgacgaggtagatgttgggataatactgtctgggcctgaatgcgcctgacgactgggacacctggcgctcctccaggtggccaacgatctcattcagggtcgtgtactcgtaggttggcgcacgagccagggcatccatgcctgtgacaccgcgattcagatcgtgggcatgtaacgtgtgcaccttgggtggggccgtgaacacgaaataagtcggcgatacgataaaaaaattgatcctgtacctgtggaagcaagcttgtatttgtatctagtgtgcgcgcgcatttgcgggcactttctgggagatctctttttgaaaatgttgggggtgcacacggcaaatctacacggccggcaacagcttgcaaaaattcacttctcgtcaatgctagcccagggtagcattgatgagagagccacggttcttacaacactatacaggagtggggcacactgccaaacacacacaagcaagccgtcttcattttagccacgcagattgggcggctatcgggacgaaaccacatccttgatggcggatgcaagaatgagcgtcagacttatcatgacgactatcgcgacggacaggggccccaccttctcatcgaagaagccaatctgcattgcaaagagtggcaaagaaatgaaaggagtgaggtctaacaggcgcagaggtacagcgctcatgttaaactgtcaatactgggcctcaacacacgatgcaaatgccaaccaagtgctcctcaacccttactctccacgtcaagctcaagaaggcgccccaacacccgcaaaactcacccgtttcttccggatgttctcgctgcggctgtagaagatgaagagggcgtacgcaatcatgcccacggagatggggaggaggagcatgctgatgagctccacggtgcgggggctgatggagctcttgcgccccgaggcatccccatcctccactgaaaagccagcgatggcagtggccacggtgcccagcgtggtggccatgctcagccaagccaggaacgtcctttcatttgctgcaaaggagcgggcggggaggggtgaggggccggggtggaaagggttgcagctgtacggtccacgccagccccctcagcacgcaccaaagtaggtcttgggctcgatgcgaagagggattttacgtggcagctggtacagcgcgccttccgtgtgccctagggtcccgaacaactggtcggtgacggcggaagatgacgccatggccaggggtcggggacaaccctgggctccggctgagtctcggtgcctgcaaccctgccgctccgcacctcgaaacttgccaaagatatgtaatggaccgagttgcgtacgtatcgagctggctgcaggtacttgcacaagggctcgctctgcccccagcaaagatgccctgtgcaagtggccttgagattcctcctgcacgcgcgcgcgcaaacttcttgggtgcggaccccatccgaaaccagcacaacgcatgcatggcgatagtcgcctctgcgaccaataatgcaagaagatgatctaagcctgacatttagataagattcacaaatagactcatggtgacctgatcagcatggtcatttcagggctctcggtgctagctaggcctgtcgccggaaggctgcacccggtcccgctctccaggagaccagagtcattcacaacatcatgctccagatctccgtgagtaattctaaaatctgctgggtgtgccgatgggagacaagtgagcgtggctccagtgccacagtcctggcatgccaacagccgggcctgagcctggggccttgcccaccctctcactcgacaggtctgggcacaacgcctacaaccgcggcgggggacgcggccttcgaaagggccaggagccccgatggaagcgcagggaggggccccagggccctgggccgccaggtaactcagaggggcggcggccgttccgcggcccccccggacggcgcgagcccgtggatgaggggcgcgaacccccccgccccgccgacttcttcgctgcatccagcttcgaggacctgggggcgtccgaggacctgatcagggcgctgtccaagaccggcgtcaccaggccctcccacatccaggcatggggtttgtggggggatgcattgggcgtgggctgccgtgacagtgcagctgctgatgggttttgaacaggggcccttccatccacacaacccnnnnnnnnnngtgcactgggcgtgggctggcgtgacagtgcagctgctgatgggttctgaacaggggcccttccatccacacaacccaactccgtgctcatacccctccatgtcctctctccatcaggcggctgcctggaacgcggtgacggccagccccacctcggccttcctgcttgcagaccatgccggcagcgggaagacgctggcctacctgctccccctggtccagaggctgaaggaggaggagcagcggctgggcctggccgccgtcacgcgcaccaacagcccccgcgtcctcatcctggtccccaccaccggtgagggtgcctgaagcttgatggtcgtgtggttgggtggagccggtggtgggggtgggggggtgagggcgtttggagcaccgacaaatcgatgcatggatgannnnnnnnnntgtgtggttgggtggggtcggggtggggaggtggggggcgtctggagcaccgacaaatcgatgcatggatgatctgcagtgcgcatctccgttggtccatctgttcgaagcagccctaggacggctgcagcgcgcttcagggatgctcttgcgcnnnnnnnnnnacgcatctctattggtccatctgttcgaatcagccctaggacaactgcagcgcgcttcagggatgctcttgcgcggcgctcagccctccaggacggccggctgtcgtggcccgctccccccataacaaaattcttcaccccactctcgtcactcttcccccctctccctccccttcccaccccccccatccagagctgtgccggcaggtggtgggggtttgccgccggctgtccggcgcggggttccccctgcgcatcacgggcctgaccacctcggcgggcaaggacagccagctggcgcagctggcggcgggcgtggatgtggcggtgggcacccccgcgcgcgtggcgggcatgctggaggacggctcgctgggcctggccgccctttcctgcctggtgctggacgaggtggatgtgctgctgggcaacaccaccttccccgagcaggtggaggcctcgctggcggcgcctggggcctcggacgcggggctggtcgtggtcaccgccagcctgcccggcgacctgcacgacgcgctgctgcggcgctggcccggtctgcgcgctgtgaccggcccgggcctgcaccgccccgcggcgggggtggaggagcggctgctggactgcagcggcggcgaggaggtgagcgaggagagcgggttcgcgcgcaaggccgacgcgctggcgcggctgctggccggcagccgcgccgcgcgcaccatcgtcttctgcaacaaggtggagggctgccgcgcggtggagaacttcctcaagcggcgcgagcgggccggcggcgcgcgcgtgttgccctaccacaccgccatcgcgccgccgctgcgcaaggccaacctccgcgccttcctggccgcccccgggggcggcgagggtgaggcgccgctggtcctgctggccaccgaccgggcctcgcgcggcatcgactcgggcctggcggagcatgtggtgctgttcgacttcccgcgggacccctccgagtacatccggcgcgtggggcggacggggcggggcccaggcggcacggggctggtgtcggtcctggtcctggggaggcaggttggtagtggcctttgctggggggcggcggggagtggataggagcaatgcaggccgggaaagggtggccagtacatcacgcgccctgctggtgactgggtgtacctatgtttccagtctcctcctctccccaacaacaaccattcacgcaggtgaagctggcgcaggccatcatgaaccgcaatcgaaagggcttcccgctgtatgacattccggcgtgacacgctgtgcatgcagggaccgaaggagacggttgtgagagggcatgcagggttgacaggacggccagtgggtacccactccccgccagacagcacaggaaggtatacacagggcaccaatacagcgccccaaggacacagtcatgagtacaagtcgagctgaagtgttgtggtgcgcaggcggacggggtaaagaatggaaaagaatgtactgctggatgcacagtcgcaggaacagccatccactcaggggcgctcgccgcggccctgctcctccgcctcggcaaacgcgcggcggatggcgccgatgtcgtccaccaccgacaccttgggcagcgacgggccgcccggcgcgccgccctttgccgcgccctcgtcctcctgtggcccgaacagcagcagctgcaccgtcaggcctgcgtacgcggcgagtgaggatacgctggagggacctgcctcgacgtcaccgtcgcccaaggcacgatgcacgctgggcactccccaccatgctccacagacccgtcctaggctccatgtcgctgcgctttccaccccgcctgcacacctgccaggcccacagcgttggcgccgaccaggaaggtcgccaggtaggcgcagcaacgcacgccagtggcgaccacctgggacaccttttgtgcgatgacctggtcggggacggcctggttcaggaagaaagcgtcgacagagcgggacaggtagaacatggcgacgcagagcccgctcgcctgcagcgccactctgcgtcatggagcaggggctggaactggaggggcaacggttggagggagcaccgcaaagcagccggcgaccgtgtgctccacgcgcaggacacggccggctcccgcgctggtcctctgcgcggttccctcgatcaggcactcagatgccagcaacaacccaggggctcacatggcagaggccaggggggtcacctcctcctccttctgcttggggtccagcagctgcgcaccgtcagggagctccagattcatcggcctccaccggcgatccctctggcctgagctcgcacgctttgctcgtcgcctccacagtgtgacaaagtaggtgaggaccagggcgccgtacgccaccccgccgacggacttgagagccgcgaggccggcgagcggctggtattcaccctcggatgccagggccggcgcggccaggagggcgtccatcactggctgcaggagaagcagggggaccagccccgcagggttagccctgcttgggccagctccagggagagctctcggcctcggattcgcattgaaaccagtctccagtctcctgatgtcgagaagaggcttcttacaagcccatgctgtgacagtccgcggtgtcgagcccttggatcgacatggtggcgagaatggctgccccggtgtcgtgagcgaccccaacatactgcccaagcctggctgaggctacggtgatgtcagatctgcataggaaaatatgctgggtgtgaatccaggccggaagtcgcttcttgcctgctgtaattcatgttgcgagtcttatctgatgtcgacgcttccttggcgcgcccagaggagctagcgcccagaacatgcatggcgcnnnnnnnnnnagtgtgaatccaggccggaattcgcttcttgcctgctggaattcatgttgcgagtcttatctgatggcgacccttccttggcgcgcccacaggagctagcgcccagaacatgcatggcgcccgcatgttgcgcgcagaacgaacattattcctatgtgagccattggtgctctttggtaaaatactttaacagcgccacctattaagcgcannnnnnnnnnatatgtgagccattggtactctttggtgatatactttaacagcgccacctattaagcgcatgcctgggctgctgctggttgccaccccgcacacaggcagagcactcagagcggctccaacccaacacctcgttctgaatcgcgagccctcgagccaggctcacaacattgctctgcgtttctctgctcctggttccctgctcctcaaatccccgccgcgccgcaccctctcgggcttcgtgcgggccatggcgaaggaccaggacctcaaccccgccaacacctcggcctatgtccaggtgtgctcaatgaatcatgggtagaaggttccaagggatgatgttcttacagcatggggtaatgttgctgcgatggtctcctaccaagtggccatgcgcctctcagtgaccctcctcatggtgcaagcctgatgtcctttaggttttggcagccgtttgagagtcaattgtgtgccttgccgttcagcatgcgcccgcactnnnnnnnnnncgctgcgatcgtctcctaccaagtggccctgcggctctcagtgaccctcctcatggtgcaagcctgatgtcctttgtgttttagcagccgtttcagagtcaattgcgtgccttgccgttcagcatgcgcccgcactgaaactgagcctcccgcttcccctttccccaaattgcaggtgctgggcgtgggcgctgatgccccctcctcctccccctctgtcctcctcttctttgaccgccagcgctacctgttcaacatgggggagggcttccagcgctactgtgtggagcaccggatcaagctggcacgcatgtccgccctgctcctcacccgcgtatcggcggccacagccggcggcctgcccggttccctgctcaccatggccgactcgtccgccggcgggctgctggccggccaggccagcatggcgctccatgggccgccggggctgtctgccctggtgaacgcctaccgcacctttgtgaacctgaaggacgtggggctgggcatgcaggagctgcagcacgcccagcccgccgtcgccaacgagctggtgaccatcaccccgtacctactcactgctggcgaggctgagggggcggctgctgcgggcggcgaggtgtccgcgctgggtgcaggaagagagggtccaacgtcgacttccgatgctgaagtgacggcagggagcacaagggaggccgctggcaaggacggcgaggagcgggccgccaagcggctcaagcccggtgagccaggacctggggcggtggcctgctatgcggccgagctcccagacatcccgggcaagttccagccccagaaggtgtgaagaagggcttggcttggcttgttgaaagtgcttgctgttgatctgcagggcagtgtgaaggcagacgtgcaactcagttcttgtctgccccgcctgtgtttctgcccatgcacctgttgggcacctcctgaacaccggcgcggccagacaagcatgtgagcagcatgcacccacctcttctcccccaccttgcaacaccttccaggcggcggcactgggtgtgccccgcggccccacttacggccgcctggtgcggggggagagcgtgctgtccacaaacggatccaccatcacccccgccgacgtcatggatcccgccacccccggcccggtggtgctcgtcgtcgactgcccatcggcggcgtacctgcccgcgctcgcggcctccgaggacctccagacctttgcacagggcggcaacaaggccagcaagggtgaggnnnnnnnnnngcgtacacctttcctcctctacattccctgcaccaacacagtggcgtgcatagtgcacctcacccccgctggcgtgctcgcgctgccagagtnnnnnnnnnngcctggatgtggggggcgggagtgcgctggagattgaagcatgtgccctgggccaccccacacccatcccagggttggatcctgaacatgacgnnnnnnnnnntcctggatgtggggggcgggagtgtgctggagattgaagcatgtgccctgggcaaccccacatccatcccagggttggatcctgaacatgacggcgcctgtcgtgacaatgatgctgtaccactgtgcagctctgggccaacctccgtacacctttcctcctctacattccctccaccaacacagtggcgtgcgtagtgcacctcgcccccgctggcgtgctcgcgctgccagagtaccaggcgtgggcagcgcgatttgaccccggtgcatcacacatcctggcctccgccgccggcaaggccgggcagccggtgatgagggcggctgcgggtgtccaggccaagctcaacgccctggacgccaccttcttccccctccagcagtcgctgctgccctccgatggagcaggcagcgagcgggccatccccctgccaggcatgtcatcccactgtggggtacttgggtggtcctgccaagctcccttcactgccacgcccgcgtgtggatgatggtcctcgatctatccactgaacagcgcatgaacccatgtggtcaatcatccatcctagtgactgacacgcgcgagccctccctacctgttctggtttccggtggcaggccgatctgcggtacccgtttgggtgcatagcctcctagaccgccgcccgacctcctgcgcccccctttcctcccccttctcaggcggcgtcgcgggcgacaacctgctgcgtttcaacctgcgccccgtggccaagcgcggcctggactcatgtgagcggagccactgtgtgaggggccgcgatggacccagtcatgcaaccccctatcggaagattcctgtctgcgcttggcgcaggcacggtgtgcatgcaggaagggccgactcgatcccaaccacctttctccctcgttccgtgcagccgaggtgctggaggcgctgagcgccgaggcaatccgggccgagctggcggcctcccccgcgggcgaggccatcgcggctctgggccccgccgccgccgtccccggcgaccacccccccccctgcctggccagcgccggcccccgcagcctggaggtgaccttcctgggcacgggcgcggcggtgcccagcaagtaccgcaacgtgacggggacgctggtggactgcttcgaggccggggcgctgctggtggactgtggggagggcacgctgggccagctggagcggtcgctggggcgcgcggggacggcagccctgcttcgtcgcctgcgcggagtctggatctcccacatccacgccgaccaccacgtcggcctggcctcggtgctggccgcgcgcgcggcggcgctgggcgccgacgcgccggcgctgacggtg

SEQ ID NO: 47041 - DNA, 61 bp, Chlorella protothecoides
tgtgctggcgcgcttgttgccgtctgtcgctgtcccagcgcgcttgttcaaggagttcccc

SEQ ID NO: 47042 - DNA, 66 bp, Chlorella protothecoides
gggtgagaatttgtatcggtagttgccatctaatttcaggaaagaatcggagccgaaggcgatcgg

SEQ ID NO: 47043 - DNA, 2633 bp, Chlorella protothecoides
  modified_base (259)..(291): a, c, t, g, unknown or other
  modified_base (419)..(428): a, c, t, g, unknown or other
  modified_base (599)..(608): a, c, t, g, unknown or other
  modified_base (1053)..(1062): a, c, t, g, unknown or other
  modified_base (2506)..(2515): a, c, t, g, unknown or other
gccgtgcgccgccggcatcggcctcgtcgccgccgccgccgccggcggcctggccgcgctgcgcctccctgccggccgccgcggtgtctgccatgctcgtctgcagcctgccctggcaggccgcgacgctggccagggcggaggccgtgccgtcctgcgcagccctcagctgcggggcggggcgggaagggagggggcatgggctctggcgctgcgcatgcgaggagagcgagctggcatcgacgcggggtcggcgatnnnnnnnnnnnnnnnnnnnnnnnnnnnnnnnnngcaggaggccacaggagtaaactcataacggtttggggtccagtagctccatgtgcgggcgtgcaggtgtccccccagcctgacacacggggggcatgacagctggataggcctgcatcttgaacgtnnnnnnnnnncggcccacctctgtctgggcctggcgcgccgtcgtctctgccgccctccgctccatctccagcgtcttgagctccatccgaagctgttcgttggccagatttgcctacggcaggaggccacaggaagaaactcatagcaatttggggtccagtagctccatgtgcgggcgnnnnnnnnnntccagcctgacacacggggggcacgacagctggataggcctgcatcttgaacgtgcagaaccccctggctctcaccttttggatcgtctcattgagggcagcggcattggccatggctgtcttcttcagctcaagcagctggtccctctgcaccgggcgatgaaggatagacttgggcctcacctgatggcggaagccaggaccccaaccattactctgacctgtatggggcacaacatggcattgtgatggtgcaccctgcccctccccacctctctccgtagctcctcggcctccttgctgagcttggccgtcagatccagcaccttttttgtctgcactcctgcaaggcacagcatggtggtgaggctctggggacatgcaggcaggggctgggggcagctgctccatccctggaagccagcatgagactggcccataatgnnnnnnnnnncggggacatgcaggcaaggtctgggggcagctgctccatccatggaagccagcatgagactggcccataatgcgcctcttcgatcctcccatcggaattcgggacgcccggcgtccatgtcgagcatctccaagcctgctcacttgattgtttgagctccctccgaacttctgtagccgtgccctgggcccctctcagggcaaagaatgccacgaaggaactcagggacaggaggaacaccagtatggcagcgattgcgaccttggggtcattgcgcatcacccgtgccctcccatatgtaaacatctgccgggtgggtggggatgcgtgggcgcggcgcagtgagtatagatccgaggtcggccacgcactgaatagctgagtcgttcttcggcgaagaaattaccacgcgcaaagtgaaattcaaactcgtgcgtaagatgaagattgacgttaccagagaagtgctatcatgccgatgccttgtcatttgtgagcagggagatgctcgcgaccatgaaaacctagatgggcgagcaagagatttgggcgcgcgcaggccagggtggccaagctgagctccggcgagcgatgaactgtaaggatgccgcattgcgttcgagagtggtatgacgcggattttcgagatccttagacatagcaggcgctccctcaccgttgactgtcctcggtgatcaccggctgacgttgttccagggctccctcacctctgccctgccaaagaaatggccgggacggaggatgtaccggtaccacaagactataaactggacttgttgaggaaggtgggcagtggcgtgtgtgtggcgtgtgggagcccgctacaccactccgtcgagctcggctgggggctgctcgatcgtggcagttgagctgaccatccccaccccaccattggcgctagaaatatttgcttcaaacccacgcggagggggcagacgaggccgtgctgcggtacgacatcgagtaccagatcactgcccatggtgcgtgaactcccgagctgactctctggatccaagaattcggactcccccaagttcggggcatgtatactgttgctgaaggcatgggcgcccctgcacagaggggagggcaccttgggcgctcctctctcttggcgctcgacccaggcacccacctccacctgcagatgcgggagccctgtacgcccatgtctgcaaggagctgcagtgggaggagagcgcgggtcggctggtgggcctgcaggccgccgccgccgccaagctttcgggcctggacgccgccgtcgccgccgcaggtctgtatgtgtgtcgattcgcaatgcggggccaagaggttttgcctgggtgctcgtgctgggtctggcgaaccccagcatgcacgaaaaggccctggagttgctcacccgctgcccccagactcatcccgggtgctgcannnnnnnnnnggtgtggggccaagaggttttacgtgggtgctcgtgcatggtctggcgaaccccagcaagcacgaaaaggccctggagttgctcaccagctgcccccagactcatcccgggtgctgca

SEQ ID NO: 47044 - DNA, 61 bp, Chlorella protothecoides
ccagtgtggtgggccccgtccatcggcggggcgcacagatgtctgcgaggcttgatacaga

SEQ ID NO: 47045 - DNA, 61 bp, Chlorella protothecoides
gacggggtgagcggctgtattctgtggcggggcatgccgcggggatgagtggctgtggtgt

SEQ ID NO: 47046 - DNA, 79 bp, Chlorella protothecoides
ccgcggggactactcctgttttctgctccctgcctccttgccccctccgccacacaattcttccctcttccaaactacc

SEQ ID NO: 47047 - DNA, 67 bp, Chlorella protothecoides
cctgcgagaccgacaccctgtacctctagaagcaccccttcatcgactggcccccccctcgctttct

SEQ ID NO: 47048 - DNA, 79 bp, Chlorella protothecoides
cagcgcctccagctcggcagcccggcccgccgccagctcagcggcctcggcgcgctgacgctgcgcctctgccacgctc

SEQ ID NO: 47049 - DNA, 61 bp, Chlorella protothecoides
atgttgtcttcagttgtgggggccggcggggtccccttcctggtggcatcgtatacagtgt

SEQ ID NO: 47050 - DNA, 102 bp, Chlorella protothecoides
aatccccaccccgaggataaactgcaccccttctccctctcccccccccccatacaacaccgcaccgagcagcaccgctcacccttgtccgggttctggagc

SEQ ID NO: 47051 - DNA, 61 bp, Chlorella protothecoides
tggcatgccggcaatgatcgatcgagctttcctcttcctgcatgttgagtttggtgagccc

SEQ ID NO: 47052 - DNA, 67 bp, Chlorella protothecoides
cccgccgccatcccggggacaccgtgcgagagccaggcagacatggcagccccaccaccagagacgc

SEQ ID NO: 47053 - DNA, 10751 bp, Chlorella protothecoides
  modified_base (1414)..(1423): a, c, t, g, unknown or other
  modified_base (1654)..(1701): a, c, t, g, unknown or other
  modified_base (1768)..(1777): a, c, t, g, unknown or other
  modified_base (2046)..(2217): a, c, t, g, unknown or other
  modified_base (2533)..(2542): a, c, t, g, unknown or other
  modified_base (4665)..(4824): a, c, t, g, unknown or other
  modified_base (4925)..(4934): a, c, t, g, unknown or other
  modified_base (5031)..(5040): a, c, t, g, unknown or other
  modified_base (5098)..(5107): a, c, t, g, unknown or other
  modified_base (5294)..(5346): a, c, t, g, unknown or other
  modified_base (5760)..(5809): a, c, t, g, unknown or other
  modified_base (6957)..(6966): a, c, t, g, unknown or other
  modified_base (7305)..(7314): a, c, t, g, unknown or other
  modified_base (7490)..(7499): a, c, t, g, unknown or other
  modified_base (8325)..(8334): a, c, t, g, unknown or other
  modified_base (8649)..(8658): a, c, t, g, unknown or other
  modified_base (9397)..(9406): a, c, t, g, unknown or other
  modified_base (9487)..(9647): a, c, t, g, unknown or other
  modified_base (10668)..(10677): a, c, t, g, unknown or other
gggggggggtgttgggaggggagaaagcgtatgggcatgaggtcccctccccccccttcaaccaggtgtgctgggtgcagttgcatgcatgaccccgggtgcgccagccagcgagcggtgggtgggaagcgggccgcgggccgcaaagcctcgcttccctccccattccctcgcaacaaactccaaacaagccccacccgtgatgagggagttgcaggccacgggctgccaggccagcttcatgacggggttgatgttgtagtccacgtcggtgatgttgcccagccccggcgcggagatggtgatgtcgtcgccctcgcaggaggcgcaggagtcgacgagcatgaagagggcatagtccagcatggcatgcgggcagacggtgtccacgcaggtgacattgaggcacatgccgcagtactgacccgccgcgtagtaggtggcggacacgcccgcgtagtagtaggtgaagtgggggttcaggtacccgatgccgcagttcagcgtctgcacgcccgtctcctggaagtcgcgggccgcggacacggtgccggtgccctggcgccagtccttgaggccggccgccgccgcccgctgcgcggcgctcaggggcggggcgtaggcggtgcccgggttcaggaagctggtcaggttggtgtaggaagtgacccaggtagggctgggcgggggcggcgccgcggcgggggggcccgccgccgggctgggcaggctggcgaaggggcccggggccagcgccggctcggcctgggacacggaggcggcggccaggtcccgggccagggactcgggcgtgggtgcggcggcggcgtccggggcgcgggccggggccaggccgctgctccgcagcgcccggggcaccgacccggcggctgcggccggggccaagcaggccagggccagcagggcgatgcaggaaagggtttgtggggctgacatctcggcctgagggggggtgggaaatagggtttcggggcgggtggggtgggtggccgtggcagacgcgtctgcgacgtagggctcgggtcgtcaggtcccagcctgactcaccactttttcaaacccgcccgatgagaggggaggggcgctggatttcaaagcaaacttgaggagaggggggggctggtccggctcctgcctgtatcggcgatgattgcaacccgtgtttgccgccttccgcgttgggaaccgggcgcgtggatgcagtcagtctggacaggcccaggtgacgaaacaggatgcgggtgcctgaagccccgccacagaatatttcgtattttatagagacttgggcatgtctcaggtcctcgatacgaggcatctatgacgcccaacccaagtctagcgcctcgccggggccactttccctggaaaggaggaaatctcggcccttccnnnnnnnnnngtcgacaaggtatgctcgcaatctgggactgtggtatataggcacgccatgctttcacatgccgcttcatgccggtgtggggtatgacccgcctgttcaccgtcccagccttacatgatactcggaatctgggcgaggggcacacgcaccgagctgccgcgggatcgcgtttgatgtggtgctgcgataaaatgtaatgaaattaatggagcaggggtttaagaatgggtnnnnnnnnnnnnnnnnnnnnnnnnnnnnnnnnnnnnnnnnnnnnnnnntgagcggttgttatgccgcgttggggtggttaaacccgggcgcggagccgacgacagcaggaaccgnnnnnnnnnntccaagtctagcgcctcgccggggccacttcccctggaaaggaggaaatctcggcccttccaactcactcggttcctgctgtcgtcggctccgcgcccgcgttcaaccaccccaacgcagcataacaaccgctcgtctccaccaagatccctgacccattcttaaacccctgctccattaattccattacatttttttgcagcaccacatcaaacccgatcccgcggcagctcggtgagtgtgcccctcgcccagattccgagtatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccggcccgcagaggtcatggcgcgcaccttcgccctcctcctgtgcctggcaggcctggtgctgcacgggcacgcagcggcgtcccccccgatcgatcctttcgccagcagctccaccgtgagcaccggcacgaacggcgccgcagccttctcgcccaaggtacagatgctcatggggcggctgcctgtccgagggtgtccaagaaggggagggggttttcgggcgacgcattttggaagatcagctctcagcttgggcatagaatgcggtatcatggtgatttgcatacttgcccacatacgggcatgtgcnnnnnnnnnngaggggagggggtgttcgggcgacacattttgggagatcagctctcagcttcggcatagattgcgggatcatggtgacttgcatacttgcccacatacgggcatgtgcgtcccctccaagcacgctgtgcattcacatgggtgggggtgcagcatgccatgtcccgggccccctcagggcccagtgcttctcactccagggcccccttccctgccagacccgtatgcctccatccccaccggagatctgtattcacatccccccccaaccccccacatctaccccacacagtcccccgccgccagccccaccgccgccgcccccgcagcggttgatggcctggccctggccgccgagtatgcggccgcccccggcgcgcagcccgcggagcagcgcctgacgtacaagggcgtggcgacgacggggtacacctccacccccctgaccacctacggcgccaccaacctgggctgcgcgctggggtatgtgggcgacaacttcacctccgactacgtggccatgggcccctccttcttcaaccagggctactcctgcggcctctgcatccggctggagtgcgacgacgcgcggtgcgagcagccggggcgcacgcgggtggcgcaggtgctggactactgcggcaactgctacgacgcggacctgaccatcgcgcagccgctgttcgtggcgctgacggggcgccagcccagccccaacccctccgccctcatctcctgggagtttgtggactgcgcgccctacagcaacggcaccatcaagatgctggtgaagcaggggggcagcgcctactaccaggccttctccttcgccaactccatctacaccatcaccgcggcgcagctgaacggggaccggctggtgcacggcaccgacaactactggagctggaacccggtgagcaccatcgaccccgccgggcccttcacactggacatcctgggctccaacggccaggtgctgcaggtggtcctccccgccctggtctccaccgacctgggcctgcagttcacgccccctgcccccgtgcctgcgcccagcgcggagtgacccggggtgcagcgtgtgggcggctggactcaggcggcccgggcgtgccgccccctgcctctcccccccgcccctcccttcacacacagccctccgcgcactcctcgcgaccgaggacgttttgaatatacccctctcctccctgccatgtgtgaatggagatgtttgttgtgaaagattgccgtgtacctgccggggcgcggggtgagggccaggaatacaggcacagggcagaacttcccccctcccccataccactgctgctcgtacgcccgcgcgcgccacccggctggagtcagcttcctgggcaccactcggcccctcccatgaacacggttcgagcgtgttcgaaagacccaaacccatcccagcggctccagcgccccattacgcgctccaaggaggccaggggttcgagaacagcgggtctggaccgagatcgacggagtaagctgcacgcgcggcgctggcgtgaggggggctcgaatccttacagacctttggcagggacgacatcaagagctggaatgagggccaacagcttcatcgtggtcatcctggccgcctgcctggcggggatggcggccgcgcagatcccagacatagttcccatcactgtgcaggaagccctgggtccgctcccggaggtgcccgcgctggaggactcggcccctgcaggtaggatgggtttcgagagcccaatggtccattttggtagtattgtgctcgatcgccgcctccccgcctgccatcgcagtcgaagtaccgcccgccgtggtcggtgccctgcccggcaccgggccggagagcgagccggtggcagagcccgtggcggagccagagagtgagcctgcagtggagccggcagccgagccagagagcgagccggtggtggagccggagagcgagacgcccctggagcccgtgacggagaccacagcccccggcgcagccgtcatacccgtgatccccctcccctctcctgtccctgtcgcggaggtccccaacctcacagcacccagccttgctgatgtggtgcctgaagtcgaggcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttggggatgcatctcctgcttcgacatgccggcctgaaattctcatcgcgagcgagcagcactcactcccctgctcccccccctgatgcccctttcaccannnnnnnnnnacacgcccgagactggtgggtgtttgtgtgtgtgtgaattggggttaggcaggggcgctggggccacaaggcgggagctgagggcgagcaggggggnnnnnnnnnnctgctgagcggggaatcacgcgggctgtaggcgaccaggatgccccttgcctggcacnnnnnnnnnnctggggatgcatctactgctttgacatgacggcccgaagatctcatcgcgagcgagcagcactcactcatctgctcccccccctgatgcccctttcaccaacagaggacctggcgggcatcgtcccggaggtgatcgcccctgggctcgagagcgcgctcggccccgacacggagttcccgctcgtnnnnnnnnnnnnnnnnnnnnnnnnnnnnnnnnnnnnnnnnnnnnnnnnnnnnnagagcagaggccacggtgcctggaccggcactgtgccgagcacagacactggtccctggggctgctggcctgtgtccattgctgagcggggaatcatgcgggctttaggcgaccaggatgccccttgcctggcacatggcccacaaacccaaccgcccctcatgcaccgcagaggagctggagggtgacttcatctacctggaggttgcctcgggtgagttggggtgttgctggggaggagtggcggcccaggccgccatgcggcgactttgcaggaacggccggatggcacgcatcgtttctccaccggcagggcactgcctctgcccctttgagctgtgtgctatgactccccatgtataaacacaaagtaaggaaagtagtccaccctcctcccctcccgccccccccccnnnnnnnnnnnnnnnnnnnnnnnnnnnnnnnnnnnnnnnnnnnnnnnnnnggcacgccgttcgagcaggtcctgtacttcctgaacagctaccggcccatcgcccaggccttcatcaacgcgcagcgcgtggagcgcacctccgccgtggacccgccgggctggaacctgacccactacggcgaggcgctggacctcagcgccccagtgcgcgtggatctgtacgacgccgagggcaacaaggtgttcacccccctgccggcactgacctcccgctccttgggcacccagtttggcgtggcgcccaggggcagcgccgccgggtactacccggccggcagcttccccccgctgtcgcccagccctggagcgtgaagagtgtgggagacccgagtgcccccccttccggcgtgcagatgggacgacccagcccctctctgcgcgcagcgccgtctcccttctgctatcggcagcaggcggcgtggttcattggagtcctgccacaccagaccccgtggctggagagcaccgcccccccgcgcttgccttttgctctcggatgactggttacaacccatgcgatcatacgcctggatttccacagcaggcgccgtgcgtgacgcggagcggcggtcccgatcgaggcaagcaggcaaggggttgtggtgccagcgggaacatttccttgagggacgagggcctgctgcaggttcatgaaaacagggggaaggggaaggccagcagcggagttcagccatgtgagtgtacatgtgccgcgtggcgcggccggggtcatagctccatgcgctcctccggcggcccctcgtcctcgctgctggacaggaagccgtcggaagagccctcgtccccgctgccctgctttgaccccgggccgtcccagtgcttggtcgcgtctgacggctgggcgtgccgcagcacatgctcccgcacgcgcttgatgtaggcggccgggtcccgcatgtgcagggcagccgcctcgccgttgagcgggtcggccgcgttggggtagagcagcagctggggcaggaagacctcgaagatgttcaccaggtctgtgcgggggcagggggaggtggctggtgatgggcagggcggcctgtcctgggggcagcggttggggaatacacagagggacgggccgcaagcagccgccaaacacctgccgcggcatgcacccnnnnnnnnnnccctgggggcagcgcttggggaatgcacagagggaggggccgcaagccgccgccaaacacctgccgcggcatgcaccccctgctctggaatcctaaaacacgaacacgtctgccgcccctcctcaccaaacatggggctccatgtctggttgatgacgtcgaggcacacggatccggcgccctcgtcgatgttggggtggaagatcttgttaacaaagcctatgctgggggacttgtacgggtatgcctcggggagctccacgtggaccctccacacgccgccctcatagggacctgcagggggaaaggagggagtgtgaagggaggggacgaatggcnnnnnnnnnncgggagctccacatggaccctccacacgccgccctcataggggcctgcagagggggaagagggagtgtgaagggaggggacgaatggcgggggccccgcccagtgtagttgtgttcgcaacgatccagggttgaatggttgcagcctggctccgcagccacagacctcacccgtcnnnnnnnnnntttcgtaacgatccagggttgaatggtcgcagtctggctccgcagccacagacctcacccgtccacatttcccctcacacaggcatagcaatgaaagaatgaactaccgtgaccactgatgctatcacacccttccatggagactcactgtcggcagggcctttgaactccacgtcaaaggtggacacattgtcgtcgatcagctccaccttatagtctgtcatcactgcgagaggttcgtgatgtgtggtcagagcggtgctgcggatgccaggggcctctgtacaggcgtgtcggggcatcgagaaggttgcccacactcactcaatttatagaggtccatctctcgccgcttattcggggacgaactcgccattgcgggccgctgagtctcgtggtagcagtgtttcagacggtcaggatatttatgggactggatggccgggggtcaatgtcgcgaggggcgcctgtcccagcagaggaggggaggagcgccaggctgacgctgctggcgtgtgagtccccttccgcgtaagtctgccactgacggggagcaatcgacagagtctacccgtgtgcttatctggagattggtgcagaaatgtgggctcttgcctgtccctggaacgaagtcagaccccctcctccgacgcttgtcggaaagggatacgacctaggcccagcatggggagcacgggggggggtgcatgcgacctcgtgtctggaggatgagcaagaggggtcaggaatgcagggatgattgcatccaccattagtctgtttggcaatctcggtggcaggagcggtggtgtctgtcgaagagctnnnnnnnnnnttggaatgcagggatgattgcattcaccattagtctgtttagcaatctcggcggcaggagcggtggtgtctgtcgaagagctcacacaagctcccctcgatcacttacggacgccccatatcatacagtaaaacctaggcaccgcctcattggggtacctgtatgtcattatgtagaaatgaaacgttcaaaaaggcccagtgaacggcggtaggcggacgaccatgtcgggagacgctcaaggccgccccagcacgggtgtgctcagtggctctggggtgccagggtgtccctgctgctgcccacctcccagcnnnnnnnnnnggccccatatcatacagtaaaacgtagtcaccgcctcattggggtacctgtatgtcactatgtagaaataaaacgtttaaaggggcccagtgaacggcggtagccggacgaccatgtcgggagacgctcaaggccgccctagcacgggtgtgcgccgtggctctggggtgcctgggtgtccctgctgctgcccacctcccagcatcacaccccgtagctctcattacattgcacagtggtacgtctgaacgtgtcttccatccagcagccccagccctcgggggaggctggcacacgtcggacagcacggcaaagggtgagaggctgggcaaaacgtgtctttattgatgcggtgagcatggggctcatcatgaaaacatcctgatgtggtgcctcacacctgtgtacagtcgcagcggcacctggacgaggagtgggtggcctcagatgatgcggagtcggacggtgggggccaggcctcgggcacgagtcagcggcgagggaggcctggcgctcgcgccaccaagcgcagtactccgtccatggcgagtgaatgagggtcgagatgcacgtctttgcttgctgacttctgctacgggctcgagcctacagggtacccgctcatcccatggccctggcgcctgcttgcccccacagcaccagcaagcggcctgaatgtgttgccagcgcacgtgccccgctcggcatgatgagcactcccatccgacccctttcatgnnnnnnnnnntgagggtgagaggctgggcgaaacgtgtctttatcatgcggtgagcatgaggctcatcatgaaaacatcctgatgtggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcgcgccaccaagcgcagcactccgtccatggcgagtggatgagggtcgagatgcacctctttgcttgctggcgtctgctacgggctcaagcccacagggcacccgcccatcccatgggccctggcgcctgcttgccaacacaaccccagcaagcggcctgaatgtgtcgccagcgcacgcgccccgctcggcacgatgagcactcccatccgacccctttcatgcccgccaggcgtctgaggaggtggactgggacctggaggaggggtatgcctccgacggccagggctatgtgctgggcgcccaggacgagaagtttgccaacttctcgtccctgcccatgcgcccagaccacccgaataggtgagggggtcctgttgagcaggggcgaggggcaggggttcatgcggtgtggatgccaggagggcagtccaagggtgcactggcactgaagcggccccggtctgtctgaagccctgctccatgctgccatgcccatcagccaccactgtcaccccaaccctgagtcccaagccaccacaccacccccgcgatctctgctccctccccccccacctccaggccgctgtgggtgtgcccggacggcaggatcttcctggagacgttctcccgcgtctacaagcaggcctacgacttcctcatcgcctgcgccgagccggtctcccgccccgagttcatccacgagtgcgtggcgccgcagcgaaccaagggagcggctccgggtcgggaccctggccggacagggccgtgccaatcgcagtcacacatcccccacccaatgaaacccctcaggtatgcgctcacgccccactccctgtacgccgcggtttccattggcctggacacgcccaccatcgtcggggtgctgggccggctgtccaagtgcgggctgccggcggaggttcgggccttcatcgaggccagtaccgagaactacggcaaggtgtgttgccaggcggggggtggggggggcggcggggatgtcgtgggggaggannnnnnnnnngcgggccttcatcgaggccagcaccgagaactacggcaaggtgtggtgccaggcgcgggggggggggcgcgggg

SEQ ID NO: 47054 - DNA, 61 bp, Chlorella protothecoides
tgacgctaccaagacatcaaaccctccatagcgacaggtcaactgcaggggagctctcagc

SEQ ID NO: 47055 - DNA, 61 bp, Chlorella protothecoides
ggagtccacaggttggcagaaggggggggggcctctggctccgaccgtgggttgctccgtg

SEQ ID NO: 47056 - DNA, 61 bp, Chlorella protothecoides
tatagatgcgagcgccgcgccggccagcagggtgaagaggtgggtgcctagagcccagcct

SEQ ID NO: 47057 - DNA, 107 bp, Chlorella protothecoides
ggcgctgaggaaggggtcgagggggacaggttgccgcggcatctgggtggcactttgcagtgtcgtgccatgcaccacccactcctggccccatgcccctgtccttc

SEQ ID NO: 47058 - DNA, 80 bp, Chlorella protothecoides
gacggtgccctgtgccgctgcgactccaggcacccccccacaccctgtttccagcggaccttggggcggaggaaggagat

SEQ ID NO: 47059 - DNA, 4793 bp, Chlorella protothecoides
  modified_base (182)..(304): a, c, t, g, unknown or other
  modified_base (639)..(648): a, c, t, g, unknown or other
  modified_base (2168)..(2177): a, c, t, g, unknown or other
  modified_base (2749)..(2758): a, c, t, g, unknown or other
  modified_base (3187)..(3196): a, c, t, g, unknown or other
  modified_base (3981)..(3990): a, c, t, g, unknown or other
  modified_base (4673)..(4682): a, c, t, g, unknown or other
cacgcccccccgccgcgaagcgggtggcgccgcggtgcgccgcggccggggcggcgccacgctgcacgggtcccaccgagccgtcggagctggcggggctgagccagtggcccgggtgccgcgccccgcccccgctgcgcgccagccggcagctgagcggggtgtccaggaagtcgtcgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggcccccgtcgcccgcctcgccacgcaggtcgcaggcaaggatggcggccacggcctgcgtgctggggcccgccagggccggcagcgccctggccgccgccccgccgcccggctcggtgggggacgaagcccgcaggcgcggcccgcgccggcgccgggccgggttccgggccggcgtcagcccctccgcctgctgctgcatcttctgggagctgctcagcagcgagtcgtccatgtcaaaggtggtgggggggcggggcagcagcgcggaaacccggcggcgctttgaccctggcagcggtgtgggtggggagcggtgcggagctgggtctnnnnnnnnnnaggtggggggccggggcagcagcgcggagacccggcggcgctttgaccctggccgcggcgtgggtggggagcggtgcggagctgggtctagcgttggccgagggaggggtcatgccaggtgtacggggaaactccacacacacacatccttacaccaccaggaagcccacctgaggcggcgcggggtgtgccagatggagccagcaagcactccttgggcctggcaacgatgtacttcttctccaggagcctgcggcccttggcggcagagtgctccacccacagcggggtcacgaccgtgggagggagagcgaactgcggccaggtggactggagatgttcgagactcgtacagcatggagggctcggaagcagggcgctcgatctcgacactttccccttaaacaatactccccttttacaacccgcaccttgtccagcttggtgtaaagctccaggaggtcggcatccggctcggccctcttggcagagggggggacgtgcttgcgctcgaacacgacatgggacacgtccttgctcaggcgctgcaccacccgggccccatgctctcgcagacgagcctggatggcctgcctggcgttcctgaccgcgtcggcgcagcacaccagggccaccacgtcctcgagcacggacatggctacgaccactcttctgccatcgtctcccctacagagctccagacagcattaaatcaaaattcgatggttgtagtccgcactgcgggatccataatttgtcgtcagctccgtcagctgacgggacctggcagcacgtcatttggatcgtgccggagcagatcggaagtcgcgccctgtttttgtacagggggtggctgcgaggggtactgccctcttgcttgctacacagtgcaccccaggtgctcacgggcttccaccgcctggcttcacagcacaccactgcacagaccactgtcagggcggcacaggcatgggtgcagggccttgggggtggggtttgccccccttccagaccaccggctcccacccaaacgccttgccccagttgtacagctcgtccagggtccaggccagcgctccagaggcctcgagcctcaaatattcctgcaggcagcggggtgagtgtgttggcgtgaaaagggacaggcgtcagggcatgcagtgctctgggtgcactgccggcagcgcccacgcatccttccacaccctgtgccgcacacacttcttcctttcctccccccccctcctcacacacatgcaaacccagcccctgcctcccccatgcaggtcccaccttgtacaggcgcagcgcggtgtgcgcgtcctcgatggagtcgtggttgccggactggatggacgtcttgagcaggtacgaggccaggaagcgcaggctcagctgacgcatcctcggcttgtggaacagcctcaccgtgtccacgatctgatgggaggcaggtcgagtgggggttcgttcaggcgtgtgtttggcagtgcgtcgcgaacaggggcggccagcgggtnnnnnnnnnngagggggttccggtcaggcgtgtgtttggcggtgcgtcgcgaacaggggcggccagcgggtccggtcacgcaacctcgacgtgggggtgccatgcgcagcagagcgctcggtgcctcggtccccgatgcaacggctcccacccgcgccttgcaacacccccaagcacccacccacctgctccgagggcaccaggatgttgatcatgcggaagtcctgcttgaggccgtgccccacaaagcgcacccccgagtccaccaggtagcgcagcttgaggtacgcgcggcgcagcgtggtcaggcagtgcggcgagcgtgcggggtccagatcgccggggacgatgccgctgaagcgcgtgaggtagtcgtgcaccgcctccgggctgcggatgtagtcgtcgatgcaggcggtgccctccagcgcgccctccccgcgcaccacgctcacccgcgccaggcccagccggctgggccgcgtggtgacctccatgcccctggagccagggcggagtgggggggggagtccagggggtgcagaggggaggggaggggcggtgcatcgacccccgagagcnnnnnnnnnnaagccaggatggagtgggggggaagtccaggggatggagaggggtcgggaggggcggtgcatcgacccccgagagcaggggggtgtggagcggtgtgcggcggcgtccgggccgaagggaccctgcacggggagccggccttcgaggagcgcattgtggagctccacttcacccccggccagccaccctcccgcaccaaagcaccgtccagcacctgaccaggctgtactggggcgggctgtaggacacgaactcggcgtccagagccagcagcatgcccggccgcggcagctcgtccggccccagcggcaggaaggtcggcgcccgcaggttggcccgcagaccctgttgcgggtgggggatgggcggtggtgagattgtgcgggtgcagtggggttctcaccagcgctgaggtttggtggcgcctcnnnnnnnnnnatgggggatggggcggtggtgagattgtgcgggtgcagcgaggtcctcaccagcgctgaggtttggtggcgcctctggcgcgcacagagtgcatgccggtgggctccgttcggttggctcagccctgcaccccaccatcggccactcctcactcccccatcaccgccatcgccgccatcacccacccaccaggggtgagatgcggcagagggcctggaagcccagcgaggacagcaccggggtggggcgcgtatccagcagcccctcctcctcgtgcattcgagccgcgcgctcctcggcatccacggcccgccgcgtgtagaagagcaggcacggcaccttctggccgtcgtacagctcccccgcctcggccgccggcacgggctggatgctgaagtcgttgaagagccaccagtctgatggtgcgggcggggcgggtggcgcaggcgggtgtggagtcgggagcccagcagcgtctgggggagggggcccaggcgccgctggcgcaccaccttgcccgccgccagtgccctgcttccacggaacctgcagacaagactgggagcagctgtgggccgacaccatggccgcaggccggtggacaaccacgttcccgtccccttggctacccctgattggcggctggtgcacgcatgcatggcctgcagatgtggtggatgggccagagagggcttgctgtccacgcataacacacggggcccctgcactggccttgatgtgtgccaccaggtggccttcgtagaggtccgtgccccactcgagcnnnnnnnnnncacacacgggccccctgccctgaccttgatgtgcgccaccaggtgaccttcgtagaggtccgtgccccactcgagcgactcgtcggcgtcacagacgtgggccaccacccccgtcagctcgtacagcatgctgcgtggggaggacgggcagggagcagcatgcgcgtcggtgcttacagacacgatgagcgccatcgccaggcctccgagcaggcccaggcgcgcacctaggacggtgtctgccgcgcacatcgtcacccgattgtcccgcctcccaccgattccccttgctccctcagaaccccacctgtctggcgctgccatggcgtccaggtcggcgccctggcgcaccagcagtcccccctccggctgcccgtcacagctgaatgccaggacggaaggcagggggccccccggcaaatcctgcaaccccttccaccatgccagcctctccttggcctgcggcggtggtgcaggggatgggactgtgcattcgcatcatcccattgccgaccaggtcctggggcggcctgggcactggaggcatacacgtccctcctgcccggcctcccaaccctccatcctgccgcaagtcccaaccttgccttggtccccacgttgaatgttccctctcttctcctcccccccaccgattccccggccccctccactcctctcactcnnnnnnnnnngctgcccggcctcccaaccctccatactgccgcaagtcccacccttgccttggtccccacgttggatgttccctctcttctccacccccccccaccaccaattccccggcc

SEQ ID NO: 47060 - DNA, 107 bp, Chlorella protothecoides
ggcctcggccgagcgccagcctcccccgcaccgagggtggggcgtccaagaacaagcttagttttgcgacggcatcaaccccaaatgtatgctttatgtaatctaca

SEQ ID NO: 47061 - DNA, 163 bp, Chlorella protothecoides
tgttgaccgggattgaacagatgggtgcaggtccttgtgcgatatcccgtgcgtctcctggtgccatcacagcctcgtgctgcggcgggtgtcccatcgccagcacgtgcaatgggcagggcaacacacctgatcatgtgcatggcaaacctgcggccacagg

SEQ ID NO: 47062 - DNA, 10746 bp, Chlorella protothecoides
  modified_base (110)..(119): a, c, t, g, unknown or other
  modified_base (396)..(405): a, c, t, g, unknown or other
  modified_base (931)..(940): a, c, t, g, unknown or other
  modified_base (1041)..(1050): a, c, t, g, unknown or other
  modified_base (1351)..(1483): a, c, t, g, unknown or other
  modified_base (2096)..(2105): a, c, t, g, unknown or other
  modified_base (2158)..(2373): a, c, t, g, unknown or other
  modified_base (2474)..(2483): a, c, t, g, unknown or other
  modified_base (2659)..(2799): a, c, t, g, unknown or other
  modified_base (2876)..(2885): a, c, t, g, unknown or other
  modified_base (3859)..(3868): a, c, t, g, unknown or other
  modified_base (4052)..(4061): a, c, t, g, unknown or other
  modified_base (4371)..(4380): a, c, t, g, unknown or other
  modified_base (6212)..(6288): a, c, t, g, unknown or other
  modified_base (6420)..(6429): a, c, t, g, unknown or other
  modified_base (7121)..(7130): a, c, t, g, unknown or other
  modified_base (8986)..(8995): a, c, t, g, unknown or other
  modified_base (9548)..(9557): a, c, t, g, unknown or other
  modified_base (9856)..(9865): a, c, t, g, unknown or other
  modified_base (10140)..(10149): a, c, t, g, unknown or other
  modified_base (10490)..(10646): a, c, t, g, unknown or other
cgcagcggcagctggacgggcgccggcccgacgcagcgccagctggcgggcatgcccgacccgggccccgacggcgtggccgtgcccggagtctgaagttccgaggctgnnnnnnnnnngcgcagcgccagctggcgggcgttcccgacccgggccccgacggcgtgcccgtgcccggagtctgaagttccgaggctgcgcaccgccccagaagtagctttgcggcgtgcggggtcgacgcgggcgctcccccgcccaggaatatccctcgcccaccttcggggttgcgctttccaggtgccctttcccccggcgtcattcccggctgctccctggccaagagcactcaacctccccccgtcttgggtcgactgtgccatgccccgatgcaagccnnnnnnnnnnttccctcgcgcaccttcgggactgcgcttgccaggtgcccttcccccccgcgcgtcattcccggctgctccctggccaggagcactgaacctccccccgtctaaggtcgactgtgccatgccccgatgcaagccgatctgccccagctgaggaagctctgtggatcacagcatgagtaagagatgcagggccccgggcgaggatgtcagacctcagttggttgcacgtagggcacccagctgggcagctgcactctggggatgacgacagcccatcctgcgaccaccccagggacgaccttgataccaattcctccttgggaaggaggtttccagaatgggtgggtactcttcggacaccaaaggcactgtgaggggtcctctgtaaggtggggatcccctgaaccccaactactgaatccggcaccgcctccacttctgcgcatttcacttctcctccccgtcgttcttgtgcttcagttggagttagcaaaataatcacgtacatatcacccccttcccacccnnnnnnnnnnaggacccgacctatccataaagctgtcggcatggtgcccacccctttctcgatgaaccagctgcctattctcattacaggacggtctgaagaaggacatcnnnnnnnnnncccccgtcgttcttgtgcttcagttgaggtagcaaaagaatcacgtacatatcacccccttcccaccccccacacaccctccttcaagctgctgctgtgcccagatcccgacgtcgtccgccaccgcttccaagaatcgcatcctctggtgttcgtccccgtctcgaagtcgatggtatacattcgaaatggctcagtgagaccatggtattgatgtggtggactttcatgatcgtcagtgcctggtcgaaccaggtttgactgctgcccaggcaggacaggtcagcaccgactccgaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagggtagtggccttgttcgatgctattgagcaattgtcaaggtgagcatggagatttggggacggactcttctacccatttttgctcggcgtggaagtattttcactctttacgcgaccacctacctgtcgttccgacgcctatatcgaatttatcatcccacagtagagagtcgtgtggggcaagtacgcgtcaaagcccgtcttctgccgagattccgcccacatcagacccagacgcgccacgtcatcgtgagtacccagagcatacagattgaattactgactgaggagactggtggtgtctcgtggggatcctggtcgggagccggtgacagtgtgttgtgtgtgtgaagacctggcattcgcccacaccttgggtagtctgtccctttcatggatgtggtggctcagcatcaggacccctacctgccacaggaagctacctggcaacaaggggcgggggccgaacgactgggacccgtcacaggggacagggtggaccaaagtccagtaaaaagccacaagagcgtgcaaggaacaggtcccggacctgcccaactacgaggaaatgcatgttccggccaagcgtaatctgctgtggacgcagcannnnnnnnnntcctggcattcggccacacctcggtagtctgtccctttcatggatgtggtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcccagaggcggccgactggaggcagctgctgctgccacaggaatccgaaggtgagggggtgtatggtagagtgtgccgctgtcctcgggaaggtagtnnnnnnnnnnatgcacacaccctgtccctcaacggcacctatgctgccccttacggcgtcgcggcggcacttcctccggggctggcgctggactatgggccctccacgccgcgaccaattgccgcctccagccaggtgattcaatgcggataaaagagggtgatcacctgtggccgcattgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaggaagaacaccacagagccgtgggcaaggcacccgcacttgtgggtgccgctgatgtgcaagctgctggcatcnnnnnnnnnnaccccagtggcggccgactggaggcagctgctgctgccgcaggaatcccaaggtgggggggtgtatcggagagtgtgccgctgtcctcgggaaggtagtgtggttctaccgctgacatcatcaggacgcccaactgttaggatggtgggatgagtagaacaattgtctgggtgcaatcccttgtatctgttgccagccatgtcgctctcttcaccccgcccattctttgcagtggctctggtgcacataccctgtccctcaacggcacctatggtgccccttacggcgtcgcggcggcatttcctccggggctggcgcttgactacgggccctccacgccgcgaccaactgccgcctccagccaggtgattcgatgcggattaaggagggtgatcacctgtggccgcattgggggtacatgatgagatggttttattttcgtgatgtgtgtgacatctgggtctggatgacacaaggccacttgacaggatcagttggcgaggaagaacaccacagatccgtgggcatggtacccgcatttgtaggtgccgctgatgtgcaagctgctggcatcgcaggaggccacgcaggtcgccgcgactgggccgggagcagctgccatgggcgtgcctccgccgcctgccgatgcacctggcaagcagacaggcgttaacttgccgaagcaagggaacaacaccagggtgagtctgggggctgatgtggatgtgactttgtggtgctctccctggtggtggttccgcagtctttcaacatggtgtggcacgggtctgtggtagaggcctgtgcctgtgctgcaacaccaacacgccaacctcgtgcctctcctgtcggtgcacaggctgtcgcgctgtatgaggccgcccgagagaggacgagggagcaccgaagggccgagtgggcgaggaagaagctggagaaaatagagaggagggttgcgatcaacaagcgcatgnnnnnnnnnnaaccaaagggccgagcgggcgaggaagaagctggagaaaaaggagaggagggttgcgatcaacaagcgcatggacgcggagtgtgcgggtttatttcaggagctccgtattgtgcgcagggccaggggccgtggcggcaggggcgccaagggacagagcgccggcgacgggagtggcggcgacnnnnnnnnnncggcgtcaggggcgccaagggccagagcgccggcgacgggagtggcggcgatggtaataacgccagctgtggcgccagcgtgggtgcggcacccacccaggccgtgaagcgattgccttgtagatccccaccacatctcatattgagtcacccttgcaaatcggtcatgttggggtgcggtgctgtgttcctcaccgtatggccagccaaaggtggagcgcggcgtggataaggatggagccaggtgccctggaggcctgcctcgctctttcgtgacaacatttcgaggatgcctttcaatgcggccctnnnnnnnnnntggccctgaagcgattgccttgcagatccccaccacatctcatattgattcacccttgcaaatcggtcatgttggggtgcgctgctgtgttcctcaccgtatggccagccaagggtggagcgcggcgtggataaggatgcagtcaggtgccctgaaggcctgcctcgctctttcgtgacagcatttcgaggatgcctttcaatgcggccctttttatcatacatggtgtatgcgacggggcgcaacactccgagggggatctgtgtgagcgtagccttacgatgggcgcgccacacggactgcacaccatcagaaggcccgcgaagggcaccgtcgcaccgtaaggccccgggtcctatgtagattcattccatgaattcaccatccagcatcgctgctggcatgcatgatctcctttcatgtcgagcaacttttagaaacgagctgtgactaggtttgtaggcggcatggcctcatctcgacatgcacaactttcacactacagatagcaggctttcgatggggcatggatgtccctttgagttttcagtcggagatggagccgacaatgtcattatgcgatgtgtatccattccgaagccaccagaatctgtacgagtgccctcaggacagagcgagcgagggacaacaatgtgttcgcttggccccggaactgcctcgatattgaattgggtccgataaaagctatgctggcctcgtcgtccctggggatggggcatcctgggcttcgccctgcttcgcgcacaggtcctcaccagaggggtagctcaaccgtcgaatagaaaccaggaaactgttgatgggtcttggacggtgcaatcatgggagtggcacatgtaggtcgacgcgtgctgttcctacgttatcgcattgtagaaggtgtctggcttccaaccccaggctccgaggctccgttcgcgctataccagcccccccccgcgctaagatctgcacagctgcgggtgcaccccttgccgacggttgcagccgagtcagtgaattcggcagcaaaggatcccctccgagagctgtttccaattcctgagtgaagagatagggccctgtgttcgtccaacgcgccgtctgcagccctctacgaggctccggggccagtcctcggacgttgatacgggtcactagcaaccgtgcgccgacccgccgctgtgcacaacggccccctgtgggcctctccttggccctagaaagctccccataggtgcggggtgtggatgacagtacgggttgcgccgcgtcggcggttatgctggcagtccatcatgtcggcccccagacgacaggcggtcgtgcagccccgctgcccgatcgagtccctgcgcgttccgcctccccgagctccagctcgagccatgcatccctcaaatcgaatcccatcgcaccctccatgtcgcagatcttggccgagcgacggccggcccctgggcccagtagatacccaggaccacaggcatgggagccacaggaacctcctccacccccgacgggagccaggacgggcggtacggctcccccgatcgccgcgctggtgccgcggcgggcatggcccccgacacgccttttgcccagggccagacgcccctgcgccccgacagcagcgcgggcgcctcccccgcgccctcgtcgctgggccatggcccgggcaccccgggcctcccccctccccacccgcacactggggagtttcaggggagcctgaggcgtatgaccaacaacctgatggagatgtttgaccagatgtccagcaagagtgaggaagggctgttgtggtttttttttggggggggggggggggnnnnnnnnnnnnnnnnnnnnnnnnnnnnnnnnnnnnnnnnnnnnnnnnnnnnnnnnnnnnnnnnnnnnnnnnnnnnngttgcagtcactgccccggcctttagcgcggctaagagggtggcgagattgtcctgtcccttcaagactcacaaccagcggccctgttaatagtcatctatgccgccttggtgccggcagctggctcagccnnnnnnnnnngaccagcggccctgctgatggtcatctgcgccgccttggtgccggcagctggctcagcccactcccagtggtccagctcaccgaccgcttcccctcctgaaccccctcgcccccctcccttcccccccaggcgtgttgccaagcggagcgggcggctctgccatcggccaacgcggtgacagcgtggccaccatcgccgacctggagagtggcgaccccaagcccgcgggcgacgccgagtccatgaaccctgttcagatgcggcggctgaccacggggatcgtggacgtgctgcgccagctgcaggccagcggcggcgcgggcgcggtggaggaccccgagatcgtggtcgcccggcaccgcctgggcctgggcaaggacgacgtcctcctgcccgacaacgtgtccgagctgagcctggacgacaaactgagcctgatctcaggcggcacctccacctccggcaaggagagctattcctcgctcaacagccacacggccctgctcaagggctggggcggcctgaagaccgacgaggattacaagggtgagtcgggggccgggggaaaggcgggggggtgagctgcaggacctgtcagcaagcgagggcctccatttgtcaacggttttttgcgtatccacctgtaactggtggccctcgtttgcatcaacaccaccacccgcccgtcgcnnnnnnnnnnggggtttttgcgtacccacctgtagctggtggccctcatttgcatcaacaccaccacccgcccgtcgccaccctgtgctcgtgcgatgcactttctccccccccttagccaccaccccacctccgaacctccacaggcgacaccgtgcacccctggtatgtggacctggccacccacacctcctccctccgcgacggcgacggcgacgccacgcccaagcctggcgcggatgacggcgaccacggtgtgcccaccttcatgcagaagcagcgcaagatcaacatctggggcacctgcgtcgccgtcatcttcttctgcgccttcttcttctacgtcggcatccgcatcaagtacaccctgggcctgggcagcctgctctggtgagttttgcggatgggtggggaggaggggaggtgggggctggatgtccctgtcttgctggcctggccaaggggggttgtggcgggccgggaggttaggtgccggcgcgagcgtcccccacccggcgcagacctttccccacccccacttcttgcccttccccaacctcactccccacccctcactgacctcccttcccccccactccctctcacccctccctctcctaggtatggcatcttggtgctggccgtggagatgatcggcgggctggcccagatgccgtacgcggtgtgcctgacgatgcgcgtggtcaactgccgcccgcccgcgcccgacgagaagggcgtggtgcgcacgctggcgccctaccacatccgcgtgctcatcccgtgctacaaggagccgctggacgtggtgtccaagacggtcatggcggccctgttcgccaccgtccccgccaactgccagcgcacggtgtacctgctggacgacgggcgcgaccccgagaagcgcaagttcatccactccctgcgcgtgcccaacgcggtgtatgtctccgggcgcaagcgcgcgcccggcgagatgaacggcaagtcggccaacatcaacaacgcggcgcgcgcgctgtaccccggcgacggcgcggccatccccctgaccgaggtgctgtgcgtgtttgatgcggaccaggtgcccaacgccgacttctaccagaagatggtgcccatgctggacggcgggcaggacgtgggcatggtgctgagcccgcagaccttctacaatctgaacccggagggcgacgtgttcaaccacgccaacgtgcacttctgggactacacccagcccgggtacgacgcgctgggcctgatctcctgcacgggaaccaactttctggtgcgcgcgcgtgccttcgccgacgcaggctggttcccggagtggacgctgaccgaggatttcgcgctgggcatcgagctgaagcggcgctactggcagtgccggtacgtgcaggaatacctggccatcggcgaggcgcccgacgacgtgcgcaattgcttccagcagcgctcgcgctggtccaagggtcacttccagaccttcttctcgcgccacaacccggtgatccagagcgggctcagccccctcatgcgctggatgtacggctcggtcatcctggcctacttctccgccttcctgggcacgcccctgctcatgctggtgcccatgatcaccgtctggttcggctccttccccatcgtcatcaacttctgggcagcggtgtgcatcacggtctactatggggcgacgctcctgctcaactactacacccactcctttgggcatctgaaggtgtggcagtgtgttgttgggttgggatttttctttttgggggggggatgggtttgagagggactgctcactagatcttgatatcagaggagtgcagcacggtcgtccttgtcgatgctggctcnnnnnnnnnnaacgctcctcctcaactactacacccactcccttgggcatctgaaggtgcggcagtgtgttgttaggttgggattttctttggggggggaatgggtttgagggggggactgctcactagaccttaatatcagaggagtacagcacggttgtccttgtcgatactggctctgcactgcctcatgcacctcagacggcccacacccggctcacacaacccccgggctcacataacccccccccggctcgcataaccccccggctcacataaccccccggctcacataaccctcaactccccttacccctcaacacgcacagtcgatgtggttcaccggcgtgtccaactgcatcctgtggtatgccttcctgaaggccatgtaccgctccaccctgggccgctacatcgacggctccatcgtgttcaaggtcacggccaagggcctgcagcgcatgggcgccctccccctgcgcgacgtctggatggccgccttcttcttcgtcaccatgatcgtcaccctcatcttcggcctgatccactacagccgcggcccnnnnnnnnnnctccacccccctcgtcatctccctcatcttcatggccctgaacctggtgcccaactacctcctgctccaggtgtgtgatgggttcggtgggcggggctcggtgtgaagatcagggcctgtgccctcaggacagggtgttgcccctggagatgctcggggctcggtcatcggtgcccaatgcctcgtcgcccatgcccacccctgcttccaccgccgcaccacacgccctcgcgccgcccaccgaccgccacccacccactcaacgcacgccccaccctcgtccccaccccccagtacgnnnnnnnnnntcgcgccggccaccctcacgccgaccacccacccaccgcccatcgaccgctatccacccactcaacgcatgccccaccctcgtccccaccccccagtacgcgctgttccggcggcccgccttcttcaacatcgtgtgccgcgtgtgcatgctgctgatgaccttcctcaccatcttcggcatcgtcctggtctgggtgctctacccacgctcctacaacttccccgccgccgtcaactcctcggtggtgttcatgaacacccagcgcgtcggcgnnnnnnnnnntctggtctgggtgctctacccgcgctcctacaacttccccgctgccgtcaactcctcgctggtgttcatgaacacccagcgcgtcggcgcgctgcccaacgacctgggcgtctcctggcgcggctccgcgctcacccaggaggcttcctgcgtggtctgggtggcctacaactccacggtcagcggcagccaggggaccaatttcccaccgccgccccccgccgccacgcccagcggctcgctctcgcccggcctgtcggtcttcccgccccccgcattggcggtcagccctggcgtggcgacgagccccggcgtggcgacgagccccggcgtggcgacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccggcgccgcctgctggacaacccatttgtcatcctgacttctccgccccccggcaccctccccagcgtgttcccgccgccgcggtcgtcgccgccgc

SEQ ID NO: 47063 - DNA, 61 bp, Chlorella protothecoides
aggtcatgaattcaattgagtggctgctgggggctctttaggaagcatgcggagtgcaggc

SEQ ID NO: 47064 - DNA, 71 bp, Chlorella protothecoides
cgttgtgtgcatcacacagggttccttcccactcattctggcagccagcccgacagccctcctcccacatg

SEQ ID NO: 47065 - DNA, 71 bp, Chlorella protothecoides
gcagcttccacccagcctgcacgcccagggtgtttggtgtgtggcactcagttgggtgccaaggcatgagg

SEQ ID NO: 47066 - DNA, 85 bp, Chlorella protothecoides
ttggtcgcgacgccatctgaagccacgggcaccggcggtggctggatgtttagactgcgctccggctgacgggggggtgtccccg

SEQ ID NO: 47067 - DNA, 61 bp, Chlorella protothecoides
atgccctgtgaggactgggcgcttttccatcccctgtttcctcgctgctgctcctccaacc

SEQ ID NO: 47068 - DNA, 61 bp, Chlorella protothecoides
gagtatagatgagtgcagtacactggagggggatcacagtgtcacatggtagtgtgtaagc

SEQ ID NO: 47069 - DNA, 61 bp, Chlorella protothecoides
cacgacgaggacaccaggcagtgccaccgtttgtcttcctgggtgacggacaagctgacgg

SEQ ID NO: 47070 - DNA, 7054 bp, Chlorella protothecoides
  modified_base (938)..(947): a, c, t, g, unknown or other
  modified_base (1240)..(1249): a, c, t, g, unknown or other
  modified_base (1467)..(1476): a, c, t, g, unknown or other
  modified_base (2530)..(2539): a, c, t, g, unknown or other
  modified_base (3420)..(3429): a, c, t, g, unknown or other
  modified_base (3708)..(3717): a, c, t, g, unknown or other
  modified_base (3798)..(4046): a, c, t, g, unknown or other
  modified_base (4750)..(4759): a, c, t, g, unknown or other
  modified_base (5704)..(5713): a, c, t, g, unknown or other
  modified_base (5890)..(5899): a, c, t, g, unknown or other
  modified_base (6348)..(6357): a, c, t, g, unknown or other
  modified_base (6544)..(6553): a, c, t, g, unknown or other
  modified_base (6608)..(6617): a, c, t, g, unknown or other
gcccccacccagcccccctccccccgccacgatgctgggctcagtgtacttcaccggcctgacaacagttaccgtggacatcacatacgtcgtcaccaccgtcggctacaccgccgcccgcctgcagtgcatgattgtgtcccacagcctgggctacctgcacagccaggcaaacttcaaccccagccagaccacggtcctctacgccgtggcccaggtgcgttccatcgcaacaggctactgggcggccgcctgctcggccctgaacgccgacgacaaggtcctggacagcgtctacctgacgctgggcaccgcgaccccgccgcccccgcccccccccgctgccgcgtgctccagcgtggtccccgtggacgacagcaccggcgcctgctccgactacacccgctacctggtcctgtgcctggaggggtcggcgctgaccgccaggtgcgccgcggggaccgtgacgcgcaacctgcccacctgccccacctcggggctcgctcgtacggtcgggggacgctgccccgacgccagcacgcccaacctgggcctctgcttctccttcgacagcgcccaggagaccgtgcagtgcttccccgtgccgtcgccgccgccggaccccgcctcgccgccgccgccgccacccccgccctcgccaccccccgcgctccccgccctctccgggacggtggcgaaggtcaaggcacgcttcaccctcaccgtctcctcctcaggccccgccccctccagcgtcaactacggcttcttcaccacggcgggggtggtgcaggccatcggatcggggccctacaacgtcgccacccccaccatcgtagacctcaacgagggggacgccgacgttgtgtcctatgtgcaggccgtcgccgtggacgttgctggcagctcctcggcagcggtcacgctggtgtgggtgnnnnnnnnnngccatcggatcggggccctacgacgccgccaaccccaccaccgtagacctcaacgagggggacgccgccgtcgtgtcctacgtgcaggccgtcgccgtggacgtcgctgccagatcctcggcagcggtcacgctggtgtgggtgtagcaggggggctggcccagcgccagctgggtgttgagtccgcccttggacggccacgaggtcgattcaaacgccagcatggatgtccccagaccctgaccgcccctcccgtgccttgaagctgagcaagatgttctatacctcaaacnnnnnnnnnntagaccctgaccgcctctcccatgccttaaagctgagcaagatgttctatacctcaaaccttgcatgttgaataccgaccatagctgtactcactgcaccaggaatgcctgaatgccagtgccggctcgtgaattatgtggtgcggtccccctctccgtggggaggctagggctggcatgatggcttcaaggtcgtcggggctcccgtaatccatggnnnnnnnnnnttcatgtggtgcggtcccccctctccgtagggaggctagggctagcatgatggctccaaggtcgtcggggctcccgtaatccatggacgaccaccacgccttcctgcactccctcccaggacctccgcagtgccatgtcgtcctccagatgtcggagccctcattgaattggctacccgacgcgctcaccgcagctcaggagtgcctggtgtgttccatcatgacccacatgatggcagcatctgctactcctggatagctctcaataccggcctctgacaatctcgtgcgatgtgcgctgttatgactatttgatccctagtaagatgtcgcgccccgactagccctgctcgcacgacctctgacgacatgttggttcgcaggctggttcccctgcctgccgccgggtgcacgctcgccgcgcccagtcctcgcttcaggcacgcggcgaccttcgcccgacggcacggctcctcctcggggctgctggaggagctggatcgcgaggtggatcgggccctcgagcgcgcgacgcgggccacggtgacttggacccccctggccacgggcttcgtctcccccgccgtcaccgccgccgtggtgtcggccctcagcacctccgcggacacgggggtgataccctggggcggctatccacaggccgagcgcgccaggctgctgctggggccgcgagacatgctggatgtgtgggcgggggaacccgccggcgcgccctggccgccgcccccgccgcccatccagatcctgcacgtgcgcggcaacttcctgttcgaccccggcaggcacgccgacttcctgggcgccgtgctggggactggcatcgagcgcagcatggtgggggacgtggtgggggtgggcgacaggggggcccatgtctttgtcagctccagcattgtcccccacctggaggccagcctgacccaggcaaggaggttttgggggagtggaagggatttgaactatggatgagagggaatgagggtttgagggtggtgtctgctgggccgaggcttcgacgctgtgtccaagtgannnnnnnnnnggggggagtggaaggggtttgaaccatgtatccgaaggaaggagggtttgagggtggtgcctgcctggccgaggcttcgacgctgtgtccaagtgatcgcggctgccatcctcgctcgcccctcgtatggcccctgcactgcatggctccgacccctcagcacgtgtgcctccaccctttaccgcgctttcaacccctatactctcagggacgcctccctcgcctcacaccttcccctcccccccccttcaataccccccaggtgcgaagcgtccccgtgaccctctccctcacggaccttgctgacctggcgctgccccccccgcgaatcagggaggtgtccagcgtggaggcctccctgcgcctggactccatcctgtcggcgggcctacgcctcagccgctccaaggcagcagacctcgtgcgccagggctccgtgcgggtgaactggcgccccgtggccaagcccagcgtggagctgagcgcgggggacatcatctcctgctctggcaaggggcggctggtgctgcgcgatgcgcagcccaccgccaagggccgctggcgcgtgaccatgacgcagaccgtgtgagaggcgggaatggtgcgagacggcgggcgggcctgtcggcgtcgtgggggggagcatgggggtccagggctccagttgttggtatgagccattccgcagggcgggtgcccctcaattagatgctccttgctgtaaaacacatgcggatggtcgacgtctccctttgctttcacacaagccacatgcacacattgtgcccctcgcctggcccctttctccctgcccgtcagcatcggtggtgcctgttgctgctgtaacacaggcccaaacagcagcagcatgtccgacatcnnnnnnnnnncagacgctccttgctgaaaaagacgtgcgggtggtcgacttctccctctgctttcacacaagccccatgcacacagcgtgcccctggcccttcctccttgcccgtcagcatcggtgatgcctgttgctgctgtaacacgggcccaaacagcagcagcatgtccgacatctcactccaccggcggctggtggctcgccgcgtggctcgacgcgggggccgtcgcagccggcgcccctcgcaccagatcagcgacgggcgcctcggccgcgggctcggccnnnnnnnnnntcgggcctgtcggcgtcgtggggggcagcgcggcggtccagggctccaggtgttggtatgagccattccgcagggcgggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggccggtgcccctcgcgccagatcggcgacgggcgcctcggccgcgggctcggccggaggattggcctgttccggcgcaggcgcggccaggaccgggagcgggtaccgcgctagcacagtgcgcaggctggcttccagcttggacgcgcgctcggggtcgatggcgcggggcgccggggtgtcctgtgcaagatcagttggggacgtggcgtcgtgtctcggctcgaccgggtcggaggcccctgccctgctgagctccagcgctgcatgcggtggggggatgtgtgggctgagcgcgatgtcaggccgccctgtatgacgggctcttgagtgggaacaggggaattgtcagggtccagggccagcctcccgccgctgcccaggtcgcaggtaccacgagcactatcgccgggatactctgcacgccatacctgctatgcatgggtgcagatcctcctgcatcgctgtaaaggccgcctgcatgctgaaccgacacctggcctgcgatgaaggggcacagagtgtgtgaagccgcgggccgatggcacgggtgcagtaaaagcgctgtggctggaaataaagtgccagatgcgagattctgactgggaggaggaccttgctccctatggagacgccacacagtgaccaacgccggcacccccaggagccagactgtcaagtccctttcatacccccttgtcaannnnnnnnnncggcacgggtgcagtgaaagggctgtggctggaaacaaagtgccagatgcgggattctgactgggaggaggaccttgctccctgtggagacgccacacagtgactaacaacggcacccccgagagacagaatgtcaagtccctttcatacccccttgtcaaggccagcacgctgtttcacacccgcagtgcatgtccagggcgctggcaagcctcccagccatcagtcccccaaacccctgtaacaccgcgcatggcgccgccaccgtcgcctcgcctcaccatgcggttggtgagcgcagcgtgcagagcgggggcctggtacacggtgccatccagcacgtagtagaccgcctgtggggcggcaggggccgacggcgcggcgcggtgctggcggcagatgacaaagaggtggggcggctgggagtcccgcagcacgtactcgatgccgggcgcgaggatgctgaggagggtgtgggccgggagtggcgggcagtgagagccatgcagaggcacaggctctcagggatttgggtgccaggcattattggagccccaggcctcacatcggccccacactgatcgactagcatccacccagggtccactggccaaccaagtgctgatccaacctacgcgagctgtgtgagctccaggccttgctgcttggcaccctcattgctgcagttcttgtcgtagaaagggctcagggagaagtagtcgaggatgttcagcgggctgatgccgtacgcctgaagccagaggtcgtccctccagctggtgtgggtgaggtcgaggccagagtcccccatcgatgctgctgagcttcagtcatcatggaggtggagggaccgtgacattgtttgaatccagggttaccgaaattgcgcatttcgaggttaacggcgcgagaatttcggggaaattccattctcgagtttcgacnnnnnnnnnngtcaagctgacatggcagtagcccatcggggcctggcacacccagcgcacagtgagcatggtgtggggggctgagcaagtgcggaaataagcgcagcgtgcgcgcaaaatgcatctttagtcaggaccaatacgttcacagcacgttacagaggaggctttccattgaaagtgcaannnnnnnnnnaggggctgagcaagtgtgaaaataagcgcagcgtgcgcaaaatgcaacttgagtcagtaccaatacgttcacagcacgttacagagtgggctttccattgaaagtgcaatggatctggtatacatctatgccaactcccgctttctgcatgccatagacagaacttggcgcttgagtgagctcttccacgatgggtatctcctggacgatggcgtgctatctctgaggcagatgaagacactcaattggccaagcatgtttacccctcgcccaccctctttcaaccacccctcttgcacgaagcgcctgatgcaatatagccctttttttatctggcggggttttcagctcgaaaaatttcggagcataatcgaagtttgccatttttccattttcggtaacctgtgggccggcgaggtacgctctaggagtcccagatcgcgcgggannnnnnnnnntttcttatttggcggggttttcagctcgaagattttcggagcattatcgaaggtttccatttttccattttcggtgaccctgtgggccggcgaggtacgctccaggagttccagatcgcgcgggatctatattagtgaaatcccaacgacagatcgccgacaccccccccccccccccccccccccnnnnnnnnnnatcggagggccccttcaccagggtcgacatagtggccgccaaggccacagtccannnnnnnnnngactgtttattcacattcaaaattctcaaatcaattgcagacaatgtgcggcgttcccccgttattcgaaccatcgaagggccccttcaccacggccgacatagtggccgccaaggccacagtccactgtacctactacaataagcctgtggcgcaggcaaccattcctccggagcgcgtgtatgacttcctgcacggcgagggccgcatggtccaaacgtccttccatcggaaagcccaccccgcaacccaggttcgaattcgaatcatctccatcggtggcctcgtgtgatgagcttgcagccgatccctttccgctgcacccagtcccagctcattataatatacacagcactcattgtcaaccaagtaatataggtgcgcccgtggtcctataaagcccaggcagctgacgaaaagggcgtcgccagccagcg

SEQ ID NO: 47071 - DNA, 61 bp, Chlorella protothecoides
gcggaggtggcggcatccactatggcgggggccacgcccgccaccgcagcgtcgtcggtgg

SEQ ID NO: 47072 - DNA, 67 bp, Chlorella protothecoides
ccgcccgcccgcctgcatgcctgtgagggccgggcccgtcgtttgctgaccgggacccctcccccag

SEQ ID NO: 47073 - DNA, 61 bp, Chlorella protothecoides
cctgagcgccctcggggcggtgctgcacgtaggtggctccctgctcatcgtggtgggccag

SEQ ID NO: 47074 - DNA, 61 bp, Chlorella protothecoides
gcaggtggggcaatggcagcggtggggggggcctggaggggcccagctggggcggccgccg

SEQ ID NO: 47075 - DNA, 66 bp, Chlorella protothecoides
aaagctgtcggggaggtggtcgggaaagggcgcggttctcatgtgaagggtgaggtgaggcaagat

SEQ ID NO: 47076 - DNA, 95 bp, Chlorella protothecoides
ggccatgaccatgaacatggtctgggctgtgctgaccccatccctgtcatcggcatcctccctttccttgcgccggacgtgtcgcaacgcatgtg

SEQ ID NO: 47077 - DNA, 61 bp, Chlorella protothecoides
cctctccaagccccgaggagtcgccctctctgagccccgaggagtcgccctctccgagccc

SEQ ID NO: 47078 - DNA, 61 bp, Chlorella protothecoides
ggaagtggaacgccaccggcccctgcgccatgccgccgctcgctcgtgcgccccgccctgc

SEQ ID NO: 47079 - DNA, 516 bp, Chlorella protothecoides
  modified_base (200)..(446): a, c, t, g, unknown or other
gggcgtgtggccccggtctggcggaggctgacaccggtccctgccccaaacctgcccgcggggcacatggaatggggactcccatggagcccagcagtcttgactgcaaggttgcccatcaccccgccacgctcctctcctccgtccacacccccaatcccacccttctctcacacagagtactacctggaggatgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacaaagtggtgcgccagctgcgctcctcacgccaacccctgcacgtgctgcccctccacggtggcctg

SEQ ID NO: 47080 - DNA, 77 bp, Chlorella protothecoides
gatcatcagagcacctgtcaggcatgcttgaagtgcagggtgcccatccgccaaacctgtgtcgggcattgcgccca

SEQ ID NO: 47081 - DNA, 61 bp, Chlorella protothecoides
gcttgctggagctggggcgttcccacccgcaccccccctcctcctgcctttccaggtgagc

SEQ ID NO: 47082 - DNA, 95 bp, Chlorella protothecoides
catgaagtccagctgcagcccaaacctggggcatggtgggcggaggtgggtggggatgaggatgggggcaaaagatggaattggtggctgagcag

SEQ ID NO: 47083 - DNA, 68 bp, Chlorella protothecoides
caagcctgggagcgtgttcctccaggcaaccctctccccacacgctcccatcgacaacaggcggcgaa

SEQ ID NO: 47084 - DNA, 72 bp, Chlorella protothecoides
cgcgtcagcaactttgactacctcatgcacctgaaccgcgaagcggggcgctccttcaacgacctcacccag

SEQ ID NO: 47085 - DNA, 65 bp, Chlorella protothecoides
aggaaggtggcgaggcctgggcggtgccatttaagcgtggtcctgccgtacctcaaactctcggg

SEQ ID NO: 47086 - DNA, 76 bp, Chlorella protothecoides
cctctctcgccaggggtgcggcatccgagacgcaccccgcggggcccgacccgccaccccccaccctccatgccgc

SEQ ID NO: 47087 - DNA, 61 bp, Chlorella protothecoides
ggcaacgcccaggcccaggccctggacctccccgctcggctgcgggccctcagccgccgag

SEQ ID NO: 47088 - DNA, 61 bp, Chlorella protothecoides
gggaaagggaggtgcagaggcaatggcgggtgggcccttggaggatggctgtgctgatcaa

SEQ ID NO: 47089 - DNA, 61 bp, Chlorella protothecoides
gccgcgccaccacgaggtggacgtggcgggggttgtggcgcgcggcacggccgccgcgctg

SEQ ID NO: 47090 - DNA, 408 bp, Chlorella protothecoides
  modified_base (115)..(313): a, c, t, g, unknown or other
gcgcacaggccgccacgctgcagcgcggcgccgcgctgctggcgcgcagcgtccaggtcagcgtgcgcgaggtacgcgtgcggtacgtgcaggcgggcgagcccgggccccgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgaggacggcatgggcccctggcacgacgcgggggcggccgcagaccctctggccggccgcgcgccggcggaggtcgcgcggtccgccttccg

SEQ ID NO: 47091 - DNA, 78 bp, Chlorella protothecoides
ggtccctgcagcatgcatgctctgctctggtgaggcttcagcacccatacatgcacaagcactgcctccgagggtccc

SEQ ID NO: 47092 - DNA, 61 bp, Chlorella protothecoides
gcagcctctgactcggcagagggcggcgggtctccaacccccggcaatgcatggggcacag

SEQ ID NO: 47093 - DNA, 94 bp, Chlorella protothecoides
ctcctcctcctcctcctcctcctcgtcctcgtcctcctcgtcgccatcctcttcctccccctctccctcctcctcctcctcctcctcctcctcc

SEQ ID NO: 47094 - DNA, 1830 bp, Chlorella protothecoides
  modified_base (143)..(152): a, c, t, g, unknown or other
  modified_base (411)..(420): a, c, t, g, unknown or other
  modified_base (1511)..(1520): a, c, t, g, unknown or other
  modified_base (1583)..(1710): a, c, t, g, unknown or other
cgccgcgctgcgcggcctggccccggaagaaggcgtggcgctggagctcgaggccgaggagcgggccatgcgtgagtgcacgcccgccggcccgcccctcgtgtacatctctaagatgatctccgtcccagccaacgtcctgnnnnnnnnnngggcgtggcgctggagcttgaggccgaggagcgggccatgcgggagtgcacgcccgccggcccgcccctcgtctacatctccaagatgatctccgtcccagccaacgtcctgcccaggtgtttgtttgtattccctttttggggggctgggaagggaaggcagaatgggttctcttgcggcaggggtcgacggcagcttctgtagggggggggggtagagccatgttgggcaacggcggcgtcaggccccgacaaggannnnnnnnnngggggggctgggaaggaaaggcagaatgggttctctggcggcaggggtcgacggcagcttctttagaggggggagtaaagccatgtttggcaacggcggcgtcaggccccgacaaggactgcactgcacactaacactcatccgtgtcacccctcttctgttctcatccgttcatctcaggcaacccggcacagcacccagcgccgacccgagtcaagaaatcttcctcgcctttggccgcgtgtttgctggcacgctgcggaccggccaggccctctgcgtgctgcccgacacacacaacccggccgacccggccgcgatagccgccgcacgcagcgtcaccccctccgccctctacctgatgatggggcggggcctggagcccctcgccgccgtccccgccggcaacgtgctggcgctggcgggcctgggccaagccatcctgaagaccgccacgctggcgcccggcgcgcgggtgcgcccgctggcgcccctcctcttccaggccgcgcccatcgtgcgcgtggcggtggagccggccgacgccgccgacctggcggcgctggaggcggggctggccctgctcgcccgcgccgaccccatggtgcgcctggaggcgcgcgccagcggggagcgcgtgctttgcgccgcgggggaggtgcacctggagacgtgcgtgaaggacctggaggcgcgctttgctcgctgcaggatcatcgtgtcgccgcccctggtggccttcaggtgcaggggcggggtgcgggcggtcgctggatgagcccttggggggggggggaaggggccagggctgttcgtggatcggggcgcagggtcgttgcagagcagtgcaggctgtcctcctggtctgtctgcgcaagattgggcctgtcgtggtgtgggtcctagggttttcacccatcgatgctcctcagcgtcgatggggtccgagacttgcgactcccttcgtcctcctcctgaacagcccctgaccgcccctcccttccccctcctttccccccccaccggcatcgcaccagggagtcgctggcagcgcctgaggacgcggaggccgcccacacccccgcccccgnnnnnnnnnngtctgtctgcacaagattgggcctgtcgtggcgtgggtcctagggttttcacccatcgatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagcacgcccagcacgcccacggcccggtggtcgaggcggccacgcccacgggcgccgtggccctccgcctccgcgccttccccctgccctcgcccctggccggtgccctggaggcgga

SEQ ID NO: 47095 - DNA, 70 bp, Chlorella protothecoides
ggggaggtgccaggaggaggaaacacggcaccccccaagggtcggcccaccaggctcgcatgatgccctc

SEQ ID NO: 47096 - DNA, 62 bp, Chlorella protothecoides
agggctgggggaggggtgccccgtcaagggggcgcgcgggcactggagcggaaacagggggg

SEQ ID NO: 47097 - DNA, 136 bp, Chlorella protothecoides
gggggcgccgatgagtaatattcgagcttgtccaggggtgagtcagggggggtcctcctcggccgcctcatcctgcccgctctgggacgtcaatgctacaaaaacactccagtgagcgacaacttcagcgcatgac

SEQ ID NO: 47098 - DNA, 66 bp, Chlorella protothecoides
atatcgcaccaagggcggcccagctgcggccgggccctcgtctgcggcgccagctttatccccccc

SEQ ID NO: 47099 - DNA, 62 bp, Chlorella protothecoides
attgcaagtcagggatgtttgaggagagtggaatgcatgtcacggaggcgctcacagtccag

SEQ ID NO: 47100 - DNA, 80 bp, Chlorella protothecoides
aaacccggcgccctccagccgcctctggacggcgccggcaccggcacgaagggtcgatccagaagggcttcgtgcatgcc

SEQ ID NO: 47101 - DNA, 84 bp, Chlorella protothecoides
tgtgggagcccaggggtgtggcatggctggcgtgctcctgcccagacctcctgtgctgcagtggcatgggcctgtcgccttgca

SEQ ID NO: 47102 - DNA, 94 bp, Chlorella protothecoides
cgccgcgccgccgtgcagcagcgcgcgcctcggcgacccgggggcgccggcccggagcacgacggtgcccagcgccgactcctcgctggaccag

SEQ ID NO: 47103 - DNA, 9327 bp, Chlorella protothecoides
  modified_base (2778)..(2787): a, c, t, g, unknown or other
  modified_base (3657)..(3666): a, c, t, g, unknown or other
  modified_base (4071)..(4080): a, c, t, g, unknown or other
  modified_base (4168)..(4177): a, c, t, g, unknown or other
  modified_base (4483)..(4492): a, c, t, g, unknown or other
  modified_base (4982)..(4991): a, c, t, g, unknown or other
  modified_base (5292)..(5301): a, c, t, g, unknown or other
  modified_base (5704)..(5713): a, c, t, g, unknown or other
  modified_base (7449)..(7458): a, c, t, g, unknown or other
  modified_base (8007)..(8016): a, c, t, g, unknown or other
  modified_base (8858)..(8867): a, c, t, g, unknown or other
ctcgccgccggccccgccagcaccgcgatcgccgaggcgcctgcaatggccgccgccgccgcgggccccggcgccgccgagcccaggctcgcaaaggccaggcagcatcggacgtcgggcgtcggcccgcgccccggcccatacacgtaggcctcgcagggtgcgctgcccggatccagcgctgcggcgtcgcccgccagagcccggcgcagccatcgggaggctgccggcggcgcatcctccgcctccaggacagcgagcttccagggaatgacggtcggctcgggggccagaggggatggccggaccagcctcccagccatgctgccaacaagggccctgcggacgatggccggaaaatcctcggcgaccgccgcaggctcaggagccccagcctgggacctgccccagtgcagcaggcccggcagcgtgttgagggtgcgctgcaaggacatggggggcgttcaagggaggggcgatcggcgcaggcgcttggcgtgtcggacggagggcctcggcagagcgcagagcgcgctcgtttgccaccccggtccatgggcgatgagcctgagtctggcacccgtgctcattttccctccttcagatcatacaccagtccacaatgaatgcttcccacaccccctcgcgactggtctctctacttcgctcaccctcacaatgccgacgctgcaggccttgcgtgctgcacgccgggcggcctcctcacgaacaaaggcccgccatcgagcaaagtgcagcttctgcacggcggccgcacacttggatgcacgccgctcctggcgctccctctgtcggggagtgcgggttgcttgcggagtcggtggggaggggctgcaccatgtgctggatcccccaagccatcacacagtgcggagccggcacgagatctgaagcatgccgttctttggccacggcccagcgtctgcgcacctcaaccctggcctgttcctccctctgtcggcgagcttcggcctcggccgcctcccgcgccgcggcttctgcctgcactcgtcgtcgctccgcttcctcctcctgaccaccccagggaggaggagaggaatgaggcaccaagccgcaccaggacacaggaggcgtgggtgccaagggtgcgcgagcatgcatcatgaccgccaagggcaagagccccgccgattctgtatccacaggcgccccactcaaagcgctcccctccaagtgaagaaccccgcaggcgtacctctgccctgcgtcggcgctgcagctcctccaccctttgcctctctttggcagcagccgcggcagcccgcagctccgcctcccgggccgcggcagcggctgcacgctccgcttccattcgctgcctctcctctgcggcggcccgcagcagcgcttcctccctctggcgagccgccagctgtctggcagcctcttgtgcgaccctcgcctcctccgcccgccgccgctgctcctcctcctgccgccggccctcctcggcacgcagggccgcctcgtgccgtgcggcctcggcggcctccttcgcctgcagagccgctctccgggctgcctgttgctgggcatgcagagtctgccgggcgacttcttgagcctgagctgcaagcgctgcgctggcttcctgtgcagcacgctgatcttcgagctggcgcgcaaccgaggcctgcagcccttcgggagacagttgcacggacgccaccgcaccagagcggagcccagccgatttctcagagatacggtgggatggggcacgctgagttgggggagggggctccacaaactcaccctgtcatcacgggagggaagcagggttggcagtggggggtgagcgcatgtcatgtgaggattgaggccatggcaaaaggtgggtcaggcaaccaactggacgactgaaatcgcgcacacgcaacccttctagtcccctattggaagcacccctgaccgagtccccacatcaacaacatcgtgactacaacccgcagacacgttgccagggatcccaccttgacgaggagggcgcactgcacgccagcgccctcagtgccgattgcaaacccatgccgaacgacagtctttgccgcctcatcggctgtgtccatgtagagtagatcctgcagaccatgacagtggtggcaacattggcaccaccattggccagcctcgctgcatgcttgggcgaccgaaacagagcaaggagaaccccaaaggccaaggtgcggagcccagcatcccgtgctgcattgaatgtttcactaccaaagttgccccaccagggtaccttgagccagtccaggctggcggcagccgtcgtggaggaggaggggttgaaggagtctgccagagctctcagcgcccgagcacgaatctgggggatgaacggccaatcttttgaaggtcgaggggcagagtatgcaaggactggagatgcgcaggcacggcaatcaatcccttccacagatatcctgtgagtgcagcaagctgccagcgtgctcatgctttgtgccgccaccaggttgcagtttgatacacacacacacactccccgacctgaggaaagtagacatgtgccaggcaggccatgaggtatggcgcccggtccaccagagagaagaatgcgacgtagttgtcgcaggcgtaggctctctgccagtgtaacgggagagggggggttttcaggcagagggtttctggagcacgggggaataggtgtcagaggcgacatgagatcctcaaaacttggttcatccccatcctagaggaagccannnnnnnnnngacgggggggaggggggtggttcaggcagaggttttatggagcactggggaatgggtgtcagaggcgacgtgagatcctcaaagcttggttcatccccatcctagaggaagccacgttgagagtgatgcaggcaggtatctctgcagctctgaactcaacattctgatgccaggaaattacacagcaccacacactcatcccacggccaccccacctgtagttgcaggacccagaggatgggaggtgacgtcttcacttccgctcgcagcgcttgcaaggtggcgaggaaggcctgctggtcccccttgaacttgccgtgctgagccatgagagagagcaggtggtaagccctgaactccggctctgcaggaatgaggagggggttgctgtgggggctcgcatgcagtgacagggggcagacacattctcatgacctttgggcggcagggtgccttcaccctgaaccagcactggtcagctgtgacccagcgacagcgcggtcatcatggccgaagaggcctcaaaaactcactcaccagactgcactggctgccccttctctgcctgcgtctcatacatgtcactcaaggatatcagggcctgtcgatgggtgagcagacgggggcgtgcgggaagtcagtctcctgcgaggatgcctctgactggcaggggaagcgcatgggtggggacaggcatgcatgtcaaaccacagagccaggccccatcctcgtgcaagcccaagccttcccccctgtcaccttgttcatctgctcaatgttcaggtgagagttgaagccctccatctccgtgactggcaacggggcgggcacaaggtgagtgagatggagcgcaggggcacgaggaagacnnnnnnnnnnactcctgcgaggatgcctctgaccggcaggggaagcgcgtgggtggggacaggcatgcatgtcacaccacagagccaggccccctcctcgtgcaagcccaagccttcccccccttgcaccttgttcatctgctcgatgttcaggtgagagttgaatccctccatctccgtgactggcagcggggcgtgcacaaggtgaatgagatggagcgcaggggcacgaggaagaccgagtgcatgcaaagggatccggcgatgaccagcatcgcacccagcacacacaagcatggaccctggtgtttcacttgccagactggtcttctccgcagagctcatgctcgcacatgacgtgaaaacgcacaacctcctcgtacacagcgatagcaaactcatcctgaggcaggcnnnnnnnnnnggggtccggcgatgaccagcattgcaccctgcacacacaagcatggaccctggtgtgtcacttgccagactggtcttctccgcagagnnnnnnnnnntagggcaggacgtgaagctccatgaatgctggaatgtggtctgccaatcaggaatgctgcccatccacacaccagatcaacctcctggtaagcctttttctcggcagggatggagggcacccatcaagtaccagcacaactcgactgcatccaccccagcctcaccgtgatgccctggacgtacaggtcctgtcgcacagctctgtatctgtcccacaggaatttgtgcaccagcccaaacctggtggtcacagcagggtgtgaggggtcaagggaatactgcaggcagacgcacccagggtgggnnnnnnnnnngagggcaggatgtgaagctccctgaatgctgcagtgtggtctgccaaccaggaatgctgcccatacacacaccagatcaacctcctggtaaccccttttctcagcagagattgagggcacccatcaagtaccaacacaactcgactacatccaccccagcctcaccgtgatgccctgaacgtacaggtcctgtcgaacagcccggtatctgtcccacaggaatttgtgcaccagcccaaacctggtggtcaccgaagggtgtgaggggtcatggaaatactgcaggcagacgcacccagggtgaggttgtcggtctgagaaagagccggcaggttacctgaggatgcatgcagcatcgtggagttatatgtagccaacagcactgatcctcgttctcttcacgctcccaaattccagacctcatagcgtcctgttctgcctcactgaccacccatcccgctcaagtattgcaaaccctgtccctcttccnnnnnnnnnnggttccagacctcatagcgtcctattctgcctcactgaccacccatcccactcaagtattgcaaaccctgtccctcttcccaagccctctcacctgacatcctgtctgtccaggagggacctcaggtacagcatggtcctcaggagggctgctcgggtccgaaagtctgtgggttgcgggtcatcgatctgcacggagaatcaggaaatggttgttcacgtgtctaaggagtgtgccagtgtgggagatggatgatgggtaatcgaagttgtatgatccctgcagtagaccaccagacgcnnnnnnnnnntatggttgttcacgtgtctgaggagtgtgccagtgttggagatggatgatgggtaatcgaagtagtatgatccctgcagtagaccaccagacgcaatctatgcataggacaggctgtacttccaccatcctttccaatacaagccccaagcaacacaccgttcgtgcaaatcgcctcacagccagctctgcactggtccgcccgctgtcattgatgtccaccctctcaaagatctggatgtcgtgcaggtgctcccgcctttcacgctctgccgcggggcacatgtcctcacagacgccgacgatggccccgggcgctggcagggcctcccctcctaaatggacagcaactataccaggaggttagtgaggcaggctgtcattcatggaggtccacatacggnnnnnnnnnngagtggggcagccactttaccaggaggttagtgaggtaggctgtcattcatggaggtccacatacggaatcccttcacatgccgggtggaacctcgcctggagcgagtgatcacaacaagacaccactgggaagcctgaggactggtgcagcgttctactaccatgtcctcttccccaacaggcccaaggaaagctgagctcaaccgatgccacggagaacttgccgtcgaggtcatggggggcgatggctgtgtggaagccatgctgtccatgctgagcagctgcagagggtggtcgcgacttaaaaggggcggcgcgctctgtgagccgagctgcatccttttggggtggcggcggcccaggagccttctgtccaacgctagcaaatggagcggcttctgctctgaggcttgatgacgctacaccctttcctgaaggggcggctgggctgggcgcccagctgcccccaaaggtgggttgctgggccagggcggctgctttggctgcctcataatcgaaggcatcatcgtccacctcctgtgcggggcagcagcagtgggcatgcagcaggttgtgaggcttccagcagctctggaaagatcagcagcacagtataatccagcgtacttacatgagataagatccagccgggatacagggaacatgggctacttaccagcctgaagtgggcaggaggagctccgggcgccttgccaaggtactcgccgaggttctacaggaaatgctcgcggccaaattccagctctaagtttttattgcgatcttttgaaaggcgaaggcagtggcgatgaggcgtgtgcacgatcgcctggctatatgacagctgaagagggagcaggccaaaggtctcgtgaataattgccatcgtggcaagtgggggcgagggagcctttgagggactcgaggttctcgcggacatacagtcgtcttggatatcttattcgacgtcaccccttcgagtattattcctggcgtgattctcactttcatcacccctccagaccgcagcgcacactatcgctgctgtcgatcacaccttgtatctttctgcaagggatcgcgcatctttggcgcagcataccgataagggtgcgaatatcaggagcacgaggaccgcctttccatacttcctggtatcgctccgcttacagagcttcgagggctgggtgtgatcaaccatgtcgcggggcagtggggcaggtttcgaccggcacatcaccatcttcagtcccgagggtagactgtatcaagttggtgagttgctgtgttgtggaagagatcggactggtgacagtgcggcagtgcagggcgcctagctcatgggtgaaccttgccgtcacttgtccagttagggtgattggctacctttccccagcacaccctatcagtgcatcgctcatacttctcacacaacctctctgcaacagagtatgccttcaaggcagcaaagtctggtgctctcacgagcatctccatccgaggtgctgatagcgcagtggtggccacccagaagaaggtcccggtgaggagtgaagaggggagggggtgcgggaagggcgacatcgccgctgtcggcatggggatgtgtcagcctctcatgcccctctcatggagcatgagagaagatgttttgatcgccgcacacacaacggggagccatgctttagtatctcacgtcgcgcttgcttacacctttgcaactctcacccacctnnnnnnnnnntagggggtgcgggaagggcaacgtcgccgctgtgtcggcatgggggtgtgtcagcctctcatgcccccctctcatggagcatgagagaagatgtttggatcgctgcacacacaacggggagccatgtctgagtatctcacgtcgcgcctgcttacacctttgcaactctcacccaccttccatgcatgcacccccacccccacccccaggacaaactgattgatccctccagcatcaccaacatccacaaagtgacgcggaccattggcttgctgaccaccggcgtccccggcgacgctcgttcgctcctgcagaaggcgcgatccgaggccgccgagttcaggttcaagtatggctacgagatgcccgtggacttcctggccagggtcctggccgaccaggcccaggtctacacccaggtgtggtttggaatgaggggcttggggcatggcagcatgtgtggggctttgcagctgccctggggctatcttgacgcctccctagagcagttccttggaggggctgcccctggctcctctcacctcctcnnnnnnnnnnttatcttgacgcctcccttgagcagtttcttggtggggctgcccctggctcctctcacctcctctggcgcagctgcgtcagtgcagaggaccccctgcaataaatcctccacactgcagcacgcctacatgcggcccctgggtgtcatctccacactcgtgggcatcgacgaggaacgcgggccgcagctgttcaaggttgacccggccgggtactttgtcgggtacagggccacggccaccggccccaaggagcaggaagccatcaactacctggagaagaagatccgcccggacctgagcctgagcgcggacgacacggtgcagatggccatctccgccctccaggtgcgtgggtgtcgtgtgagaggggtgctggttggcgtagggttgcttgagctcctcgacgtggtccagcctgtgcagggactgtcgctgcacaaggagcaggtctcccgagtgtagagccggaggctgtgccgcgaccgcattccaaacaaacaccgaagagcgacgcgcggtatgaacagcacctgtgataccatggccggacgctcatctcattcctcctttcttgccgcagaatgtgctggccgaggacctgaaggccacggatctggaggtgggcatcgccgagaccagcaacggcggcctgttcaggtcagtcggtatgggatgggatcatccgtggaccggctgcctgtgcatgcagacgccgcatggactcggtgccgtggagatttgatgctccctcgctcaggcacgtgcctgccacgacgtaccaccctacatcagtgtatgtccatccccgcagagtcctgacgaacgccgaggtggaggagnnnnnnnnnngtttgatgctccctcgctcaggcgcgtgcctgccacggcgtaccaccccacatcagtgtatgtccatccccatagagtcctgacgaacgccgaggtggaggagcacatcgtggccatcagcgagcgcgactgagcactcctctggtgccccggccccgccaggtcctgaagcgatggacaggagtgccatcccgggccagcgacaggggaccccatggcttgatgcaggcgggcgggcggagcctctgcacccctgcacccgcgcatcttgtcagtttgagcaagcttgcatgaacagaggggccgctgagcaggcagaatgtgtatgggcagcgcgaggcaaggagacactgtgtggcacatgcacgttggggttggtttgcgattcgcatgtcatgggcgggagggtgtgtttgcggctggacgtcgcagggagggaagggggggggggggggggggg

SEQ ID NO: 47104 - DNA, 61 bp, Chlorella protothecoides
agctggccaggcttggcaggcgtataagggtacaccagacatggacatgctgcagccctga

SEQ ID NO: 47105 - DNA, 61 bp, Chlorella protothecoides
cctgcgcgatcagccccggctccggggtcagcatgcgcacgcggttgaaggctgcgatggc

SEQ ID NO: 47106 - DNA, 91 bp, Chlorella protothecoides
cggcgtgggcaactggtcggcccaggaccgtgggggcatcatgcgggaccctccgccaggaccctggatacgcttcttgcggcgcctgcgg

SEQ ID NO: 47107 - DNA, 76 bp, Chlorella protothecoides
gtgcgcggccacgatgccgcgtagctgctctgggcgcaggcacagacgctgcaggatggcgcgccaggtgcccacg

SEQ ID NO: 47108 - DNA, 14996 bp, Chlorella protothecoides
  modified_base (300)..(309): a, c, t, g, unknown or other
  modified_base (831)..(840): a, c, t, g, unknown or other
  modified_base (928)..(937): a, c, t, g, unknown or other
  modified_base (1077)..(1086): a, c, t, g, unknown or other
  modified_base (1211)..(1220): a, c, t, g, unknown or other
  modified_base (1450)..(1459): a, c, t, g, unknown or other
  modified_base (1603)..(1612): a, c, t, g, unknown or other
  modified_base (1686)..(1695): a, c, t, g, unknown or other
  modified_base (1939)..(1948): a, c, t, g, unknown or other
  modified_base (3032)..(3041): a, c, t, g, unknown or other
  modified_base (3394)..(3421): a, c, t, g, unknown or other
  modified_base (4918)..(4927): a, c, t, g, unknown or other
  modified_base (5214)..(5223): a, c, t, g, unknown or other
  modified_base (5718)..(5727): a, c, t, g, unknown or other
  modified_base (6019)..(6028): a, c, t, g, unknown or other
  modified_base (6216)..(6309): a, c, t, g, unknown or other
  modified_base (6912)..(6921): a, c, t, g, unknown or other
  modified_base (7001)..(7010): a, c, t, g, unknown or other
  modified_base (7103)..(7112): a, c, t, g, unknown or other
  modified_base (8083)..(8092): a, c, t, g, unknown or other
  modified_base (8379)..(8388): a, c, t, g, unknown or other
  modified_base (9458)..(9467): a, c, t, g, unknown or other
  modified_base (9761)..(9770): a, c, t, g, unknown or other
  modified_base (9961)..(10016): a, c, t, g, unknown or other
  modified_base (10458)..(10467): a, c, t, g, unknown or other
  modified_base (10945)..(10954): a, c, t, g, unknown or other
  modified_base (11553)..(11562): a, c, t, g, unknown or other
  modified_base (12877)..(12903): a, c, t, g, unknown or other
  modified_base (13056)..(13065): a, c, t, g, unknown or other
  modified_base (14564)..(14573): a, c, t, g, unknown or other
tatcttcgactcgtgcgaagcatatgttgcaaggctcatggcaagacgcccatgtttccgatgcagggtgatcaaacaaatttgccaaccaatcatctccacttccaaatcagttcacctcgggtcatttctacaacacagtacacaactcaaaagcaaggtggatgcaggagctcgaagctgaggccctgcagaccgacgggacgttcttggtcccatgcgctcgtgcgcatcccgcacgaggctcattcccgcctgggccatcctcgttcgagcaagagagcatacacgtggccgcgnnnnnnnnnnaagctcgaagctgaggccctgcagaccgacaggacgttcttggtccgatgcgcttgtgcgcatcctgcacgaggctcattctcgcctgggccatcctcattcgagcaagagagcatacacgtggccgcgcccaaggaccaggcccttcccaagtcaggccagcatgaggcccgaccgggagcgcgatgccgcgtgcatgcggcccacctcctccgccgcctccctttcctcctcctcctccagcagcgccgcctccaggtccgcgctgcgcaggctgagcgcgccactgcgcgtgcgctgctgcaccgaggcccgcgccttgtcgcgcgggtaggtcacgtgcaagcccgtgaacaggaagcagcagagcgcccaggggatgcaggtgcagatgacgatggcgttgccgagcgcaaccgcccgctcccggtcggtgccgggcttgctggggtcggtgctgaaccccaggtgctccgccagccagcccacgatgggcgcccccgtcgcagcgatggcgcctgnnnnnnnnnntgtgggctctgccgctcatgggaccaaccccactattcccagaaggggggggggcatcagtggcagcaacatttcattccccagaagnnnnnnnnnngtgtattttgtgggggaggggggttggaggggaggtgtggagggaggagtgtttgggcggtgggcgctgccgctcatcagaccaaccccactattccaggggggggcaacagtggcagcaacatttcattccccagaagnnnnnnnnnnaaaagaaatgggaggcgaatgatgacccaaggctgtgcagtggccatgtgctgcgaaacatccatgcaactcccctgctaccacgcagccaagcacagagcaggtgagtcaggcgccagtccacnnnnnnnnnngagaggcatgcagacaaaagacctcgagcacggagccagggactcaccctcaaaggcgcggtcaaaggagtagacgatggcgcgcagctgggaggggacctgtagggaggaatggggaggcgaatgatgacccaaggctgtgtagtggccatgtgctgcgaaacatccatgtaattcccctgctaccacgcagccaagtacagagcaggtgagtcaggcgccagtccacnnnnnnnnnngtcgggagccctacccaccacttcggcaaagatggggctgttacaggcgggcgccacccaggagatcatgaggccccaggagaagaagcagatgctgtagatccagaccagcaggttggagttgcccatgggcagcagctgcannnnnnnnnnttcagaagccccacccaccacttcggcaaagatggggctgttgcaggcgggcgccacccaggagatcatgaggnnnnnnnnnnggggaggccaaggcgagtgtgtggaatgggggacatgagcctggaccaggcaagcgacggagtgatatatgggcagatgtgatgccccatgcacagcacaggtccccccctcggcatggcgcacaccccttgcccaccgagccagcgctttatctccccatgcactaaggcagctttcgtccattggcatcatctcaaaaacacaagcagactctggacgccatgccaggctatcccagccccnnnnnnnnnnagggaggccaaagcgagtgtgtggaatggggggataggagcctggaccaggcaagcgacgtggtgatgtatgggcagatgtgatgccccatgcacagcacaggtcccccccttggcacggcgcacaccccttgccccaccgtgccagcgctccatctccccatacactacggcagctttcgtccctcggcatcatcacaaaaacacaagcaaactctggactccatgccagactatcccagcctcaccagccatgccttgagttcccaaaccaccgctcgaaacaaggaaccatccccctcaaataccttgaagatggcaaaggcgaggggcacgccgatgccgacagagaactgggcgatcaggatgcggccgtgcctgggcgagcgtgcggcggccaggtcgccgaaccagccgcccacctgcccgcccagtgcggtgccgcccaggaagagggcggcgatgagggaggcctggaagtcggtcatgcccatgagctggaggtagagggtggtgaagaccagggcattccagggcgccgaccccacgatgccctgcaccaccacgatgacaaaggaggggacggacagcacggcggcgacatcggcaaaggcgcgcgcggcgctgccgtcctgcgccagcaggtccggcgcctgcgcgtactcgggctcctccgcctcgaagcgcgggtccacggaggcgaagaggttgagcacgccgatggccaggctgaccgtgcccacggcgatgaaggtcacctgccagccgtccaggccaaagggccgggtgtggcccatgttggtggcgaacagcgtgcccagcgtgccgcccagcgcgccggtgaggtagagcgcgccaaaggccttgccacgcgatagctcgctgaagtagtcggcgatcagcgactgggcgttggggatgagcaggcccaggcccaagccgttccaggcccacaccgcgatgccctatattgttattgggggagggggggggcaaatgtgtgtgtaagtgtgttgtaggggtgggtgggagagagatggatgtgatgtgatgagatgtgatgtggtgtggtgtggtgtggtgtnnnnnnnnnnatgggggaggaggggggcaggtgtgtgtgtgtgttgtaggggtgggtgggagagggatggatgtgatgtggtgtggtgtggtgtggtgtggtgtggtgtggtgcggagcaaagttgggaggcgcggacatgcatttggcagccgcagtacaggcacgtttggcgatgaccgacctcaagatgatgatatccgcggtgatttcccccaacgaaacagcgatcgcgtgccagccgccctcccgcccacccatgcaaggctaggtttggccctcggagacacacccatcatccctcctcatccttctcccctacctcgaaacaacagagacccaaaacaacccccccacacacaannnnnnnnnnnnnnnnnnnnnnnnnnnntgacctcaagatgatgacatccgcggtgataccccccaacgaaacagcgatcgcgtgccagccgccctcccgcccacccatgcaaggctaggtttggccctcagagacacactcctcatccctcctcatccttctcccctatctcgaaacaagagagacccaaaacaacccccccacacacaaaaacacacccagcaaacctgcttgacattggtggtgaaggcaaaggcgatggacatgacgccccagatgaaggcgccggcgctcatgacgtagacgcggttgtacaggtggcccagcacgccgcccagcggcgcgcaaactgcctgcatcagcgcgcaggccagcgttatgtagcccagctggcggggggaggccttgaaggacttgcccacgtagcggtaaagggctggcagggtctgctcattgcagcgctccaggatgcccgccaggttgaccaccaccgtggtgcgggcccgctggtcggtccaggtgcgcaggttgcctttacagaggggggaggggtgacagggagggggtgacagggaggggggccgagggttaacaacgaggagcatggccaagcctggggctgtagacttcctgggtccagtcaggacgggcaaaccctggatgaacaaggatttctaccaccccggtgcggcccgcgccgcgcacaacccagaggcgaggcatatcagtcgaacccctgccacccacacccgaaacccttgtcacccccctccctgtaccaaccatgcttgtcgcgcagcacgcccccggccttctttacgggttcaccagattcctgtgcccctgtggtctggaaaggcgatgagaaggcggactggccggcgccgtcctcgtcctcgccaggcacggcgacaaaacccacggtcttgcggggcggtgccatgggaggagcactccccctacacctcgaggtggctcagcacaggacaatatgacggcacaaacttcagtattgtattcaatgcagcctggctcgctgtgtgcgcccgacctaataagcatatgcgcctccactgcttcatgcacgaggtgcccggcagcttcatggggggcccacatgccggccgccagttttagggcatagcctctaagtggactgctgtctttgcagagatgaggtcatgaagcatcgtatgggtctgtgtagatcctcttccaactcactacgctgagcgcggggtttcaggcgtattccagggggatgagagcgatgcgggaggacctggcaatggcgaggagggggggattcgggccggaccctttgagtcccacaaaggccacgctgggaggagtggcgtcgtcctctgtctcgctcggcacctcccccacgaccctggtggtgaccagggggtcgcagcagatggcgtacagcacaatcgtggctggccggcccgcggccgctaggctgacggcaaggcgctggccatcggggttccacgccatgcctgtcacctcctcctttcnnnnnnnnnnggcggccgccagattgatggcaaggcgctggccatcggggctccacgccatgcctgtcacctcctcctttccatctgcgatcttgtacatggtgcgcagagtgagtcagggtgctgcaagctgcttgtttgaccgatactgtcctggatgtaggtttaataaagtgaggggaatgggggcatgcatgtccctccggtgcctcaccactcaccataccccactcctgcagtccctccaaggagcaccccttgcatcacctcacactcccaccccgcctccgttccccnnnnnnnnnnctcacgcacctgccggccatgccagggagacaggcatgggctgcgcctccaggctgggggcgctggcgcccgtcatgtgcagggcggtcagggagccgggcgccccggcatgggccacgagcatgagaccctgggcggacaggcgcgcaggcgcccaggccgccgccaccacgggggacggccttggtcccgctcttgcgctgtgcacgctgtggctgccaccgtaggcccacgcctggctggtccaagccgtggtctcccacagccgcagcgtgcccgaggcgtggccctggaagaggtaggcgccgcagggggaccaggccagtgcggtgatggggtcgctggttgcctgtggattggggcggtggggaggaggtgctggtggactggacagcttcctgagatacttgccggtgtaggggacaggatgccattccatgattgggggtaaagaaaagcctcgatgcatgcccagcctgcttctgaaagcctgcnnnnnnnnnngtggggtcgctggttgcctgtgggttggggcggtggggaggaggtgctggtgggtctggtggactggacagctccctgagatacttgccggtgtagaggacaggatgccattccatggtcgggggttaaagaaagcctcggtgcatgcccagcctgcttctgaaagcctgcctcaccaaacctcctatacgatcctgagcatgcacacagcaataccactgaatcaacccccctttttgacaagaccaggagaccgacaacaccgcctcaccctgacgggcgtcgcacggcnnnnnnnnnncaaatcaaaccccctttttgacaaaaccaggagaccaacaagaccgcctcaccctgacgggcgtcgcacggccggtggcgacgtcccagacctggaaccccgccacgccccggcacgcccccgccagcaggtggccctcggggtgccaggtcagcatgttgacctggcccgtacccgccagggcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccaccgccagcgcgcccgcgcccgggtccggggggacgcgccagagcgccacccccgtgccgcagcccacggccaggtctcggccgcccacgggccgccagctcagcgccgccacgtcagactgcagctcgtgcgccaggacggtggcggggtcggggctgcggccccggcccacacgccacactgccacgccgctgcttgattcttcctgcgcctggcggtccaggggcacagacgctgccgccaggggtcgcgaggggtggcaagccacgatcggaccccgggaggtggcagtgtggctggacggcatcctgcatggccggggggggctgcgattcgggtgcaaaggaggatggtctccaccaggagcctgcgcctgcgtcagggcaaaagtcctctagccacacacacccaaatcgctaccaaagcgacccgtccaacctcgcgggaacgccctgggggcagcgcacttcgatctcgcccattcccaggtggcgctccgtctcctccgcgctactgtctgggaacctcaggcatgagcctccctgtgcatcagagggaacgatgagggcaccacggtgcactgacttctagaggctggnnnnnnnnnnccgccaccaaagcgacccggccaacctcgcgggaacgccctgggggcatcgcacttcgatctcgcccattcccaggtggnnnnnnnnnntctggcacgtcggcagtgggtccggactggtacactccctcccccacacacaccccgcaccgaatcgtccatgtcgttctcgtagccgccccnnnnnnnnnntggtactgtctgggaacctcaggcatgtgcctccctgtgcatcagaggcaacgatgagggcaccatggtgcactgacttctagaggctggtgttggactctagggcagtgaccgctgacatgcgaaaactgcacgaccaagtcgctgtccttgaacagccgtcctctgtccccagatcgatcgcccgctcacctcgccctgctcgctccccgcgccattgacaagttctacagagaacaagattttgaaaacgcatcaatcaacagcatcccagatcacctggcacgtcggcagtgggtccggattggtacactccctcccctacacacaccccgcacctaatcgtccatgtcgttctcgtagccgccccatcacgctttccgatgagttggtacttgaggtgaaatgtacaacagcagcacggaagcactcatgcattgagcctacattcatctcgtgcgtggaatggtctggcgcgccctcccggtcctccatttcgaaagcagccatgctggcagacatccagccacagccatgatacaccccctgctgcactgccttgatgaggacacacaagagttctacatgccccatcagctcttataatacagatatgcagccagtgccgcgatccagaccagcgctgggaggtagctcctggtggtgctcaggcacctgtctgggatcctgatcttgtcctccttcaacggcacaaacctctccttgttgcaggccaggtactgactcgtggggtacctcatgggcgagcatccaacgttgatcttgtctgtcagctggtacagcctgcggaggggaggtcgggggaatgagggaaagggatggaaggtccgcgacgagcaggcgagtccatggtcgcccttgcacactgccaggcctcacgcgcaccggcccccctgcgtcgctgcacctgacgtgatcaatcttcatgatggaagggaacgccaggtggnnnnnnnnnngacgagggaaagggacggaaagtgcgcgacgagcgagcgagtccacgctcgccctcgcacactgccaggcctcacgcgcaccgccccccctgcgccgctgcacctgacgtggtcgatcttcatgatggaagggaacgccaggtgggcgaggtccaccgacgaaaaggagtagctcatgcctgcgcgtggggggggcggggctgggcgatccgagcgctgggcggaggggagtgccggggaggagtggtgctgtgaagccacccacggtgtcccacacagggcatcannnnnnnnnncgatccggccgctgggcggaggggagtgccgggggggagtggtgctgtgaggccacccacggtgtcccacacagggcagcagccaccggggaggcacacctgccagcctggcaggggctgctgccctgctccatctcacagccctgcacgatcaggcagcctgcgctcaccaaagttcatcaccaggtacatggcttcgttcgggatcgagcgcgggccagcgtaggcccccgtcgcattcgtgacctccaccagggcatccgcgttgacctcaaacaccacctgcgcgcacgcgggagggagaccgctcggagtgccccgccgtacagggcaggcggtgcgatgcagcggggtgggagcgttctgtgtgcagcgctgctgccgggcatcctcgtgacacgcccgtttccccgccgggcatgccagagacggcactccgccgaggtctgcaccaggaacctcacggccactgtgcgcgctgtgcaagggggccccaggccagatcccagcgagccctcggatgccgccagggctggactcccacacgcccgctgcgccacggcatcctgcacacacccaacacccggtcccacacacagcccacctggtcatcgattgtccatcgcatcacctccccaggctgccagaacaggccaaacttgtgaaactgcgcgtagaacgtgccgttcagcagggacttggcggagaagcagtcctgccagaggttcccaggtcgcccgtgcacacccttccagtcgttcttggtcgtcttgtggtgcgtctgggagcctgcgggggatgcaggaccggcaaggacggtgttgctggcgagggccggcggagcacggggcggctggactccgaggcgccaggaccctgtgccggggcgggccctgtgccggctggcgagcatcatccgggggcgtgcagtgcaggtggtgggctggccctcatccgtgagtggggtgggctgctccgcgcacactgcgctgcgccagaaaggtgcctgcccgcacgccgtccccacccacccgggtatgccacgccgcgctccatgaagggcgtccccnnnnnnnnnngcgcgcacactgcagtgcgccagaaaggtgcctgcccgcacgctgtgccccacccacccgggtacgccacgccgcgctccatgaagggcgtccccggcggctgcaggggcgccatctgcaggctgtgcgaggctgtcggaggggatccggcgcccttggccctgccctccttgtccaccttcctgtaccccatcctggggggcgaaagggtcgcacgggcggctgagtgggtggccatgatgccgcgggaacagagtgctccagcgccaggccgtctccgtgccgacgccaggnnnnnnnnnntcttgtccaccttcctgtaccccagcctggggggggcgaagggatcgcacgggcggctgagtggctgggcatgatgccgcgggaacagagtgctccggcgccaggccgtctccgtgccgacgccaggaaacgggatcgcccccaggcatccccacagagcccctgcaggtcgcgtcctgccctccctcccnnnnnnnnnnnnnnnnnnnnnnnnnnnnnnnnnnnnnnnnnnnnnnnnnnnnnnnncaaaccctgtgcccccccccttgcgcccacgcacccaacttctatgaggtccacctccggggcaccgcggccccgcccctgctcccatccaaacctgccccggtcctgccccgggcggtccatgcaggcagaaaagcgctggcccggcagcgtgctccacgccaccttcctggcggcgtcgtcgcaggtgctgtaggagtagggccacatcccctcggccgttgccaggtagcctgcaggggacggggtggcatgttccagctcagagggctttgctctcgaggcagcgtccccagcagctacgacaatgagaaagatgtgttgggccgaggacctccaggggatgtgcttggccgcaccacccctctccagcagacatgccctgcggcaaacgtcccctcctactcatctggctctcacccggcctggccaggttgcccannnnnnnnnnggatgtgctgggccgagaccctccaggggatgtgcttggccgtaccacccctctccagcagacacatcctgcgccagccgtcccctcctcctcgtcgggctctcacccggcctggccaggttgcccatcatccagattgcaggccagaagccgggggtgacgtcgtcgccaggcagctgcgcagaaacctcgatgtatccgcctggtggaagagagggaggagggaattccttgaacctcgacacgctcgaccatgtggccaggcgtcgcgcccgccccgtcacccctcgttcacacaagggttgccaaaaggacacagctggcacatgcaccatggctcctgcacagtccgcgttcctggtcgagatggtcattcacggggtgatgagccatgtcccacacgaccccatccacccgcgcgtgcctcccctcctccgcgatactcatgctagaagcacagacctgtgaagcaaaactnnnnnnnnnngccgcgttcctggtcgagatggtcattcaccgggtgatgagccatgtcccacacgacctcatcaaccacgcgtgccccccctcttccgcgacactcacgctagaagcacagacctgtgaagcaaaacttgttccaggaggtcaccatgcctgaagcatacttgctggacacctccttcatgctcccatccacgccctgcatcacggccgtgctggaccgcttgctcatcttcagctccagcgctcctcctgggagcgggagggagggcgtgggcgcatgacgcggtgctgggcgcgtgcggcagtcccgtcacagcctcgacccggtactgctgctgcgccccaggagcaccacggccccccctcccggcccgcagaccaccagccgccgcacctcggacctggacctgctccggctggtagacttctatgtcctgcgtcgcgctgtagtgcagctgcagggatggagcgtgcagggtggagtgggtgaaggccatcgttgcgtctccggctgtgctgggtctgtgggctgctcctcaccctggcgcacgccgagtctgcaagaacccacgacccctgccacggtcgcatcccaggcannnnnnnnnntcacgcccggcctgcgagaacctacgacccctgccacggtcgcatcccaggcagccagcaccgaccttctcggctgtccacttgcggtctcgcacccccaccgccagacttttcttggggttgccaaactcgtcggacatgaccaggctcatcgccgtcgccttgccactgcaagccccccaccgggtggcagcacacacgctcttggtgcaggcgtcgaggggggtggtctcatctatgccatcgaggagggcctggggtacgccgacagcagcccccctggtcctgcatgtctcccctctcgccacatggcccagaaccagcactgaggagggcagacagttgaaaaggcgtggcgtgaggtcgggcggcatggcagggcgagcaggaggctgctgatccaggaatcaccggtcttggatatacttgccgaggacaaggctctgcgccaggagcatgcttccccgcacgagcatctccggcaagggtgcggcgctttgtgtacttcctgtccgggccaggtgtcgttgaattgcctagtgcagggtgccactgatcagagtcattcaatgattcatcaagtgatcctctcggcctggaagtgtcgggacagattgtcccgatcacgagcaggtgcccttttgtcgtgagtgggtgcttaatcaggggacgcacgcacgtggggtagggggggaagagagagttgggcccacaacgcacgaatgtgaacccgcctcttggatttgtggagagcttatttacaccacatgtgcaaggtactgctagattcagtatcatgcgtgtcctgggtgcggctgcttgcagcatctgaagtgcagctcccatcgtggatggcacatgcacaccaaggagaacaggcaactcccagattcaagaggaacatcacccctgaaccttctgtgaccatggtcttacatgtacagagtgtgcctgtcccccagctgaccaccgcagaaggtccccccgagctcccttgcctcgcagcaggccaagaagcggcgctcatgccaggcagaggagcagcacagccagcaggccgatgctcagggccggctgactggccagcgccccactcgtgcatccgccgggtatcctgccccggtcctccttgagcactatgtacaggtccttgttgcacgccaggtactgctgggtggggtatgccgtgggcgagcaccccacgttgatggcggtggggtcctggtacagcctgtgggggtgggggcatggtggcgggctgaagcactggttgccgtcctgctggtgctctgggcggatgcttgccctgtgctgnnnnnnnnnnnnnnnnnnnnnnnnnnncccacctgatgtagtccaccttcatggtggccgggaaggagagcctgtacaggtctaccggtgtgaagtcattactcatccctggcaaacatccatgaagggacggggttgaattggtttgaaggccaggaaggcgtgcacttgcactgcatnnnnnnnnnncacatccatgaggggacagggttgaattggtttgcaggccaggaaggcgtgcacttgcactgcatgctcaggtcgagctgcccgctggacacatcgccttcaacatgtgcagttgcagaggcccagacacagagcccggtgcctccatgccacagcacagagactggcacccatttcacgccacgccggcgctcacccagattcatgatgatgtacatggcctccagggggatctggcgctgtcccacctccgccccactcgagtttgacaccgcggtcagagcagccgcggtgatctcgaaagtgatctggaacgagtgtgagaagaggggtggacaggcttgaaccaggcttgcggaggttccagaggtggggaggagcatgtgtctccccccttgcctttccagatgcacatcagcagctccctcttgcaccagcactgctgtgcagtggatggtgccatgctatccccgtcctcccaccacacctgccggcaacagcaatcgcagcaccctctcctcccacctggccatcgatgtaccagcgcaggacctcacccggctgccagaacagcccaaagttgtgatactcgctgaagaaggaggtgttaatgctggacaccgccgagaagctgtcctggtatgtgttccccgggcggccatagatgccagaccaggagctcttctgggtgtcaaagtcggagctcgcccctggaaatggaatggtggggtgattgtgtagaatttgtgggaactgtatgattagaatgtgtaaagtggctgggagggaaggggtgggcgggagacccaggaggctccaaatgcatgacttcgaatgaggggtcaagcatgcccagcccccctgtgcgtgagtgcacacagttgggggggatgggtgtctgcggcgagacacatctgttacgggtcacattttcagggggtgatcgctctcaatgcatgatgctggggacaacaagggcctacagcagttcaccgaaaccttagagacacgagccagctttccaggtgcaattgcagtgatcaaccagacagctacccattcccatagcccctcgccagggtccccaggcccccgcccctgcccacggacccggatagttgacacccgaagccatgaaggcggtgccgggcggctgcaggggggccatctgcagcgtctggctgacatacggcaggctgtagtcgctgtcgtgggccgtgggcgtgcccttgagcccatttacactgctgggcacgctgtgcaatggaggcaaaggaggggttggatgaccagggcttcaggatcggaggacaaggagcaacaccgaggacaggcgacatccagatggccgccatcttgctcgagaatggtgattactcatcaattttgctgggccctatggccatgtggcctgaacggcaagtgaatccatgcatcgataagagcctgctccttatcaagctccatggatgggtcaactcatcaggcctcgtcccttnnnnnnnnnngcggcaagtgaatccttgcatcgataagaacctgctccttatcaagctccattgatgggtcaactcatcaggcctcgtcccttgccctcccctacgtccagactcagcactcggcgagctcagggggccccttcccctccccccccctcccacacttgctgcagcaccccacctcatctcaaagaggtccacctcaggggcgccgcggcccacgccggccggccagccataacgagtctggttattcccggccgtgtcggggcaggccgagaagcgctggcccggcagcgagctccagtccaccttgccagccgccgcgtcgcagacgtcgtacgagtacggccacatgccgccagtactggccatgtaccctgcagactccccaggggagggaagggtgaggaatgagggggaggggggggg

SEQ ID NO: 47109 - DNA, 61 bp, Chlorella protothecoides
catcctgtgcgtggttgggaacgcgcggttccggggcctcatcgcgccgcacctgccccag

SEQ ID NO: 47110 - DNA, 61 bp, Chlorella protothecoides
aggtggcccgcctgggcactcccttgttttgtcttgtgtacgctgctttccccaaaggtag

SEQ ID NO: 47111 - DNA, 76 bp, Chlorella protothecoides
ggtctcgcgctccaatgacaatgtgccactgttgctggaagagccagtcgcttggcccctgccccgggtttccctc

SEQ ID NO: 47112 - DNA, 61 bp, Chlorella protothecoides
ggcctggagttgtgcaggcagaggcaggaggggcctccattcagagacttgcacgagattc

SEQ ID NO: 47113 - DNA, 114 bp, Chlorella protothecoides
agccctccgcagcgattgcggaatctcacattctacccatcataaatgcgtccaggacaggcgtcgcgagcgggcccggctcgggtactcaccgtgcttctgcatgacctgcag

SEQ ID NO: 47114 - DNA, 73 bp, Chlorella protothecoides
cgagcgggagcctgaagcggtgcatcgtcgatcggtgttccgctctgcgcctccgcaggcacaatgctcgcag

SEQ ID NO: 47115 - DNA, 61 bp, Chlorella protothecoides
gctgctggcgctgctggggtgccgggcggggcgggaggcggcgctgctgccgggcgtggcg

SEQ ID NO: 47116 - DNA, 66 bp, Chlorella protothecoides
acacggcaggagtgagggcgctggcaagggaaggcagtgcactgtgcgcatgcaggagcaatgttc

SEQ ID NO: 47117 - DNA, 72 bp, Chlorella protothecoides
caccagcgtctcagtccaccagccctttggtgcgcggccgtatttcacaaacaattgtgcctgtgaatggca

SEQ ID NO: 47118 - DNA, 61 bp, Chlorella protothecoides
cagcgcagggactcctgctccttcaggcaagcaaagggcccttctcacctgccaacccaca

SEQ ID NO: 47119 - DNA, 61 bp, Chlorella protothecoides
acaggggaaacggatctcgatctgagggggcgcccacattctaatagaccagcaactcttc

SEQ ID NO: 47120 - DNA, 384 bp, Chlorella protothecoides
  modified_base (87)..(322): a, c, t, g, unknown or other
ttcgaccacagtgatgcggctgcccttgcatcccgccgtccgagcagggtgtgcacggcccagagacaccacttcactccagtcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgtgatgcgtctggggacacagggccggcttccagcattcaaagatgcagcggaaaagct

SEQ ID NO: 47121 - DNA, 61 bp, Chlorella protothecoides
caccccgcgcgacatcagctccaggaacttgtcctgggcctgcgccaggtagccgtgctgc

SEQ ID NO: 47122 - DNA, 73 bp, Chlorella protothecoides
gctgtttcagtaacttgacaccctgtgcgacagagtgcagagggatgggtgataaacggaagtcccgggcgga

SEQ ID NO: 47123 - DNA, 77 bp, Chlorella protothecoides
ctcatgcacgcttgcgggaaatgcgggccgtagggtcagccccaaacagctccaaacattcctggcactcaggcagt

SEQ ID NO: 47124 - DNA, 61 bp, Chlorella protothecoides
gggcgcgcggttcaccctcaagagcggcgaccgcccccacctcctcaagttctgatgcgcc

SEQ ID NO: 47125 - DNA, 61 bp, Chlorella protothecoides
ggaggatggccaaggtgggagtcgtggctggggtcggtggcaaggccctctttgtcgccgc

SEQ ID NO: 47126 - DNA, 84 bp, Chlorella protothecoides
gtgcacgggcgcagtgtggtcatctaagcgcgggggggggagggtggggtggggttcaggaaaagcagggggaggtgaggagga

SEQ ID NO: 47127 - DNA, 61 bp, Chlorella protothecoides
atgacaagacgctgcctgtcacctgcaggcggaggaggaaggggggattcaaggctgcaag

SEQ ID NO: 47128 - DNA, 61 bp, Chlorella protothecoides
ggggaagaagttcactggggcggggcggggatgcttgctgtttgggccgcccccctggtcc

SEQ ID NO: 47129 - DNA, 136 bp, Chlorella protothecoides
ccctccctccacctctcactggttcggtcacgctccagccgatcgtccctgggattttgtcaaagccccccaccacccaatgatatattaagattgaaaccccccataacaaatcaccttttccagatcaccggct

SEQ ID NO: 47130 - DNA, 28443 bp, Chlorella protothecoides
  modified_base (845)..(854): a, c, t, g, unknown or other
  modified_base (1094)..(1103): a, c, t, g, unknown or other
  modified_base (1328)..(1337): a, c, t, g, unknown or other
  modified_base (1737)..(1746): a, c, t, g, unknown or other
  modified_base (2126)..(2135): a, c, t, g, unknown or other
  modified_base (3146)..(3155): a, c, t, g, unknown or other
  modified_base (3985)..(3994): a, c, t, g, unknown or other
  modified_base (5274)..(5283): a, c, t, g, unknown or other
  modified_base (6181)..(6190): a, c, t, g, unknown or other
  modified_base (6667)..(6676): a, c, t, g, unknown or other
  modified_base (6730)..(6739): a, c, t, g, unknown or other
  modified_base (6863)..(6872): a, c, t, g, unknown or other
  modified_base (7411)..(7420): a, c, t, g, unknown or other
  modified_base (7697)..(7706): a, c, t, g, unknown or other
  modified_base (8440)..(8449): a, c, t, g, unknown or other
  modified_base (9694)..(9703): a, c, t, g, unknown or other
  modified_base (10195)..(10204): a, c, t, g, unknown or other
  modified_base (10357)..(10366): a, c, t, g, unknown or other
  modified_base (10547)..(10556): a, c, t, g, unknown or other
  modified_base (10950)..(10959): a, c, t, g, unknown or other
  modified_base (11658)..(11667): a, c, t, g, unknown or other
  modified_base (12152)..(12161): a, c, t, g, unknown or other
  modified_base (13617)..(13626): a, c, t, g, unknown or other
  modified_base (13820)..(13829): a, c, t, g, unknown or other
  modified_base (14672)..(14681): a, c, t, g, unknown or other
  modified_base (15695)..(15704): a, c, t, g, unknown or other
  modified_base (16857)..(16866): a, c, t, g, unknown or other
  modified_base (17057)..(17098): a, c, t, g, unknown or other
  modified_base (17261)..(17270): a, c, t, g, unknown or other
  modified_base (17739)..(17748): a, c, t, g, unknown or other
  modified_base (18098)..(18107): a, c, t, g, unknown or other
  modified_base (19667)..(19676): a, c, t, g, unknown or other
  modified_base (20026)..(20035): a, c, t, g, unknown or other
  modified_base (20646)..(20655): a, c, t, g, unknown or other
  modified_base (21191)..(21200): a, c, t, g, unknown or other
  modified_base (21760)..(21769): a, c, t, g, unknown or other
  modified_base (21857)..(22055): a, c, t, g, unknown or other
  modified_base (24056)..(24065): a, c, t, g, unknown or other
  modified_base (24327)..(24336): a, c, t, g, unknown or other
  modified_base (24643)..(24652): a, c, t, g, unknown or other
  modified_base (26105)..(26114): a, c, t, g, unknown or other
  modified_base (26306)..(26315): a, c, t, g, unknown or other
  modified_base (27056)..(27065): a, c, t, g, unknown or other
  modified_base (27479)..(27488): a, c, t, g, unknown or other
  modified_base (28239)..(28248): a, c, t, g, unknown or other
acggcgcagcgcacgacgggggtggtcgggccccgggccagcaccatgaaggcggggcaccgggccacgccggccacggcgcccgagccgtccagcagcgcgtcgaggcgggccagggtggccgcgcgcgccgccgagcgcgcctcctgcgagccgaggtgggcgggcggcggggggtgcaccgcctgagccttgagcgcgaggcgcaccttggtctgcagccgcatgaggtgggcccgcacctccgcctcgctgcagccggcctggcgagagggcattccgggagtgggggctgggtgaggctctgtgaagggagggcatgtgagaccagcacgcctgtgggccctgggaattcaagcaggagagccgctacacccagcacccaacaggcaaccgcatgggatgagcactctgtggagcgagcgcccgccgccatgctcacctggtgcgcgatgtgttcgatctcctcggcggggaaatggtcctggacggagaagacgcggtggatgtagtccacgtcgcaccggcttttctcctcaccggcctccatctttggtgtgccggatagcgccggcatgctcaactcttgtatgtaggctacatgttcttttgtaaatcctgtagagatcgtgtgttagccttgtcccagcggggtcgagcccaagctgggggcactcctgtaatgatagacacgcggtcaatgacggggtgcacctcaagctccttctttcaccaattccaaattaggaaaattgattctcggctcgtattggctcatggtcctggcgactgcctgtccatcatgggacgggaaccccccagcaaggggctggtcatccaaaccnnnnnnnnnncggaaaattgattctcgtctcgtattggctcatggtcctggcgaatgcctgtccatcatgggactggagccccccagcaaggggctggtcatccaaaccctccgggcgcgaccgatccccccggcgtagcaaaaaaccttccccacaagactcgaccctgacacccatcaagaattttgatgaccattcttaattacgccaggtcagactcatcgaccgtcacgcggctcctgtaaaggnnnnnnnnnncgacttttgattaccattcttaatcactccaggtcagattcatcgaccgtcacgcggctcctgtaaaggcgctggcctcgggggaagggtccactggatcacaatgctgagtaggagcgtccgccaagcggtgagaaacggatcggagacttgattgtatgcctgaagatcactcggttaacccatcacgacctcccgcgccctgcaggagaggtccctgctggnnnnnnnnnngtcacccggtaaacccatcacgaccccccgcgccctgcaggagaggtccctgctgggtgccctgcggtcttatgccctggtgccaatggtagtagaatccacctctcggggcgagcgggccttcgacatctactcccgcctcctgcgggagcgcatcgtgtgcgtgaacgggcccatcgaggacacgagcgccaatctcatcattgcccagctcctgtacttggagtcggagcaccccgagaagcctgtgggtgcaggaagaggagggtaggagttcaggccgtggactgatcccttgcctgcacctgctggagtgggagcaggacctcgctcccccttcaatgcaattggccagcccctcaccactttccgctcgcatccttatttccctgtacagatnnnnnnnnnnctggccagcccctcaccacacccccgctcgcatccttatttccctgtacagatcagcatgtacatcaactcccctgggggtgtggttaccgcagggctggccatctacgacaccatgcagtacattcgctgccccgtcgccacgctggcggtgggccaggcagcctccatggcgtccctcctcctggcctctggggagccggggcaccgacggagcctcccacacagcagggtcatgctgcaccagcccagcggcggcgcgcaggtgcggactgtgggaaaagggagttggcaaggggggggggttggaggaggtttctgaaacaggcttctaatggagcggttttttggaagtttgtggatccacaagggtcctggacnnnnnnnnnnagggttctgatggagcggtttttttgaagtttgtggatccacaagggtcctggacatagcctggatgctcttggcaggccaaacgactgcctcaattcagtcatccatgaactttggcctggagtcacggcagagcaacatcggccttgcacaaaactgggcgcctggcagtgctccgtggcgtctggtcctgccccacccctcgccattccacagctcacctggtaaagctgcacgagcccacgctcccccacccagggtcaagccagcgacatcgcgatccaggccaaggagatcctgaagatgcggtccctgctcaacgacctgtacgtccagcacacgggccagacccagcctcgcattggtgagctggaaagcgcggcgtagttggcgggagggggggggcgagtagtagatgtgcacggtttgtttggcagcaacatggggaggggcctgaggaagagggctgaccatgctaccgccgctccacatcctcctcacgcatgatcatgtcgcgccgctgccgtcaacactccataccctaactcgctttccttcccccacctgcagaggagtgcctggagcgtgacttcttcatgtcggccaaggaggccctggactttggggtggtggacgaggtgatccagcccaggatgcacacgccggcggcgccttgagactgcggccgccagtcacctgaaaccgggggctgtgccaccctgggaccgccagagagcacagggcatggcggctgcaccgggtgggcggctgtcgaagaggcgcctgatcaaagaatccaccgcagcacccctgccaccctcagcgatcgccgcccagcttcagggcgtgcgtgcgctggcctatcttgcagaccagctctgttgcctgaaagggtgtgggcaatgggcaggtggagcagacgagaaatgggaccactaggcatctggggcgtgcaaaagaggccaattgttgagtcaaggtttgggattcactgagtagatcggagctggnnnnnnnnnngaagggacaactaggcatctggggtgtgcaaaagaggccgattgttgagtcaagttttgggattcactgagtagatcggagctggcacgtcgtcccttttactgggcgtcagatctccccacttccctctcccctcgggcccatgcccacctcaatgtgccaggccgggagcgggacagactgctgcttcagcactgcttccagccgctctaacgcatccccagggacccaggccacagagacgtggggccggggttccacgtagaacgtcggcagcccgtgccggcggaagaccgcgtccacagcgcgcaccgcgcgtgcaaaggcgccgcctgcaccctggccctcaatcgccagaaaggcgaggctggcgtcctcgttggccaggcaggccaggcggcgcaggtcgagggcaaatggggccagccgccacgcggcggcagtcagcatgcgaagcagggactccagctggctgccgactgctggggcggtgtgcgaaagggacacgtgccccgtgcccaggtccagcccacacagggtgggcagcgcggcgcgcaggcgggggagcgcagcgcgcagcgcgcgggtgacatccggcggggcgggggccgaaagggtgacatgcactgcgaactggccctccacgtgggggaaggcgcggatgcgctgggtaggaggtgcgggcgccggtgcggtggcggctgtgagaggtgggttgggggagatgggggtgaatgtggagtcaatgcccttcctattccgatggcatttgcaggccggtaggagctttaaacagcatttgcagggcttcctcaccctgatcgggctgnnnnnnnnnntttggggagatgggggtgaatgtggagtcaatgtccttcttattccgatggcgtttgcaggccggtgggagctttaaacagcacttgcagggcttcctcaccctgatcgggctgcagcagggcgctggggtctggcagcctgctctcaagagtgatgaagggcttaggttttgtgcagggcaggagctttcccaacgggccagtgatctcacgctttccctttcagcacaacacgtactcgccttgcttcttccaccttgaggcgtttgggggagggctctttgctctcctgggaagtcagctctccatcgtcctcaacatgagcactgccctctgatactgcggagcctgacggcgagctaccgtaggatgccacaagatccattcagtctgcggagcatagcttcctccaaggaagtttgtggtatgtttgaatgattagacagctctacgagaatcgccaggtgagttttgggtggagttttgcagccctgccgagcgttcgaggcgcgcccgcgcgcgattgttgtctgcagatgggcactcgacttctcaacacctctgcaggcaatcgagtgcaatgcgctactcaccagaaggctgcttctgcattcaagaatgtgagcccagcatgggcgaggatctgaggcgcctggaagaggcagagcaggtcagttcaccagaagagatcgacggcatgatatctccgtgttcatgccgcctgcagtcatgtcttactttctatatgcagagaattatcaatgcactggatggtgctgcggccgtcatgcttgagctggagaggggaggcgtagaagtcggggctcaaacattggaggtcttgcagaatctggaggtgagtacaggctccccgcatgtcgcacccaccatggtcagtcagacactcagggttaaactgccaccccaacttttgtctttgcactcaggaggctgagatcaccctgttggagctctgtgatcgtcatgccgaacccctgccgctcaagtatgcccaatggcccacaaccctgcgccgactgacaacttctgcccaacctgggacgccggggcatcatacattaggttccggaggcccaaacgtccaagaaacggatgacggcatggacttggatcatgactgactccttactataagcctcttgcacgagaagtttcctcctccccccccatcccagctcatggtgcattggggtgttgtcgtgtgaccttgtaccccgagatcctgacatgacgtgggagtcctagtcttcctctggcannnnnnnnnntctgcgccgactgacaaattctgcccaatctgggacgcccgggcctcatacattgggttcaggaggcccaaacgtccaagaaacggatgaaggcatggacttggatcatggctgactccttactataagcctctttcacgagaagtttcctcctcctcccccatcccagctcatggtgcaccggggtgttgtcgtgtgaccttgttccccaatatcctgtcttgacgtgggagtcctagtcttcctctggcaccagacttgatttgaagtacctgacagcatttaccttccagaattctctgcccttgacttgtcatgcagggtggtcacaatgtcggggtatggttttgtttggaggtagaaggggctgcgcagtggggaacgccagagaaaaaatgatgtagacaccgaacatcacgtggaatatggctcacaattgccagattgctctacacgctgccgcccaaagtaggccatgtgcttgtatggctaaaggagagcggtcatccctggcctcgtcccctcaagaagttggtcacactgtccaccagctcctggcgactggtgggcaggaagggcagcccttgcgctgcagcggtaggaacgtcctctttctgcggcagagcggcctttggcaccgcctgcccacccagttctgccatcttgctcgccatctcctctgggtccatggccacccgaaagttacggaagaaatcgagcagggaggactgattgccccggccgccctgaaaggtctggtcaaaggtgagcagttccccatcctgctttcggagttggccatctggtaccattttgagagcgcctgtggtatggttgggaggttcaggcacgtggggcaagaggctgttgcattactgacaaggcaggagatcagtannnnnnnnnngcaagcatgtggggcaagaggctcttgcattactgacaaggcaggagatcagtatatgataacgttcccatctctatctcgtacatccccttacatgctttacacaaactcaccttgcagcttgcctgcccaatcatccctgcgctcgaagaccaccgagttgtttggaggcgtctgcccgctcggaggaaggtccactgcagggcatttcagagtagtgtgtactgagaaattatacaacccaaccctccggcgggtgccctggcgcaaagatgcggtacaggaggcatgacttgaattgatcagctcccatgcaagttccccttggcttgcctggtgttgggtgtgggcagggtaatgctttcttctttgcttcagccctgcatgggacttctcgataccgaatccccatcaccccccacgttgtgttggccagcttctcaaatgccctgagacgaggcagacaaggtgcatccnnnnnnnnnngcaaagatgtggtaccggaggcgtgacttgaattgatcagctcccatgcaagtnnnnnnnnnnacggtgagcattcaggttggagtgccgatgagtcgattgcagcaccagggacagctgagaggtgctcatgaccgccagcttcctcactgtgttctggtgaccacctccatgaccctgcaacccnnnnnnnnnngcggtgagtattcaggttggagtgcgaatgggtcgattgcagcaccagggacagatgagaggagctcatgaccgccagcttcttcactgtgcctggtgaccacctccatgaccctgcaacccatgctcacacagtcactcaccacaccgagaggtcaaagtgggtgatgccatggtcgaagcagcaccacttctggttggagtaggcattgtcagggtagcgactgcgagagtggcatatgaatgaagaccagttatcgaggatgttcttgcaaggaagatctgcccccgaaccccaagcttcagcttaccagggacagctgtccgtcacccgcacgatgacgctggccgcctcatccagacacacatgactcctgtccagtaaatctccgaagccgtccaggagtcggggagtgggatcgcattgcacctcatagcagcgcctgcacacgggtgatgctactctttcagtcgaatgaggggaacaaaaatacgccatgatcgccttgtccctgctcggcgtcaccttacccgcatgannnnnnnnnngctgtttcagtcgaatgaggggaacaaaaacacgccatgacccccttttccctgctcggcgtcaccttacccgcatgaatcggtgaagtcgggagcagcatccgtcatggcggccacatcgaaccccgtcccgatgcccggccattggaatccaaagccgcaggagccggtctgaagagggcacacgagttttgtatgagtgcgtatatcatctaacaaagagtacgtacgattttgaagctcccatgtccatcggtgatgctcggccctggccggnnnnnnnnnnttgaataatttaataacgagtaaacactcccctgtccatcggtgatgctcggccctggccggtattgcgagatcgcggagatgtcagcgatatggatcctagccgacatgaatcgctaaaaatgcatgtaaaaccagctcccactcacatgaatactgtaaccgtccgctccgtagaatgtctgcagaagggttgcgcatgtgtgcattcgggagcatttcgtggacagggatcgcaccgtcgacatgaacaggccggtcaccccactcgcttaccgctctcccacgagtccatgcacacacttctatggcataaatcacacttgtgagatacaaggcggctagtagtcctcctcgcgccatgcctctcgaggatcgttcctttgccggagactgtggggtccagggtatctacaaaatcgcggtgccagcctcgttgaaggatccggtccgcgcagctcgagaattgtgagcccaccacatgagcaagtccacgagcaggctgtttcttcctcccgatatctttctagtgatacgtatctggcttttgttgcagattcgcaacagcgacaaaaacctaggtcatgcctcggacggtgccaatgctccggtcccccggggggcaagccgccctatccagtttccgcatgactacagcagggagtgattacgggccttccaaatccacagcccaacagtcgttgtctcttttgcattaccgtctgcttctattannnnnnnnnncgactacagcagggagtgattccgggccttccaaatgcacagcccaacagtcattatctcttttgcattaccgtctgcttctattactatgacgagagcaagaaagcgtagcagggaggtgatggaaggctgggtgaagagacatcagcttgactgattgaaaatatcaagacatggttcccatgtctcgggtgtagggtgattgaaaactagagtcgtagcaaagcgatgaatgtatggggcttgttataccttggaagtgctgcacttcaatttttccgaccgacctcgcaatgaatgcgtgggggggaggcgaatgcgccaggccacccacgaaagaagtaaccttcacagccgccgtccctggccaaaggacgagtcgtaggccgagacggtgggcgcgctgcatgcgccgcaggtggccttgcagtagccgtttgcagtgatctcggagcacttgccccactgcttctgctgccagcactctgcctcctctggcacaggggcatcttcgcagggcgaagatgaggaggaatcgccggagctcgagggggactgggatgagctgccgctgtcgctggatccacagcgtccgcaggtggaggcacagtaggagccgtcgatcatccactgctccccgcactgtgggagaaagggtttgtaatgggatgggcagggtgagattgtactatctgatggacgccaatactggaaagctgatggcaaaacagtccatcgcacacacatattggcagtctgtccttctctcaggcagaatcttagaagtaggctcccaccagctcccaaaatcatcgagagaagggcccaggcatgtcgtctcaccttgccccagttcttctgatcttggcaggagccgtagctgatggtgtacggcactgcagtgtcctggcagtcagcagacgatcccgatggggaggaggatggggaggaagacgaagcgtctgatggggaagacgatgactctgagggtgaagacgggctggagctgctgctgcaccggccgcaggtggtctggcagaagttgccgctggtgagccactcgtcattgcactgtggtggggttgtaaaagacttgtgtgagtccatgtacagtggcaaagtggggttagtacatatggcaagtcctttactggctcacagcagtgtctgatgatggcgagggtcacaacaccacaaacaacggcacaacccatcaggtaatgcatctccctgcacgagtgcctnnnnnnnnnnctggcaagggtcacaacaccacaaacaacagcacaacccaacaggtaatgcatctccctgcacgagtgcctaccccaacccccgctcaccttgccccagtccagctgttgctggcacgagccggtatcgggagcattgtcagtgcagccctcggagctggtgctggacgaggagctgtcactgcccgcagaggccgtggtggagccattggggacgctgttgggcgccagtcctcccttgaaggtagactcgtaggtgatcttgtccgaggggggggcagcatccacattgccggacacggtgacagcacctgtgatggacaaataattgggaagggcacgaggggtgaggcgaggcgcagcaggaagccggctggcgagggacctgagtagtgctgagcgaaggggatgcagggcaacacagacagcaaggcgccttgcttgttccatgcagctcacgttattgcaagcatgattatgcagggtcgaaggnnnnnnnnnncggggtgaggcgaggcacagcaggaagccagctggcgagggacctgggtaatgctgagcgaaggggatgcagggcaacacagacacagcaaggcgccttgctcgtttcatgcagctcacgtgattgcaagcatgattatgcagggtcgaaggnnnnnnnnnncacgtagatggtgtcctcagaaggcttcaccatccaggactggggctcctcggctgcaaaatagaggcaacatgggccagcagtgaggacagtgtgattgatgatggagtgcatagatccttcaaacgctcagccgtggtcaagctgagcaaaacaagtcggcgcgctcacgtggggtggnnnnnnnnnntacgtagatggtatcctcagaaggcttcaccatccatgactggggctcctcggctgcaagatagaggcaacatgggccagcagtgaggacagtgtgattgatgatggagtgcataggtccttcaaacgctcggccggggtaaagctgaggaaaacaagtcggcgcgctcacgtggggtggggttggcgatgggcggcgcggggttgtcggccgccttggtgcaaggcacctcctggtactggatgcccatgacgccccacttcacatcgctcaggcgctcgtaggccctgtggtcgggtgaacaccatttatgagtggagtgcctcgggctgggagaagcagaaaccaaagcgggcctcccaattcacaccctctcaccagatggacaggtcannnnnnnnnnaagcctcgggctgggagaagcagaaaccaatgcgtgcctcccagttcacaccctctcaccagatggacaggtcaaagtgcgtcatcccgttgtcatagcagcaccacctcttgttggagtaagcattattggggtagtcactgtcataggaataaatagagcaagggatgagggtgaggtgtttgcttgctaggtcgcacaaaattccaaaccgttctggacagaccgggtcgatgcttgcagtacatcatgcttgctccatgcacaactgccatgtgcggaacccccatttcctttccttcccgcctcaccatgggcagttgtcgacagtacgaacgacaatggtcttggatgagtcgtagcagacagaggagcgctcgtgggtttgaccgtacccgtcagggacggcggactgggggtcgcatttcacctcatagcagcgtccgcacgacccaccgaactcgggagcggcatcggcgatggctgcgacatcgaacccggtgcccacatctggccactgatagccgaagccgcacgacccagtctgcggagtgatggcgaggaagggttggtgcgcgccccaggcaaccgggctgcgggggtgtgcgcggcttcgaaccggcagacaggcggtatgggcatggggccacgcccgggggagacgcgcaccaccatcccaatgtggatgccctaccactnnnnnnnnnntgtgtacgcggcttcgaaccggctgacaggcggtatgggcatggggccacgcccaggggagacgcgcgccaccatcccaatgtggatgccctaccactcacatgaatgctccatccgtcggttccgtagtacgtctgcaggggtacggatggttcggacagggttcgaggcagacctgtactgctcaagcatgtgacacccgctgcccgatcacgcaactgcaaacatggactcaccgcacggcctttctgccaggcgagcgctccgctgaagctcaagcacattagaagcagaggaagcatcgtgtggctggccattctgttgtctgccgagcaagggggggagggttgggacggacaggtgagtaagccgccggcggagcttggagtcgtcaaggtcacgccgggctacagccagaacagagggaaaccgggtcgtgaatatgtctcggtggttgggcaagcgttgaccaggtcgtcatgacnnnnnnnnnnagcggagcttgaagtcgtcaaggtcacgccgggctgcagccagaacagaggagaaccgggtcgtgaatatgtctcggtggtttgggcaagcgttgaccaggtcgtcatgaccgctatcccacgtacctctccaatgagcccctccaatgattatgaaagtccaaaagtcgtctggctgactgaagaggtgcgctacacaagtcagcagtgatctcaggaagttcaagcgttatccgccgtcacactgaggttatgaatccctttcctcgggtctggtttgtgctgaagccacatcggatttcggcagtggcgtgcagccatccagacggactggtcggagcaagggagcgcccatgccggcaggaccgcttggtcacgtgacacgcagtcagtctcaccgcacatcgcgcacgcagcgcccgactcatgcgcgcttcccgatgcagacagggcctgcagtacgcctcttaatgggacgcccagagcaggtccctcgcgagtatgcgtgcacgcactgcgcattcccgttgccgcacagcgtaccccaccggtcccgttggtcagactccatactcggaaacccttggacgaatcccactgtacccaaatggtttctgtacaacacccatttgcacagatcaggcatcacagaggatcaggggcaacttcactggcttcctgagccaaacacgctgggcctggccgcaggcgccatgaccctgaagtattcctggtcgagggcctccaggttgcctgcggccgcgacggcggcggcatcctgcgtgatccacccgcgccaagtctgagcaagctcgggaggggcggtggcgagggcagcttccagagcctcggcagaggatgggtccaggtcgtcctctggccgccctcctctcgagcctgcatggggttgggggggcctgggcttgtgggataccatcagcgacggcatggcacaggggcggcgagcccttccccgacatgggacggtcatgaatggaacccggggcatgtctcaacactcccacgcatagcctcgcaccctgccgtctgccgggtgccccgccggccgtcacctcgcccagcaggttggagaaggcctcgcggagggtggcgcccctcaggacgtggccctgctggccaccctcgatcgcaccatcacccaatatctgccccatcatctgctggacggcgggcgactccgccatctgcatcagcgccgggttgttcatcatgccggacaggagcgaccccagcccgccgcctcccccagcgccgtcggcggaagggggccccgaccccagcatggactgcagcatgttgcccagcgccggcggcacaccggccaccgcgccagggcccctcgccggggcgccagctcgcggggcgccagcttgcggggcgccagcctgggaggcctgggcctgagggcacggcgcccctggtccggctgcctgcnnnnnnnnnncgcggggcgccagctcgtggggcgccagcccgggaagcctgggcctgagaggcctgggcctgggggcacggcgcccctggtccggctgcctgccccactcccgcgtcagaccctgctgcctgcggcggccccgcctcgcggcccgccgccggggcctggggcacgtttggcggcgcagcgggggcaggctcccnnnnnnnnnnacctgcggcgcccccgcctcgcagcccgctgcccgggcctggggctcgtttggcggcgcagcgggggcaggctccccgcttgggccgccgccctctctgcccttgccggcctggcggcgcaagggcagcggcctgaggcccttgaaaggcggccggggcttgggggccgcctgcacgccaggcgcaggggctgcgtccacgggcgcaggcccggccggggcgaagggtgccgcacctgccggcgttgcttccgccgcccccttttctgttgtggcaggggcggggccactggaggggccggcctcggagtcgttgctgcgctttggcggtcggggcgatgcccccgcctggctgctccctgcggcgccggtgggcggcgggacagcgcccgacgtgctgaggggagccgcgggtgccgtcgctgcggtcgcggggccccgaacagctgcgtcggaggggttgggagcagcagccgaaggttgacgacccgtctctgccggcggtggcacggccgggaccgaggtcccagggccggcggatggtccggcggcgacaggcgggccttcagcaggtgcttgctgcgcatgctgcgccggcgcggcgtacacgttgggcacgccgggacctgcgcagcgaggcgtgccagagcggggtcttgaggcatcccagatcccggcacgcggcggggcagccccggcccactcgatttctggcacgtgcccatggcacaaccccccctggaccgggggccttcacaccgcatgccacctcagcgtcgctgagtacctctccagcatggcgacccgccacgccccccccaccccctcacggcccgcgccctcnnnnnnnnnnacgcccatggcacaacccccccctggaccaggggccttcacaccgcatgccacctcggcgtcgccgagtacctctccagcatgtcgacccgccattgcccccccaccccctcacggcccgcgccctcacccgggatgcgaagccgccggccgtccagctccggccccgccgggcgccggcgggggggcggcaggtttgtcaccgcgtgcccctgccagtcggtgcccagcacggcgacgtagccgggctcggcacgcgtgatccaggcgttgtcctggcccagccaggccgcgtagcactgcgccacgcgcatcagctcggcggcggccgcgccgaccaccgccaggtgttgctgcagcagctggaggtcggcctgcaggacggggggcggtgtgcgccggcagcagtgcatgtggagtagggagcgcgccaggctgcgcagccggcgccccatcacgccgtggctggggttgtcggggcccgtgcccgtgccaaacaggcccaggtagcgccgcagcagcgcgctgagcgccgcgccggccagcgcctgcagcggggcgtggggtgcgcgcctgcggggcgcggcgccgcggggcgccggccccgagcaggagtcctcgctgcccgagtccccgcaggccgagccctcgcactcctcttcgctgcccaggctctcccactcgttgtcctcgccgtcgctcccgtcgtcgtcgctccaggacccccgctccccccggtcgtggacctccggcatccccgcgcggcgcagcgcgcggcgcagcgcccgatccaggccggtcatgtgggcgcggtcgttgcgcagcgcgcgccgcacgccgcgcagcaggtggcgctgccacatggcccccgcctcgccctcctgcgccgccagctggcgcggtgtgggggcgggccaggggtcgccggcgcttgccaagggcaggggcgggaggtcctgcatcctggaccccccatactccacggagtcgaagaaggaggtcaggccggagaagnnnnnnnnnnaaggtcctgcatcctggaacccccgtactccacagagtcgaagaaggaggtcaggccggagaagatgtccagggaggtggggcggctctgcccgtcggcatcgccggagccgccggcggcaggggccggggggggtccgctgccggtggggaccggcggcgagtgcatgacgccccgctgccgcgcctgggaggaggggccccggggcctcccgcgggagcccacgacgccggcgatggggtagaccaccaggtggatggcagaccccgactcaacgccataatctcccagatgctggtggtcctccagcacacgaccgcggaacaggagccgctggtggggggtggggatggcgcagattccttcgatcacatgcttcaacctccgaatgggagtctgcggggatcattgtgggtggcggtgagatcgggcggaaccattggctccgcactgcgactcggctctgctcgtgctgccgtgcatgacatgcaacccagtgcgcacatgttctgtgaagtcattcacgaggcggaaatcgtccacatcctgccgacggatcagcaggttggtgatgccatcgtccgccatttggccggctcggaagggggattggcccgggcacccactccacccagatgatcaggggtgtagcacaccgtctgcaaagtccgatttctaattatgcatgaggactatccactgtcctgctttgtttgcccatcactgcgatttcccccgctgcgcatcgcgctccagatgccatctttccaatatctgaagcgcccaattaactcaatcacatgtagacgaccgaggttggctcgcgaccgtgaatgtatctttcgcttctcacagtataacacaaatgctctcggtgcatgctccagcagctatgcagctgagcggtgcgccggtgaagggcaaggcctctggagcgccaggcaacaggctagccgctccccgcagtcgaaggcagcgtgttgacccctgcgtgccacgcgccatgtcctctgttacccatgaagcctccgaggtaggtgtgcatgtggcaacatggtcgatgcccggctttactcggggaaccccactcacgtagttcccctgcctggactcattcaccacggcctcagagccccgatgctccacctgcagnnnnnnnnnncttactcggggaaccccactcacttagtgcccctgcctggactcattcaccatggcctcagagccccgatgctccacctgcagagcgtcgttattcgacggagaccaccaaacagcgcttccgcccggaattgcgggcctctgggcttcaaggtgccctccactccagaggatgagccacgcaacatactnnnnnnnnnnnnnnnnnnnnnnnnnnnnnnnnnnnnnnnnnntgtgattccttgagcatcgagtatcccctcatgtgtcctcctgacttgtagctggtgggcatccagacttgcctgtacactctgctcgtgcccaggccccctgcaaacccccttgttccctcaccctccacatgtgctgctctctcaatggccaggtataaannnnnnnnnngttgcctgtgcactctgctcgtgcccaggtcccctccaaacccccttcttccctcaccctcctcgtgtgctgctctctcaatggccaggtataaagctgtggagatcgagcagtggcgggccagcacacccctgtccaagctggcagagcaagcaaagcgcgcgaagcctgcccgcgacttcatcggcgctctcagggcccagtccgaggcacgggggggctgtcctgggctcatcgcggaggtgaagaaggcttcgccttctcgtggtctactctgccccgactttgaccctgtcaaggtgagcgctgtgcattgccgctgcacaacagccagaggccaggcaggatattctcgtacagtccaccttgagtccctgaaagggaaaggcttctcccatgctgtgatgcgctggccacgccctgcacaagacccgcccacacacgccctggctccctcgcagatcgcgcnnnnnnnnnnaagcgctgtgcattgccgcttcacaacagccagaggtcaggcaggatattctcctacactacaccttgagtccctgaaagggaaaggcttctcccatgctcttaggtgctggccacaccctgcacaagacccgcccccacacgccctggctccctcgcagatcgcgcaaggatacgaggcgggcggtgccgcttgtctctcggtgctgacggatgccaagttcttccagggcgggtttgagaacctggccgccatccggagggctggcgtgacctgcccgctcctgtgcaaggagttcatcgtggaggtaacctgcctcttgtctctggggatgcctagagtgtgtgctnnnnnnnnnntgccatccggagggctggcgtcacctgcccgctcctgtgcaaggagttcattgtagaggtaagctgccttttgtctctggggatgcctagagtgtgtgcttgtgaagcacagctgtgagcggggacagctgcgtgccctggcctgatcctgctcaaacttatgccggcgaccgcctgcacctttttgtgccaagctctcctctgtcagtcagcaaccatgcagctctttgagtccccaccatggcccccgatcgccgtcacaccgatgccatgtcctgcaggcgtaccagatcttcaaggctcgggcctatggggcggacgcagtcctgctcatcgccgccgtcctttccaatcccgacctggagtacctgaccaaggccacccgatccttggggatgcagtgcctgatcgaggtgagagtggatgcggggccccgggtgaacagattcgccgcgctccaaaccaaatgggtcaacttggatcgctgctgcgctccggggcaggtgttgagatcatcgctcacagcaaaccctgctgacagccccacgccttctccccaggtgcatgatgtgccagagatgcagcgcatgctggacctggacctgaccggctgcatgctgggcatcaacaaccgcgacctgcgcaccttcaaggtctccctgcagaacagtgcggacatcatggccagcgtcccaggccaggaggtgggcggcgggtgcgtgcggcgctgcctcgcaaagggggaggggcgtaggcgcgatgggtatctgcgtaccgtgccctccatcgacagaggtgctgggtctggacacgctgcgacccatgtgtcgcatgttgtgggcaggagcattgttcgtgcccggatgcaccctctccttcgaccctcatccccatggcagcagatgcctgtcgcgccactgcccccccctcctcctcccccctcaaacacacacaatcttcccaggtccagcgccggggcctcctggtggccggcgagtccggcatcttcacgcacgaggacgtgcaggaggcgcggcgagccggctgcggcgccgtgctcgtgggcgagtcgctcgtgcggcagggcgacgtcgcccaggcggtgcgcaccctgctgggggagtgaggcaccagggcaggatagcgtgaagcgccggggtcgatgccacctgtcaacggccccctcttttgtatctggctcggcacggggctctcattcccggggtctcaggacagccttgctgtgtctggttcaagagacgtcctgccgccgcacgtgggcatggcatggcgtgtacatccatgcaggagcatgtcaagtgtataagggagcagagccatagcaagagggcggggatgttggtccggggacctggtttctgtgtcggggtgaagcatgcgcggtcgagcggaggcagggcgccgcgcagtgaccttgtccacatgagcagtacttgggtgaaggcagtttatatggcagatgccccggtcgagcccgtactggaccgcgacgccgggctcaaggcagcgtgccggcggcctggcagctggcggggcccnnnnnnnnnnaactgcgatgccgggctcaaggcagtgtgccggcggcctggcagctggcggggcccctcgggactgggctgggcctggccctaccccagcgccgggttggcaagggcagcgccggcctgcccgtttgccgtggcttcgccctgccccgcgagacccgccgagcccgcggccacaccgacgccgagcccctgcgccgcccccgacgcggcctgcgtgaccgcgctggacgcgccctgggatgccgtgcccggggtcgagccgcccagggtctgggtcgacccgccctgactcgacgcgccctcggctgacgccccctgagctgatgcgccctgggtcgaggtgccttggannnnnnnnnntgccctcggctgacgccccctgaactgccgcgccctgggtcgaggtgccttggactgatgcgccctgggtcgaggtgccttggactgccgcgccctgggtcgaggtgccttggactgccgcgccctgggtcaatgcaccctgggccgaggcgccctgcagcgccgtgctctggtcctgcgccgaggcgccctgggacgtctcgccctgcgccgaggcgccctgggcatccgccgcggcggctcccacactcgcagcgccggcggccctgctcccagcctccgcctggcctcccgcgccctgacttgcgcctgccgccgccgagcgcgggtccgtgccctgcgaggccccggccgccggagtgacgggtgggggtggggagggcagggcgaaatttggcttgaccccggggctcgtgcacttgaacctgcgcgggacaggggggtgcgtcgtcgtgggtggtcgtggcaggctggagggtcagagacggggcagggaggccgggatgccgcccactgcagataccgcgcaggctctgcatgaggccccggtttctccttcccacgagcgtcgaggacccctgcaggcgtgcctcagcgctgcaagcacgatnnnnnnnnnnaggccgtccactgcagataccgcgcagcctctgcgtggggccccggtttctccttcccacgagcgccgaggaccccggcaggcgtgcctcagcgctgcaagcacgattgcatgcacacccccattttctacccccctccccccaacccccctcccacgccgcacttccctccctccctccgctccacctctgtcctgcgagcccacctgaacacgcgtccctcgtgctgcccaaagtccacaaagtggtcccacatgtgggcggcggtccagggcgggatgggcaggtccgggttgcgcagcttgtaaaagtcaaagtcgaagcaggcggggccgcgctcgcgcatgcccaggaccttcacccgacgcaggtgctcctgcttggccgtgtattcgttggaggccagcccctggccctggaggggtggcgggggcggagggcgagagaggagtgaggggagcgcggggggccgggcgtgccggcacgtggcagggtcgagccgccggcgggcacggcgccgcggcgagcggaggagnnnnnnnnnnagagggcgagagacgagtgaggggagcacagggggccaggcgtgccggcacgtggcagggtcaagccgccagcgggcacggcgccgcggcgagcggaggagctcagtgcgccgcagcgacgcccagccaccgcgggcccagaccctttcctggggatggcctgagagggggcgggcggtgttcccccacatcaccccccctacccccctccgacccaccactcacccggtcgcgcgcccactccgtgtactttttgatctcggtggcggtggtccagttggcctccagcagatactccttcatcttcacaaacatgacctcaaagggcgagaggttgatgccgtcgtacatgtactctgcgtacgggttcagcctgcgcagcgcaagggtgagggcgcgagcggtggcggcggctctggcgtgcacggccacgtgccaggaaacccctgctcgaagggccgggggagagcgggggtgcgcgcggggaggagggcccctccgctgctcgctcccatccagcgccacggcatccccttccccacccgatgcgcgcccctccnnnnnnnnnnaggatggcctgggagggggcgggcggtgttcccccacatcaacccccctccgacccgccactcacccggtcgcgcgcccactccgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatgccgggacacccctgctcggtggaccggggggagagcgggggtgcgcgcggggaggagggccccctcgctgctcgctcccgcccggcgccagggcgtccccttccccacccgatgcgcgcccctccttgcctcagatgcccctcccaccgccccctgcggacccccttctccccccacccccagctcacgcggcgttgcagccccagttgttggtgtctcgccagtccacgccctggtagcgcagcatgagcgagtcgatgttgaagccggcgcgcaggatggccgcgctggaccccatctccgcgtacctggccggcggaggtggaggtggagggttggtcttgaacccgaaggggggggagggtcgaaggctgcgccgctgcagagcccggcaggtcactcgtgaccacgccgcgacccccaggccccaggtcaccccggatgcccactccagccccccgtggacccagcgcgttcctgtcctggcaggcgcacaggcacctgccgcccgcgtgctgcgcaccccacccgcgctcccgccaccgccgactcaccacacggcgtcgtggtaggcctcgtagcactgcagcgccgaggcgtcgctgcgcaggacgttgagggacacctggggtcgggggggggaggggggtccaaggggggtgaggctcggcctgccccacgacgacggagggacgtcgatgggcggagggcgcggcctcccagcaacctctccggccaggcgtacggccctggcagcccccacttcgtgcgcccccctccattcccgaccgacccctcccgcggttcagcccccacccccttcacacacacacccctccggcgccagacctggtccatggcgacaacgtaggactggatgtgggggttctggcgcttctcccctgtcagcacgccgtccttccaggtgccctcgcaggagatggtggaccccaccagcttgacctggtccgtcagccggctggtgagcacctcggtccagtgcagcgcgcggggccagtagggcggcaggaaggggccgcgcaccgagctgttcaggaagagcacgtagcggtagcgcgccgtgtcgacgtgcttggtgccgatcatccagccaaaggtgccccagtcgaagcaggagttggggtggcgcaccaggcgcacgttggccggcagggtcggcagccgcgtctcgcccagcaccgactcgccctcctgcatgacgatgacgtagtccaccccgtcgtcggccgccacgccgtgctccaggaagtagcgcaggttcccctcgtactccgggtcggtgaaggagtagacgtaaaccaccagtgtgctgcggtcccgtgggcccatcgcatggatcaggctgctgggtcggatgccctggtacctggcagagagggagggggtggggaggggaatgagtggggcaaggcgaggaggggaggggccggtgatgggtggggagttgagtggagctataattgaggtgtgcaggagcctggaggtccgctgcacgatgaggcagcagtggcgctcccctccttggaaaaacaatgtgctgaggaagagggagtgtggcttccccggcccggctggacgaacacacactcccacagggcgttgcgggcacgcttctgggtggactttcaagggcttgagtaccccaatcagtccccgacttccctcctcccttgcctcacgcccacctctccgggagggcattcagccaccagaagaggcacaggagcgctgcggcggcgaagatgaagcggtagcgcatgccgctctggcgacgaaacgttgccgtcctggtactgcgcagcgggactcgagggcgaattgtgtggggcgaggtggacgcttgatcggacatcgtttccaaagccaagcaggcaggatttggggggggatgcggtggatgaaggggttggtcgcaggccgcaacagctcggaggacaggaacactggtgcaggggcccgtacatcgcacatgagnnnnnnnnnnaagggcgaattgtgtggggcaaggtggacgcttgatcggacatcgttcccaagccaagcaggcaggatttgggggggggcgcggtggatgaagggggtggtcgcaggccgcgacacctcggaggacaggaacattggtgcaggggcccgtacatcgcacatgagcacatgagcaccttgcggttcgccctggcccccccccgccccccccctggtggctcacgctgtgaccctgctactgcgaggcgcctccacatcctctnnnnnnnnnncttgcggttcgccctgcccctgcccccgcccccccccacccccctagtggctcacgctgtgactctgctactgcgaggcgcctccacatcctctgagatgctgttggaccgcaatgagaccaggctgtcgctcagcatggctcaagctgctcctgtcctgctacctgtcggtggacagcatggtgcaagggcaagctgtgaagtggtgcccctggaacagctggacagaatgcagcccgaggatggactcgaggagcgcgcatggggctcactggcgtgattggagatatcgaacgagcatattacnnnnnnnnnnatagatggagctggtaatccaggccctgcgtccgggcgtggtggccctcatccgcgacctgaacggtaaccacgtcatccagcgctgcctccagcgcatgaccaacgaggacctgggcttcgtctacgccgccgccgccgaccactgcctggacatcgccacgcatcgccacggctgctgcgtgctgcagcgctgcatcgaccgcgccgacgccgcgcagaagcgtcacctggcgcaccgcatcgccgcacatgccctgatcctcagccaggtgtgggtgattgggtggtggggaggggttggtggagggtgtgtgtgtgtgtgctgtgtcaggggctgatgggataccagcccgcgcgctttggggtttaccagtgaatgagcctggcccaacaaacaacgttcccatctgcccgccggaccccaacacatcccccaccgccgccatcctttctcggcgcaggacccctttggcaattacgtggtgcagtacgtgctggagcagggcaacggcgagatgctggcgcccatcctggcacagctcaagggccattatgccgagctggcagtgcagaagttcaggtgcggcgagggtgattagggaagggggcccctgtcgctggcgggatgtgctggctggcggcaggctgaatttcgcaggagcatttgatctggcatctgccgaggggggccagcagccctaagagccagctggctggcactgtgtgagagcgccaatgcggcgcctgctgcctgccctggcgcatggagggtgtgcaggcagcggcgacgcgcacggtctggtcccaccttccctcaggtactcctccacccctcacccccaaaccatccccccttctcgacacacccacagctccaacgtcgtggagcggtgcctcaaactggggggcggggagacgtcgtccctgctggaggagcgcgacgcggtggtggaggagctgatgacctcgcccagcttcgggcgcctgctgcaggacccctatgccaactacgtgatgcagagcgcgctcagcgtgacctccggcgcgcggcatgccgcgctggtggaggccatccgccctttcctcccagccctacgcggcacgccgcatggcaagcgcatcctggccaagatcgccatcaaggtctgacgagccggggcgcggcccggggtcaaaaaccccgcagcgcgcgtcctgacccctgttaacgggtgcccccggccggtgcgtgtatgtacatggctcacgtgtggggcgcggggtggggtggccacccccctcctccgcccacgagagcagcttatccccggcactcccattgcgaattgtactcttgccgctccctctccttgtcccttggccccacctctgtaaaggctggtgggtgtagagtgcagcgggccagacctggagggttcgagcttgcatggtcatcgacggctgtgcagggnnnnnnnnnnttggcgctacacagccccgccaaccgcacgccgccccgtgctcatttccccccccccacggtgaccctgcctgccgtaaaggccgcgctcgccagcctactcgggcctcgccactctgaacagacgctccctggactcgttgttcggcaggccagtgcaatccctcgtgcagccccctcccacagtcgcccnnnnnnnnnnctggcgctacacagccccgccaacggcacgccgccccgtgctccctccccacctcccccgtgaccctgcctgccgcaaaggccgcgctctccagcctactcgggcctcgccactctaaacagacgctccctggactcgtcgttcggcaggccagtgcaacccctcgtgcagccccctcccacagtcgcccatgctggaatctcagtccgaaactgggcagctgctgcttgcgagaggttacaggactgcaggcggcacgcatgcagcgtggcgccgagaggctgtccagccgtcaagtggcgggggttacagcaggcgctgtgcctgactgagcgagagctcactcgtcgtcctcgtcatcctcgttctggtccgcaatgttgaagtagcggagctcgtacacgctgcggtccttgttggaggcaatcacccggagccagtcgcgcacgttgtgcttcttcaggtactgtggagaggggggtggcagggcaggcggctcaatgggcgcaccaggggttcccagggatgggacctggccttgaccaggcaggggccttgcacgtgcaacactgcatccacctgcccgtggcatgagagcgtgcgtgcatgcatgcatgcatgtcccacatgagaagtctctcttcagtctggagaaagagtggtccgcctggccctccccacgacatccccgcgcgcaccttctttgtcaagtacttgaggtaccgcttgctcatggcgatnnnnnnnnnnatctcttcagtctggagaaagagcggtccacctggccctctccacgacacccccacgcgcaccttctttgtcaggtacttgaggtaccgcttgctcatggcgatctcgctggtgacggtgacggaggacttggtgcgggacaccttgacgttgtcgcccagcagacccgtcttgccatcgaccttgatcctgtcttgcaggaacttctcaaaggacgcaatctccatgatcttgtcctccaccggcttggtgcagtcgatggtgaaggtcaaggccttcttggccttcttgggcccgtgggacttcttgatgactgcctgcaccatggtgccgccctgcagtgcggtgggggggtgggggagcatcgcccaggagtccctgctcacagacgctggacgaggcccggccgggcgnnnnnnnnnngtaggggagcatcgcccaggagttcctgcacacagacgctggacgaggcccggccgggcgacgcagcaccgacgacattttcatacaataattgaatactcgatacgtcgaggccgtgaaggcgcaattgttcagccccttccagtccaagcacgcctctcggtgcccgcacacggcggggcaaggagacagggcgccgccctctaccctcaatcctcgacggtatgctgagaacacacctttgctgcctatccacgcttgggctgaaagagggggcaccaggagcacaccccagactactcgccacggcaaagttgccggctcaaaacctgggtcaatgggaggctgcccgagtgtgggtctcgctcaaacacggggtacctttcgtcaggtgcactgtatagggaccgtcgcgtatgcccgacggtgctcacggttatttgcagcaattccagacaaacttcctggcgcatgcgaaaggattgcgggcctgcgatgcgacagctacggtgaggatctccgtcagcttggtagctccgtagcttcttcccctcccaaatgatcttgaagccctgtggagctggaaataattcttgaaactgtaccatgcacccttggcagtggctgtgccttctccaaatagatcttgcctgctgcttcgcctctgctgtactgtggcaaagcgccgtctgcaccagagtccacggaccaatcccttttcctctctccggcatgtcgcatgatatcgagnnnnnnnnnncgatcttgcctgctgcttcgcctttgctgtactgtggcaaagcgccgtctgcaccggagtccacggacccatacctttccctctctccggcatgtcgcatgatatcgagtaatatgctcgttcgatatctccaatcaccccagtgagccccatgcgcgctcctcaagtccatcctcgggctgcattctgtccagc

SEQ ID NO: 47131 - DNA, 74 bp, Chlorella protothecoides
ctcggtgtcggagggcgagcagcaggtgtgtgtgtgtgttggggtggggggacatcaaagggtcatgtgctgcg

SEQ ID NO: 47132 - DNA, 61 bp, Chlorella protothecoides
atgctgcagtgattgcctgggacgcttgcaggtggtgcgggagtgctggctgctctgttcc

SEQ ID NO: 47133 - DNA, 114 bp, Chlorella protothecoides
ggggggggagggggggttctgagcgaagccttggtggctggctgctgagtatggatgccggggcaaacctgtgcactcagtcatggttgtaccacactcccttgagcagtgctt

SEQ ID NO: 47134 - DNA, 2907 bp, Chlorella protothecoides
  modified_base (628)..(637): a, c, t, g, unknown or other
  modified_base (711)..(720): a, c, t, g, unknown or other
  modified_base (1437)..(1446): a, c, t, g, unknown or other
cctcgcgcaggagacgcgccgcctccacccgcgctgcgcgctcctcccgctcccgctcggcgcgctccagccggcgctgcgccagccaggccgccgtggcgcggtcccgggcccgcagcggctccagcagcgcggcctcgatgcggagcagccgctcgcggtcgtgcgcggggtcggccaggacctgcaggtggacctccagcgcctccgccagctcggcagcagtgcagcgctgctcgggcgcgaaggccagggccctgatcacgcgcagcaggacgcccgcgggcaggccgtcgatcaggtggaggaggggcctggcggggtgctccttgtgaccccgggctgcatatgtgtgcggaggtgagagggggggggaggagtgaagggatgtgcaggatttcggtgaggaggaatgggaggggtgttggggtagggcaaggatgggcggcaggagtcgcaaggcagggtgcggtcgcatggggtcgcgcggcaagaggcggggccgcaagggtgggcgacgcgggggcacggcaagcaagcactcgcagtgcggttgggggtggtggacaggtggtgacccagcaagggtcgccgaagccgggccagccagacgcagcaggcacagccnnnnnnnnnnccaagcacagccctccttgcccctgcccccgcccccatgcatgggcccacacacctcgctggtactccttgccnnnnnnnnnngccccgggctgcatatgtgtgcggtggtgaggggggggaagtgaagggatgtgcagagtatcggtgaggaggaatgggagggtgttggggaaggacaaggatgggcggcaggagtcgcaaggcggggtgcggtcgcatggggtcacgcggcaagaggcggggccgcaagggggggcgacgcgagggcacggcaagtaagcactcgcagtacggttgggggtggtggacaggtggtgacccggcaagggttgccgaacccgggccagccagacgcagcaggcacagccctttgcagggaagggcgagtgagagcaggctcccacgcctggtcgtcacagggtgcacctctccacaccctccccacccccgccccaaagccaaccacagccctccttgcccctgcccctgcccccatgcatggcccacacacctcgctggtactccttgccctcccagccgttgcccagggccccgggctgcagcagctccagcatggagcaggccattgcccagacgtcccctgacatctgcggtctcttgaagccctcgttggggcagaaggcgtatgtcaccctgcagtggccagtgaaggaggttgtcacacacggccagcgtgcagggagggctcctgaggggggagtttcgggcacattcacgatatcgcatcccccccctcccatgaccgcggaggcccccaccaactcacgcgacgccttnnnnnnnnnnggtcacacacggccagcgtacagggagggcttctgaggagggagtttcgggcacattcacgacatcacatccccccccccaagaccgtggaggcccccaccaactcacgcgacgccttcccacatatcgtgggggtgagggggtctgccgtccgccgtcggccggaaggctgtgggtggcggcggaggcaggccatcagcgctcgtgcagaggattgacggtgcagccagacaggcccagacggcagggcgggaagcatgcgggctggggttgcacggagtgggcgggggggctgcaggccacaggccccggctggccatgtgcaggggacgacctccccactccccactcaccccccgaaaagtccaccagctttgccgtgggctcgccattggcgtccacgcagaccaggatgttgcagggcttgatgtcgcagtggacgatctgcggcggggagcgcagggtcatgaggcagcgggtcgagggggggggcggtcaggcaggcagtgaggcggctccaccggcggcgggcatgactcaggccccgtcccgccctcacatccactcacccccagctcgtgcaggttggccagggcgcgcgccatgctgcacagcaacttcacctggctgacctcgtccatgcccgggttttggctggggggggaggagggggtggaatggttgaggcagggtgcagggggcgcagggccggctgggcgcggcgcggcggcgtgggcacggctctgcgactggccaccgcactccgcgactggccatcgcactccggaggctcgggcgcgcgcgcccttctgaccccaccccaacaaccgatgacggacgctgcctgccctcccaccaacacccactcaccgcatgtactcgtacaggtgcccgccgttgcagtgctccatgaggacgccctcggggcaacccacgtcgtccgtcacgatgcccacaagcgcgacgtttgtcggcccgcggaccatgcgcaggctgcgcacctcctgcagcaccgccttcatgcgctggcctggggtgagtctggggtcgaacagcttcagggcggcctcggtggggaggcctgcctcccatggggcacccgccaggcaaaccctggagaccctgccgtaggtgcctgcccccaggaagcctgtctccacgaccttcacgggcggcggcggggtggggtggggttcagatcagtcggccgggtgaaccatgcaggcccaggccatcaggcggccaagcagcctcggcaggacattggtgcatggactatcaacacagtaccaggtccccaggcaggcagcgccaccccgcctccactgaggcacccccctctcacatggctcctgtggatcagaggcaccttggtcttgatgcaggcccaatacttcccagtagatgtaatggccatctcctcggctgcaatcggagggggagcatggcatcagggggggg

SEQ ID NO: 47135 - DNA, 61 bp, Chlorella protothecoides
cacagctacataggatggtacagggggggggatgggcggtcgagggcaggttgcggagggg

SEQ ID NO: 47136 - DNA, 61 bp, Chlorella protothecoides
gtgctgccgagtccagtacaggcatagagatctgtaaccggcggcctcgtggaagacacat

SEQ ID NO: 47137 - DNA, 61 bp, Chlorella protothecoides
gtgttggcggggtggaagcattgggatcgcgccatcatggtccggactggagccatgcgcc

SEQ ID NO: 47138 - DNA, 70 bp, Chlorella protothecoides
cagcacacgcgcgcacacacagtggccaggtatgggtgcgggggggtggggccatggtggcgccagtgtg

SEQ ID NO: 47139 - DNA, 61 bp, Chlorella protothecoides
ggtggtggccggtaaccaggttgtggcaggggccaggctgcgtactggttaaacccctccc

SEQ ID NO: 47140 - DNA, 61 bp, Chlorella protothecoides
gacatgtacttggcatctccagctggtgtatggtgccatctcttgctgaagctaaccccag

SEQ ID NO: 47141 - DNA, 61 bp, Chlorella protothecoides
cggcagggccagagttgaacgaggcgcggggatgggagatgcaaggaggaagctcacagga

SEQ ID NO: 47142 - DNA, 65 bp, Chlorella protothecoides
tccagcgcgtccctttttatagagggggggatccggggggggggggcagtttaaaaaggggaggg

SEQ ID NO: 47143 - DNA, 77 bp, Chlorella protothecoides
gccagctcctcgggccccgcgggcgcgtcttcctcctcgagttccttgtccagggtgtcggaggcctggcgcccaaa

SEQ ID NO: 47144 - DNA, 76 bp, Chlorella protothecoides
gctggccgccgccgacgtgggcgtcgcggtgggctccggcgccgacgtcgccgtggaggcggccgacctcgtgctc

SEQ ID NO: 47145 - DNA, 77 bp, Chlorella protothecoides
cagagctcgtgctctgtgtaaggattcagaagagtacagcatggtgttggaactgggctacttcctcctggctctca

SEQ ID NO: 47146 - DNA, 70 bp, Chlorella protothecoides
cacgctgagcgccatggacacgctcatggcgaaacacaagggtgaacaaagtcacaagaacccccccccc

SEQ ID NO: 47147 - DNA, 61 bp, Chlorella protothecoides
ttaatacaactcgagcgggtacagcggcggtgcctgcagggcctgcttggtgcatgacttg

SEQ ID NO: 47148 - DNA, 61 bp, Chlorella protothecoides
tcttgaccggctgcaacatccgatgattgccccccagccatgcgcatggcgcatgcacagc

SEQ ID NO: 47149 - DNA, 61 bp, Chlorella protothecoides
gcaggcaggcggcgcagaaggcgtgcccgcaccctgccagccgcacccccggcgccgcgtc

SEQ ID NO: 47150 - DNA, 62 bp, Chlorella protothecoides
gtgggtggcggtggcggggtggggcgcagtgcagcccccaagagcctcactcccgcaccgat

SEQ ID NO: 47151 - DNA, 61 bp, Chlorella protothecoides
gcctcggaggtcaaagaggcctggcgggagtgcaggtccccgatgccggagacggtgcggg

SEQ ID NO: 47152 - DNA, 68 bp, Chlorella protothecoides
gacatgagcaccacctgcaggcactcagcgcaggcgagcgccccaacactcgaactgcatgcggcgct

SEQ ID NO: 47153 - DNA, 74 bp, Chlorella protothecoides
ggaggctctgccctcggactgcaggtgtgccactgtcccttcatgtttttgtttctcctttgggaggggggggg

SEQ ID NO: 47154 - DNA, 94 bp, Chlorella protothecoides
attcgcaaggctctcgctcgcctgtcagccagcaagtctgtcagcctgcccgtactggtcttcatgcactgccccaatccccacccgcagcgac

SEQ ID NO: 47155 - DNA, 61 bp, Chlorella protothecoides
gttgagggagatgttgtccacgatggcttcacccacccctgatcccaaatcctgaagcagg

SEQ ID NO: 47156 - DNA, 165 bp, Chlorella protothecoides
gcagcgcatgaagcctttctcctgatctcctcccccaccccttcctcctttggcaggctgctggcgagacacgtgagcctgctgctgtcacacctaggcggcgcggcccacaccctgaggtccagcatcgtgactgcttcgggcctgctcctgcagcgcgccttt

SEQ ID NO: 47157 - DNA, 89 bp, Chlorella protothecoides
ggtggcgctgctggccgcgcgcgcgcgggctctggacggccgtgacccctgcgcggacagccctcgccttgtcgcctacaccaccgacc

SEQ ID NO: 47158 - DNA, 61 bp, Chlorella protothecoides
gccgcgcgtgcacccagcgagcctcggacgtgtggcttgatcggtgcaagtcatcccacgc

SEQ ID NO: 47159 - DNA, 61 bp, Chlorella protothecoides
ataacaatgcacatttagtgtcgggaacaggtttcactcgacacaggacgacacccacctt

SEQ ID NO: 47160 - DNA, 69 bp, Chlorella protothecoides
cccgacccaatcactcaggcaaccccccccactctccacccctcccctttgcaggtgtctggcggggag

SEQ ID NO: 47161 - DNA, 61 bp, Chlorella protothecoides
ctcggcagcaatgggcgcctcctcggcaggggggtgagacttcgccttgctcaccgtcttc

SEQ ID NO: 47162 - DNA, 153 bp, Chlorella protothecoides
tgtccacctgctccattggcctctcctgcagccccaaaacaaccggcccaacgccctgccctggtgcctgccagccctctcacaccctgccatccctccgacccagcgacccagccacccgctccctttgctcacccgatcgccgctccagta

SEQ ID NO: 47163 - DNA, 88 bp, Chlorella protothecoides
gcgctgaagtggtggcttgacctgtgggtgcggcttctagagtcgtctcaccaatatccaggcctgccatgtccccggaagcttcccc

SEQ ID NO: 47164 - DNA, 6078 bp, Chlorella protothecoides
  modified_base (934)..(943): a, c, t, g, unknown or other
  modified_base (1941)..(1950): a, c, t, g, unknown or other
  modified_base (2090)..(2139): a, c, t, g, unknown or other
  modified_base (2237)..(2246): a, c, t, g, unknown or other
  modified_base (2555)..(2564): a, c, t, g, unknown or other
  modified_base (2923)..(2932): a, c, t, g, unknown or other
  modified_base (3896)..(3905): a, c, t, g, unknown or other
  modified_base (4527)..(4536): a, c, t, g, unknown or other
  modified_base (4729)..(4738): a, c, t, g, unknown or other
  modified_base (5072)..(5081): a, c, t, g, unknown or other
  modified_base (5294)..(5303): a, c, t, g, unknown or other
ggggcggccggcggcggcgacaacagcaagggccccgcctcgccggggacgaccggcaccggccctgcgccgccgtcggtcaccctgctcctgcgtccctttgcggaggagcagggctcggtgttgctgggctcgcccggcgcgcgcgcggtgctggcggccgccgacgtcgccgccttcgtcttcgacgccacctcgcgcgaaagcttttcggccgctgtggcgcgcatgctggcggtggccagcgctgccgacgactgcctgccctgcgtgctcatcgccgcgcaggacaccgtcatggacccggtgagcttggtggggaggaagggggagggtccctgaacgggatcaaggccgatccccatgggcccccttacgcctctgccacggaaccctcttctgtgcctaacgattgcatttatcacttggtgaccaccccaggtcatacctcatcgttcctcgctctccatccctggcagcagcaatctccatttcatccaacctcccccgcgcagaccctggcggcggaggtgggggaatcgtgcagccggctgggcgtggccccgcccatcccctactccggcaccttcccgggccggggcatgtaccaggcgctggcgggcgcggcgctgggcgcggagctcaccatccccgacacgccctcgctgcaggcccggcggcggcagcgccgtgcgctgcgccgcgccgcctgggctggcggcgcgggcctcgtggccacgttggcggggtacgccgcgtggcgggcctaccacggcctgccgctgctgggctccggcaaggcggccgaggcgcgcgccgtgccggagcccagggcggctgcctgacgcgggaccttgcagctcgccgtcgtggctgtttgagtcgggaagagggactctcccactgacgtgcaggaacccttttctctggagcnnnnnnnnnntggcagggcggccgaggcgcgcgccgtgccggaggccagggccgctgcctgatgcgggacctcgcagctcgccgtcatggctgtttgagtggggaagaggacctctccccctgacgtgcaggaacccttttctctggagcacactgccatgcgtcttcccaatctgtgaggcacagctccccctttgacaacatgggagggcccatgtgccttcggaggagcgggccactcgatgtagccccaacaccccgacgcccttcgttttcttccgcaggggtgcattgccatcaatcccaggcatcctcgtcttcgatgaacttggtttgcaggcatggcagtagcacaggaatagtcagcaggacaggcaggggtgggagcaaagcagtgatgtcgttgtgggcgacaccaccgacaaaccaaacaataaagaggggacatgggtgctgccacatcaacaagcactagaaccagggctgccaggtgggctccatgcggcacaggttctgcgggttggtcgccgcgtccaccagcttgcgcatgccggtctgcgggttggcggccgccagcacgctgctggcgggccccaccgccgccacgcgctcggtcgccgccttcacgttcatggccacgcaggtctggatttgggcggggccaaagctggagctgagcgccgccacggagcgcgagccggagcgccgggccgcccaggccaggatgtcgtcgcggaggaagagggccagcagggaggccagcggcgagtgcggggcctgcaggccctgcgccgcggcggcggcggccgccacgaacaggccctccagcccgtgcactcccatgaaggccaccatgttgcgcgtcaggcggaagggcaccgtctcgtgccccttctccagctggaagtgcacgtcgtagttggatccctgtggaacgattttaaaagggggggattgatgggcgttttggtaggctgtgggaggggaggggtgagtttcacggcttgnnnnnnnnnnaatttgagaagggggggattggtgggcgttttggtagggtttgggaggggaggggtgagtttcacggcttggggaggtgctgaggccggggtgggaggggatgctggtggagtgtggcgagtgtcagaggcacagtccannnnnnnnnnnnnnnnnnnnnnnnnnnnnnnnnnnnnnnnnnnnnnnnnntgggagaagtgagggggcacacgcagtgagggctttgtttagggttgggagagctggtgtgccgattgacggctggccagatgctggcagggcgacannnnnnnnnntccatctggctgatgcgtcccgttgacttggacaccagcacccgcccaggggagcgccccgtcagcagcagcatatagcattgcacggctgtggggagaagggagggggcacacgcagtgaggactttgtttagggttgggagagctggtgccccgatggacggctggccagatgctggcagggcgacagagaacagcacgaagctaagatctccgaatccagcccacaagaatgccatgcagccctggtttgatgcaccctccgccccctttcccacacaaaagacccccctttcccccccccccccnnnnnnnnnnacacccacctgacatggcggcggactgcgcaaactgcttcttcacgatccaggtcatcttggggtcgatcatggtcttgtgcatgtgctggctcaggatgttttccgtcaccaccttggaggccacctcctcgtaggccgacagccgcacctccaggttggtggtgatgccctccgctgagcagcaccgcgccttgaaggccacgatcgggtcgtccggctcccggccgtacctgtgcagggtgatgaggcgatcgagtgcatactgaaatgggtgagggggtcacgatgggaaggaaagggcgggagagcgggataaaagggatgcaatactgattgtccaggggctgctgagggcgnnnnnnnnnncaatgaggtgatcgagtgtatattgaaatgggtggcggggtcacgctgggaaggaaaggacgggagagcgggacaaaggggatgcgatactgattgtccaggggctgctgagggcgtccggtgcggcgccgcccctccttcccttttcttgattcaaggcgcgccgcgcatcggctcccctccccgttccacgacccccctccactcctctcaaaagccctccccaagcccagagacgcatgcctaccgggcgcagtggttttcgtacacgtccaggaaggagagggaggtgggatcgtcctccacgatgcgcactcccagccagatgggcaggatggccggggtggagaactgcaggctgcgccggcgcgactctgggtgcatggtcaaaagcacgttggcggctcgcagcatggccaggatgcgctcgtccgaccccgtcagctctgcggatagatggagtgttgggggggttaggttgcggggggccgaccctcgagctgagaatcctatttctgggaccgctggggccatcattcgggcgacaggcgcctcacaatcgcggcctcggccccgcccccagccagctaccctgcagcgcaccaccagagaaacacagccccgccgttgcctcgatccttttccttcgcgcttccacccccccccaccccccccctcctcacgttgctgctgggcctggatgaggaagtggcgcggctggccgtccgatccgtacagcgtcaggcggcggaaggagttgcagttgcgacggaccacctccagcgtgctcgccacccgctcgatgaagacgggctcggggctgtccaggctggcaggggcctgcccgggcatctccacgtcgtccagcgccaggtccagcagctgatgagtgggtagaggtaagtggggctgatggcgagggtctggagcggaaatgacgtcgactaccaggggcgaagtgacnnnnnnnnnngagtggggcggatggtgagggtctggagcgagaatgacgtcgactaccaggggcgaagtgacggatgggcttgctctccctattgcaggactggctggtcgcgtggacacatcgagtcaaccccccctccgcactcccgtctcctcctcaccaggggcgcctcgttctccagcttgaggtgggtggggtaggtgtcctcgatcactgcctcgagcatgaccctccagcccttgaggcgctccgtcagtgcgcccagggtctggggcgaggaggggctggccgggtccacgtccttggcaaactgctggtggtactggttgctgcgtgacggcccggcgccgtcgcgcgccgagcaggcccggcacacattgaccagctccttcttgaaggtttcggggatgggggcggagggcggcagccccgtcttgtacgtgcgctggcccagcgcatgcaccaccgccagcagccgctcgtcggtgcgattggtgaaccgcaccgatagctcctgcatcaggttctccagaccctgtgagtagggaggtggggggttgggggccgggagtgacaaagggtgagagcagtgttctggtgtcatggcgatgggtactttgggaagccagcnnnnnnnnnncggggggttgggggccgggagtggcaaagggtgagagcagggttctggtatcatggcgatgggtactttgggaagccagcgccgtttcaagcagccaccacaggcaggccagaggccctgagcctctcatccagagttcacttccaaaatgcccttttcgatgtcgctcacctgcagcggaccgccaaaccgnnnnnnnnnntcacaggcaggccagaggcccagagcctctcatccagagttcacttccaaaacgcccttttcgacgtcgctcacctgcagcggaccgccaaaccgccgcttcaggacgtcgatgacctccttgagcgcatcgtacgcgagcacctccatgggcttctcgatgggcggcgagttctccggggcggcgccgccgtcggcgcccggcgcggcggcggcggcggcggcggctggggcgggcgtgccctcaccctccgctgccccctcggagcccttgccctcctccgcggcaccacccgcagcagcgccgctcgcaggctccaggctgcccgcctcgnnnnnnnnnnctgccccctcggaggccttgccatcctccgtggcaccacccgcagcagccccgctcgcaggctccaggctgcccgcctcgcggcgcgcggccttggccacctgcacagccttcaccgccgcctccttgagcgcgtgcaacgcgggtcgcgcatgccagtagaccagctgggggtgcgctgcagcggcgacgcagagcacgcgccgcgcggcgnnnnnnnnnnagccttggccacctgcaccgccttcactgccgcctccttgagcgcgtgcagcgcggggcgcgcatgccagtagaccagctgcgggtgcgctgcggcggcgacgcagagcacgcgccgcgcggcggccagctcgggtcgctgcagcgagaccaggagctggggcagccagggcagccagacccaggcggggagatcgcctgccgcctcggccagcgtccgacccaccacctcggcgccgccgccggagaccatgagcaggtctaggaggcgtgggaccaaggaccgcgcctccagcccccccagccggatggcttgggtgtagcaggccgcggcaaactccagccagctggcgccggcgcccgccgcctggcgtgcgtcgcagaagcgcccccacgcgatccatgcgtcggggcacagcgtccacagcgtgagcgcctcgctgaaggtcgcgtcggcggcgtcgccctcgcccagggcggccaggaactgagccttcaggtttatcatctccgcctggtgctggggctggaagtagtccaggttggtgctgttgatcaggttcaggccgtgcaggtgggtgtcgggcttcatcaggtacgctttggcctgtgttgttgggggggccggggaggggggagggggattgttcgagggccaaacgccatcatttcgcatgagcatgcccgtccttcctgatgcgcccatgggaagagcatcgatgcactcactactccccattcctgaagcccctcactccccccatccctgccccccc

SEQ ID NO: 47165 - DNA, 65 bp, Chlorella protothecoides
atataccgtgcccgaggtgaggatcagcactgcacgttgcggagggaggggtatgggtggtgcag

SEQ ID NO: 47166 - DNA, 61 bp, Chlorella protothecoides
caggcccaaccaccaaccaggtgtggctgggttgtgatgacaagaagagtatggacagaag

SEQ ID NO: 47167 - DNA, 154 bp, Chlorella protothecoides
ccgtggatcgtgctgctgcagagcccaggctctggagcgcggctggagaccttgcaaggcctgcacgggtactggcaggctcggggcctgcaacctcacggctccagcccacccccattcccatcccccctgcaacagatcaagaggaccgagg

SEQ ID NO: 47168 - DNA, 80 bp, Chlorella protothecoides
gagtggacactttctgccaggccagccagcgcgcagccaaccctgggccaccaccccacacctcctcactctgcaggcag

SEQ ID NO: 47169 - DNA, 160 bp, Chlorella protothecoides
attcttgtgaggaggtgctggggcgaaactggtgaggacgcgaggaatgtgtcttccggtgcctgctgggttgcggcagggtctcgtgcgacgtcagggagggtggcctgtgtcgataggcaacgagggcaaaagccgcctgctgtgcattccgccctca

SEQ ID NO: 47170 - DNA, 61 bp, Chlorella protothecoides
ggcctttctggagagcatggaccgccgcatcgggagggcccacctcttcaagcgcagcatc

SEQ ID NO: 47171 - DNA, 103 bp, Chlorella protothecoides
cgaccctggctgccgaacgtcggtctcaggggccttgtgtggcgatgccgctcatcgctcgacgacgctcggaccccgaccctgctaatcctcgacatacagg

SEQ ID NO: 47172 - DNA, 639 bp, Chlorella protothecoides
  modified_base (109)..(290): a, c, t, g, unknown or other
  modified_base (382)..(578): a, c, t, g, unknown or other
gaccgcgagtacgagagttgagggaggatgctgagggatacgaacgatgttcttggggggggggagtggtgtaagtgggcaaattgtgaaggaatcatggctgggtctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcccgtaacgcataacgaagtggaacgccaccgcctactattccagccgcaaatgctcgatttagatgaatgacttctcttcgtaggtccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttacgtatcttttcgagacttgatggagttaaagatgggctgcagctctcagactgtctga

SEQ ID NO: 47173 - DNA, 62 bp, Chlorella protothecoides
acccctaattgacgtccccctacccctttcccacccctttcacacccccaaattgtcctcgg

SEQ ID NO: 47174 - DNA, 61 bp, Chlorella protothecoides
gtccctgggcatcctcactgtcgccatcgtcaccacccccttttccttcgagggccgcatg

SEQ ID NO: 47175 - DNA, 61 bp, Chlorella protothecoides
agtgctttgggtagtggagggcgggaggggtttgttgggtttgctcgccgtccagagttga

SEQ ID NO: 47176 - DNA, 61 bp, Chlorella protothecoides
cagacctggactcgggaaccttgggtgcctcgtgtcttccaatcgcagcccacgcctttgt

SEQ ID NO: 47177 - DNA, 64 bp, Chlorella protothecoides
gacaggcgcccgccggattcccaggatctcgccgtgccgccggagcgcactcccgacgtccgac

SEQ ID NO: 47178 - DNA, 61 bp, Chlorella protothecoides
aaacaataaaacatgaaggtgcacatgcggctgttgcgctcgctcttcttcgcgctggcga

SEQ ID NO: 47179 - DNA, 62 bp, Chlorella protothecoides
tgagggaactgatgggtgggtaggtgggtgggtgagggaactgatgggtgggtaggtgggtg

SEQ ID NO: 47180 - DNA, 63 bp, Chlorella protothecoides
cgtgcccgatccctcacccacccacccaagaccccccaaggtccttgctcccctcctgttcca

SEQ ID NO: 47181 - DNA, 123 bp, Chlorella protothecoides
gtcgcgctggcctacgcccccgcccactccgtaccctacgccgcgcttggcgctgagatggcggcgcagggcgtcgtgctggacctcttcgccctggggccgcacttcctgggcctctacgcc

SEQ ID NO: 47182 - DNA, 61 bp, Chlorella protothecoides
agtgatccctcgcggcagacacccgcacgagacgtgaaaccgagggatcgatgtatttaat

SEQ ID NO: 47183 - DNA, 80 bp, Chlorella protothecoides
gccagcgctgacattgcaggccgctgcgctgtctgccgtgagcgtggtggcaccgccgctacgccgcgatatcgcagcgg

SEQ ID NO: 47184 - DNA, 71 bp, Chlorella protothecoides
gcacatccgccaacccaggcacactccctgggcgtccctcccgcgccccaccattgcagccgagcatgtcc

SEQ ID NO: 47185 - DNA, 66 bp, Chlorella protothecoides
cggtcaggccaccaggcatgtgctcgtggcgcgggccggcagcctgtcatgcaccaggcccggctt

SEQ ID NO: 47186 - DNA, 7982 bp, Chlorella protothecoides
  modified_base (297)..(306): a, c, t, g, unknown or other
  modified_base (601)..(679): a, c, t, g, unknown or other
  modified_base (1039)..(1048): a, c, t, g, unknown or other
  modified_base (1309)..(1318): a, c, t, g, unknown or other
  modified_base (1397)..(1406): a, c, t, g, unknown or other
  modified_base (1485)..(1494): a, c, t, g, unknown or other
  modified_base (1652)..(1708): a, c, t, g, unknown or other
  modified_base (2252)..(2261): a, c, t, g, unknown or other
  modified_base (2336)..(2345): a, c, t, g, unknown or other
  modified_base (3566)..(3575): a, c, t, g, unknown or other
  modified_base (3680)..(3871): a, c, t, g, unknown or other
  modified_base (6471)..(6497): a, c, t, g, unknown or other
  modified_base (6676)..(6685): a, c, t, g, unknown or other
  modified_base (6740)..(6844): a, c, t, g, unknown or other
cggcgcggcgccgcgctcgcggtggcgctgcgctggggctgcctcggggcctcccagcagcgaggcgatggtcgcggcggcctgcgtcgccgggctcatgccgggggagggggccgtggcaggggccgcggcgcggggcggcgtgccctccccttcctccagccgctggtcctgggatgatgacaaagaaaatttgttgggggagggggagcggaggtgaaggggatgcatgagcacgaggcagacgcacgacacaggtcgctgaggtgagcctgccgagcccatcccaggacctgnnnnnnnnnngttttgggggggcccctggaggtgaagggggcgcatgagcccgaggcagacgcacgacacagggcgatgcagtgagcctgccgagcccatcccaggacctgacgctctcgcgacccccacctcccaccccccacacccaccgcgtcggaggcctcgccgtccgactccccgaagcgccgcctgggcttgcgcacccggcgcgaggggcgtgccgcggcggcgtgggcctcgccgaccgaggccgaggcactgcgtgccggtgcccctgcagagcggtcggggggtgggtgggtgnnnnnnnnnnnnnnnnnnnnnnnnnnnnnnnnnnnnnnnnnnnnnnnnnnnnnnnnnnnnnnnnnnnnnnnnnnnnnnncagcaagccgccaggagtttaagaggctgcttcggcccgccggcaacagcaacacccgtcccacgaaaccgcaccgttgccatggaagcgtcccgccacggcctcggcccccggattggggacctgggggtcgggctcctgggcctgcctggcggcgctggggctcggtgctgactggcgcgtgggttcggagggcctcgcggagatggacggcccgccggcggcagggcgtgcgtgggcggcggggtggggcgctgcgcacaggcgcagcacgtgcctgcggcaggcgccggtgccctgccttgcccctcggccgcacagcgcgtgcatcgccgagcctgggcgcagtggcggcgggcnnnnnnnnnncatgggcggcccgccggcggcagggcgtgcatgggcggcggggtgaggcgctgcgcacaggcgcagcacgtgcctgtggcaggcgccggtgccctgccctgcccctcggccgcacagcgcgtgcgtcgccgagcctgggcgcagtggcggcgggcgccgggagcaggggctgcggggcaagaagccggcggcaagggccacggggggccctgctgcgtcaataacgagccccaggtccccgccctgcagccaatcaacagnnnnnnnnnncgcggccagggtcgagagcttccgcgccgccgcggggaggtctgaggtgggagccgcggcgagcatggagcgggggagnnnnnnnnnnggcggccagggtcgagagcttccgcgccgcggcaaggaggtctgagacgggagccgcggcgagcatggagcgggggagnnnnnnnnnncgccggcgggaagggccacggggggccctgctgcgtcaatgacgagctccaggtccccgccctgcagccaatcaacaggagtcgtcaggatggagggcccgaggggcgcgccccaagtcccaactgccgctcgccaagcccggacggcgggccgccgnnnnnnnnnnnnnnnnnnnnnnnnnnnnnnnnnnnnnnnnnnnnnnnnnnnnnnnnncaggggcgagcgggcctggctacagagcctcgctcccgagcgcggcgacgcctcggccggcgtgccgggcaccgcgtgccagggtcctgccgccggcggggcgcagaaggtcccggctccgacctccacgccgccacctggcgctggtggcagactgacggctgccgggaggccgccaggctcgttctccttgcgactcggagacgacggccgctccctcgggcggctgggcccgcgcctccgcttggcgggcctgggcgcaaccgccgcggcctccttggcgccggcacggcggccggcaggggattgcatctctccctcggcccctccccgctcgccagcagccccggactccctcgcgccagggtcgcgtgccagagcccgcaggtccatggagcccttgcagttgggggcgccgcagcggcaggcgtactcccctcgctccgtcccaccctggaactgctggaagttgtagttgtacaccagctcctcgcccgccgggacttggcgggcggtgaacagccccacacgcatctgcggggannnnnnnnnntcccgccaacgggaggcccaagtccagccccccacactccgccccacctcgcccgtggcggcgtcgcgccacttnnnnnnnnnntgtgggggaatatggtagtgtgagcgggtgggtgtgtgagtgtggcttgggtggattattagaatgtgtcagagagaaccccccccccacccccccgcctgagggatttgctcctggccccgtcagactgcctggcagcagggtgacagagatacactgcagtcccttggcagcctccctcgactcagtcatgccggcccacccctcctcaccccgccaaggtgaggcccaagtccagccccccacaccccgccgcacctcgcccgtggcggcgtcgcgccacttctgcgccacgcagttgggatcgcaggagctgttcagcaggcgcgccacgttgcccttgggcccggcgtcgatgacgcggtccgcctcagcctccatcatgtaaaagtgtggcgcgccggcgtcccgcgcggcaaccgcgcgccgccgcgcctcgcccgcgtccaccacctcgcccgcgtactcggccaagaatgtgccgggcgccagggcgtcggcgcagcgcacgccccagcccttgccgtcggtgaggaagacctccaggcgcggcgcggggagcaggtggaaagcgcggttgccgcacgactcccccgccgggcaggtgcccgggtcgcacagcgtgagggacaggcggttcaggcaatcggggccgcagccgccgcggcggctgggcggcggggagcccaagtgcggcgccagcgcggcggccgtcacggccgccgcgaccgcggccgcaggcatgtcgtccgtcagggcggcacggcgcggaggccgggccacgggccggcagctgcagacgtccacctggtctggcggcagccgccgcggcttcagggcgggcgtgtggtaagcattggaccggaggtgcaggtaggaaggcagggcgtccttgccggtgagcgcggccgcccccgcccgccgcttgagagtcagcaggggcaggccggccttggtcaccaggcggccgtcgatgacgtcaaacacgggagcgtcgctccgcgtgggggctgagagtagcgacagtgacgggggtgaagggggtttgaaccgagaggccatctggggaggtcctaatgaaatgctgatgtgcaagtacatgcagaatggaggaattgcaagggcagggctaccgcagtgtcaaagcaaacactcccaaagcgcttttccatcataccttgaatggatgtgacggcaggggctgagcctccagcatgatcnnnnnnnnnngacggccgccgcgaccgcggctgccggcatgtcgtccgccagggcggcacggcgcggaagccgggccacgggctggcagctgcagacgtccacctggtctggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccgcgtgggggctgggagtgacgacagtgacggggttgaagggggtttgaaccgagaggccatctgaggaggtcctagtgaaatgctgatgtgcaaatacatgcagtatggaggaattgcaggggcagggctaccgcagtgtcaaagcaaactcccaaagcacttttccatcataccttgaatggatgcgacggcaggggctgagcctccagcatgatccacgggactcacaccttccttcttcacacgccgagggaccaccgcaagcgtgtgcaacgatacggatggcgcggtctgcttccgctgcttgcttggacctccaggcttgccaggagaggcctgcacctcgctgcttgccttgcagacattcctgcccaccagcgtctcagtccaccagccctttggtgcgcggccgtatttcacaaacaattgtgcctgtgaatggcagagaaaggaacccgatccatcaggcatacaggtacactgcagggagcgaccaaacccatgacatgcactggggtgccaaccccagcaccagaccgcacaggagcacagggtagcacctcagcaagggcggcggccagcttcttgttcttgctagctttgctggcggcggcggtgaggccttcgtgccatcgttggacttgcgagccagccagcctgttgagatagagggttttggtgtggtaagaagctggcatgggttgccaatggcggccaataggagaaaagacctgacacaatacctggcccagagacaggcacctgccatcactcaagcgatccctgggggctcatcaactcccaacacaacaacacccccttgcccctacccacccactcaccatgccgcggtgtagtcaccaaaaaacatcacggccgtggtttgctgaggcacccgctttgtggcctgtagtcctctgtgagctgccgcagccgtcgctgggagaacctgagcctgcggtggggcgagtggactggcattgcatcttgagaatgagggggcagtccccttccacacaccccaggcccggttggcagaacacgcaccggccatggagggtagcctgtaagcctgccccagaccagccccgcctcgtcggcagcagtctccgtccctgcacctcgtgcagggtccgcactggtctctaccatctcgaatccatctgcagtagggccaacggtgggtcaggcgcgatggtaggggcgtcgaccctaagacagacacctgcgtctgtgtacagaacgcacatccccccgcggcgactagtctgcatcgagcaggccgggcaggacggatcgccagtgacgatgccgggatacttacctcactgaagtgcgtgtgcaacgagcggattgatggtaccatccacaccctgtcccgcagggcgcatgagttggtctgcaaccgagtcgcgcaccagcccaggtgcctgcttgggcactcccaacacttcctggaaccagtcgatcctccacgctccggtgagagggatcggaaaggagtttccgcgccacctgatgccgtctcatcccaaattttcaaaggcaggatagcacttagacgcagatcggtttcccggggttggcgccacgagcttctgcatgccggagttcggcatcacatggcaggcacgatgcagtatgcctacaccttggatgatcaatgtacctggattaatgcagcatgggctcgatgttctgcgaggctgatctgcactctgggcatggcccctggcactatggatccccatgacggagctggaactgctgccagcgagatgtgagccatggagtccccactgctgggtcccagcggcgctcccaatgtgatcctcaggatcgtgaacatcgagtactacctggcaccaccaattcccgaggtggatgcctgctggtcatctctggagggtagccctgtgactcatgtgccggtggtgaggatttacggatccacaccccagggccagaaggcgtgcctccacgttcatcaggtgggcatggaaccagctgaaggtgaagatgttgccacggcatcaagtacgtcctgccgacattatgaagctgtgtgcacctgccagccctcccaccctcctcataggcattcccttacttttatgtgccctaccatgaagaccttccccaggatgcagatggaggtggggaacagggtttgagactttcaaacggtccttgccatgatgcagcccacctggcccgcaggcaagtagcacccggcactgtaccatgggcatgcccgagtacagaccttccccttcccacacgccctggtcctgcagcgggaacccagctgcgcaggctggggatggcgctggaagcggtcctgagcatgtccaccgcccaggccatggccggagggcaggccgtcaccggggaccaggggtccgcgaagaggcgccagcacatctttgacctgaccctggttgccgccaaggcgttttacgggtaccatgcccaggacagggcgtgggtcaagatctccctgtgagttggttgagggaggggagcgggaggctgagcacggaggggcagaatgtggctgctgcatgcctgcacacagagaaatttgcctccgtnnnnnnnnnnnnnnnnnnnnnnnnnnntgcaggtacaatccgcaggacgtcaggcgcgcagctaccctgctgcaggtggggtggtgctccgtacatctgcagcagccgtcctgcatgcaggtggagcggtctggtgcagggccatgtgggccacaggcccccctcattcccttgtccgcagacaggcgccgtcctgggcagagtgnnnnnnnnnngaccatcggcatccctgtctgctgagccttgccgtggcaatcacatcttcaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcagcagccgtcctgcatgcaggtgcagcggtctggtgccgggccattggggccacagccccctctcattcccttgtcccgcagacaggcgccgtcctgggcagagtgtggcagccacatgaggcgcatgtcccttacctgctccagttcaagatcgacttcaacctctttgggatggggcacctggtgctgtctcgggccaagtttaggtgaggctgggcttggaggggtctgcccacccgatctgaattgggcctgccactctgttgctgagcaagagagtcattcttgcagggagccgctgccgagcacacactcccgccagcgcccgggctgggcggcgcagcaactcgtgcatgaggaggagcctgtcacaggtgagaggaggaaagggatgggatttctggtgggtgggcggcgccggtgagctgcgatggtcggagcagtctgtgcttggtcggcctgggagccattggcaactgtgcctcgggcgcatgagcacggtgttgcaaccctaggacggcgacctgacccacccatgccacgatgccctcctgtccctccctgcagcggccggcggctgcggcggcagcgtgtccatggccctggacaccagccatgtgtggacgacctccagcacgccccgcgactgggtctgggcgggggtgaagccgccgcggcggcagacggtgtgtgagctggagctggacgccgtggtggacgccatctgcaacaggcacgaggtgagtagggggaagagcgagcgtcaggcaaaagggtggcacgggtccatgggaggaggtggcgtcctccagcgacctggttctccctctcgtgcgcccaatcttccgcccttccttccatccccagctggtgcgtgtaccgctggcacaggtgccctccgagaagcggatggtggagagcctggcctccatgtgggccgaggagagcgagcgcagcggcggcgccgtgccccgcgccccgccctccccgccccgccaccccgccagcctctgcgaggcggtggacgccacgcgcgcgggcttccaggcggtggcggacgcgcagcgggcggacattcggggcgcggaggaggcgaccccggtcctggcgacgccgccgccgccggcccgtgtc

SEQ ID NO: 47187 - DNA, 72 bp, Chlorella protothecoides
tgccgggcgtctgccacctcgcgcgtcgccccctcgcgctccgccatccctgcggcggtctcggcccgggcg

SEQ ID NO: 47188 - DNA, 96 bp, Chlorella protothecoides
gtgtcactgccaccagagacctcaagctgttgacggggtagagattgttcaggagggcacttcattaaacacgacgtgcccctgagacccatcggc

SEQ ID NO: 47189 - DNA, 63 bp, Chlorella protothecoides
cgcggcacccgctgcgccgggcgcagctgcagggcagctgccgctccgccccgcgcaagaggc

SEQ ID NO: 47190 - DNA, 67 bp, Chlorella protothecoides
ggcgtccaggaggtgcacgcgcacggcgcgggtgccggcctccacctccacgcggaaggcgggctcg

SEQ ID NO: 47191 - DNA, 61 bp, Chlorella protothecoides
tgtgtgtcttggagttgaaggtcgtggcggggaggaaggggatgttggctggccgtgtcga

SEQ ID NO: 47192 - DNA, 61 bp, Chlorella protothecoides
cgctcgtactttgcatgcagggcctcgaaaactccccctgccggcgtgtgcagggcccaga

SEQ ID NO: 47193 - DNA, 61 bp, Chlorella protothecoides
gtcggtgacaaagagcaccatgtccccctgtcccgctgtgatcagggccaccgccccgggc

SEQ ID NO: 47194 - DNA, 66 bp, Chlorella protothecoides
tccttctaggacccccaggcccccatcccccccgaaacacaccttgagggagaggcccgagtcggc

SEQ ID NO: 47195 - DNA, 69 bp, Chlorella protothecoides
cggtgctgctttgcccatctgctgtggggcggtgatgggttgagagtggcggctcctgctgcgctgttc

SEQ ID NO: 47196 - DNA, 61 bp, Chlorella protothecoides
gcacattgtctgtggcaggctgtgcatgggggctccgtagcgagctcacaacccacaagtg

SEQ ID NO: 47197 - DNA, 73 bp, Chlorella protothecoides
ccgaccacgggaggaggtcctggcccaggtaccgcgtggtcctgacgcggaggcccgcctcgcggaactcgcc

SEQ ID NO: 47198 - DNA, 120 bp, Chlorella protothecoides
ccgtgcgcgacacgttgcgaccggtgcccaggatccagccaagagattcgagcgggggggtggcatcccctggcatggggccggttccgagaccccgcacggtgacagcccgaggctgat

SEQ ID NO: 47199 - DNA, 61 bp, Chlorella protothecoides
ccggggatgtgcacgatggcctgtggcggggggggcgctccgcatccgttgctccattggt

SEQ ID NO: 47200 - DNA, 61 bp, Chlorella protothecoides
gcggtgttgcctgcacaccgccgcaggcgggtcaacataagatgtccgcatccgaacctcc

SEQ ID NO: 47201 - DNA, 61 bp, Chlorella protothecoides
taggcagggttagccggcaggaatgtcgggggtgtatctcggcgtatcttccgacccgatc

SEQ ID NO: 47202 - DNA, 67 bp, Chlorella protothecoides
tggtccaaacggatgccgtcgtcgaacctgtgtgtgtgaggggtgcacatggtggttgacggggagc

SEQ ID NO: 47203 - DNA, 61 bp, Chlorella protothecoides
ttgtgcgaagggctgtggcagcaggcgcggtccagcgacgcgccgctgctctcctacctgg

SEQ ID NO: 47204 - DNA, 78 bp, Chlorella protothecoides
ggaggaggtaccgcagcgtctcggcaaagtctgttcgaaaactccccgaccatgagcattgtcacactgagggggggt

SEQ ID NO: 47205 - DNA, 70 bp, Chlorella protothecoides
gataccgttttggcgtcacattcgagctcgccttgcttatatgtgcagtgcaaggaccggcaccttgaaa

SEQ ID NO: 47206 - DNA, 61 bp, Chlorella protothecoides
ggggtcgaccatgcccatgcccatgcgctcgacgcgcagggcggtggagcggtcctgggct

SEQ ID NO: 47207 - DNA, 61 bp, Chlorella protothecoides
ggtgctggccggggacaaggcttccagccgccgcggcaccgaggcggccctctccggctgc

SEQ ID NO: 47208 - DNA, 41015 bp, Chlorella protothecoides
  modified_base (658)..(667): a, c, t, g, unknown or other
  modified_base (925)..(977): a, c, t, g, unknown or other
  modified_base (1341)..(1350): a, c, t, g, unknown or other
  modified_base (2417)..(2426): a, c, t, g, unknown or other
  modified_base (2495)..(2504): a, c, t, g, unknown or other
  modified_base (4505)..(4514): a, c, t, g, unknown or other
  modified_base (5357)..(5366): a, c, t, g, unknown or other
  modified_base (5549)..(5558): a, c, t, g, unknown or other
  modified_base (5940)..(5949): a, c, t, g, unknown or other
  modified_base (6120)..(6129): a, c, t, g, unknown or other
  modified_base (6507)..(6609): a, c, t, g, unknown or other
  modified_base (6701)..(6710): a, c, t, g, unknown or other
  modified_base (6802)..(6811): a, c, t, g, unknown or other
  modified_base (7051)..(7072): a, c, t, g, unknown or other
  modified_base (7655)..(7664): a, c, t, g, unknown or other
  modified_base (9197)..(9206): a, c, t, g, unknown or other
  modified_base (11028)..(11037): a, c, t, g, unknown or other
  modified_base (11520)..(11529): a, c, t, g, unknown or other
  modified_base (11788)..(11797): a, c, t, g, unknown or other
  modified_base (13385)..(13394): a, c, t, g, unknown or other
  modified_base (13876)..(13885): a, c, t, g, unknown or other
  modified_base (14399)..(14408): a, c, t, g, unknown or other
  modified_base (14494)..(14503): a, c, t, g, unknown or other
  modified_base (15375)..(15384): a, c, t, g, unknown or other
  modified_base (15644)..(15653): a, c, t, g, unknown or other
  modified_base (16496)..(16505): a, c, t, g, unknown or other
  modified_base (16693)..(16702): a, c, t, g, unknown or other
  modified_base (17144)..(17153): a, c, t, g, unknown or other
  modified_base (17699)..(17708): a, c, t, g, unknown or other
  modified_base (19931)..(19940): a, c, t, g, unknown or other
  modified_base (20889)..(20898): a, c, t, g, unknown or other
  modified_base (22918)..(22927): a, c, t, g, unknown or other
  modified_base (24117)..(24126): a, c, t, g, unknown or other
  modified_base (24880)..(24889): a, c, t, g, unknown or other
  modified_base (25746)..(25755): a, c, t, g, unknown or other
  modified_base (26161)..(26170): a, c, t, g, unknown or other
  modified_base (26841)..(26850): a, c, t, g, unknown or other
  modified_base (28017)..(28026): a, c, t, g, unknown or other
  modified_base (28893)..(28902): a, c, t, g, unknown or other
  modified_base (29018)..(29137): a, c, t, g, unknown or other
  modified_base (30132)..(30141): a, c, t, g, unknown or other
  modified_base (30489)..(30498): a, c, t, g, unknown or other
  modified_base (32122)..(32131): a, c, t, g, unknown or other
  modified_base (32285)..(32488): a, c, t, g, unknown or other
  modified_base (32557)..(32566): a, c, t, g, unknown or other
  modified_base (32724)..(32733): a, c, t, g, unknown or other
  modified_base (33421)..(33430): a, c, t, g, unknown or other
  modified_base (33905)..(33914): a, c, t, g, unknown or other
  modified_base (34172)..(34181): a, c, t, g, unknown or other
  modified_base (34593)..(34738): a, c, t, g, unknown or other
  modified_base (34920)..(34929): a, c, t, g, unknown or other
  modified_base (35979)..(35988): a, c, t, g, unknown or other
  modified_base (38908)..(38917): a, c, t, g, unknown or other
  modified_base (39115)..(39124): a, c, t, g, unknown or other
  modified_base (40106)..(40115): a, c, t, g, unknown or other
tcgcgcgcggcggcgtgggaggccagctgcgcctcgaagcgtgcgcgctgctccagcgggtcgttcagctcggtgaaagagttggccagctcccgtcccgccacgtacagctcgaagcgctcggtgagcgccgggttgtcgcggtggcgcttggccagcggggacacctccacggggtggtccagcacgaaggtgggctgctccagcgtgctttccaccagcgcctcgaacagcaggttgaccaccaggccaggggaggtggcggctgcgatcgcggtggccagttcaggggagggcgccgcggcgcccggcgcggccagtgcggcctgcgcggcctcgatcgcggcggccgtgtcggctgtagagaagccgccgaagtccacgccggtggcctcctggaccagggagtgcatggtggcacgccggaagggggcgcccaggtcgatggcggtgtcctggtacgtgatcgcggcggatcccgtgaccgcctacggttcggaggaggggccaaggggggatggatgtgaggggtgatcgatggggggatgcaggtgtggcgcatgcatgccctggagagtccgtcacgtcccgatgcagcctgaaggtcaaaatgtctccccccccccaaaagtccatgcctgggcgcaggcgcgtatgnnnnnnnnnntgtcatgtcccgatgcagcctgaaggtcaaaatgtcctcccccccccaaagtccatgcctgggcgcaggcgcgtatgagctcctccgtcagctccatcatgccatggtagtcggtgtaggcctggtacagctccacgctggtgaactcggggttgtggcgcgaggacacgccctcgttccggaagatgcgccccacctcaaacaccctctccaggccccccacctggcaggaggggggcgcgagaggtgggggggggnnnnnnnnnnnnnnnnnnnnnnnnnnnnnnnnnnnnnnnnnnnnnnnnnnnnncccgagagcatgtgatgacgacctcagccttgtaacccaagcggctctgagggtccaggggccggtcagcctcatgcacagtgccaacccctcccactcccatccccacccactcaccaccaggcgcttgaggtgcagctcggtggcaatgcgcagggacagctggcgctgcatcacattatggtaggtgaggaagggccgtgcatcagcacccccggccgccgtctccagcacgggcgtctccacctgcatgtgtgggtgcgagtttgtgaagggggaagttggagataatgccttgtatgcctgggatcagctattccaggagcatttcatccggaaggcttcagccagggctgaaccctcnnnnnnnnnnatgcgagtttgtgaaggggggagttggagatagtgccttgtctgcctgggatcagctatcccaggagcatttcaaccggaaggcttcagccagggctgaaccctctcccacgcccaggacctccacccaaccccaccaacctccaggaagccccggtcctccagggcgcggcgcagggcgctgatggtcttggaccgggcccgcagcgtgtcggtgacgcccggggtaacgatcatgtcgacgtaccgccggcggtaccgcgcctccacgtcagccaggccgtgccacttgtctggcaacggctggatggccttggtcagcatggtccaggatgtgaccacgacgctcagctcccctttgtcagtccgcttcatgtgccctagggggaggaagcaggagggtcgccagagacatgccggcagcgcctggagttgcagacacacatatactaggcatgctgcgctgaaggcatgcaccgccccctccacctcccacacctcatggggagccaatgatcaaagatccccgagaacacaccttccgcgccgacgatgtcgccgatgtccagcacatccttgacgcgggcaaaggcgggctggcccagcgtgcccttgtcaaaatagagctggatggcgccggactcgtcgttcaggcgcgcaaaggccagcttgccgagcacacggcgcagggtgatgcgccctgcgatcgacaccctggcttcccggtcctcctggccggcgggaagctcggcgtgggctgcctgcagctgcgcagcgctggcactcctgtcaaaggagtaggcatagggctccagtcctgcgtcccgcagggcctgggccttgccgatgcgcactgatcggatgtcctcctcagatgcggtgcggtcggggcctggcgccgtgggtttgcggggaggggcgggtgcaccggcttccgtgcctttggctcgggcctggaccgccaccaccctgtgtgggttcacattggaccctttcagtacgccactacacagcgcatggtggtacacctcgtctctatgcctcgctggcaaggctgacctcgggcannnnnnnnnnttgatttgtattaattcaggccatgcatttaataatgcacaccatccatgcatgcttgggtgggaacannnnnnnnnngtcagtacgcctctacacagcacatggtagtacatctcgtctcgatgcctcgctggcaaggctgacctcgggcacagcgtcgcacggggcatgggtggtggtcggcagagggacatgaagggcctcatgatctgcacccgcaggcacggcagcagcgacgtgcagtgctgcatcctgatttgtgttagttcaggccatgcatttaataacgtacaccatccatgcatgcttgggtgggaacagacacctcggcagataatccgtgccactccctgcaccgcatgcggcgcctgtcggtgggacgattggccggatgccagacagatcgataggcaccccctgcacttatcacatctatgcaggcaaccatgtgctgcattatctcgaacatccagcctcaccatatatgttcagtgctctcatcaccctgctaccctggcgcacgcagtcaccgtcatccctcctcccagcaccggcctgggctgctacactctttcacatgggcacattctcatagaaaagcaaggatgatgatgtagaaaacgtcgtacagagcgctgcccagcccatgccaaggtcacatcccgtgctgggcatgcgcctgcgtggccagcatgaggtaggaaagcgcgatagacccagagtagaggagggccaggggggcgggtctcccgcgcggcccccgccgccgcccctccgccagcgccacccgctccgcctctgacttgtaccgcgcgcggcccgcggggtcgaagtagcgcccccggcgcagtggggccgccaggaagcaggccagcacgcgggcgggagtgaggtaccgcaggtaatggccgccggcggagcgccgcgccgccagcgcccgcatgcgcgggaccaggtgcgcggccaccgtctccggctgctcgcacagcacgttgaaggcggccttcgtccccggtgtggcccccgccagcagcaggtcggtcagggccatgccgggggagaggttgtgcagtgcggcgccgccgccttcccttccgctggccttccccgcccgctcccgcaccacgctttccagaagctgggctatgccggccttggtggcgccgtaggtggcaaagcccggcgtcgggccgccgcctgcccccgcgccgtccatgttgaagacgtggccccctgtcggctgggagcccagcgtgcgcagcgcgacgcgggtgcacagcaggcaccccaccaggttggtcctcaccacgctttccatgacctccaggctctgctccttgaacatctggcggcgaggacaagaggggtggcaaagagtggtgatgcccaggttttacgggggaatgatgagcgggggtggagactccacagctggcctcacatgcgcctgctcatggcagccgtcgccctctgcaagaccaggcactgcggcatgaactccaaagcgcacatgcccttcacgaatacggaaatggctgacaggatcgaccacaccccgtaccacacgaaagaacctttggacctggaagccgccgctggtcccagcattgtttatccagacgtcgacgcccccgagctgatgcatggccgcccccgccaaggcctccacgctcccagcgtccccgacgtcacaggccagcccgatcacagagcggggggccccgcccacgccttcccccaccagggcagcagcggcggcctgggcgtcggccagcgagcgggaggtgaccacgacacggtccccagccctcaggaactccctcgccagcgccttgccgatgccgcggctggaccccgtgatgaccaccctcaggggtgcaggcttgcgggcccgcaccctcagcatgtccgagtgccagttccagaaggaggctcccaggatggccccggcgatggcccccacgctgccactgcaggtgtttgtgcctgtggaaagaaagtgggtatatttgagcacaggaacaagggttcacagtactggacggatatgaggtcggagatactccaggaagggctctnnnnnnnnnncatacttgagcacaggaacatgggttcacagtactggacggatttgaggtcggagatactccaggaagggctctatgtatgtatgttgaatgagaaggaggatgaagaagcctctgtgaattgtgcgacatcttccttctggcactatacgtagccggagagggaaccaaatatcacaggaatcgcaatctggcatcgaagcttgagtccaggatgagcccaggccatgcgaatttgctttcaccctacgctcacctgacagtgcgagggctgtggagagggtgaggctgctggccacggcgaggttagcggggcaactgcgtcgagccatgcgcttgtcatttcgaacacagtccttccgaagggcggcgacctccaggccccgttccggagaggactttgagtttgtaccggatgtcgaagaccgggactccgcatgattaccatcagctttgtcgggatttttgtgcgcagacccatgtcctgtgccaccagggccggaacacgaagtacgatggagtgcccgagagcgcgccctgctccgcgacgatgtgcctatagtatgcgttttgtgaattccgcggcatgtcgcgcccggcatgacgcaggccgaccacatcgtggtttcggagtcctagggcttcggcagggttgccagaccaggcgatcggaccaacaccccgccaggagctcttcacaaatcatgcattaagtcgagcatttaaggtggaaaaaacgctgccgagaattcgtttcgtatttgttggtgggatatgagaggccgtctgacgcccggccggccgactccacgtgggcaaatgcggtttgaatgcaggaagcttnnnnnnnnnncttaaggtggaaaaaaggctgccgagattggagaattcgtttcgtatttgttggtgggccatctgaggtcgaggccggccgactccacgtggggcaaatgcggtttgaatgcaggaagcttggaggtagggatggttggattgcaagggaatataccgccccggcaccgctccttggcagggnnnnnnnnnnactcacattagtgaaatcatttcagcggtgtgcgtttcgaatacaaggcgtaccatggggaattgttagcccacctatatatcgtatggctgggcggaggcatgtcaaaaggtggctgaagcaatgctgaactagattctagacactcctcgagcaggtgatctaatgcaagattgagaggcttggatctggaatcgaactttgctcagctgctatggccctgtaacgcagagagcctatcctgcagattgagcaactttgaccctgcccaagtcgggagcatgtggggagcaagagggtacatgcatgcacactgccctagccgattctactacaacaccggtataggttatatggccaggcaccactcacaaatatcacnnnnnnnnnnatgccccagccgattctactataacaccggtataggtcatatggccaggcaccactcacaaatatcacccgacaagatgtccttggaggttgagctcggtcagtctttgtgagccgcagcattgatcttagagcctatgtcatcagttgccttctacctggctacaaaggnnnnnnnnnntgctcgggcagtctttgtgagccgcagcattgatctcagagcctatgtccatcagttgccttctacctggctacaaaggtgagaatttgcttgtatacatcggggtatgggaccagctcacagctgttgtcacttgtgggcatctgcctaattggcacagccagactggtcaggccatcctgcgcggccacctagtagacaccctggctataatcctggcagcgttgtcgctcctcgtgacttcaagtgaaagacgcgtttgaattaatgtgggtaggatattcgtcaggagctccagattctcagtgttcaccaaggtgactttgagggcgagtgttgacagccccagcgcgctggggtgaagtcatcgaacgcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccgcgggatctctttcgcactcagaggaaggaagcccctcgcggagggtttcccgagtagggcgatgtaccccaccgtgtccttcgatgnnnnnnnnnngcccgcgggatctctttcgctctcagaggaaggaagcccctcacggagggtttcccgagtggggcgatgtaccccaccgtgtccttcgatgnnnnnnnnnngagacgcgtttgacttaatgtgggtaggatattcgtcaggagttccagattctcagttttcaccaaggtgactttgaggacgagtgttgacagcccaagcgcgctggggtgaagtcatcgaacgcgcaagaaggtggagctcgcaggcacaacctctccgagcgcgaagcctgagtcgcagtaccatactaccagtgattgacattaagacattcttgtccccagctctccgtggtggtnnnnnnnnnnnnnnnnnnnnnnctcctacatactcctcgtcggactattcttgggtcccggcgccttccacaagtgtcgctggggccaggagtaatggctccggcaagctggagagtgcttcctcctcccagccaacactgcgcgtcgtgattgccgagcccttccgcatcgcacccccggtatgtgacgaccgaggagttggagacatgcagcaagataatacaaaagtaccctgggctctgtgtaccatctccctgctcccccctcaacccccaggtgcgggtctcccccaagctgcaagccgtgctggatgctcagccctccacaagtcagccgcccatccgccgcaatccctccaacagaggcaactttgactatgagcagggcgtcctcagacaggtcgctgaagccagtgcacggagtgtgagtgcactttggagtggtaggggggtcggttggagcaaggaagtcacacagaggatttctggtgcacacgcatcaacggcgcataggcaggggtcctcactgatattgttattgggactgtaacgttgcagtcctgttctgaaatcgtacgacgtcctgatccttcccctctccggcnnnnnnnnnnttaacgttgcagtcctgttatggaatcttacgacgtcctgatccttcccctctccggctccatccaccctcaacagcaggcgcccgggcccgcctccccctccacgcaaggcccatggcggaccgaggccgccaagtacgagggcatgggcttcgcccccctggacgtcgcgctggcggccgccgcggcgggtcaggagcaggcgcaccccgatctcatggcgcagacgtgcagggccgtggcggacctgaggagcatggggtttgaccccgtgcgcgtcgcaggggccctgagcctgcacaagggtgacgtgtctgccgccacggaggcctgcctgagcgccgcaggcgccgggtcctgattgtgctttgtacaccatggttggctgagacggacacagggtggggcgcgccggggaatgggcagctccggcgcatggggcttgaagaccaggacaggaggagaggagcgggcatgcagggagcgctcctcctcaacagcaagggactggaggcccgctcagctcggcggcccgccccggtcgagctgggcggcgtggcgcgccgtcctttcctgctccgcctcaggcacgcagcacaccacgtgccccgcgcgcagcatgagcagctccacggccttgttggcaacgtcgaacgcgttcacaaaggtggcgtggtagtcgcaggcggccagggcgccggccaggtcgatgaccaggcccgaggcatccagggggccctcggcggctgagctcagccgctccaccgactcgcacaccgcccggcccagagctgcgtgctccggcagcggggtccactcctcgtcgagccacagggtgaccatccgccccggccagtccgcctcgctggcggcgctggcgggcgaggccagggccggcagcagcactggggagggtgccgccgcgccgtcctgagggatagagatgagtggccgcagcgtcggagacatggactgtcattttgtgggagcacgcacgccgccgtgatcacatgcccctcggctggcatctagcatgtgctcaaccctgccactccagccaaactccacgggcatggcccccaaagccaaacatggaccgggccgggcacctgatcgccgctggccctagacctgtagatggggtgccatggcaatcttcctgcatgaagggccctgcagcaggaatgtccagctcgactcgtgccgatccaggtccccttcgcgacatgaaactccctcaggcccggcatgccggtcatccatcgcacagaagatggtaatggaatttgcatgcaataagatgtcataataagcaaagcttccagcctgagctcgatcataggtcggcagtggagtacatggtggatcgcgcgccctgttaatgcttgatcaggacccgacgaagatgacctgtcagctccagcatgggcacatcgcagtcgtgtaatgctacggaattcggtttgagaaacgatcgccagcgagaggcgagaaatctcctaagctgaccagagccccaccgtcatggctggnnnnnnnnnntagtcgtgtaatgctacggaattcggtttgaaaaacgatcgccagcgagaggcgagaagtctcctaagctgaccagagcccccccgtcatggctggtcacgggaacacagggcggggccggaacatcgccctctgctgcgcacactggagcgattcatcgacggtacacgcctggacatggatgaaacaatatttgctgaaggtggggctgggaagcttagccgtctggcgccgtgggtcacctgtccccccgttgcaccgcttaccccccctgacagttcccacctccccggcatctcccatgcagcgagagacgatgtttgggcaggggacgcgcctggatccctcagaccatctcatcatcgtccatgtggggaagggcggtgagaaggaacgatggaagatgggcggtcccctcatccctgacctggagacctgcctggagtccttccctcacacgattgaggacttggcgggcagtatccagggcaacatccgggagttcctggacagggccaagattgacatcgtagtttttggtgcggtggggtttgcgtatagcaaggttcaggggagtgaatacgctgcactcgagcttgagcggcagttgcttttgggctcaagattgtggcgtgaccattccacatcttcaccccaaccacctcacccgcataggcaatcggtacccacagtcggtcctgaaggccctgtccctggtgtcggtgcgggactgggtcaagcagcatgtcaacacgccctacatcatcatccggccggaggtgggtggttgggggtgcatacacggtagtctgctgacccaattccagactggcaccagacttaggcaatacctcttgcatggaggatgtgcctcctcaggatgctgcagttccaagggcggctgtcccgacacccccaaaccccatccccttgcccccgcgatgcgtccgcaggcagtgcgcaacgttcgtatgcgcttcggcagcggcccggaaacgagcgccgagtcggtggtctcgcccgggggcacttttcccccgccacgccgcattgccattgcctatcccacgctggccatagggcgagccttgctccaaatggctcgcgagagggtgctgcagccctcggacaccatcgacatcgtgcatgtcttccccagggacgacgccgacaaccccatgaaggaggtggggccttgccgagacggcgggggtgggctggaatcacaggatgcggggctgaaaatgcctgagttttgggctttgggttcaggaacttgtgacggtcccctgctgtgttgtggggtggacccacttgcccatcttcagcatgtgactttgaaggccacccccccaccccctcctctcatctaccaaactcccttggcaggtaatgaaggggacgctcaagctgatgcgggcaatgaccctgcagaaggcggggtcaaatgaggtgtccgagctggactccatcaactttggggcctcggagctggagggcttcaatgtcaacctgaatgtcatcctgaaggcacgcgggtgggggggtgttgtaggtgtggtcacttgtagaggcggaaacgatgctggcccctgggtaggcaggggatggttccagcgggaacaagattgggcctggaactatgcatgtttggatgattttcctgagccagatgccggcaacggttgctatgtgccacccacgttagctggcaaaggcgccacccagtcctcgggtgtgccgaggctgtaccagagccttcccatgccttgcagattcccctccgccactctggccactcccatcccctacccacgccacnnnnnnnnnntgggtgtgccgaggctggaccagagccttgccatgccttgcagattcccctccgccaccctggccactcccatcccctacccacgccacctcatgctgcacagggggagaggaaatcccagctgagccagtacctggagacggaaaagatcgagctgctcatcatcggcgcgcgctcctccaatgccctccagaagacgctgtctggcgggtccacctccagccacctgatagacaatggtgcctgccccgtcatggtcatcccctatgtcgccatgggcatcaccgaggaggacgaaggctatggcagcccagacgcgtcctcccccaccatgcccctctcccccagctatgctgcgcccaccgggtgagccggcggcgcaaaagagtgggggtctcagcaaggatgccaatgaagagaacagaaggaacgcgttccccaccgcatgcctttctgcggctgcggtgtggctcatggatgtcnnnnnnnnnngcgacgtgagccggatgcttgcggaatcggcccctcagaggccccaaccgagggagatcgcgcctggccatcctagagccgcctggccctcttgtactcatattaggtcagccacagctacccggtatcggtgagtggacatttgcccctcacaggcaagggccagccctggtgagcctggagctttagaattgctcgccgccgcgcaagagacagctcggcccccagtctttaacacacggtgaccttttgccaagtnnnnnnnnnntttattccccctttcctgtcccccaaccatgcaggcaacgctctgagatagcccggcagtctttccaggtgcagcagcaggcggtgagcgacgtggtaatgcggctgcagcagcagttgctggaacgggaccgcaccatcgccgagctgaggagtcagctggcagcgctgcaggaggcacagcggacgacgtgagccgggtgctttcggaatcggcccctcaaaggccccaaccgagggagattgcgcctggccttcctagagccgcctggccctcttgtacccatattaggtcagccacagctccccggtatcggtgaatggacatttgcccctcacatgcaagggccagccctggtgagcctggagccttagaattgctccccgccgcgcaagagacagctcggcccccactctttaacacacggtgaccttttgccaagtatacacgccctacaataactgtttaaatgatcgcacaaggcgaggcttgcatccgtgcatctgcaccctggcagcacccagaaaagatcgcggaacctcgctggaagctgtcccacagccacaagattttcgagagctctcctcgtatccctgggtggtcggtgtgaacccaggaaggaacttttcactcagagacgacatcacaatttgaaacttcccattcaattagaagtgacaacccctttcggtcttcattggtcgccagctacacgatgatgccggttgtcgcgagaagcgctcccgcactggcatgggcccctgttatgcaggcgagacgggacggagggcttgctcgcctgcggggaggtgcaatagtgttgatcactctcatactcatgcatcgctatagtccgaggaacgtcatgcatcgccccgggctcccggtgctcagcagtgcactcccatgggcgccacgctgcgcaggtgcccgtggccgcacgatccctggcccgccgggcgcacggacgcgcgacgggtgtcaaagcctctgcaaacgcggaagcgcaggccacagtcctggccgacccacacatggccacgtcggtgaccacgccggtcacgccggcagcgacgcctgccgccatgacgtaccctggcctcaacgatgacctgcgcttccagcaggtgcacggagttgtttgtggattttttgcgatcaatcaagccatatacgcattgtagacatccatcaagcccctcacacacctgtgttcagcactggagtgtggccatgtggcgcgatttcaaggcttcggacctgttcccagagggagggaacagctccttgacgggcaggctcggggaggcagcacgctcgctgcgagagggcgtcactgcttctggcgccttgaagaacattgatcatgcccggtgtgtgggctgtatgttgttgggcgaaaggacggcagcgtcgcctggcagcttagtataagaaaccctggccctaaatgcatcgtggtgccaggtagccactctcacgcgtctgccctggcacaaggggagatttactgccgtacaatagctaagatggccctttcatatcgtcgtctgacactctcgcccctctgcccactgatcactgcagnnnnnnnnnnttcatgcgtctgccctggcacaaggggagatatactgccgaacaatagctaagataaaccttttatatcgccgtctgacattctcgcccctctgcccactgatcactgcaggtactgggcgtaccatgtgtcgaggacctccttcttcctcctccaggcgattgtgggcctgttcattgcccagtcaggcgggtcggcagggagtgcctcggccactcccaccaagctggagacaattgtgacgggcgcccgtggtcctcttgccgaggtgctgctcatgtactatcaggacctgcagaacatcaaagaaggtgggaagggtcaactggcggtgctggaggcaaggagaacatggaagacaggtctaatggtttcagaaagccaagaagtattattatcccgagagtagtcctcctgccctggcccacatccaggaaagtatggcttcccctgggacatggagacggtgcgtcacaggcagnnnnnnnnnntaactggcggtgctggaggcaaggagaacagggaagacaggtctaatggttttagaaagccaagatgtattattatctcaagagtaatcctcctgccccggcccacatccaggaaagtacggcttcccatgggacatggagacggtgcgtcacaggcagttcaaccccctgttcgtgctgcagcgggcagcagccttcatgggcgaggcccgtctgaccatgcagcgcaagtgaggctcgtgttcggtgtgataattatttgtcacccagtactgcatgctctcatcagcacttgctcgctgcagggtcccagaatgaacaacacaagtcttgaacttcctgcaggaatgcccagcagccagactcagtgtggctcaagagcggcctccttccccaatgtaaggctgggtgtcttggagttgagttggagcatccatgctgccggcaagcttggttgtgaggtcctcaccgcattccatcaccaagccacccttcccttgtttactcccacagnnnnnnnnnnactggtgttcggtgtgatcttcacttgtcacccagtactgcatgctctcatcagtacttgctcgctgcagggtcccagaatgaacnnnnnnnnnnacgtggggtcgagttggaacatccatgctgccagcaagcttggttgtgaggtcctcaccgcatatcatcacaaagccacccttcccttgtttactcccacagactaccagaacaccttccactaccaggtgagaagcatgcaagtggcccctgtgatgagactcgctggcatggttgtcctgcctgtatactatctaggctgtgcacacacacggccatgcgtgctctccttgcggcagtttcaactctcaccttcccccttgcctcaccctttcccagaccgacggctggctgagtgccgactcggccaagatctatgagacctccaccgagacgctcttcctgggccgccaagacgctatgcagcgctgcaccctggtcccgctgcatgactacctgcagggccgggaccctgcccagctgagggcgctggaggtggcggcaggtacgggacgctttgctacctacgtcaaggacaactggcccactctgcccctgacggtgtcagacctctcgccctactacctggcggaggcgcgctccaacgccaagcactggcaccagctgagggcggggggggcctggctgggcggcgctgagggcaccggctgcgactttctgcaggtgagggcacgtttgggttctctgttggtagtttagatgatgtgtgtcgtgtctggggtgctcatgaggtggaccagtgcacacctgcttgaccccgcacctatggtgatctggtcaaaggtgtcgttcttgattcaggcaggaggttgagtctggggagaacagtagcaatacttggccatctgcagaatgcagtcgcagattgtcttccaagacacgcatgctgatgtatcctccagtcagtccgnnnnnnnnnnccaggcatgaggttgagtctggggagaacagtagcaatgcttggccatttgcaagatgcagtcgcagattgtcttccaagacgcgcatgctgatgtatcctccagtcagtccgcatgcatccaaatcgttccctccccacacacaatctagaccccggctgagaagatcgatgcgccggacgccagcttcgacatcgtatacagcatctacctcttccacgagctgccacccgccatcctgcgggccgctgtacgtgagnnnnnnnnnntccagacgccagcttcgacatcgtctacagcatctacctcttccacgagctgccccccgccatcctgcgggccgctgtacgtgagatggcacgtgtcgtgaagcccggcggccttgtggtcttgacagactcccagcagctgggggataggagtgtcttcaactctgagatgcacaagtttggaggtgggtggccggctttggtgagcgtaggcagttttcgcctcacaagtaaagtggaagctcgtcactgtcgacagtctcatgattggcacgactgtatgagactggccaaggagtgttctgcattctgcaaggctagcttcactcatgaaccttccgactccccctttccctctgccagacttcaacgagccatactacagggcctacatccagacagacctgggccagctttttgaggaggcaggcctcacctgcgacaccaaggtccagggctcctccacaaagaccctgtctttccgcaaacccaccgtgcctgcgacagaggggagagccattctggagcgctccttctccatggactccatggacgaggagtgagactgtgggaatacgctcttcaagatcgcgcctggtactcctctcgccaagcccttgtacccacttgatgtcctgggaggggagactgcctcccccaggaggaacccttatactctaagaattatgtgccaacacaaagctgcacacaaacttgcgatcacgttcccatgctatgagaagaaaatgggctgtacagtatcggtgaaatggtcgagtgagcagggcggttatatcatggtgaagcatctggcagggaacggcttgttcaccacacctcagnnnnnnnnnntggtgaaatggtcgagtgagcagggcggctatatcatggggaagcacctgcagggaacggcttgttcaccacacctcagccattctgcaaggtgtacaaggatgccgctgttgtcacgtgcacacagcagataggctaccaatctgagtgcaccacattgttgcgcacaatggtggggcctgtctccnnnnnnnnnncgcacacgatagataggctaccaatctgagtgcaccacgttgttgcgcacaatggtggggcctgtctccatgtaggctgcgcgcgtgatggcgacctctcggaaggctgctcaatgggtcgcccatgcaggggaggagaaggccatgcagagtgagatccttgcggggcacttcacaccgtggctcagcatcggactgtgtggcatactcacgagaaatcacctgcaaactgtcgacagccacctcattccccacgcccacagacacaggagcaggggcaggccaatccggcctcacacctccagggtcgcaccttcgctggctcccaggaccgagccgccaaaccaggcaccaaagtgctgcatggggtgggtcacgacatggacttccaccccggtggcggctgcatgactggcaggtgctcggccctggaccctggcannnnnnnnnnatgggtcacaacatgaactttcaccccggtggcggctgcatggctggcaggtgctcggccctggaccctggcagccacccgcgcctgcacctcggtctccagccgccgagccaggcccttgaagagggtgctccctccctgcatggcgtagggaggcagggtgggagcagaaggcagggtgcgcgtcgtggcaatcgcaagggttcaatgcctgcccaaggggagggatagcgcagccagatctcacgaggtcaacaaaatacagttatcccctgaaaagatgggggcccttacgctgaggacgatgttgccatacagggctctccgagtgtcaatggggcaggcctggatggcatcatctatcaggtctggaaggctgggcgtggcatctggagggcgagagtgccaggaggggaggtgaggtccctgcgagtgcgagccatgcttgcacacaagcagctgtgcaggggtcggccacctcacacgcgctccgacgcacagtcacaaagacatacggtgtcggcgcacgtcccatacacgccatgnnnnnnnnnnagccacctcacacgcgctccgatgcagggtcacaaagacatgtggtgtcggcgcacgtcccatacacgccatgtcacctttggtgaaggcgccggggtaaaaaaacagctcgggtccccgccatctctcctcccccaactggatgcgcagcggctgccccgtcctgaccggcatggtttgcgcggaatgaagggagggagcacgtcatccttgcatgctggagtgcagctttgtaaagtctggcgcacagtactgccgagtgcagagtagcatgcatcctgaccgcgactgagttgtctcctgcatgtgtgcacgccagtccatgccgccccaccttgaatggaccgtctggtacgctgccggggacctggttgctgctggcgctgctccagggcccgcccccgaggccgcgacaaagcattgcctctccttgaccgctaccgctatctccagggactggtcaggcggcggtggggcagccccttttcgcatcagcgcctggatgtgccgcgtgagctgtgcgccccccaggggcatggagcgtgtgccggaagccaggaggaagccgtccaccagggggatcacgtgggtgcacccctccccgctctccaccactaggcctgtgaggctcgccgagctcgtctgccagggcgagaggggtaaggggggaggtgtgggtgctctaatggtgtggcgccgctgcagagcattcttgatggattgcagtatgtgcagctctgcccggagagcagagggatgggcctctatgagactaggtgcagctgtccaaaagcatgcaaaggagcccctatggagctccttccccagtctccccaacacccacgccagccacccccagccaggtcagacctgagagcccatggcctgtcgggcagcatagtcggcatacagcgccagctgggcctgcacccctatgtgcagcgccggcacgtccaggctctcaaacatgacttcggcagcctgctccctggactctgggctgttctggggcggctcggtcaggatgacaggctggtcggaggtgtagacatgcagccgcctgcgagtgtccggggcgcggtggggtgggtgagcgtgagtttgcagcagcgctcacaggtggggcacagacaggagatgtggaatggcgggtcctgtccagcatggcgaagcattccaccatgaacttggtccctcagccctccagtcacctgtacgtcatatccagccagagctgctccatggcatcccagtcctggacgatgccatgcttgacgggcacgagcgggggccccggctccagtcccgcagctcgcggcacggtggacgggtcccgaaccgcggggctgacctcgcccgcgaatccggccttgatgaaggcggacccgcagtcgatgaccagggcgggccgggcaaagtcgtccatgccgcgcagcctgggttctgcgggagtgggagtgccacttgcaattcgactcgtcacgactggcccagtttcattctcgagactgcatgccaggccagcaagcccaacggggcctcagctggcctgcgctgtcgcctgcatttcgaaccccgagatgctccggcgcgcgcggccctttcctttaaacgttgcatgattcaagccggggccagcatgctcactcgggggtccccgttgggtgctctccaccgtagcacaagacagcattgtttcgttgcagccctcggtgactggataggggtctgcgatccctcacacgcaaggcgctccctcaccaggtgcagggcgcgcggagctgacggagcacctgccttgcgcaacccctggttctggaagcccagcgcgcacctctaccaatcccaaaacagcgaatatcgatcagaatcctggtacaatgcctctggcggcctccctggatcgcctggcgcagtcggccgtgtgtagcgtgctgacctgtcggcctaacccctcccatgtcgccttcatcatggacggaaaccggcgccacgccgaggcccggcgccagcccgccctggcgggccacacccaggggtacagccgcctgatccagtccctggagtggtgcctggagctgggcgtggccactgtcagcgtctacgccttcagcatcgagaactatggccggggcgaggaggaggtggagggtctcatgcaccttgcagagcagaagttcctgcacatgctgggggaggtggcggtgctggagcggcgcgggnnnnnnnnnncgggtctcatgcacctcgcggagcagaagttcctgcacatgctcggggaggtggcggtgctggagcggcgcggggtcagggtccgtgtgctgggggacttgaccctggcgccgcccgccgtgcgccgagcggccgagcacgtccaggccctgaccgccgcccatgatcgagtgaccttcaacatctgcttcagctacaggcacgctgcgggcgggggaaggggcgctgggttgggatgatgtgttcatctgcctgcgtgtggctgggtgaaaccctgcccacgagtgattgtgtggggagagacagagaactcgggggatgatcattcaagcagcatgacagggagctgagaacctggccgccctttccctgcccccgctccgtataccatcggtgcctccaggcactctggatccttgtcggcgtgcatgcctcagccgcttccccctttcttcccccaactcccagtgcgtccagcgagatgctggcggcccaggatgcggcggcgcggcacgagccctgctcccccgcctccccgcctttcacccagggcgagaccgcgcgcacgggtgccgaccggggcccaggatgcgctcgcgagggtccctgcgccagctggcggtgccacctggcgcaggctggcaccccccccgtggacctcctggtccggacctctggcgagcggcggctgtccgacttcctgcagtggcagtcccgccatgcgcacctcttcttctcccccaccctctggccggacttctccttctgggacctggcggccgccgtgctttcctggcagcgggcggcgccgcacctgcgggagacgaggcgggtcgccgcggcgcgggcggcggccgccggagccgccggagccgccgcgagtgcggagcccgctgtggccgtgcgcgccgagcccggtgtggccgtgagcgccgccctacctgtcgannnnnnnnnncaagcgcggagcccgctgtggccgtgagcgccgagcccgctgtggccgtgagcgccgccctacctgtcgaggacggacctctccgccaggccagcgaggacgggcagtcgtgcgaggtggagagcgagggcggtgccagcgaggtggagagcgaggcggggccgggcagcccactgctcccctggcgagcgacggcaaccggtggggtgcgcgtcgccgccggctgagattcggccgcgggggccgtgcttgccacgcgtcagacggggtgccttctggctgagttttcccacacacacacttgccccaggcatgtatatataattggttggtcgctcgagagcttagcaaggcgacgctgttcaaggggtgcgggctgcacacctgctccgcctggctgctgcaacaaagagtgcaggcagccccgagggccccgaggaggagctcggcccagcatctcgagcccctctacaggagcacctcgtcctcctcccctgcagcatcctcgctctccgcaactgccacggcttgagcccggcaccccaggctccaagcggcaatgagcagggcctctgctctcccatggtctttcttcctcctgcatgaatgaaggcaggccagtggcgtgtctggacagccatggcttgtgactcggagggggagggaacagagcttggccagcatggacgtcaagagcaggatccacggaccatccgcaccccaggttcccatcgcttgacaacaacgccatcgttccaggctcgcctgagaaagggggccgcagctgggagcagctggtgtgccagtgccatgctccccggcttccccttcttgaagaggcccagctggcgcttccagatcgcggcgtggatgcgggtgcacggaatgtcgagagaggtgaggatgccgtccagcattcccgtcgagtagccgatgttgaacctgggggggtggcgaacgacctgggggtgacctggctggggtgcccagcgcagggcgagctcctttccctccccatcgtcacgcccacagacccggctcgcagcagcccaggccgccccacgccgcccctcaccaggcatgcttgccgctgatgtggctgggggtggtcacctccagcgcggcgcgcaccaccacgtcgccgtcagcgcgcgccaggtcggcatagggccgcagcgtgcgcagcaggcccacgctgcacggctgtttcttcacgcgcgaggccagctgccagagcacgatgggcatgtcgtgcacctccaggcgagcggcctgccaagggaagaaagcgccctcggcagggttctgccagtgcagcaccgccagggcgccggagatgtcggggtccacgccgacgaggatgcagcgcttgcccggcgccaggagctcggggtagatgggggcctctgcggggagctggatgtactgctcctgctctgcagacagtcaagggagggatggtatgagaaatacgccccatgagaccctggtgaggaggcacccaacttgaactctccatccgcaggccactgcatgaaccgaccagcagcggtgggctgtggggaggagttgagacacctgagtcccgtccatgagctccgtggtgcgctaagccggctacgaaacttctcagacaagttcttcgaaggtgtgcatggtcgttggagggaggagcaggggagtgtgcgagctgcaagacggaaggacgccgctcggcttgccagcagcgagctcgacatgagccgtgctcctgcggcggtgagatcggcactatatatgttgcatgactacatgtgaggtgtaatgcgcttcaaaaatgttgaatggaaatgatcacgacctgacgacatcttgcgaggatgatctgcgagaaaccctgcccccgccctttttccattcgactgtgtggcgggcttatgaagacgactaccccgagctagcctcctgggatacgtctaggccgatgaccctaccctctcattcataaagagtcgcgacacatctttgttcccaagagtannnnnnnnnncccattcgactgtgtggcgcgcttatgaagacaactaccccgagctagcctcctaggatacgtctaggccgatgacccaaccctctcattcataaacagtcgcgacacatctttgttcccaagagtaacaacgctgtggatccccccccgcgccgaggcgtatgacgaccccaagagtgacagggcgtgaagacatcagcgcagcggtcaagagcacctggcaggatgccagcagggtgctgatcttcacaaactctaaagttgtccactcgacgttcgaggtggggggtcctgcagggcagggaggcttgggcgacaggtgtccaaaagctctcggaggtggttttctgagcctcacggcgatccctcctcccacatgtcccgcagaccacagaagccgagagggctgccctgacgacggtcttcgcggaccgcgagacagctctcaagcagggcttggtgctgggaggccggcggtatgaggtaagcagtcatgtgatggagcccaccctctcgcatccatgagtgcagcccatttgtatattcattcacccttgcatggttaccaccacctgatcgccgctcctgccccaaacaggtgcaccgatttcatccccctctggtgtacggacggaccatggatggcgacgcagagacgagcacgggaattgccatcctgaaggttgacagcggcaagtatgggagccccacctatgccctcatcacctacgagatgcccaacgtctcagcgcgcatggtccaaatgctggccgactttgggaaaacatgcctggaaggttgaggtgggagccagcccccggcagcagtactgccattgtgttccacttgctctacattgtcagcatccagcaggctccatggcaagaagggacgtcaggacgcatgcaagctgtcgcttgtagacttcatctggcctggaatgcatgtgcatgggagggtcggaccacccatcaagccggctcccaaaactctcagcgggagaaggtcttctcgatctctggaggaaccaggacatcctttcgtgcctgcgagagcacagggagaggcggcagcctatgtgcactcatcctaatatatcgcctacatgcgcagtcaaattcatgcaggtgcatctttgcagtccccctccttgcaaaagttcatgctcacccaggggactcgcttctcgnnnnnnnnnngagtgcactcatcctaatatattatctacacgcgcagtcaaatttatgcaggtgcaactttgcagtccccctccttgcaaaaacttcatgctcacccaggggactcgcttctcgggtgggtcgaggctgagtgctgctcctactgccgcaaacacgcccatgccagctgccagccacccgagagcctgaccaggggtcaccaggtcgtagctgtccagagccgtctcggggttgccagtgccatcttgccaaatgctacgccagggacatggtggagaggactcagcaacaatgcaatcgatcgtccaggaagagggatccgtgcatgtcggacctcccccaacagcatccttcccatcagttcactcacagctcgtcttgctctgcaaggggctgcgtgggcaccgctgcccgggagaggggaccaccacctccgcctcggcgtgccatgagctggcgcgcctgcccggcactgcgcgcgagcaccgacagtcccttggacatatcctaccgatgccgagggtgctccgattcctccggtggcttccctgtgaggcctccctcagggacccagaccacggggtttctaatacgaggttgcgtgggcgggggggggggggggggggggtgcgcgaatgtgatgctgtgcttgccaaccccgggccgcagcctccctagcatggcagagcaggtccctgcccagcgcacaacgcacattggtcgaccagcccggcggcacgctgcaccatgaagnnnnnnnnnntgtggcttcgctgtgaggcctccctcagggacacagaccacggggtttctaagacgaggttgcgtgcgcggggagggggggggggggtatgcttgtgctccttcaagccacggagcgctccgattcaatgcaaattagagttgctctccacctttgtccgaatccctggcgcagggtccgcaccgtgctctcgtcccgggtgcctgtgtgtgtcactttcttcgtgcagtatgcacactcacattcgttgccctatttccaatgctccacacaagataagttcctgtatcgcattgcttacttattcctctacgacgcccaacctgcgcatcagaagtcccaggcagctttgagagcgatgattgcagtcgaagcctcaccgctggactggagaatgacccccggggtgaggctgagcccctcccccatcgcaagcttccacgatgcctcggccaggtctggggccatgcccctgtcaccgctactcctcatccccagggcccagctggaggcggaggcgctcgggtggggcgccagaatggctccccaccgccccccgtgtgcggtgagcggagccgagtccgcagacccttgcagccaggcatgtgccatgaggccttggggccccagcggccgacacgtcgccatgacagccaggcgcgagggctctgccacacccggccgcagcagggctgtggccgccaggttgagatggggccccacggcggcagtgacctgaccaaaatgctgtgccgcagagtgcccggcacctgttgtacgcgatgggatgaacaaatagattgcgggatgtgtcggtgaccagtgtgcacggaccttcaggcaggcggactttgtgnnnnnnnnnntggcacctgttgtacgcgatgggttgagcagacagattgcgggatgtgttggtgaccagcgcgcacggaccttcaggcaggcggactttgtgtgaagcacatgaggccagcatcccccgccacaacacccactttggcgatcgaggaaggtgccagcactgatccagacccctggcagagagagggcagcacccacgccagatcccagccggctttggtgcagtggacagcctttctccagcacatgcgtcagcccctggcctgccaatgcgaagaccggaggcggaggtaacgttcactgcgtctgacccggaagttctgacacctatgccggcacaccacccgagtccggggtaatattggagtaggccactccattgcaagtggttgctcccccccccccttnnnnnnnnnnttgacacctatgccggcataccacccgagtccgggggtatattggagcaggccactccattgcaagtggccgggcccccccccaccttacctgccactggattcaacgtgaatgccaggtcttcgccgcaggctccatggggtgcgaggaagacatgcaggttggggctcgctccgatgcgatacatgagctgcgacgagcgggggaaatgggtgcgacaagatgtgatggatgtgcacagcctccctgcgcggccgatggcatagtgcagggtgttctggccttgatacatgctgagactccctacgccgccgcaccttggtcaagcccagcccttcaggggcggtggtcatccgcaagtggagacgcagcgcgtccctcccgcctcgcggcttccccgccagctcaaggtcaagctgagggccagatgcagccccagggagaatggcgggggccgagttggtcgcctctgctgcaccaggcgcacccgccgcggcacgtcctcgctgcaggggtgcagggcaaggggttgattcagtggacaaatggccccatccgtcgggctttgaccccaggactcacaacacacagccacggcagccaggctcccagctcatgctcccaccttggtccaggtcttggcatggcgccaggtcagcatgccggtcagnnnnnnnnnnccagtggacaaatggccccatccgttgggcctttgaccccaggactcacgacacacagccacggcagccaggctccctgatcatgctcccaccttggtccaggtctcggcatggcgccaggtcagcatgccggtcagcactgccctgccgcgctgcggttgctgggccagatcagagagggaaccaccaggcccgacgccggctctgccctccagctccaccaggcgagacctcagagtcaccatttccgccagtgtgtccctcaggattcgtttgagcgctctcgtgtcgtccctgcggcatggacgagaaacttcttggcgtgcagggacacaggcaatgggactgcccaggcaggggcgctacggccagtaattgctgcactggtatgatcacgcacctctccttccagtcccagtcccaggcttacgtatccagggcctggacgccagtgggcctgctcagacgccgcttgatggcccaggccaggcccaccgtgagggccactccagagatgagccaggcccaaggtttctcgctgcctccatcgccctctggctcctcatcagactcgccatccccaccagatccatcgaccgggggagcaccgcgcccaccggcccccccgccgggcagggctcgcagatcgaggtgccgtcggcatccagccccgtggaggggcgccgcaggggcgcatcgtgaatttagctttactctggggaccttgggtgcatgattgattgttgaaggttctcgaagggacgaggaaggctccacgacggggcatcgtcgtgggtacggccctgccgagggcaccgagagcatggccaatgccatggtgccctatcctcggagcctcagggacaatacatttccatatggttgttcttcatattgtttcagtgatgtatcagatcaaggcgtccaagtgctttgcatggagagagtccgtcgccacggccgtccccccgcgcggggtatgcatcacatgttggcctgagcagtatgactgggtacatattgttcctatcacaaaggatcaacggtgcacttcaaggaacaaggcatcaataagtcatcatatacagatcacggttgccactgaagcggcctcacaacttcttcaacatgccggtcagggtctcggtcacctcctccacccacttnnnnnnnnnnaaatgtcatatacaaatcacggttgccactgaagcggcctcacaatttcttcaacatgccggccagggtctcggtcacctcctccacccacttggacgcgctccgcctccgcctgcgccgctggtccggcctcggcgtggggcccgtcggctgcggcgggcccgcctgcgccggccaccccagctccgcgccacccaccgcctggtagggggccacgggcgggacggtgcgcccgcccagggccctgccggcctgccaccgcgcctcgtcccccgtgaagggccgggggcaggtgtgccagtagcgccagggcccgtcgccgtagaccctggtcagcagggaggccagccatgggtccgcgcgcttcactgcgtcgcgcgttttgaggccgctggtcacgtcgtcgcgcatcgtggcctcaaaccaggcctgggaggcctcggcctttggttgggtgggggtccgagcacaggggggttgctggaaacggagtggtatcagactgggaagacaaagcatgcttcctcaagggcccatccacgacggcctggccctggtgtgaactcgatgtcgcgaccccgcaaggccctcctccccacgctcaactcacccagtactcccccgggttggagatgatgtagctgcctttgacatacgtgccacgcttctccgccgccttccagcactccacgatctctgcctgcggcccggtgcaacgggacagggcagggaggtaacgggctaagcatcgtttgacatggtgtgagtctaggcgtcgtacaagagcacggcccaggatcgtgtttcgctcgggagtcatttcttgccaggcctagcacctcaaatgccctccgaggaagggccccnnnnnnnnnnctcgacatggtgtgagtctaggcgtcgtacaggagcacagcccaggatcgtgttccgctcgggagtcgtttcttgccaggccccacacctcaaatgccctccgaggaagggccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataccccaggtccatgaccgcatgggcccactcgtggatgaggatgctctcgcagccgtagtgcacgtcgtcctccatggtcaggttctcctcccccaccgaggacacggggttgctggtgcccccccccagcccgcgcgtcgccgtctccacccgcccgccgccattgccactgtcctggccgcggtactgcgcgtactgtgggatgtcggtggtcacctgcccccgtccgatgatcgccaggaaggcgccccagccgtgcatgcgcgacaccgccggcgcggggaggtgcgcagtcatgcagtccatggtgaaggcggcgaggcgcaccgccgcgtcgggcacgcagtcgaaggcgtagatcgggtggccccgggcgcagcgcccgcgctggcggtaccagccccagggtgcgacgtgcatgtcggggggcctgcggggctgcagcccgggctccacgcgcagtcgggcgccggggaggaccgtcagcgtggcgcctgggcccacatactccccaatctccgcgcccgtgtctgccacccgcgcgcgccaggggtggctggtgtaggtgtctggttgcaagggcaaccggtgggagtagggcgtcatgaggctgagtttgagcctgcctctgggatgggaacaatgctcagccttgcacacaatcccccaggacagaccaggccaccttggatgtggctctggccggggaacaccgtggcgtacgcatgctcctgcccgtcgtagtctatccagaggaacttcaccgggccatccgtgtcattgttgaatctgtgacgacatgcggttttgcaatccttggaacgcgccatagcgggcaacgggacgccaggcacctgccccctcgagatccctcaacggaaggctgggattcccatgagtaagcgcatgctcattgctaaaaggtaccaatgccggaatacgtatggcttattaatcagcatgcaaaggaatgtcactgtgcgcgtctgaannnnnnnnnngagcgcatgctcattgctaaaaagtaccaatgccggaatacgtatggagtattgatcagcgtgcaaaggaatgtcactgtgcgcgtctgaaccaattgggtcatatccagccattccggtgtgctgtgctggtcccggtctgtggaaattgtgtctgagctcataaatttcatagggagtgaagttgtcttgaagtcaggacagtttcacaggatcatcgccaagtgtacagctctgtaagtttggaatcaggcggtgcataagtgagacatgcatagaagtgctcatgcttacatacaaggtagtgtagtagtatacagtaatgatctgaagtgattggcgttacannnnnnnnnnaatgcacagaagtgctcatgcttaccgacaacatacaaggtagtgtagaagtattcagtaatgatctgaagtgattggcgttacaacttcattcggttcactgtatactgcacatattgctttgattgccttacatttggggacgggcctcgtaggaggaatctagccggcctagggtcagaaatccattacaaaaacggcctccaaacccgcaccgcattcaagcgatctgaaactcccatcagagtctccaacatgaaacctgatgctcatgtgcccaaggatttgctgcgccatggcacagacgatccattctacgtcggcttctccatgtccgtgtaccagtcctcgggccatgaccacagcagctggggcgagtttgggcggtcgaggacctggtatgggggccacaccatccagggcaatcagcagtgtggggagtcctgcaatttctgggagctgttcgatgccgacatcgagcgagccgctagcctgggtgcgaattgcttccgcatctccctggagtggagccgcatcgagccggagaggggggagatcgattccgcagctgtgcagcgctaccatgatatcatcgacagcctggagcggtgagagctgttgggcgggggagaacgagcctcggtgtggttgagggtcccatggccgggcatggacggcggccttaggaacaacatgccacgctgcctgtcgcacgccctctacaccacgctcaggcacaagatcgtcccctttgtgtccctgcaccacttcgtccatcccatctggtttgagcacctgggcggcttccaaaaggaggagaacattgccttctttgtggactatgccaagctgactttcaggtgattgcttgggagctctgtatggcgtgggtgtctgacctccagggtggagggagacccatgtcgcatgcctcaatagatgaagagcgagctgcctgacaagacttgattcatgcaccgcttgcatctgagggtttggtgcgatgctgatagtatcaaaccagtttaagatccctacgcacgctaaagctcgtttcttccagaatacatcctgatcaccaccgaaattggcccaggctgtttggctcccgcatcaagtactggagcaccttcaacgagcccggcatcgccagctttgccggcctgatgagcggcaccttcccccccggcaagatcctgcgcatcgcggggacggcccgccacctgcttcacatgctgcaggcccacacccgtgcctacgaagccatcaaggccatgcctggcggcgatgcggtgctggtgggcatcgtgcacaatttcttctggttcgagcccaagcaggcgtggtgggtgcccagctatgtccgcaccatctgcaagttcctcaacctcatgtggggcaacgataccgtgctagagtatctgcgcacagggagattcgagtccaaggccagctggtgagctttaagggtggagggttgctgtgttgggatgtggcctcaaggacatcgattgccattccatgccactatgaactgggctgggtgcaggcgtacactgttgctccatagtgtgccctgccatgtccgctcaagagccatgggtgccctgctgccagcactcgnnnnnnnnnncacactgttgctccaaagtgtgccctgccatgttcgctcatgagccatgggtgccctgctgccagcactcgcaccatggtttgactattctcgtccaccctacacaggtttgttcctggggtctactaccagaaccccaccggcaggcccgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacctctgccgtgcaccaatgtgtcaaaccctttgctaacaggggcgttatcgactggaagctgatgcnnnnnnnnnnagcaggtgcaggcgggtggcagcgctgagaattcacagagcgaatgagagccactccaagggctggtgcttcaggagtatcgcaccctttctgctgtttgcatccgtacccatactgagtatcaataagattgtgcctgcgccggctgggtgtgcatnnnnnnnnnntgcaccctttctgcttattgcatccgtacccaaactgagtatcaatgagattgtgcctgcgccggctgggtgtgcatgctgcagcctcttccaacaactataccttttcgcctctgccttgcatcaatgtgtcaaaccctttgctgacaggggcgttatcgactggaagctgatgccgtcgtgccagccgggtgaaaccatgaccgacatgccgtatgccctccatcccgacggcctgaagaaggcgctgcactccatcaaccgcctggatgtacccatctacatcacggagctcggggtggcggacagcggcgacgacatgcgacgcaagctgatcgagggttacatgcccaaggtctgagctgggtgggcagctgggggaatggggaatctctggtgatgtttgggcatgcagggaacagtgctgcccgttttagagccccagacccttacccgtcccaccaatgccatgcctgaccctggactgagcaggtggccgaagctatggaggaagggtgcgacgtgcgtggtgtgctctactggtccctgatcgacaactttgagtggcagatgggcttcaagatgaaggtgtgggacagctgaatgtatcaccctggcgttcacgatgtggtcttgtcaggaacctgaaaccctgctgtttccagcaactcccatcaacctggtggtnnnnnnnnnngtcgccctggcgttcacgttgtggtcttgtcaggaacctgaaaccctgcagtttccagcaactcccatcaacctggtggtagcagtattctcggtggcctcctcaatgccctccactcctcacctcatgccccgcccctcagtttggcatatacaactgggacaatgacggcagccagaagcggaccctgcgtgacagcgggaagctgctcacacagtggttcaagcgtctgacggagtatgcggcagggaaggggctgccggtgggcaacacggacgccctcaaatctgatgggcacaagggagtcctggaggccgcacccgcataggatggccagcgaggccattgaggactcagtggtatagagagttgcttgagaacaccaagctgtcacagcttgtatttttgtgagtaaaggtagctgccttagaataccccacaggaaaacccccagagcgcgttgagatggatctcnnnnnnnnnnggctgtcacagcttgtaattttgtgtgtaaaggtagctgccttggaacaccccacaagcaaacccccagagcgcgttgagatggatctcgaccccccttacagcttcccctcgattgcactgcgtgtcggtccgacaccctactcatttaagcgggggcacagcgcaggtaaatacatttgaatccaccaagtaaagtggtagcagggaattttcaacaactcgtaccctctctcaagccctggggcctgggcgcacnnnnnnnnnnctaccgcgggcatagcgcaggtaaatacatttaaatccacctagtaaggtggtagcagggaattttcaacaactcgtaagcctctctcaagccctggggcctgggcgcaccgggacatccatatgcgaggctgcacctttttggtcgtgctgctggttttgggcgtccatgctggcgccgaatggaccccatccacctttcccaatcccaaagtcgacataggcaagtgtggcagacgggtagccagcaacatttgcgacccggatggggtgctggcccaggccgaggccgaccgggtggagggggtgatcaaggacatctgggctggcgtggacccctacattcgcaagaaatgtggagatgagatggagggatacatggtgcgcgggggggggggggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtattgatagtatgggtgaggttactgagctctcggacatgaccagctgttcatcagagttttcacactcccccacccacaccaccccccttccccctgggcaggtgggcgtggccctcatgcggtccatgcatgtggaccccgggcaggagcccggcgccgcggccgaggcctttgcccannnnnnnnnngtggcagtgtgtgacctgcccatggaccaggagaccctgtgcggatagtggatgctccctgctcagactcaggcctacatcaatattgatagtgtgggtgaggttactgagctctcggacatggccagctgttcaacagagttttcacactcccccacccaccccaccccccttccccatgggcaggtgggcgtagccctcatgcggtccatgcatgttgaccccgggcaggggcccggcgccgcggccgaggcctttgcccacgctgtgcacgctgcgtggggcgtgggcagcgcggcctgcaacaatggcgtgctcctgctcctggccctggaccagcgccaggtgtacatctccacgggggccggcgcgaccaaggcgctgcccgacgcccacctggcagccatcattgccgccgcccggcctctgctgcggcgccagctcacgggggaagccgtgcagcagatggtggtggacgtggggttgggcctggccggtagcccaggtccccgccatgacagcgaggacggactggactgggttggcgtcggcatcttcggcaccgtcgccgccgtgatcggggggtccatgtggtgcgtggacctatggtgggagctgatcagatgcagagcttgtttctcgtgtgggggcgtatggaggtcaatgtcctccttgcgggcctggtcagtggtcgagaacaggcctgcagcggtctgcggggcggtgtgcaggggtactgcgcatgattctctgccgtccatctgaggggcgcacccaggctgcacagtgtcccttgcttccactcccatcctggccactgctatgatgctcaccaccctcgaacatccacctcacaggaagcactggcgcaggaaaaaggagttcaaggcctgcaagcgcatgctggacaaggtctgcgccgcgtgtgattgggtgtggcgctgggaggcgggggctctgttaagcagctctcctggcgcacccttcctgttactctgcaccgatcatgcccgcgtcaaagaaatcgctttgcacaagagatccagtcannnnnnnnnngggcagctctcctggcgcacccttcctgtgactctgcacccatcatgcccgcgccagagaaatcgctttgcacaagagatccagtcacttcgccccatctctcaccctttccttccccgcaactccaccccctctgcagatcaagcgtgagcaggacaacctccgcacgcatgcctggtcccggcctgcgagctgcccagtgtgtctggaggacttcagcgcgccccctggccccggtgagggcgcggaaggcacagtgccttcatccaccgccgacgaggcaagggccagcagcagctcagccccgtccgcgccgctcctgcctgggggcgacgccggggtgggcctgcgccgccggagcgggggccaggagggcgccaaggagggctccggggacggcgacgccaagaccccggtcacgctgcgctgcggtcacaccttctgcgagccatgtgggtttgggatggggcaggtcccggggatgcacagggcactgtggtgctgggctttatgacaatggttggaccttgcctcatgtgctgctcgatggctgttgtttccccatccctccctgtccaccttggccccttgcatggccaagcccccacctgcattctgctcacccggtcgtctccactcactaccttccacctctccataaacgtgttcccccttttccactactacaaattttccaggtctggagcagtggctggacaaccacaccaactgccccatctgccggcaggacgtgtccaccccgcctggggcccccactggcaagggacagccggccacgcagcagcagacgtcgaccgctgaggagcgggagcgcgcccagcgtgccgcccaggaggtgctcaacaccgacctcagcttccggctgctgatgctccaacgcatgtacccctggtacctcaccgacgacatgatcgggcggtggacgggggaggcgcgggagacagggaccttcgactgggcgggcacccgcgagttccagctgcgcgacccaggcgtcgcggcgcagcagcgggagtccggcgcctctggcttcggaggcgggtggggcggcgggcacagcgtcggggggggcggtgcgggcggcagctggtgatgaagatggctgggcaccatttggggagcagtggccagaagaatcatcagacgagccagagcgacacaccttcctttgaaggtatcccactcacgtcgccccttctttgaatggattcacccctccccaggggacccatgcatatgccctgcacccccacctctgtattgcttttcgctgtatcagcttggaagtgtgcatttcaaatgcgaagggggatacaatggcgctgtatcagcgcaggggatggttcggtgcctcgacagcactgtctggcattgcatggtgaggtcctggccctttgcatcaagcagtgcaaagggagtgggcaagtgatggtcaactgtgtgaggcaagtgatgggcctgggggctacctcatgcttctcagtgtcagggtcttggcgagggtgggagtgctagatggcttggaggcggcgcgggctgctggctggccgactgatgcgagctggtggccggatcgaagacagttcattggcccggcgttgaatgcgctggtgatgtctcgcaggggcgacctggacttaccatgatgtttggagccggagggagaagggcgtgtggaatctgcacattgtgagatggcggttggtgggtcggagcagggctttgctgccgtagtgtgaggtcgatgccatccaaatagattgaatgcgtgaccacccccctcaccgagaaggacgccgcgcatggatgtgaagtgctcgtcacggtaaatctccatcactcctgtttgatttgggacgcgatagttgttcagcgtcaagtgcaacccggcttcgaagctattaaaacacccttcgaggcacgcatcaccctactttcgcaggcgcacctccaatgccaattcgactggcagccttttcgaggtatatccctccccttcaatatgcgatggtagaggcgtgggagggccctgtgtatggctgcgcgtcctggctggtccgtttgacggccgcggatgctcgagagggatctgcgatctcaaaccagtacgatctgcccaaggacaacttcgattgcgctccctcggttctctgcacttaatctcattacagtgatgagagcagaacagggagcggcccgggcgcctcggtggccctgtactatcgagtgggctgggattcgaatccgggatttcgagcggactcccgccggcttttgaaatccggcggttgaaggctgaggcttctccccctactgtgcggtgggcgaagcctctctggatgccggatcacccttgccagtcgcatcactgatgaagtaaaatggcacaaggaggccttgcaagcccttcaaaccctgcactggcatggccggcacggcgcaggctcactttggcggcactgcggcggcggcgcgcgccgccaccgccgcccgccccatgagctcctcgtagaacacccagatgagtgcggtctgcagcgcccgtttggcgacgcgcggcaccgcccccgccagcaggcccctcgcgccctgggacgcgctgatgtggcgcagcatgcctagagcggagaggtgcggcgcggccgcccctgccgcccccgccgcccgcggcaccagccgcagctggacctgggtccgcaccacgtcaaagggctgagtcagcagcgtggcggagacagcggccaccgtgccggacagcaggttgacggccatgggccgccacgctgtcctctcgttcagccgcgactgcgagtttgttgcagagaagggggtgaagggggtttggggtcgttggaagtcggggctggacggacaggcctgtgcatggccgcgccggccnnnnnnnnnngagggggagaagggggttggggtcgttggaagtcggggctgggcggacaggcctgtgcatggccgcgccggccagcacccgcagcagggcgcgacgagaggatggggtgtgcaggcagcgatccccccttgggttgacagtgaaccccctcccgaccccaacaccgtcccctcttcacacacacacctgcaggcgggnnnnnnnnnnaacatgtagtacagccctgcaaagggggcgttgctcagcacagtgggccccaggccgccaaacaggccccgcacgccctcggcgcgcgtgatggcgcgcagcgcgcccagcgtgctgctgccctgcacgctcccaaactccatgcgcgtcttgaccacggtgatggggcacgagacgacggcggcgatggcgcgggagcagccccctggagcgggaagggtcggaaaagggggagtcacgtactgaatttgccatgagggggttgtggacggcacgggcggggtgtctcggtcggcaatggccacacgcaagtggaaagacagcctcgtcaccccacctgcaaacgcggcctggagggcgcccagcttgagtgagccgtcaggctggcgctgggagaccaggggcttgatggtctccagaaggaagaagtggagaccggcgcccagacccagccggatgacggtcggctgggtgccccgccagagccccgtccagtgtgactgagggagggatgcagggcaggcatcaggctacaactcatcgagatggggacatacaatgtaagtagcctctttaaatcgagggtcccgccttcccaggcgctcctacctccttagtgatggtgcgcagggtgccccaggcactcacgtgcacccctcggttgacgtccacctgcatccgtgtgcgcaccacgtccagcggctgcacgatcgcgctcacacatgctcccgacagggatccagacatggccgagaccagcctgctcttctcggtcctctgggccatcgaccgctggtctggacactcggttgtggtcacccaggcgacattggaaccagctcgtcaacacctgcccctggcgtgacgacacatgttgcacatatgcaatgtattgcttgtcgagtctggatttcggttgaatgcgcaacccgcattcgacgttgtgttcgtcccactttgcatgtccctgcgtgtggcgccnnnnnnnnnntgagtctggatctcggttgaatgtgcaacccgcattcgacgatgtgttcggcccactttgcatgtccctgcgtgtggcgcccacacgagggcgcctgatgggcacgtcagcaggaacacttgatcagactcggtctcaggtagctctgcgcgaggtgccaatacgaccacgaactgtcgcaagtcatcagggtacaaaattacattgcttggcatggtatctagccttggtatcatggcctgaggtcgggctggagagggacccgaggggatgaagaggggaaatctccgcaagacgtccgccctgtccttcgatgacgaggatgaggcggatcaggaacctttgtctgcatctggaccagccaaggcgccacggcctgcagtccaggcccgacagaaggcggagcgcaagtccctgctcagcttcgaggacgatgctgaggatgggatggctgctttgcccgtcgtagtgagacccgagcgccgcaaactgaggggcgcgggcatcgctcgccctgagagcagggagttgagactggaagcccggccagccagcacacaagtgtcgtctgctggtgtgtgtctgtaaggggtggtggtctgaggtgaactcattgatagtggaggatctgcatggactcacaactgggcctgctcctcacaccgctgctcagctcctgcctttcgacctcctcaccaggcgagtacagcgctgatcggctgaaggagctgcagagctcgatgctgaggaaacctgtggcctctgcacagcccgcctttgtggtggcgggcagcttcaaggccgggcctcccaagccatctgttgcgcaaactttgtcaggaggtacagctggcctggcacggcccagatccagctcctccctgccatatggtcagggcg

SEQ ID NO: 47209 - DNA, 61 bp, Chlorella protothecoides
ggttctgtcggacggcgggatgggagctggaggtgtggtagagccggcccacgatgccttg

SEQ ID NO: 47210 - DNA, 25600 bp, Chlorella protothecoides
  modified_base (711)..(742): a, c, t, g, unknown or other
  modified_base (947)..(956): a, c, t, g, unknown or other
  modified_base (1040)..(1049): a, c, t, g, unknown or other
  modified_base (1133)..(1142): a, c, t, g, unknown or other
  modified_base (1778)..(1787): a, c, t, g, unknown or other
  modified_base (3099)..(3108): a, c, t, g, unknown or other
  modified_base (3202)..(3245): a, c, t, g, unknown or other
  modified_base (3306)..(3315): a, c, t, g, unknown or other
  modified_base (6740)..(6749): a, c, t, g, unknown or other
  modified_base (6917)..(6926): a, c, t, g, unknown or other
  modified_base (7080)..(7089): a, c, t, g, unknown or other
  modified_base (8407)..(8416): a, c, t, g, unknown or other
  modified_base (8638)..(8647): a, c, t, g, unknown or other
  modified_base (8898)..(8907): a, c, t, g, unknown or other
  modified_base (9671)..(9680): a, c, t, g, unknown or other
  modified_base (11093)..(11102): a, c, t, g, unknown or other
  modified_base (11773)..(11782): a, c, t, g, unknown or other
  modified_base (12237)..(12246): a, c, t, g, unknown or other
  modified_base (13124)..(13133): a, c, t, g, unknown or other
  modified_base (13821)..(13830): a, c, t, g, unknown or other
  modified_base (14140)..(14149): a, c, t, g, unknown or other
  modified_base (14523)..(14532): a, c, t, g, unknown or other
  modified_base (14646)..(14655): a, c, t, g, unknown or other
  modified_base (14805)..(14814): a, c, t, g, unknown or other
  modified_base (15796)..(15805): a, c, t, g, unknown or other
  modified_base (16367)..(16376): a, c, t, g, unknown or other
  modified_base (17789)..(17798): a, c, t, g, unknown or other
  modified_base (18023)..(18032): a, c, t, g, unknown or other
  modified_base (18699)..(18708): a, c, t, g, unknown or other
  modified_base (18778)..(18787): a, c, t, g, unknown or other
  modified_base (18916)..(18925): a, c, t, g, unknown or other
  modified_base (19873)..(19882): a, c, t, g, unknown or other
  modified_base (19990)..(19999): a, c, t, g, unknown or other
  modified_base (20171)..(20180): a, c, t, g, unknown or other
  modified_base (21539)..(21548): a, c, t, g, unknown or other
  modified_base (21746)..(21759): a, c, t, g, unknown or other
  modified_base (21975)..(21984): a, c, t, g, unknown or other
  modified_base (22188)..(22197): a, c, t, g, unknown or other
  modified_base (22690)..(22761): a, c, t, g, unknown or other
  modified_base (23330)..(23339): a, c, t, g, unknown or other
  modified_base (23596)..(23605): a, c, t, g, unknown or other
  modified_base (23693)..(23702): a, c, t, g, unknown or other
  modified_base (23919)..(23928): a, c, t, g, unknown or other
  modified_base (24324)..(24333): a, c, t, g, unknown or other
  modified_base (24431)..(24440): a, c, t, g, unknown or other
  modified_base (24578)..(24587): a, c, t, g, unknown or other
  modified_base (24789)..(24798): a, c, t, g, unknown or other
cgggcgggagggcgcgctgcgcggcaagcgtgcaccccggccggccgccccggcccagcctcaggctcgccagccggccggcgcgggtcagcgcgtgcacggcgtgggggccctgcgccgccgccagcagttcgtccccggcgaggcccaggcacggctccgggggcgacagtccctcggccccagccgcggcaaaagcccgccccgtcagcacgccacgcgccagcagagcgatgccgggcgactccaggggctgggaggacgccagcgcgggccccagtcggtcaaagagggcctcgctggcgccgggcacccggacaacaaaggccgtgctgggctctgaagcgtccaaaccgccacgggcgaggacgctgacgaggacggggccccctggcaggaccccatcgcggcccctccgtctcttggcgttgccgatcagcctcagggctcggatactgcagggcgacctgcagtccaggggtgcggctgcggctcccggtgcaacgccggcggggatgccggtctcggcagcctcggtcaggccatcccgcgggaccagcagcgcctggagggtgccatcctcaaggccgaccaggaggttgagggcccccggctggtaccaggcagccagggcggagactggcgctgacggagattctggagagtggtttgtgaggacctgggggtgagccatgcctgagagcgttctcnnnnnnnnnnnnnnnnnnnnnnnnnnnnnnnnctcctgaccctctttgacctgagcttccacgcacctggggtgaagctggcgaccacgaaaccttgggcagtcagaatgtgcacgccccctgccccatcacccacagcaagaaggggagtcagtggcccaccaccgcgcggtgtgagatcctgacctgggttctggatccatgtaagtgcagtcacattgctgcggaggttgtggnnnnnnnnnnttgttgaaatagaattgcctggcaagctgcttggaagggcacccagagcaacagtgtgggatgcatgcacatgcgccgggtccnnnnnnnnnnctgttgaaatagaatcgcctggcaagctgcttggatgggcacccagagcaacggtgtgggatgcatgcacatgcgccgggtccnnnnnnnnnncccgcgcggtgtgagatcctgacccggggtctggatccagctcagtgcagtcacattgctgcggaggttgtgggccgacaggagggtggcggtatcggtccacgtcggcacactcgtgtacaagggagtgatctgggcctcgcaggtatcgctggagcctacgcaatggggccacgagaggttgctggcagtgcttgatgaagaatgcctgcatgtaaaggcgcatgcatacctgttgcgcatgagatggacgcgatgagcaggagcacgacacccctcatggtgtggagcgtccggtcccaacagccaaccatgctcgaccctccgggatgcagtcgtcagcaatcctgcatccactcatggcatctggagggaagcatgcgatgctgagatcgcatcatcgggtttcgcatgcttggcaatgggcaaacccagccaggcgagtggggtggtggggaagaaagggtgtgcttggaaaacccagggaagggtcaagaagttgctcgcacacgagcccctgctcctcagcaggtcgcggaagcaaagaattcccagcatagtacattgacaaggtgtgacgagaagccaggacctctccccgcctactccgacctcgtgcgccccgacttcccacannnnnnnnnnaagtacatggacaaggtttgacgagaagccaggatctctccccgccctctccgacctcgtgcgccccgacttcccacacctgcttccacgcggtgcgcagttgaggcccagatctcgacacactccgggggagctgtccgtctgatctttagccatggtagaacaggtacagcagtccaaactagtcctcctgggcgagatgggctccgggaagaccagcctggtccagcgctttgttcgtggacagtatttcgagaaccaggtacgacctgcgccggcggggggcaggctggactcttgctgggcgtgagtttatttcttcgatgggagcaagtgttctttgaggctggcctgggaggggagactgaggggtccctgccgtcattccatgcgactggggcttgaaggctggctgctccactcccttgctgtgccctccccctcccgcccaggagtcaaccataggcgcttccttcttcacaaaaaccattcccgagaagcacgtcaagttcgagatttggtgagattcggtctgggtggtgcccaggtttgttgctttggtggatcgcggatggatgggtagggaaggtgcctgccccatcctcacctccccctccctcccctccaacccacctcgcagggacacggcggggcaggagcggtaccactccctggcgcccatgtactaccgcggcgccgcctcggcggtagtggtcttcgacaccacgctggccagctccttcgaacgcgccaagaagtgggtacacgagctgcgccagaacgtagccaaccccgacctcatcatcgcgctggtggggaacaaggtggacctggtggacgcgcgcgctgtggccgaggccgacgcgcgcaactacgctgctgagaccagcctgctctactacgagtccagcgccaagaccaatgtgaacgtggtggaggtgtttgaggacattgcggaccgcctgccgcgcgccgccgcagccgccgcgcccgctggcatccagctggacgagcagccggccgtggcgcccaggagagcgggctgttgctgaggcctgtgaagggacggggggaggctgggtggctggtgctggggtggagggccctgagggcctggcgccgccgtgcccaagccagatgagtatggatctgtcggccttttccccgcgccggccggctggcagcatggggcccaggagccggggcaggccccgaggccgggtttgaaaccgtcaccctcaccttgcgcaaaaagccagacctcatgtcacgatgttcagtggcacctggagtcacggccacgaccccactnnnnnnnnnntgggcttgaaaccgtcaccctcaccttgcgcaaaatatcagacctcatgtcacaatgttgagcggcacctggagtcacggccacgaccccactnnnnnnnnnnnnnnnnnnnnnnnnnnnnnnnnnnnnnnnnnnnncgcgcacaggcttcaggatcagcaaggtgatcaggggcgaggagaagggaataagtagaannnnnnnnnngtctccagggtttattgtccccctcccctgccccccgccgcaactcgcaatgtgtacactaggcatgccaggcgcacaggtttgaggatcagcaaggtgctcaggggcgaggagaagggaataagtagaaacctccccaggaggacactgcaggtaccggggggctgaatgggccccccgggcaggcgcgatcaggggcccagacggtcatgcacgcaagggcttccgaaagctcgcagcgaccatctagcgtaaggggcagagcaagcgggcagatgagagagagaggagaagagggaaaaggtacagcatactctcgcgcggttccaagtgaatgctactgggggccgtttggcaaggagggaggtggcacgtggcatgcacaggtgccaccagtgtgccaccagtttaaaggcaccgacatgcgtgggcgcatggcggtctcaaggcgagaggcagagggggtccacccagggcatgatacctgcctccagcccagcccgtacaccgagcgcctcctcgcccgctccgccggctcgccgttgccacgtccaccccctcgcacatgatcccctgccgcccgcgctcaggcggacgacacgttgaaccaggatcgcatgccctcgtcgtagtgcacatgggtctcggtgtacagcggccagcgcccggcggcggtggcaatgacgtccacggtctgcacgatggagggcagcagctccacggagtgggtgtgggtgttggccgccagcagctgctgcgcggtgaaggccggcgcgtgcaggtcggtctcggtgcccatgccgatgaggacgaagcgcacgcggctgcccagcgccgcggtcaggtcgggctggttgcagaagaggaagccgttgatggcggagcgcacgacgctggttgcgaagttggtgtcgttctgcgcgccgatggggtccagggcggtgcgctggagattggccaccacgtaggggctcacgctctcgtccccggtcaggaacaggagtgggtacaggtggtccacgcccacggggaccggggcggggtcggtggacaggtcgccgccaaaggcgccggcgcggccgatgaccagcgtgcccaccaggcccgcgtattggtgcgtcgcgatgtccacgccggaggagtaggcaaaggccacggtactcaggtcgttggtctgggggccggcactgcggtgggtgattggttcatgggtggggtgaggtggggtgggtggggagcttgcgtgaagggtctgggcagattgcgatggggagcagcagaagttggtgcctggcggggcagcgcccaggccctcagacagttcagcacagaccaaggcatcccttccccccatgagggacgaaaaagggcaccattcactcacgtggaaggcacgaggaaggtgtataggtgggtggcattgggcgcgacgggggtggaggcggggtcgctggcgttggacagcgggatcaggccggcgtcgaaggccaggttgacatccatgtccagggcgttgcggaagacgacggcaaaggtctggcccacctctgcgaacagcgtgggccccagcaggccggcggtggcgggggcttccacgcgcgtggcaaagtccggccccgtgtactggcggtagacggccttgatggcctcgggcccgatggacacgttggtgtgcgccacgtactgcttggcgttctcgtcgaacgcctcgcccgtgcagccgtcgaggcccaggggcacgtagttccagaccagggtctcggcctggacgtagtaggtcttggcggcctcggcggcgggggggtcggcgacgtcccccaccacgtcgtacagcgccatcatgccggcgttgatgtggtccacggtgcggcaggtgagcaggctggagccggagccgtgcgcgaccacgtccagggactgcatggtgccgggcatggcggtgacggagggcgcggcgcggccgtcggccagcaggttctggcgctggaagttgggcgcgtgcacgtcgggctcggtgccgatggagatgatgtggacgcgggtgacgccgtcgcgcgcgatgggaatgtgcgggccgttgcagtacatgaagccgttgatggagtgcatgaggttggactcggcaaacgcgccggcgggggaggactcgccgccctccgcctgctccgtcacctgggtgtcgttcagcagcacggtccagtcggcgtcggccaggaacagctgcatgttggcgtccaggaacaggctgccctgctcgttcatgacgctgaagtagagcaccacctccgcgtccacgtccagcgggaccatgtcggggccaaaggcgccgcgctcgccgatgatcagcgcgcccaccaggcccgcgtaggtgtcggcgtcctccacggtgtgcgagtggtagagccaggccttggtggagaggtcggcggggccggggcccgcgatgtcgggcacgttccaggtgtaggtgaaggtctggccggtctccaccgcgtcgtcccgcttctcctcggcgctcgtcccgtcgttgtagggcgtcccctcgttggacttgtcgtaccacacgccgtgcgggtgcatggacaccgggaagggcagcgtgttcttgaagtgcacgcgcaggatgtcccccacctccgccttcatgatgggccccagcaggcccaggtactcgtcggccgcggcgcgcggcacgcgctgcgtgtaggtgtcgtcggtgtacaggcggtacaggcccttgacgtaccggctcccgatgcggtcgctgaagttgcccacgtacgtcagctggtcggcggtgaaattctccgccgacccgccgcacatgtaggcgccgtgcggcgcgtagtcccagatgtcctgctccgcctgcacgtagtactcgcgcgtcgccccgtccagctgcgcggtcagcagcgcctgggtcgtcgcgttgggcgccacctcgtacagcacgatcatgccgccgttgaagtggtcattgatgtggcagtggaacatccaggtgccgggggagcgagcctccatggccagggagtaggtggagccggggatcatcttgatgatgtcggcgcgctggccgtgcaccgtgatggtgttgccgtgccagtgcacgttgtgcaggtccaggtcggagccgatggccgccgcgtgccagcgcaccgtctcgccctgcaccatgctcacgttcttcaccgcgcagtacagcaggccgttgatggagtggtgggtctgggtctccagcagctcggtggggctcagcccaaaggactccgccgtccggccccgcatgttcatctcgtacagcggggagttgaactcgtagatgatctggatggagagggggtggggggagggggtgtgatcagggagggagacaatgccgggttggcgagggagtgactgcgaggctgtgctcgaggccnnnnnnnnnnggagggggtggggggaggggctgtgatcagggagggacacaatgccgggttggcgggggagtgactgcgaggctgtgctcgaggccaaggctgcgcctgagagtgccgttgcagcacaggatactgaggcagggggacgtgcagcaaaacgcagggcaatgtacaacnnnnnnnnnnctgcagcacatgatactgtggcaggggggcgtgcagcaaaacgcagggcaatgtacaactcaaactacataccaaaggggcgttaattgcattccaacaatgaaaaatgggcatggctggccaaaaccccgaatggcaaggaggcagcacaccnnnnnnnnnnggaggggctataattgcattccaaaaatgaaaaatgggcatggctggccaaaccccgaatggcaaggaggcagcacacccagatctcatccctcccagatacccacctgggtgacggtgatgatgtcccggccggggggccgcgtggtgtcggtcgcgctggtggaggcgttggcgatcaggatgggtccgatcaggcccagggaggagtgggcggtgggatcgaccatggacctgggcggggggaggcgcgtgcatctcggtgacgggaatgccggggatctggagatccgatccagcgcacgcgagatatcctcgacgcaccccgacacgctcggatttagaccctcgaacgatgaattgcaactcacttgtacagccagagctttgtgtccggctcgtaggcggtgggaccagcttcttgggggatggtgaaggtgagggtgacggtggtgttggacggtacggggtccaggaagtcggaatcatccccgacgatgggcgagaagccggtgggcacgaggttaacgtcgaagtccagggtgttccggaacacgatggtgacattgtctcccacgcgcgcgctgatgatggggcctgtggaggggagcggggatggccagtggctggagtgcccaggttgcatggccgcacgcaacagccctaagcctcggcagccaaggcgtgggacacaaaccgtcatgacaccctgtaaactcacccagcatgcccaagtgagcctcagctgccggcctctgcagctcctccgtgaaggtctcgtcagtatagcccttgtacaggcccatgtaatacgagctgcccacggccgccgtggtgaaggtctccgaggcgccgtgcgatgtgccacagatgtcggagctgcctgagtcaaagaggacgacctcggccgagatgtagtagggagccgggtttgcagctgccgccagtgaaagcagggtgctgagcaccagggcgcgcaccaggcgtgccatggtgtccgtcgactgaaacctggtccccctggaatgcaggcgaatgcaacgtatatggccggcagcccgtccgaccagtgatgagagacgtttgtgggtgtccgcctgtcatggctcgcgtacgctgtggggtggcgtgtgctgcgatcgctggcgtacgctcgtcacggccaaaccccacgcacgtgccctccgatcacgatccgtccttggcgaagatttgaatatcatctcccggatctccttcgccgagcacccttaagaacccgtcaatgtagcccaatatcaaattacaagtgtatgagcaaggcatggggtcgcgcacgnnnnnnnnnncagcgtaatatcaaattatatgtgtatgagcaaggcatggggtcgcgcacgcaaaaggcacaagggatagggggttggatttggaaggaccgcatggacggcatcacatacgtgttatccatttcaagcaagacatagaagtcttgggggtgggggggatggaacaaggcaaatttagatcggagcgatcgcatacgccttccgaatgagcgtcatgagacnnnnnnnnnnggtggaacaaggcaaatttagatcggggcgatctcatacgccttccgaatgagcgtcatgagacccgaaaacaaacaaatgaggtgtgcatgcagggattcccacgggcgcgagtcctcgccgtatacctcttgagcatggagggccatggccaattaagctccagccccccaaaccacgttttccattccccgtcgccggcggcacgcacagcacgcggtcagccgtcaggagaagaaggcgtaggacgnnnnnnnnnnccgggttcccacgggcgcgggtcttcgccgtatacctcttgagcatggagggccatggccaattcagctccacccccccaaaccacgttttccattccacgctgccggcggcacgcacagcacgcgatcagccgtcaggagaagaaggcgtaggacgtggcgtggtccacgatgctccatgccgagccgacggcggccaggaggccgaccagcacgaagagcgcggcgatgagctggcagagcgcgcgctcccagcggcgcagtgcggcgccgcgcgccatcatccacatgacgcagggcaggatgaagcagaggggggcgtagcccacggagcccaccaggcccatcaggtcggtgatgaagggcagcgccacggccaggaagcccgtggcggccacgaaggcccagcggaagctcaggcgcttggcgatgacggcccaggagtctcggtactccagccccgtccagtgcgccagcgcgatgcgggtgtccacccagtcaaacaccgagtgcgcaaacatctgcgagtgtgttgggttgggggggtggggttcgagagagggggtgcagattcaagaggagacgggagggcaatgcatgtgcactgtggttatactctgtaggcaggccgagaacctcactggaagtcctgccgtggagcaccgacccttggggttgcccaacgattctgcccattttggcaccccgcacttagcccacacttgcacaccagacaccacaccccttcactctgacagcttgcnnnnnnnnnngttgggttgggggggtggggtccgagagagggggtgcagattcgagaggagacgggaggggcatgcgtgtgcactttggttatactctgtagacaggccgagaacctcactggatgtcctgccgtggagcaccgaccgttggggttgctcaacgattctgcccaatgcggcaccccccacttagcccacacttgcacaccacacaccacaccccttcactctgacagcttgcacccctcattcctcccctccatcaccacacacaccccacgtcctcctcccatcaccaaaacccactcactaggtagcctgccaggccgttgccgaccaggaggaagttgcccaggaccaccaaccagatggggtgccggatagagttgaagaccaaggagtccacgcccgcaccaaaggcccagtagccggagaggacgacggcgagcaccagggcgcagatgacggtgtagccgaccagcgcggcgcggcgcatgggcggcaccgcgctgggccgcgccgccagcaccgcctgcgtctcgaccagcacggtgttgccaaagagcagggtgatggagcccagggccgagaaagcggggaacaggcgccccgccacgctgccggcgatggcgtaggacacgtccgcgtcccggcctgcgcacggaggtgtgtgtatgggtgtgtgggggggaggggaaggtgtgcgggtgggacaggcattgagatccatcgaggctcggcgagcaggcctccccccccccaaaaaaaagaaaccctcacacgcaccgtggaggatgcagcccaggacggcgaggaagcagaagcccagcgtggtcagcgcccccgcggcctgcaccggcgccaggctggcgatgtccggcaggacgacgaggagaagctgggccccggaaaaccccgcgatccagggggacagggagggcaggcagtgcgcgccggcgcgcaggccgcacagcgccgtgtaggcgccctgcagcgcctggccgcagatgacggggtagatggtgcacatgcccgtgttcaccaccagctgcaggcaggtgaccagggcgcggccgaggcggggccccagcacggccacgcccaggtcgcggtagcgcgtgcgccgcacgccgccaaactcgtgcaggtgcgccatgcgcgtggcacaccacagcgtggccaggtaggccaccagcacggtggtggtgccgccggcccagcccaggcgcgcaaaggcgttgggcagggacagggtgaagggcgcgcccaccgtcgccaccaggtagtagcagccctggaaccaggtgcctttggagtttgaggggaggggggggtaggaggatggatatttggggaaagaatggagatgggggaggccagtcggctgcggaggcagagccagtcaggcactgcatgtctggnnnnnnnnnnagggaagggggggataggaggatgcatatttggggaaagaatggagataggggaggccagtcggctgcgggggcagagccagtcaggcactgcatgtctggccccagggcctgtgtgtgcgacaggccaggagcatgcaaactgcctcagggcaggcctgaccggcgggcttcaggagaggtcctgcccttagtatatgacccctatcgacgttcctggtacctgtgggttcttgaaaggtgcagctgctggagtgcggcagcaggctggtactgctgctaaaggtgctcagggacttgtgcaggcgcgacagcgtgccgggacggggggcaaggggctccgtggcgccgttggcttccacgaaggaggccggcacgtcgggcaggctggaaaacctgacgacccccaccgccgcaggctcattgggaggggccatgcttcctcctgaaagcctatatgcccccagccgtcatgagggggaggtccaggccgcctgcgggacatgtgggtggccgaatgggtaagtgtcgctcacatggcttgcccaagtcgaaaacttggtccccgctttccacccgagccgggaccacctggcggaagcagcaggaccgactgaagcctgaggcccggacggggggttcctgcaatccctcattctgccgtttcaaagnnnnnnnnnnacgactgaagcatgaggcccggacgggggtcccctgcaatccctcattctgccgtttcaaagcactcaaggcatccgcgacgatggacgccgcagcgggccaggtccgggactttgccaagaacagcatcaggttggttgggaggcgtgttgatactcgaggcgcggaggcacgcagaaggccttccgttcagcgatcttccatttccaatctgtcccgacaggctagtaaagaggtgccagaagcccgatcgctccgagttcgccaaggtggcccggctgacagccatgggtttcctggccacgggcctgataggcttcttcgtcaagctggtgttcatccccatcaaccaggtactcccagggttgaatgcatggcgttctgcgagaaaggatgccattacacgcttcgaagcgtcagatcctgttggctcagaacttcccacacacacccannnnnnnnnnattcaatgcatggcgttctgcggaaaaggatgccgtcacacgcttcgaagtgtcagatccttgttggctcagaacttcccacacacacccacacctcagatcatcatcggcagcactgcctctgcttgaagaggagtctggtggcgacatgctcgttactcggccgcagccaaggcccttcctggagaaactcctttgtctgaccatgcccttcctgctctcatttgtgtaatgccccttacgacggtgtatccggggcctgggtgccccccaacttgtagcccaggccagacacgacattggacagcgcgtgcgcgagcgcggcatccgccacgttcccggtgtggaggtagagcgcgccgtacgcggcacccacgcccgtcgcccaggcggccgacacgggggtccgcctgcgatccagaagatgcagcagcccaaacacgatggcagtgacggctgcgcctcgcctgtgcgtgggaacaaattgctcagggtggaggggctggcgtggggtgggcagtttcgggagtccagcacgtcaaaggttggactggccgagctggcaggtccactgaagctgacactggccccatgtaccagtgcatcccccctcgcaccaatccggggatatggcgggcagtaggcctcccctgaagcaccactcctctgcagcgccgggaatggccccaacccaaacgacgtccaggggggagcaggcactcagcgcctttgtgggtgggaggagattgggtggtcgacgtgtcgcgatatccactgaggggcaccttgtttctgtgtcgtcaacggtcactgcccgtttgcgcaagcgaccaagtgcatccacttgagcatgcttacctgggcattactggcattgnnnnnnnnnnctgtgttgcgatatccactgaggggcactttgtttctgtatcgtcaacagtcactgcccgtctgcgcaagtgaccaagtgcatccacttaagcatgcttacctgggcattactggcattggaagaggccttgaagccggaaacgagggccatcaggcaccatctggcggcactcacacccgccaccacaccggcatccagagcaagggagggggagctgacgcctgagctggcgatggagtggagctgctcattaggcgcctgcagaatgctggcggatttccccatgcagcagtgccattcctgctccatcctcagcacatgaccagacacatgtggactcgaaagatccccccccccccctctctctcctgctgcaccttggctcaggtagtgctggagcgcatccgcatgacccagccacacggcgggagaggcaatgggagcgaccatgcgcaaggcttggcccgtcagtgcgagcacaagtgttgtggatgccacggccgacagcacatccgaccgagatgggaaattggagtggctggccgcaccgccctcggccgcggatcgtcggcgaggttcttgactcgaggaaaacccgtttgggggtgttctctgggtgctgccgtcattggtggcgtgtgctgttggcgcttccccctcgcgcagggcggtagtgcctccctgcnnnnnnnnnnttgccgtcattggtggcgggtgctgtaggcgcttctccctcgcgcagggcggtagtgcctccctgcttgtaatgaagacgaggtcgcactcctaaggccttgtgcagcacatgggacggaagcggtgacaggagctgcattttatacgcccattttacgttctgggagaagctcagtgtcgtgttaggctcttcaggacaccttacggcagtatgctcgagatgcgattcccgtagcgagctggatcggagctttaccttgagaattgatgtgctctggtaaatggtgaagcatgcagccattgcaaaannnnnnnnnngacgagctggatcggagcgttacctttgagagttgatgtgctctgataaatggtgaagcatgcagccattgcaaaagatgtacaagcacattcacacaagctcaatggtggccatctcagcagagtcgcctcgcctaggctggatcacgggcttgactcgcgtgtagcctccaggcctctcaccataccggctggccgcctgttcgaacacggacttgaccagctccgggtcgtacacgaagccgagagcctgcgtgaaaggattgaaggaaagcgtcggggagtatctggagcacacaaagaagccatgccttcatttgcgctcacataccttcacgcaaagtccttccctctggtcccacgcaggacacgannnnnnnnnnagattcaaggaaagcgttggggggtatctggcgcacacgaagaagccatgccttcatttgagctcacacaccttcacgcaaaatccttccctctggtcccacgcaggacacgannnnnnnnnnttgacaacactgcaaagactgtcatggtttcggcgatggtctggcaatgttcacaacatccagcgctcatgtaccgcatctctgtgactgcaggtcctcgaccacccctcacgaaatggtccaggattatcaccttggtggtctggatcnnnnnnnnnntggccagcgtgatgatgtggtcgacgtgtttccgaatggcttttgcgcgggcctgggccgaggagggtgaaggggttgctgacaacactgcaaatactgtcttggtttcggcgatggtctggcaatgctcacaacatccagcgctcatgtaccgcatttctgtgactgcatgtcctcgcccacccctcacgaaatgatccaggattatcaccttggtggtctggatcttgccgtgcctcaggacctgggtgacaagaccccgaatgagggccttccgctggtctgcagggaggttcagctttgccttcttgttgccatggcgcatggcaaaaacggtggcgccgttcgtgggggctccttgcagagagtctgtgcagggttggaatgggaaggtcaccaccagggcccatcactcaccatagccacccccgtcatccacacggtcccacgcatcccacctctggcgacagggtccagctgcgtaatctgcactcgcctcattcctacatatgagggggttgccgtgaaggcatgcagcctcacgggcgcacgggcacccgagcagggtcccagcaccctcggcgtgccaagggataacacggacatggggggaacagccaaggttccgcccacaagaagaataagtgcacaatgcgagtcactggttagacctccccgactcgtcgatgtgggccactcaactcaggaccgcagcagggcgaagaaggatagcactgcctttccgcgtttccttttgccacgggcgaccgcagaccaaaagccgccgatgcacaggccttctccaccaaaatcgcgcttcatctcgagcgtcctgttggcgcaggacgcatcgatggcgcgatgttgagtccaccgctcttctaaacccaccacggcggtttagaaccccctcacccccccaatatttcccgtgcaccaccccgacagcggcagctggccaagctcaggctccacgcctacnnnnnnnnnnccgtgcaccaccccgacagcgtcagctggccaagctcaggctccacgcctactataacttggtgctataccaataaaagcatacagttttcccatcgggaccatcgagcttccccggggcggtccccccactgtgcgctcccatgatttacacctctctggacaacttctacctcacccccgaggaggtcgaggcgtccccttcccgtgccgatggcgtggatgcggctacggaggatcagctgcgccgcttcgggtgcggcatgctgcagcgggccgtggtcctgctgggcctgccccaaggcgtggcggttacagcccaggtgctcctccaccgcttctactgccgacgctcgctgaagaagtttgacgtcaaggttggtttctaatttgtggcgggggggggagggtggcgaggatgggaagggtggcgaggatggaaagggtggcgaggatggcgtgccttccggacgagggccctggccccgcagccggcctttcgacaacgttctgaagatgctgtcacgtcccccaacttacctgtctccccccccccctcctcnnnnnnnnnntgggggaaaaagggtggtgaggatgggacgggtggcgaggatgggaagggtggtgtggatggcgtgtcttccggacgagggccctggccccgtggccggcctttcgacaacaatttgaagatgctgtcatgtcccccaactcacctgtctccctccctccctcctcaccccggccccaggtgacctccatcgccgccttctggctggccgccaagctggaggaggtggtggagatcgatcgcccggaccgcctgcgcctgcgcgatgtgctcaccaccttccaccgcctgctggcacgcgccgccggctctcccgtccccgccccgctggacccccactccgcgcgctacgcggagctcaaggcggcggtagtgcgcgacgagcgccacctgctgcgcgcgctgggcttcgtcatcggcgccgagcaaccgcaccgcttcgtgctgaactacggcgcgctggtgctgggcgcagggacgcgcgtgcagcaggaggcctggaacctggccaacgactcgctgcacaccacgctgtgcctcacgctgcgccccgaggtcgtggcctgcggcatcctcttcctggccgcgcgccggctgggcatcccgctgccggaggcgccgccctggtggcagccactgggcgccaccacgcagcaggtgcacgcggtggccgccgcactgtgccagctctacgccaagcccccggcccagtatacagacgtcagggcgcgggggagcggggggcctgcaaggggtgcggcggcgggtggcgcggacgcggaggagggtctggagacggacgctggcgtcgggaagggcgccggcgtggaggcggcggctgccgccatcgacgccgtgaccctggagcaggggcccgggagcgcgtcacgggacgcgcgtacagacacggccagacgccgacaggtgtgctggggtgggtgccgcatgctcccacactgcaccaccctgagctgtgatgaccaatgattcccctacctatgccggcggataccctgtcggccgttatggactgtattcgtacactgagctcaactttggtggcgcgagcacccccctgtgctctggaaagggacgcgttccacccctgctctactccatggtgcctgcacatcgaccaattccctcgcctgtacccgcaggcggagggaagcgaccgcgcacagccggacggcgggcacgcgcgggagcggagggagagcagggagcggcgaaggagccgcagccgggaagcacgggagcggcgtcaccgcgacgactctaagcgccggcggcaccatggcgagtaagggcctgtgctcccgcccatgatgtggccccagtctgatttcgtcgacccccatcacccattccctggtgaggaaagcgtgaaaatggggccgcaacaccacgcagnnnnnnnnnnagtggccccagcctgtttccctcgacccccatcacccattccctggtgaggcaggcgtgaaaatggggccgcaacaccacgcagcgcccccctgccccatgattatatgcctatatatacgctattccgagaaggcgtgcacccgcacgacctgctgcggacttcttgcaatacccctgagggccgacggggctgggctgcagggccccggtgccttgaggtagnnnnnnnnnnttcttggtcacacgtggccgagcagactcgaatgaagttgcggcttcactccccttgcatcagatgcccgtcatcatggcctccttcttttcccgctgcacaaggcggccataagtctgcccgtaaaagtaccattaacagttgcctatatgctctttgacggaccaccattcaattcctgactcagtacctgaccatgcacgtgccccctagcggccactgcccccttgcaaaactccgagactcgcgctgggagccgttgaactggcggggtggaatgccatgtgacctcatgcccttgtttcaatgtaacaagctggccatgttggccattcaccaagacagtgttaccaggggtccccacaatgaggtcttgtcctgtatgtgcctgcctctcagccaaaaccgtccacgggtccaaaggtggtgtagctgaccttcccgccgtccagcagcgacgcgacgagcaggtgctttcgggcctggtgggaggcacggcacgcagctgccagcagggccggcagcaggggagcagagtagtccatcaaccggacgcagaactgggcgtggaacagggtgggatcgccggggtataccaggtagtctgctccaaacttggaaccccccgtcacacggaagctgcaagggggagcggggtttggatgcnnnnnnnnnnaacacctaccgcaatcagttcccagccctggccctgtgaactcacccccgcgacagcaggtctttgaatnnnnnnnnnnagtgtggatagggtgagacgatgatattacctgagctctggcctggggagacaggctggttgtgcccctggaaggtacaagctttccatcttccccaggcttgcatgctcagcaaaaagcatcccacgnnnnnnnnnnggtgtggatagtatgagacgatgatcttacctgagctctggcctggggagacaggctggtcttgcgcctggaaggtacaagctttccatcgtccctaagcttgcatgctcagcaaaaagcatcccacgccaggccacacccactgcaatcaattcccagccctggccctgtgcactcacccccgcgacagcaggtctttgaataccgcataccgctgccgctcccctggcgtcgctgggaaggtccaagcgggcaggacgggcatggcctcaccggggtcacgcgccgctgcgcgggtgggaatgcaaaagtgcgatccgcgggccagtgcctccctccaggcaggcgcctcgctgctgccctccacagcccgtggcccggcctcttcgtcgctgccgtcactctcgctctcatgcgcccgcttcctcgcaagtgcggcgctggcggcgtccgctgccgcagcactggtcctgagcaccggctgcagccgcacccactctgcacattgaaagcgggaaacgcatgggcacgcagtggcgcgagggcacatcgtgctctgtcaaaacagctcttccgccctttctattcctcattggccctcacaggcgcaagttacctttctcaagtgcgagggtcacctcctcaggacttagctccaggggaagcccatgcacagcgttctgctgcttgaaccctgggtagaatgggtgcaggaaagcatgttggagagggccagcgggaggcatgcacgcaacattgtccagccttgctctgccgtttaggtcgagcctcctacgggtgtccccaccctacctgctaccccaccgaccatggccccaacgagtccgcaggtctgtcgcagccacagagcctctgcatgtgggtgcaaaagtctccatctgttctttcacatgttgaagatgcaactcctgagtgattagccagagnnnnnnnnnnagagagggtcagcgggaggcatacaagcaacattgtccagccttgctctgccatttaggtcgagctccctgcgggtctccccaccctacctgctaccccaccgaccannnnnnnnnnagacgtatccacggccctcctgcacttcgagggaggcgatcctacgctcctccatgttcatcgatagtgggaaattgctatcatcactttatttacctacagacaattatttactccttttgcgtcggagatgcatgtcaccgagcaccgcgcgcgctcgcgccccaggatnnnnnnnnnnctgctatcatcagtttattcacctacagacaattatttattcctcttgcgtcgcagatgcatgtcaacgagcaccgcgcgcgctcgcgccccaggatgtcgacatctcctaacgcatggatacctccgaggtatccagtgactgcccatcccatggcaatatagtcaatgtgcgattatgttaggactgccaattttgtcaggcaggtgcacatgggagtgtttggcctggaagggtaatgagcaagctggatagccgacgacagtgtccaacaaagggcacgaatggtcaagggccctgacagagcgttggctgatcttacgcacatatctgggatgtagactagtgtccatggtttgcgtagtggagcgatggctcgggtttggcatgtgtgtcgctcattcctgcacttcctggctaggcggctgggcaagcagcattcccagggccgtccaagatgtcatgcaggctccttgacttgactagcaagtagactgatgccttgtgattcggtatcagataactgaagcagtggcatgcccaaggaagtaggtgcatctccttcaactggaactggtccagggcactggtacgcaatcatccaggctagagaagcaacaacaatataggtcctttcatcccgatgcacatcttctcaaatacatatacatgagaaacgctttttgagtaggtatctgtcctaagtttgggaatatagagatggcgatttgtcacggtgattttgcagggagactcgttgctgctgctgcgcgcgccccggctcgactccttcgatactgtgggggacccacggacagtcatcaagatgctgccctccgcaatagtctgttgaaacgttctgctggcagggggctcagttaccgtcatcatggccccacctgtgagtaagactgcgtatgtatattggttgtcgtgatgctgcctgtctccgactgcatgccatgtccaccatttacgcaggtttattgtggaaactacgagtacgatgccagtgaacgtgacttggagcgcttgttcgacagatatggtcgcgtggaaagagtagagttcaagtctggtgcgacatcttggggaaggaggggggtgcgtgcttcagctctgctccctcccactgcggactaatttccccacttgcctcccaggtttctgtttcgtgcactatgaagacatccgcgatgccgaggacgccatcaaagatcttgacgggtgaggcgtgggtcctgagtgttgtgggagaggggaagcagggccgttgccctgctgcaacatgcagcagcagccggtctacagtacagggggcgggtcctagcctcgcatcccacccaagatcagtggacnnnnnnnnnnagggaaagcggcgcgggggtggcggcgtcgggcgagggaaggccgccccggcccgccaagcggggtgcagacggggttccccgcccgcaggacgcgccggggtcgcggaggggcagcaaccaggacccggaaggcagggatggcgtggccgatggaggatttctgggcggggacgagggagaacaccgccgtctgcgnnnnnnnnnnnnnntggaaggcagggatggcgtggccgatggggaaattctggacggggacgagggagaacaccgccgtctgcgccacgctcttgcgataggtgagctgctgtagaggggccaagggacgcgctgtggcctgctgctcacctgggtcgaaagggggaatttcctgtacgctgccagtcagaattttcgatctgcgtggtcgtggcacgcggccatcggannnnnnnnnngaagggagattttctgtgcgttcccagtcgcaattttcggtctgcgtggtcgtggcacgcggccatcggagcaggggttgcaggcaactccgatgtccctgtgcctggcgcaaaaagcccccctggcaccacacacctcaccacacaacatccccctcgtcctgtgcacaggcttcgctaaccagctcgcgcgccgcatgcccnnnnnnnnnncgaagcccccctggcaccacacacctcactacacaagatccacctcgccctgatcacaggtttcgctaaccagctcgcgcgccgcatgcccttgcacaacggctaccgcaccctgggcgaacgcccgacgctggcccaggtgggttcgcggtctggcactgagggctctgctgcgctcatcctttgcaccaagcgccctccgcagccagcgctccctactccctggcactgcctgtgggcacccacaacctgatgtatactcgtatcggtgtcacccacctccaaaacactggccatccaaccaggtgcacccgtcctgcgcgcggctgggtgccgacgaggacggcctgctgccggaatgggtggtgtaccacgagctcatcgccacagggcacaccttcctgtccaaggtgtgcgcggtggagggggcctgggtcgcggccctcctcccgcgcctcacgggcgtggacgtggcgcggctgagcggcggggnnnnnnnnnnnnnnnnnnnnnnnnnnnnnnnnnnnnnnnnnnnnnnnnnnnnnnnnnnnnnnnnnnnnnnnncacgacgcctccggcagcgcctcaggcaaagctggcccactgcccctctcccgccgcaactcggacgcagacgtgagcgacgcgcgcgcgcgcttcctcgcccgcaagtcgcagcgcgggggctgactgggggacctgccacgaagtggccctgccaggaggttcctcccgctggcatcacggtgcagctccttcggcagccagctgcgactggggtcggtcaaaccccacggtcgtgccaggaggagcagcgcatgctcctcacccctgacgtgctggcacacactcaccggcactgtttgacctgattgaaaccctcctgtgctggaccccagagcactgtattcgggcgattgccctgtgcatttcaggtcaccgtaagccacgccacagcccagtcaaggcgtgcaggggaagaggtgcatgcgccatggacatgcaagcccgcgtctgcctcggcgtcacaggggggaggggctcctggagcgcgaggcatctttccgccgcaccggcgaccgcgagcggccgcgcaggggggagcgggacctgctgcgtgccgccctgcaccnnnnnnnnnnttttggccgaccccagtcgcagctggctgctgaaggggctgcaccgtgatgccagcgggaggaatctcctggcagggccacttcatggcaggtcccccagtcagcccccacgctgcgacttgcgggcgaggaagcgcgcgcgcgcgtcgctcacgtctgcgtccgagttgcggcgggagaggggcagcggaccaggtttggccgaggcgctgccggaggcggcgtgctcgccgcccaccgcggccgccacggcgggnnnnnnnnnntgcactgtttgacctgagtgataccctcctgtgctggaccccagaacaatgtattcaggcgattgccctgtgcatttcaggtcaccgnnnnnnnnnngggggattgcgtcggagagtggcgaggaggatcagggcatgcaggtccgaagccggggcaagcgtgtgtgctgtcgtgccacccaggtggaggcgtacggcgggccgcccatcaccccgcatgcaccccttcccaggtttggaaaggcttgccgacgccggcggccatgctccccacgcccgcccatgtccagctctcacctccccgccggggagcnnnnnnnnnnaggggattgtgttggagagtggcgaggaggatcagggcacgcaggtccgaagccggggcaagcgtgtgtgccgtcgtgccacccaggtggaaacgtacggcgggccgcccatcaccccgcattcacccctccccaggtttggaaaggcttgccgacgccgtcggccatgctccccacgcccgcccctgtccagctctcacctccccgccggggagcggtcctcgcgccgcgctggcaggggcgagcgtgcgcgccgcgccggggccgggctgcggctgcggctgtaccgcggcgaggcgcggccccggcggccagcgctgcgtgagcgggagcgcgagcgcgagcggggacgtggccggcggtcgcgggacgggtccctgcccctcctgtcctcgnnnnnnnnnnccggccccggcggccagcgctgtgcgagcgggagcgcgagcgggagcgggggcctggccggcggtcacgggacgggtccctgcccctcctgtcctcgnnnnnnnnnncgacgggtgaggcgtgggttctgagtgttgggggagaggagaagcagggccgttgccctgctgcaacatgcagcagcagccgctctacagtgcagcgggcgcgtcccagcctcgcatcccacccaagatcagtggacnnnnnnnnnnccgtacggcgccctgtcgcgagagtcgcgccccctgcatcaggcgtgggcaggtggtgcggccaggtgcggcgtgcatcgcaagcggggagtgaggcacgacatccaggctgatcaacatgctgaggaagaagcggaatcaccagacagacggccagccccgactcacccagccggggagaaggagcggcctgcgctcgagnnnnnnnnnntgcccaccctccccacccctcgcgacaggcgggaatggggccgcatgcgccgcaggctgagggccgagttctccaagaccgacgtcaacgtgaaggtcagggaggagcggcggagggaggctgcgatccccaacaccacgctcttcgtggcgggcttcgatccccgcaccatccgcacacgggacctggagcgtgcctttgagccctttggcagggtgaaggtgaagctgagaggctgcagggctgctttgccggctgcctgtgcagggggggcctggtggcagcgccctccgcgcctggaggggaacagtctggggtcgatgtgccacccacctcactcccttgcctgccctccccccgctccacctccagcgctgccaaataaagaagagcttctgctttgttgagttctacgacctggaggacgccaaggaggcctgcaaaaaggtccacggcacccggatccttggccgtgacatcacaggtgggcttgcgatgtcgatcctggtgcaagggttgcagaaccttagctcagctgtgatgcggtgtcaacacttgcgccccctttccacccagccgaacatcgatccccacttctcccttgctagaatccaagcatgcagcctcattcactcccatgtgcagtggagttctgcgtcaaggactcgagcgcaggccgctccttctccccggccgggtgagtcggggctggccgtctgcctggtggttccgcttcttcctcagcatgtcgaccggcctggatgtcgtgccccactccccgcttgcgatgcacgccgcacct

SEQ ID NO: 47211 - DNA, 61 bp, Chlorella protothecoides
accgccaccatcgagttcacacggctgcatacccccgccgtgaacctggcgactctgggaa

SEQ ID NO: 47212 - DNA, 3160 bp, Chlorella protothecoides
  modified_base (492)..(501): a, c, t, g, unknown or other
  modified_base (1271)..(1280): a, c, t, g, unknown or other
  modified_base (1632)..(1641): a, c, t, g, unknown or other
  modified_base (2213)..(2222): a, c, t, g, unknown or other
  modified_base (2680)..(2689): a, c, t, g, unknown or other
gtcggcggccggcagcgcgggcgacggtgtggcgcggcaggatggcgcgccgacgaccccggcgacagacgcctccagcccggcggcgacgacaagcgcagcgtcctcgggctggggctggtacgagggcgcgggcgtggcggcgctgcgcgcctggctggcggcaggcggcatgcggcgcgaggcgggcctgctggccaccctggccgacgcgccctggcccaccgaccagctcaggccgggtgagggtggtgtgctgtgtgcgcgtgtgtcgccatgcgatgcggcggtggggtccgtgatgcccctctctggcgcccatggacgccggcgagggtccctccatcttcagccaacgcccagccacgctccggacccttcctccacaccatgctcccgctcacgtgtgcactccccctctcctcgccaacaaaccccatgcaggtcgccccgcgtcggcggtggagctgagctcgctgcgcgcggacgggnnnnnnnnnncagcccagccacgctccggacccttccttcacaccatgctcccgctcacatgtgtactccccctctcctcgccaacaacccccacgcaggccgccccgcgtcggcagtggagctgagctcgctgcgcgcggacgggtaccgcgggctggtggccccgctgctgcgcggcgactggcagtgcgcgcgcggaggcgtgtacgccagtgcagaggcgcggctggcgggcgcgctggacgcgctgctgggcgcggtcccgctctggttccggggcgaggtgttgcagcgccagcacctggccatcggcgaggcgctggcaggcggcgtggggccgcgcgaggccggcatcgccgtggccgagaccgagcgcctgctggcgctggagggcgtgctgggcggcgagtggcgcgacgtgtggcaggtggtctggcgccgcgggctcagcctcatctccgacgtgcgcgaggcagccatgtacgccgccgcgctgcagcgccacgccttctccccggacgtcgtgcctcgccccgtcttcgagcgcctgatggccgaggccaactgtcacctggtcctgcccttcccgggggacagcgtggtcatcctgcgctccggcgccctcatgcacatcgataggtgcgtagattcgttttggtggttggtggttgaggggggctccaggggccaggggaggatgtggcttaccgcaggcgcgtgcagcagatcctggcggctgtcttgagacccatggccgggtggatgcagccatcccaggnnnnnnnnnnttgcgctccggcgccctcatgcacatcgacaggtgcatagatttgttttagtgcttgggaaggggggggctgcatggggcaggggaggatgtggcttactgcaggcaggtgcagcagagcatgggggctatcttgagaaccatggccgggtggatgcagccatcccaggctgctgtcggaggaggggacgcatgggtgaatacatcgagcccatgagtgggcgggggtccagccttcctcgcaacccgatcccattcctactctaggtacatggaggtgctgggcatcgccgaggattcggaggagcccaagcatgcaggtgggaccgagcggctgggagatggcccggtcnnnnnnnnnngcggaggagcccaagcatgcgggcgggaccgagcggctgggagatggcccggtcgctggcgaggtaaacctcgcggcagctgcgcccgctggagccggccaggcacccagtgacgccgttgcatcggcagtggaggctactgcgagcatgtcaatcgacgccacccccatggaaacatcggcgctgcctgctgacgcctcacaacctggccctccgccgtctgcactcgcatctgcgccccgacgacaggacgatggcgccacccccggccctgctatcacacccccgggcccagcaaccgtcctacctggtatcgacgatgcgatggacaccgacaacccaggcccctcccccgtcccctaccccgtccgcgacgcgagcgtcgccagggtcaagggtgactgggcggccctgagggcgcgcgtggcgacggccggccatgtggggcgatacaccgtgcgctccattgtgtaccgccgtcacctggttgacgaggcggacgcggcagagggctctgcagtgcgccgccccggggcctggttgttcctgcgcccggcgcgcttcggcccgcnnnnnnnnnncgcgccgccctgtggcctggctgttcctgcgcccggcgcgcttcggcccgccggcgcagctgccgcgccaggacctagtgctccccatggccgccgacccgggcctgccagacttcctggtgcccaccgaggcgttcgtggagcacatgcgagtgtcctggctgccgggcgaccgcttccgcctgcaccccaccagcatcaaggcccgggcgcagcgccgcgccaagtcgggtgggtagttggaggagggaccgccgggggggggaagaaaagaggagagggggcggtgcgtggattgcttgtggacggtgactggcccccgtgttgcatctgtcagggagggaagaccgtcccttggcgacgcccatgccagtaatcagtcttcctgcgtatgtggcttcccccttcctcgatcactcaagagaaacccccatccacacaatgcccaccacccgacnnnnnnnnnnaaaagaagagaggagagggggcggtgtgtggattgcttgtggacggtgactggccctcgtgttgcatctgtcagggaaggaagaccgtcccttggcgacgcccgtgccagtactcagtcttcctgggtatgtggcttcccccctcctcgatcactcaagagaaccccccatccacacaatgcccaccacccgacaacccaccatcaccccaccgcgcaggcatcctgacgcagcgcggcacggtggtggacctggtcagcgccgcgcccggccccggcgccgacccggcccagcgggcggcctacgaccccttccgctccgtggtggtgctctgggaccgggcgttcgagggcgaggaggtggcgctgagcccctgggacctggaggtggaccccgaggacgagcggcggcgcgtggaggaggcgcggcggcagcagcaggccgccgcgcgcgcgctgcgggcgcgcggcg

SEQ ID NO: 47213 - DNA, 72 bp, Chlorella protothecoides
gatcgtacagacttagggtggagctgtcaaaccggctcaggtcgtccaccacctccccgcactccgaggtca

SEQ ID NO: 47214 - DNA, 157 bp, Chlorella protothecoides
tggcccaggggttacacagcagcgtctcacaagtaaacatcccagggggtcatccagcctgccatttccctgtacttcccgccaaggtccctcacccaaaaccccaccatctgtaccctggtcccctctgtcacccaccggcggggacgatgtcctg

SEQ ID NO: 47215 - DNA, 61 bp, Chlorella protothecoides
gccgatggcggaggcggggatagaggcggggccccctgagatggtgttcccgatgaactgg

SEQ ID NO: 47216 - DNA, 61 bp, Chlorella protothecoides
gtcgagtaccagacggcaggcccgtcaggggccagaagagcaggtacaagagggctatgca

SEQ ID NO: 47217 - DNA, 76 bp, Chlorella protothecoides
tgcgcagcagagggcgatgttccggccccgccctgtgttcccgtgcccagccatgacggtggggctctggtcagct

SEQ ID NO: 47218 - DNA, 64 bp, Chlorella protothecoides
ccatttgccggcgcatgacatgccagtgcctgtacacacaccttggacagggaggctgggccga

SEQ ID NO: 47219 - DNA, 77 bp, Chlorella protothecoides
gtgcgggcacacagtgcgcaaggcgcgctgcggttgaaaacccctggtgcggtggcagccctacctgatcacaatcg

SEQ ID NO: 47220 - DNA, 64 bp, Chlorella protothecoides
tgcatgcggccctcacacaaactcgttcgcccccccacccctcccagggatccctggcggccaa

SEQ ID NO: 47221 - DNA, 75 bp, Chlorella protothecoides
cgcggtgaggtgcaaggactggcgggcaggtgagctttggtgtcagggaggctgcaggcgagaaacgcttgtgag

SEQ ID NO: 47222 - DNA, 61 bp, Chlorella protothecoides
gccgtccagtgatgatcgcggacagggagggggtggagatggtgagcagggcctcggatgt

SEQ ID NO: 47223 - DNA, 73 bp, Chlorella protothecoides
acagcgcccagctgttcccccccttcccacccacccccccctcacctcttgcagactgtctgcatgtgaacga

SEQ ID NO: 47224 - DNA, 61 bp, Chlorella protothecoides
ccctgcgccggcgcgtgacctgggaaggggccggactgctcgacccctacacccccagctc

SEQ ID NO: 47225 - DNA, 94 bp, Chlorella protothecoides
acccctttctttttttttggggggggggggttgtttgagtctcaatgccagctgggagaggtgcactgggggcagcaaaggatgcttgaggcga

SEQ ID NO: 47226 - DNA, 61 bp, Chlorella protothecoides
ggtgatggcggggaccaccgcagcagcacctgcagctcggaagggtgaattcctcaggtgg

SEQ ID NO: 47227 - DNA, 78 bp, Chlorella protothecoides
attcaaggcctgaggatctggactgggtggctgacaggctcctccagatcaaaccctggcgacgttattctcatagag

SEQ ID NO: 47228 - DNA, 77 bp, Chlorella protothecoides
gtgggtggaggaccccatcacatccacccaagggctctgcgcccacaaaacatcaccctggccctctctgcaccgtg

SEQ ID NO: 47229 - DNA, 70 bp, Chlorella protothecoides
tggccccactcaggccctcctgcttccccccctccacctccactcattctcatgcaggcagcgaccaagg

SEQ ID NO: 47230 - DNA, 72 bp, Chlorella protothecoides
ctggtttcccaagcacccccagcacaacccccaccaccaccaccccatcaccgccaggcggcgggcccacat

SEQ ID NO: 47231 - DNA, 99 bp, Chlorella protothecoides
tcttgacctgtgggccagggagggaagggggcggggaaggtggcggaaggcgttgtaaaacgggggacttgggccggaccgggacatgctcccggcctc

SEQ ID NO: 47232 - DNA, 61 bp, Chlorella protothecoides
atgccaggcccaggctttccaatctgggaggaaggggaagccgccgcaaccccctccctcg

SEQ ID NO: 47233 - DNA, 101 bp, Chlorella protothecoides
ccctcccccccccccccccgaactgcactcgcaatcctgagagtgacccttacgtgcaaaagtcgtagagaatgcccagaaactccagacgcagggcatcg

SEQ ID NO: 47234 - DNA, 61 bp, Chlorella protothecoides
gccccgtcgacgtggggccggcttcacctcacccccccccgccctccctcaaacacccatg

SEQ ID NO: 47235 - DNA, 61 bp, Chlorella protothecoides
gcatgggtgtgtgtgtgtgtggggggggggggtttgaggtatgtgtgtcggggagactggg

SEQ ID NO: 47236 - DNA, 71 bp, Chlorella protothecoides
ggaaagcagcagcaccaagtcggagggtagtccttgacaattctgggtttgagcacagcacctcacccgca

SEQ ID NO: 47237 - DNA, 64 bp, Chlorella protothecoides
caaggccaccgagcgacgaggtgagggcggccaaggggaggggagcatggtgtgctggacaccg

SEQ ID NO: 47238 - DNA, 61 bp, Chlorella protothecoides
tacgcgggctacgccgcagcatcgcatggcttgccccccgatgtcgttcatgtggccctag

SEQ ID NO: 47239 - DNA, 61 bp, Chlorella protothecoides
cccccccccccccccccccccccctctctctatatccctgctcaatgtccacccctccctg

SEQ ID NO: 47240 - DNA, 61 bp, Chlorella protothecoides
ccggtgctggcggaggatgtgctggccttcattaccgccctggacctctacactcgccccc

SEQ ID NO: 47241 - DNA, 66 bp, Chlorella protothecoides
ccccccccccccccccccaaaaaaaaaacaacgactcgtggcaggcacggccgacatgtcctcctt

SEQ ID NO: 47242 - DNA, 68 bp, Chlorella protothecoides
ggggctggggctggggctggggctggggctcgttgcgacgtcgatctcggcaggggccgtggtggcgg

SEQ ID NO: 47243 - DNA, 61 bp, Chlorella protothecoides
cgccgcgccgcgctcgccgtggtggccctggtacaccacgaaggcgtcggcggggacgtcg

SEQ ID NO: 47244 - DNA, 61 bp, Chlorella protothecoides
tcaaattttactgtcggcggcttgaagggggagtctgccccaaagttcagggacaagcgga

SEQ ID NO: 47245 - DNA, 87 bp, Chlorella protothecoides
gccccatcgaacctgtccacatcgccagcttctgggcagctcccccaccccccccctcacctgatcatcccgcacggtgtagtcgac

SEQ ID NO: 47246 - DNA, 74 bp, Chlorella protothecoides
acaccaagcatctggaccaccgtgcacaggcgaggcgttggatcatcaatcaacagcttattgataaaagctgt

SEQ ID NO: 47247 - DNA, 2069 bp, Chlorella protothecoides
  modified_base (92)..(101): a, c, t, g, unknown or other
  modified_base (773)..(782): a, c, t, g, unknown or other
  modified_base (1037)..(1046): a, c, t, g, unknown or other
  modified_base (1323)..(1332): a, c, t, g, unknown or other
  modified_base (1593)..(1602): a, c, t, g, unknown or other
ctcgccgccgccgccggcctgcccctacgcaacctgggcggacgcgaccgacgacttccctgacctcaccatcatgcagggcctgctgaacnnnnnnnnnnccccgcccaccgcatcgtcgccacctcccaccgcatcgcctcccccgcccgccgcctcgccgccgccgccggcctgcccctacgcgacctgggcggacgcaaccgacgactaccccgacctcaccatcatgcagggcctgctgaacctggccaacatctcgctgagccagctgggcgggcccgaggacggcgtcaccatcatgctccccacctcctccgccatgctcaacgccatccattccctggacgtgaccgacgcggaggcggcgctgctcatcacccgcgtccccgccattgccgcctacctcgtggtccccaaggcactgccgctggacgagcaggtccccgccaccagcttccagacgctgctgggcagcctaacgggggggtcctacccgctgaccttgcgcgtgcagaccaacgcggagacggtgcccaaccaggtcaggggcaacttcaacgccgccaacatcctgaacaccacccaggtgtgctcctcctggatctactccctggacaagacggtgctgccggccgacaccgtggaggccatgccccttgtgtccctggactgacagggagggggccccagcaaggaggggaggcgccgcgaggcacccccctgaggcaccttgcgccgtgcgcgagagctcccattggagctctcgacgnnnnnnnnnncgggccccagcaaggaggggaggtgccgcgaggcaccccccggaggccccttgcgccgcgcgcgagagctcccattggagctctcgacgcgccgcccgccggcccgccccggggagaggacgtgccgcaaggcacgcgcccctgaaacacggcgtgggcgaggctggaggcgggaccccagtcccgacacgaatttctcccagattgttgaacgaattctcagccccagtgggcaccatgcccgccagggaagcnnnnnnnnnncttcctccagattattgaacgaattctcagcccagtgggcaccatgcccgccagggaagcacttgctccatcattcccaatactgaccgactgaccccgcccgcaccggggtacatgccctctgcgccttgtaaatttatgtgctctcgatgtggggttgggcggggaagggtgtaggcaaggcaaaaagccgcagggctggctggagcgctcacagtgattctcgtatcattggctgtcagctgggcacagcagatgctcaacaggtcaactgccnnnnnnnnnnacccgcactggggtacatgccctttgcgccttgtaaatctatgtgctctcaatgtggggttgggtggggaaggctgtgggcaaggcaaaaagccgcagggctggctggagcgcccacagtgaccctcgtatcattggctgtcacctgtgcacagcagatgctcaacaggtcaactgcctgatcaagggagcgtgcatgcatgcaggcatgagtgcaccgcagcagcaggggaccacggcaggcacggtgcaaacaccgcannnnnnnnnnccaggcatgtgtgcaccgcaacagcaggtgaccacggcaggcacggtgcaaacaccgcagcacagcgcccgcctaggccgacgcggcggcggcgcggccggcgtaccgcgccagcgccgcatgattcagcaggacgagcagcgacacgccccccacctgcaccagggaggcgtggggcacgagcacgcttgtccccggtggcacggcgcccccgttcacgcgcatcggccggcggccgatgcagcgcaacgcgagtgagacgggtcccttcgtcctggcgccccccgcgccctccgtctccgtgggcacccagaggagggcctggcgccgggacacacggttggcggccgtcggccccgcctccagacttaggtcgacgtccagcggcagcgtcggcgacgcggtttccttgggcccggcagcgtcggcctgtggccccggccccgccgaccccgccccgccgcccc

SEQ ID NO: 47248 - DNA, 61 bp, Chlorella protothecoides
tggcctcaaccccgaaaccctatcggcagggaccataccgaagaggggagacggatcatcc

SEQ ID NO: 47249 - DNA, 61 bp, Chlorella protothecoides
gctcgagcacggccccgcccccagcagcgccgtctcgttcgcccccgcgccggccgagctg

SEQ ID NO: 47250 - DNA, 7483 bp, Chlorella protothecoides
  modified_base (209)..(218): a, c, t, g, unknown or other
  modified_base (737)..(746): a, c, t, g, unknown or other
  modified_base (1056)..(1103): a, c, t, g, unknown or other
  modified_base (1199)..(1301): a, c, t, g, unknown or other
  modified_base (1900)..(1909): a, c, t, g, unknown or other
  modified_base (2602)..(2611): a, c, t, g, unknown or other
  modified_base (3557)..(3566): a, c, t, g, unknown or other
  modified_base (4575)..(4584): a, c, t, g, unknown or other
  modified_base (4670)..(4679): a, c, t, g, unknown or other
  modified_base (5115)..(5124): a, c, t, g, unknown or other
  modified_base (5543)..(5552): a, c, t, g, unknown or other
  modified_base (6233)..(6242): a, c, t, g, unknown or other
  modified_base (6793)..(6802): a, c, t, g, unknown or other
cggggcagacagcgtgtgcctgccaggtggggtgacgccggccgcgcagccggtcacgtctcatcgcctcctgcgctcccctccactccccaggccggcgtatcgtccccgcgtcccacacccagaccagcctcctccccccatcttcccacgccctccttccccacaccccgcccctgcgtcacccaccttcccctcgcgctccaggnnnnnnnnnncctcctcccccccccccttcccacgccctcctttcccgcaccccgcctccgcgtcacccaccttcccctcgcgctccaggacggtgatgctgcgcaggcgctgcgagacctcgtgcagccagccggagagcgggtagccctccacctcctccaggtgggtcagcaggcgggtgatgccgtccacatcgcgccaggcggcagggcggatgccctcgtacaggtcggtcgcgatcatggtcaccccccgcgtccctgtcaagagtgggagggcagcagcacatgggtgggctcccctcagtccagttccgtgatgcacccgcagagaaccgcggggtttgcttcgcaaggaaacagcggcacatggctccaggcgctgaagcgcgcatcgtccagggcaccgactgctttggaggggtgaggcggtccatgcaggcacgcgctggcgccgccacggcgccacctccatcccccctccccaatgccacaaggtgcccccccttcccccgccccccccctggnnnnnnnnnncgatgcacccgcagaggaccgcggggtttgcttcgcaaggcagcagcggcacagggctccaggcgctgaaagcgcgcaacgtccagggcaccgactgctgtgcaggggggaaacggtccatgcaggcgcgcgctggcgccgccacggcgccacctccaccccccctccccgacgccacaagttgggccccacttcccccgcccccccctctggtcgcccgcacaccgtcgcgggtgtagagctcgatgagcatggcgccatcggtggcggcgtccaccaggtgcgcgcggcgcacgccgttgcggcaggnnnnnnnnnnnnnnnnnnnnnnnnnnnnnnnnnnnnnnnnnnnnnnnncaccgccgcggccaccacctcgcgcgggaacccgatctgctgccagctgtccaggtccagctgcagctcggtgtcggccggcgcgacgggcgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgtgcccgccctggccgccgcggtcgccacccccagccgtcctgccccagccgccctgcccctccacctcctcgccgctgccaaaggtgaaggcgccgtccacgccgcggccggcgccggtgccgccctcccccgcgccgcgcgcgatcagcgcctccgcgtcgtccaggggcaggtaggccggcaggcccaggtccgccacgtcctgccccgtcaggcacagcagcttgtcggcgcccagctccaccgccgcgtgggtggccacgtcgtacacgttgcagttgagcagctcgccggaggaggtgaccccgatgttggtcagcaccacgatggcccccgccgccagctgcacctccaccgcgtcgcgcttgacgtagcgcacctggcccatgagcccaaagtccacgccgtccacgatgccgcggcgccgcgccaccgtgaagttgccgttgaccacctgcacggcggggccgccgtgaggcgccagcgccgcgtgccgacgcaccatcggcacaaacggggcctgtggatcggtggtggggggggcttggtcggggggtggagcaaggatgacaaacggtggggagctggggtgtgnnnnnnnnnngtcggtgggggggggagggggcttggtcggggggtggaacagggatgacaaacggtggggagctggggtgtgggtgcatgtggagagtgtgtgctgagtcagcaagcgctggtgtgggggcagcgaggctggcaacgccgctgccgccgcgggaccagcgcaggcccgcgtcggggagggaggcccctgcacggccaaacaggatcctctccctgaccccctttccccctgggaatctcagaccccacccgcgacatgtgccccgcgatggtcgtgtaggtgacggccgaggcgtgcagcgcgcccgccatggcggccgcgtcggtcactcggtacgcgccctcgaagcgcggctcgcgccccgctgcgcgcaggtggtcgtcgatccagggcttgcccccgaccacaatcaccaggcgaatgcccaggccgtgcaggagcaacaggtcctccagcaggggctgcagctgccggggctcgtacgccacctggcgggtgtttttggtgtggtagtggtagggggttgtcggggagggggagggcgcaggagaagggacgcggtgaggtgcaaggactggcgggcaggtgagctttggtgtcagggaggctgcaggcgagaaacgcttgtgagtacgggatgggcctcttatgaaacagccacactccacgccgcacagtgcaagccctgtgcgnnnnnnnnnncacgggatgggcctctcatgaaacagccacgctccacgccgcacagtgcaagccctgtgcagggtcctacctcgccgggcacaacgatgacgaaaatcctgccccgatgccgcatgacgtagggggaggccacatgcaggaacttgaccagctgggcactgcaggcgtggaggtgggggactttcaggcgagaggttggggatgggtgggaacggtagcctgcatgtggtagcccctcggtgttcatgtgtgtggatgcgtcaacccctcgcccttaccaaaagacacacaccaccacatgctgtgcactcccccctacctgtcccaggcggcatcgctggatccctcctccaccggcttgctggtaatggagtcgtccaggttttgcagccccgtctggcgactgacgcggcaggcgaaggagggccggcacctggcaaccccctgctctcgccagggtgccataaaacccttgcacgccgtcccccattcagcaggcccatgggcctgcctttgggagtggggtgattccctgtgtttcctaacatacgtcctgaggccagagatgtgtcgtagacgggcgctctggccctccaggccgatgctctgccggagcaccatgtcaggggcacaccccacaccagacctgccgcgtcatcgagcacgcatcattcaagtacatgttgaaaagtgtaatgtgaacaagtatatgttggttgtaccagctcgagtgcagtgtgtatgcccacactgagtcgcacaggtgcggactgatcgatcgatcgcctgtgcgatctcaagcgaggtcctttcctccagccctgagcgtctcattgaacccccgctcctgcatcgcagaccaagccttcccttccgttaaaaaacgcccaagtctgcaaaaaagccctcccacgaggctgggagcaatcaggggcatggatcctgnnnnnnnnnnacaagccttcccttccgtttaaaaacgcccaagtctgcaagaaagccctcccacgtggctgggagcaatcaggggcatggatcctgaggtggattcggaggagcttgatcaccaggagcccgagcttgtccaggatgacgcgcagccgatggaaggcaaggacgtcgctctgactgatttgaatggtgccatgcttggatgtgtccttccggggacctgctgcctgagctgctgggggaggggccccgacactcgaacagaccctccgcccctgccgcgtccgcaggcgtcaccatcgaggaggaagttgttggtcaggcacctgatccgttgaaaggcgaatacacggtaatcaggcgcagcatgggtgcgcgtgctctatcaccgaagggccgctcgcacactccctcgccaaggggctgcacctcatgctgtccagcatcccttttgagcccctgatatcacgtcacccttgcagtgggagctgcgggacttctcacagcagccgctgaagaccttttctgaggtgtttgatgctggcggcttcccatggtgaggcgctgggtgtggtctcgattgaacatcatgcaggccccccatgagagcgtgcaggaggggcgcatggtacagtcgggatcgggacccccgtcggggatccatcaccttccccaaatccgtgcgcaggcagctgctctgcttccccaagggcaacaagcccggacagctgtcgctgttcctggccgtcccagagaacgaggaccagcccatgggctggcagcggtccgccagcttcaagctcaccgtgctcagcgcgcatgggcgcgagcacgacgtgagcaaggacgccacccacaccttcctgggcaccgaaaacgactggggtgagcccccgaggtctgcctgtgctgggggcagggagggggcccatggtgtgcacattggaagacgtgagaggatcgatacccccagcctcaacctcgcactgcctggctgggggctgccccagctnnnnnnnnnnatgagagcgtgcgggaggggcgcatggtacagtcgggatcggcccccccgtcggcgatccatcaccttccccaaatccgtgcgcannnnnnnnnnccgtgagagaatcgatacccgcagcctcaaccccgcactgcctggctgggggctgccccagctgccagtggtcgatcgcagggggcgccggcccatgctggtatcggccgtggggcctgcacctagggatgtaggctacctacattgtttcacgccatagtcacctcccccacctcgcaggcttcaacaccttcatgctgctgaatgacctggtcgacccctctcgaggactgcttgtggacgacacgctccgcatcaaggcaagttgtttgggatctttggggtcggaaaaatgtagcaagctcatcccagtgtgtgcggagtttactcagagtcatctgaagcccatcacccacgacccactgcccttgctggcgtgcccaccaaatcatgcacacctcggacccccgtgcaggtggaggtggaggtccgcgtnnnnnnnnnngtgggatctttggggtcgggaaaatgtagcaagctcaccccagtgtgtgcggaggttactcagagtcatctgaagctcatcacccacgacccactgcccttgctggcctgcccaccaaatcacgcacacctcggggccccgtgcaggtggaggtggaggtccgcgtcccagaggacttctcctacgactcccgcaaggagaccggctacgtcgggctcaagaaccagggcgccacctgctacatgaactccctgctgcagacgctgtacaacatcaaccagttccgcaaggtgggccatggtgggggccaggcaacagcgtcgggattatgtcgaccctggcgtgcccacattcgtgctgccaagagcgccggcagaccccccctggcatgcttacgaccgcaggccgtgtaccatatnnnnnnnnnnctgtctgtcgacactggcgtgcccatatttgtgctgccaagagcaccggcagaccccccctgctatgcttacgaccgcaggccgtgtaccatatgcctacctcggaagacgacgacccggccaagagcatgccgctggccctccagagcgtattctacaaggtgcgtggctgcgtggtcgtgcctgtgcttcatctgtggggaggtgcgggtggcaggggatgtatgggttggcgtgcaaagcagcgtcgcaggcagggagaacaggcctgtgacccaggtctggggccctatccaatgcctggggtggctcatgaacaaacacagcacctccctgcccccaccggcccacccatgcagctgcaattcacggacggcccagtgtcaaccaaggacctgacgcgctcgttcggctgggacaccagcgacgccttccagcaacacgacgtgcaggagctgaaccgcatcctctgtgaccgcctggaggagaagatgaaggtgtgggggcgggttttgaggagggggaggagctcgtcttttgaacaggcgctgtccattccggacggggtgggcctggagggcgcctgtcatggtgttgcgggtgaagcaccggcacgccgggttcgggaggagagcatgtccctggacgcaacaacaaagacccccacacatgcactccgcnnnnnnnnnntggacggggtgggcctggagggcgcctgtcgtggtgctgcgggtgaagcaccggcacgccggggtcgggaggaaagcatgtcccttgatgcgacaacaaagacccccacacatgcactccgccatgcagagcacgcgggtggagggcaccatcagcaagctgttcgaggggcacaccctgaactacatcgactgcatcaacgtggactacaagtcctcccgccgcgaatccttcatggacctccaggtggggaggaagggggacgagggggctggggccttgtttgaattctctggcgtcattcgcaggcgacagtgagtcctcctgtaacccccttccctcctcccttcctttccccctcgttcccccatagctggacgtcaaggggtgcaagaccatcctggactcctttgatcggtactgcgaggttgagacgctggagggcgacaatcagtacctggcggaggggcacggcttgcaggacgcgcgcaagggcgtgctcttcgacggcttcccccccgtgctccagctccagctcaagcgcttcgagnnnnnnnnnngcctttccccctcctccccccccagctggacgtcaaggggtgcaagaccatcctggactcctttgaccggtactgcgaggtggagacgctggagggcgacaaccagtacctggcggaggggcacggcctgcaggacgcgcgcaagggcgtgcttttcgacggcttccccccggtgctccagctccagctcaagcgcttcgagtacgacttcatgaaggacagcatggtgaagatcaatgaccgctacgagtttggagaggagctggacctggacgtgggcgaccgcaagtacctggccgcctcggccgcccgcggcgtgcgcaacaagtacaagctgctggcggtgctggtgcactccggcggcgtgcacggcgggcactactacgcatacatccgccccgacggcgcgcgctggctcaagttcgacgacgagcgcgtggaggccgcggaggcggaccgcgcggtgcgcggcaactggggaggtgaggacgaccgcggcgcgccgggcggcggcgcgccgggcctccgcttcacacgcttcgccaatgcctacatgctggtgtacgttcgcgagagcgagtgggggtctgtcatgtgcggcgtggagcggcgcgacatcagccagcacgtctgcgctcgcctgcaggtgggggtttggggaggagggggtggcaagagggg

SEQ ID NO: 47251 - DNA, 65 bp, Chlorella protothecoides
ctggcagacactgctgtgggaccgcctggacgcgtttgtcggcgaaggcggcgcaggcgcggagc

SEQ ID NO: 47252 - DNA, 146 bp, Chlorella protothecoides
ggacagccagagactttcatcggatggagagtcacccctgcccggcatgcctgggactatcctcgagccggactggtggtgggtctctgttcctggagaggacaggcgggtgggaagacagctctccatgccttccacgcatgcga

SEQ ID NO: 47253 - DNA, 61 bp, Chlorella protothecoides
ggttgaccagcctgtagactgtcagacaagaagcatgaggtacacacccctgcagaccgca

SEQ ID NO: 47254 - DNA, 61 bp, Chlorella protothecoides
catgcgacatgcacgcagggccatcatcgtattactgccccgcccgcatacgctcctctgc

SEQ ID NO: 47255 - DNA, 61 bp, Chlorella protothecoides
tcagcagggcagcgtgggcctggagctgctgaccaagtgcatgaaccgctacttcacgcag

SEQ ID NO: 47256 - DNA, 73 bp, Chlorella protothecoides
caggctcgccctccatgcccgctccccagccgacgggcagagtattgtgatccactctgccgcctctaccgcc

SEQ ID NO: 47257 - DNA, 79 bp, Chlorella protothecoides
gctggcatcatgcccttgcggccgggcagggcgtgaagcctggaggaggttgtgagattgttgaggctttgacctcaaa

SEQ ID NO: 47258 - DNA, 1095 bp, Chlorella protothecoides
  modified_base (124)..(133): a, c, t, g, unknown or other
  modified_base (202)..(211): a, c, t, g, unknown or other
  modified_base (269)..(278): a, c, t, g, unknown or other
  modified_base (674)..(683): a, c, t, g, unknown or other
  modified_base (906)..(915): a, c, t, g, unknown or other
ccgcccccgcccccgcccccgcccaggccggggctcgcgctgtgcacatcgcgcaacggccctgccgggacgcgccgcgtcagcgaggccacgcgggcctgcaggctggccaggtcccccaggnnnnnnnnnnacggccccgccgggacgcgccgcgtcagcgaggccacccgggcctgcaggctggccaggtcccccaggnnnnnnnnnncggtagcgcgggctgcaggccgtaggcggctgggtggggcggcgcgcccacgcccgtnnnnnnnnnnccgcctggccgcgccgcgcccagggcctccatggggggcggtgtgcacctgccggcagggccggggttggccgccttgagcgggctgggcaggctgcccaggctgcccatcaggtcactgccccccgagtcctggcgcccgctcagcatgagcaggtgctggtgcagcatggccgcctcggacggaagccccgtgggcgaggggggtagcacgggctggaggccgtaggaggctgggtggggcggcgcgcccacgcccgtcagcggcaggctcagcctgtgagtgaatttggggaggggactggtgatcgatcaagtactccacttttgatatgcctgacctccaagacaggcccccccccctgagggtcgatgcacagtcgggcggaggaaggannnnnnnnnnaatcaagtactccactttttatatgcctgacctccaagacagccccccccccggtgggtcgatgcacagtcgggcggaggaaggagccttagcccataatgggctgagactgttgatccttccgaccccatgcacgttacgacttcctccaatgacccatgaaggaacccccccctcctccttcccccccgagctccaacagcatgcgcgacaactcacaggnnnnnnnnnnccccccccccctcctccttcccccccaggctccaacagcatgcgcgacaactcacagggatgaggcagcggcggcgtagggcgtgggcgacacgggctgcccgcccgcgccgcccccgctcaggtacggccccagctgcccggcggacgccgcggccgccaccgccgcggccgccgcgta

SEQ ID NO: 47259 - DNA, 61 bp, Chlorella protothecoides
tagcttcacaaagggtgctgaccccaaacctaaggctgcctaccagaggccaggactccgg

SEQ ID NO: 47260 - DNA, 63 bp, Chlorella protothecoides
gtgctttggcagcctgtcagggaggacaccgcgatcattcacaccagccagcaaacaggtatg

SEQ ID NO: 47261 - DNA, 71 bp, Chlorella protothecoides
ctgcacagctatttgtcccaccactgtacgttgatcttactgcagaaccagtcaatggctcgctccccatc

SEQ ID NO: 47262 - DNA, 61 bp, Chlorella protothecoides
tcagcccttccatccgcaagtggctgcgggggcatgggcgcaccgttcgtccccgcatgac

SEQ ID NO: 47263 - DNA, 61 bp, Chlorella protothecoides
tggcatctgccggcaaggcgatggcggcggtgggtgccgccgccgacctccccggcgccca

SEQ ID NO: 47264 - DNA, 61 bp, Chlorella protothecoides
ccagcagcgtggcgttggccgcgtggcgggggaggaggatgggaccctcattctgcgtgcc

SEQ ID NO: 47265 - DNA, 79 bp, Chlorella protothecoides
actgtacaacatccctccaccccgccacccccctccaccccgccgcgaccctcctccctactgaacagcacagccagac

SEQ ID NO: 47266 - DNA, 61 bp, Chlorella protothecoides
accctaaccctaaccctaaacctaaccctagccctaaccctaaccctaaggtggtaaaagt

SEQ ID NO: 47267 - DNA, 61 bp, Chlorella protothecoides
cgagctggaccaaggcaccgtggtggcaggggggctttcggactcacggtggaccagcaag

SEQ ID NO: 47268 - DNA, 3255 bp, Chlorella protothecoides
  modified_base (552)..(561): a, c, t, g, unknown or other
  modified_base (1053)..(1062): a, c, t, g, unknown or other
  modified_base (1724)..(1733): a, c, t, g, unknown or other
  modified_base (1807)..(1816): a, c, t, g, unknown or other
  modified_base (1913)..(1922): a, c, t, g, unknown or other
  modified_base (2599)..(2679): a, c, t, g, unknown or other
  modified_base (2938)..(3078): a, c, t, g, unknown or other
gggggggtttggggggttgtgggggtggggggtaagaagggaggggagaggggtgcccaacggtggggcctgtcaggctgtaacctacattgcctggagggtgggtttgagcgggttgattgagaagccaaggtctgttggtgcggggagtatggcctagggtacctccctcacaccaccacccaaccgaacaacctcgtcaggggggggggaggacaaccatgggcatggtgatcggggccctgctgcgccgcgccatcaacggcgcccagatcggcatgggcggcgcgcagagcaccgacaacctggacgaggacgtcggacaggcagagccccccccgggcaggcaagtctggagtgggtggagtgagagaaagctggaatgagtggggtttggggggtaaggcgagggctcgcttgagatcccccggagtgctctgcacccacaggcccatgggagttgttcagaacacgtccggcgttccccacctcatccccacagcatgctggaccacgacggcagcagcgccgagtacgaggacgccctgcccnnnnnnnnnngtaggcgagggctcgcttgaggacccccggagtgctctgcacccgcaggcccatgggagttgttcagagcacgcgcggcattccccacctcctccccacagcatgctggaccacgacggtagcagcgccgagtacgaggacgccctgcccgccatggaggcgccggaggccgcgcgccgggcggggtcgctgacccgtgccgccgaggtgctcgaggaggttggggagtttgaggactgtgagaaggcggcatgggtggtggtggtgaagctgcttggtccaggcaccagccctgcatgcagcagtcatcctccttgcaacgaggcctgtgtatgggggatcttctgtccgtgctggctccctgtcctagtgttcgtttccctccccatgacatgggtgtcactagtgtagcccatccagtgcaccgcccggtcctctacatctactcccccccccaaaaatcaccagaatcgagctgccctacctccagcnnnnnnnnnnacatccagtgcaccgcccggtcctctacacctactccgcccaagaaaaattcaccagaatcgagctgccctacctccagcaccccaaacattccctccatcaccccccccccccccccccccccccccccccgctacaacacacctggaggggctgctccgctcacccatgttaaaagggcacgccctgggaccaggagtcggccaacctgtggtctggtgagtacgtggcggtccggcggctggtgcgcatcctggagcgtggcgcggaggccaaggcggcggtggactgcgcggtggacgcggcgggcgcgctgatcaacctgcgcaccaccatcatgcgctaccgccggcccaagagcctggagcgcttctaccgccccgaggtgcaggcccggcacgccgccttcctgcgcggctccgcctacttggagcgctactgcctgctcatcgcctttgcggcctacctggccgagtgccgcgagtgggggaggcgcgccaccttccaggagtggtgggcggggcggcccgacgtcctggccgcccgcgacttcatccacaccaaccccgcctcggccctggcgcccgtgccgggcgtgctgccggccacgccggcaccgccctccaccctcggcgccggccagctggtctgcccgggccgtnnnnnnnnnnaccgggcgtgctgccggccacgcccgcgccgccctccacccttggcgccggccagctggtctgcccgggccgtnnnnnnnnnnggaggagagaaggggagtgggtgggttggagtctgttgggagctggaggctatgaaagaagctgtcggggggttgaaccgttgaagggatgggtggnnnnnnnnnnttgaggaggggttcaagggaaaaccgaggagagaagggaagtgggtggattggagtctgttgggagctggaggctgtgaaagaagctgttgggggggttgaaccgttgaagggatgggtggccccgggctctggggtggacacacacgtttggaatggatgcggcaagaccctgtggccataacgctccaagcggtacagcggggtgcgcaggtcgtggtcctgtgcaaacaccagcctggtgcacacgcgtgcacggcccacctcagctcgtctgcgtcctgcgagcacgcatgccacatgctctctttccaccccccccctccactcttcctgcagctgagcctggaggagcagcgcgcggtgctgagcaagcggcggggtcatgtggtgggccggcgcacgatcctcaagtccatgcccccgcccgtccccggcgcagggggcaccctggacggccagccgctgccgggcgtggccgacgtgcgtgcggtgcacggtttcccggtctacacgctgggcggggccagcgtggcgggcctgcgcgccctgctgcgcgcgctgggcgcctggcgcggcgtgcgggtcgtggtcaccgacctgcgcgaggagatggcgctgtacgtcgcgggcgaggtgtacctgcgccgcgaactcgagtccccggccgcggccgcnnnnnnnnnnnnnnnnnnnnnnnnnnnnnnnnnnnnnnnnnnnnnnnnnnnnnnnnnnnnnnnnnnnnnnnnnnnnnnnnnctggagcggcgcctgcgctccgacgccctggccgaggccgccgcctggggcgggttcctcctgctgcaccgcgaggtggcgaggccggtgggcggggaggcggatctcgacggcggcggtggccggcgcatgggcggagccgcggccccggacgtcgatgcctgcacgccgcgcgcggccaagcgcgcccggcccaacgacttctcctgcggcgtgctgttcgcggagcgggggagggaggcaggcggcgaggcgggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagcccacgacggaggtacagcctttttgggcggcggtgggcccctcgggcgacgtcgactcgggcctggccacgcccgccgaggtgtttgccgcgctggcggccgacggcgcgcgcgtggcgtaccgccgcgtcccgctctcccgcgagcgcacgcccgccgccgccgacctgga

SEQ ID NO: 47269 - DNA, 80 bp, Chlorella protothecoides
tgatcgcgtccaatggcggtgtggcgagggacctatgggcctgcatgccggcctgcagaccagggagccgtgaatcctgt

SEQ ID NO: 47270 - DNA, 77 bp, Chlorella protothecoides
gatggcttgatgatcgggttgggagcatcttcaggatgcgcgccgggctatggatatcacctcacctcacgttcctc

SEQ ID NO: 47271 - DNA, 90955 bp, Chlorella protothecoides
  modified_base (727)..(736): a, c, t, g, unknown or other
  modified_base (1381)..(1390): a, c, t, g, unknown or other
  modified_base (1470)..(1609): a, c, t, g, unknown or other
  modified_base (2038)..(2047): a, c, t, g, unknown or other
  modified_base (2399)..(2408): a, c, t, g, unknown or other
  modified_base (2570)..(2579): a, c, t, g, unknown or other
  modified_base (2656)..(2685): a, c, t, g, unknown or other
  modified_base (2820)..(2829): a, c, t, g, unknown or other
  modified_base (3083)..(3092): a, c, t, g, unknown or other
  modified_base (3721)..(3730): a, c, t, g, unknown or other
  modified_base (4691)..(4700): a, c, t, g, unknown or other
  modified_base (5365)..(5374): a, c, t, g, unknown or other
  modified_base (5713)..(5722): a, c, t, g, unknown or other
  modified_base (8536)..(8545): a, c, t, g, unknown or other
  modified_base (11108)..(11117): a, c, t, g, unknown or other
  modified_base (11178)..(11317): a, c, t, g, unknown or other
  modified_base (11888)..(11897): a, c, t, g, unknown or other
  modified_base (12051)..(12060): a, c, t, g, unknown or other
  modified_base (12492)..(12501): a, c, t, g, unknown or other
  modified_base (12892)..(12901): a, c, t, g, unknown or other
  modified_base (13229)..(13238): a, c, t, g, unknown or other
  modified_base (15278)..(15287): a, c, t, g, unknown or other
  modified_base (15345)..(15354): a, c, t, g, unknown or other
  modified_base (15426)..(15435): a, c, t, g, unknown or other
  modified_base (15896)..(15905): a, c, t, g, unknown or other
  modified_base (17446)..(17455): a, c, t, g, unknown or other
  modified_base (17884)..(18001): a, c, t, g, unknown or other
  modified_base (18094)..(18103): a, c, t, g, unknown or other
  modified_base (18196)..(18205): a, c, t, g, unknown or other
  modified_base (18352)..(18386): a, c, t, g, unknown or other
  modified_base (18647)..(18656): a, c, t, g, unknown or other
  modified_base (19489)..(19498): a, c, t, g, unknown or other
  modified_base (20436)..(20445): a, c, t, g, unknown or other
  modified_base (21419)..(21428): a, c, t, g, unknown or other
  modified_base (22386)..(22395): a, c, t, g, unknown or other
  modified_base (22725)..(22734): a, c, t, g, unknown or other
  modified_base (23175)..(23184): a, c, t, g, unknown or other
  modified_base (23645)..(23654): a, c, t, g, unknown or other
  modified_base (24171)..(24180): a, c, t, g, unknown or other
  modified_base (24694)..(24703): a, c, t, g, unknown or other
  modified_base (25163)..(25172): a, c, t, g, unknown or other
  modified_base (25711)..(25720): a, c, t, g, unknown or other
  modified_base (26224)..(26233): a, c, t, g, unknown or other
  modified_base (26778)..(26787): a, c, t, g, unknown or other
  modified_base (27669)..(27678): a, c, t, g, unknown or other
  modified_base (28154)..(28163): a, c, t, g, unknown or other
  modified_base (28643)..(28652): a, c, t, g, unknown or other
  modified_base (29501)..(29510): a, c, t, g, unknown or other
  modified_base (32708)..(32717): a, c, t, g, unknown or other
  modified_base (34858)..(34867): a, c, t, g, unknown or other
  modified_base (36590)..(36599): a, c, t, g, unknown or other
  modified_base (39023)..(39032): a, c, t, g, unknown or other
  modified_base (41188)..(41197): a, c, t, g, unknown or other
  modified_base (42071)..(42080): a, c, t, g, unknown or other
  modified_base (42822)..(42831): a, c, t, g, unknown or other
  modified_base (43368)..(43377): a, c, t, g, unknown or other
  modified_base (44078)..(44087): a, c, t, g, unknown or other
  modified_base (45115)..(45124): a, c, t, g, unknown or other
  modified_base (47830)..(47839): a, c, t, g, unknown or other
  modified_base (48567)..(48576): a, c, t, g, unknown or other
  modified_base (48807)..(48816): a, c, t, g, unknown or other
  modified_base (48890)..(49049): a, c, t, g, unknown or other
  modified_base (49743)..(49752): a, c, t, g, unknown or other
  modified_base (50446)..(50455): a, c, t, g, unknown or other
  modified_base (51000)..(51064): a, c, t, g, unknown or other
  modified_base (52308)..(52317): a, c, t, g, unknown or other
  modified_base (52411)..(52420): a, c, t, g, unknown or other
  modified_base (52579)..(52643): a, c, t, g, unknown or other
  modified_base (52884)..(52893): a, c, t, g, unknown or other
  modified_base (52987)..(52996): a, c, t, g, unknown or other
  modified_base (53079)..(53088): a, c, t, g, unknown or other
  modified_base (53803)..(53812): a, c, t, g, unknown or other
  modified_base (54872)..(54881): a, c, t, g, unknown or other
  modified_base (55088)..(55097): a, c, t, g, unknown or other
  modified_base (55391)..(55400): a, c, t, g, unknown or other
  modified_base (55588)..(55597): a, c, t, g, unknown or other
  modified_base (56901)..(56910): a, c, t, g, unknown or other
  modified_base (57411)..(57420): a, c, t, g, unknown or other
  modified_base (57608)..(57617): a, c, t, g, unknown or other
  modified_base (58497)..(58506): a, c, t, g, unknown or other
  modified_base (58814)..(58981): a, c, t, g, unknown or other
  modified_base (60221)..(60230): a, c, t, g, unknown or other
  modified_base (61875)..(61884): a, c, t, g, unknown or other
  modified_base (64907)..(64916): a, c, t, g, unknown or other
  modified_base (65214)..(65223): a, c, t, g, unknown or other
  modified_base (66962)..(66971): a, c, t, g, unknown or other
  modified_base (67235)..(67244): a, c, t, g, unknown or other
  modified_base (67423)..(67432): a, c, t, g, unknown or other
  modified_base (68105)..(68114): a, c, t, g, unknown or other
  modified_base (68500)..(68509): a, c, t, g, unknown or other
  modified_base (69151)..(69160): a, c, t, g, unknown or other
  modified_base (69389)..(69398): a, c, t, g, unknown or other
  modified_base (69999)..(70008): a, c, t, g, unknown or other
  modified_base (70644)..(70653): a, c, t, g, unknown or other
  modified_base (71016)..(71025): a, c, t, g, unknown or other
  modified_base (71375)..(71384): a, c, t, g, unknown or other
  modified_base (72187)..(72196): a, c, t, g, unknown or other
  modified_base (72775)..(72799): a, c, t, g, unknown or other
  modified_base (72852)..(72861): a, c, t, g, unknown or other
  modified_base (74322)..(74331): a, c, t, g, unknown or other
  modified_base (74577)..(74586): a, c, t, g, unknown or other
  modified_base (75882)..(75891): a, c, t, g, unknown or other
  modified_base (76556)..(76565): a, c, t, g, unknown or other
  modified_base (76709)..(76718): a, c, t, g, unknown or other
  modified_base (76922)..(76931): a, c, t, g, unknown or other
  modified_base (78107)..(78212): a, c, t, g, unknown or other
  modified_base (78408)..(78417): a, c, t, g, unknown or other
  modified_base (78578)..(78587): a, c, t, g, unknown or other
  modified_base (78748)..(78815): a, c, t, g, unknown or other
  modified_base (79289)..(79298): a, c, t, g, unknown or other
  modified_base (79757)..(79766): a, c, t, g, unknown or other
  modified_base (81068)..(81077): a, c, t, g, unknown or other
  modified_base (81788)..(81797): a, c, t, g, unknown or other
  modified_base (82336)..(82345): a, c, t, g, unknown or other
  modified_base (82972)..(82981): a, c, t, g, unknown or other
  modified_base (85245)..(85254): a, c, t, g, unknown or other
  modified_base (85920)..(85929): a, c, t, g, unknown or other
  modified_base (86306)..(86315): a, c, t, g, unknown or other
  modified_base (86716)..(86725): a, c, t, g, unknown or other
  modified_base (87068)..(87077): a, c, t, g, unknown or other
  modified_base (87653)..(87662): a, c, t, g, unknown or other
  modified_base (88267)..(88276): a, c, t, g, unknown or other
  modified_base (89042)..(89051): a, c, t, g, unknown or other
  modified_base (89167)..(89176): a, c, t, g, unknown or other
  modified_base (90077)..(90086): a, c, t, g, unknown or other
  modified_base (90182)..(90191): a, c, t, g, unknown or other
  modified_base (90268)..(90277): a, c, t, g, unknown or other
  modified_base (90632)..(90641): a, c, t, g, unknown or other
ggtggtggggggggtggggggggtgcggttttcggttttccactcgattcgtgtgttggcgccgtcgcatcgccgctggaaactgaggcgctcggctcgcctccacccctggaccctgtgagtgggggcgagttgatttgaagatgagattgtgtgattgggttggcgagacatgcacaagcacagtcagaagatgcagtgttgacgtatcagggatgcgccctctaccccaaggttcttcatcatcatcggtcaccccacacacctgcaatctccccacctcctccccggccccttcccaaaccacaacacacaggcagacctggtcccgggaggcccagccggctcgccagcacctcctcggcggcccgcagcgcctgcctcttctcgctctcctgcctcagccggtgggcatgtgccgccagcagactggccaggtccaggggggtgtaagcgtccggcgcatcgtccccggcaaacccgccgccgggcggaccctcgccgcccgggctggggaggtggcgctgcatgtcctctgctgcctgcaggaggtcgtccagcgaaagaccggcggggaggaatgccgtcacgccgtccccaccctccgtcctgggttgggaggggagggggatggggggtgagcgaaggggctgccgcgcatgctgctccaggtgatgtgcagagctcgatgccattgccaggcaggcaagtgcaagggggaggggcnnnnnnnnnntgcccggactggggaggtggcgctgcatgtcctctgccgcctgcaggaggtcgtccagcgaaaggccggcggggaggaatgccgtcacgccgtccccaccttccgtcctgggttgggaggggagggagaggggaggtgagcgaaggggctgccgcgcatcctgctccaggtgatgtgcagagcttggtgccatcgccaggcaggcaagtgcaagggggaggggctgggtgcgtgcaggatgcgcatatcatgaaactgggcaggacaggagcatgcccgacatggtacatgccactgcagccgtcacctcccgcccatgccaccactttgccatcttcaaccatcccaacaaccgccggacccacttttgaacgaccgctccggtttccgcgtgcacgtacagcccgccgcccagaccaggcagggctgccgcggccacgccgccctgcgcctcgcccggagcgggcgagtcgccgccggcgggctcgcccgctcgcgcgtgcgggtgcctggcgccgtccctggcgcgtgcgcggtcggcgtagccccccttgccgcgcgcggcgctgttggccggcgccttgccgtcggccggccttggccggcctgagcttgcgcagggcgggcggcgtccgccgctgaccnnnnnnnnnngccgtcggccggcgccttgccgtcggccggcctcggccggcctgagctcgcgcagggcgggcggcgtccgccgctgaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctgcgatggggggacggtgagaggggggcgatcggcatgaatatcagcagcaaagcagggaaatacaggagacagatgcacgcaaccactctcactcatcatctcgcacagctcctccaaccctcgcagccctgcactcactgctgagcgcctccttaagcgcctgggaggtcatgaggggagcgcccgccgcgtacctcgcagggcccttgcggccgagcgccgcgcgctgggccgccgccgaccgcgccagctgcacgctggcggtcagcggcacgcgcatggcctgggtgccctccggctgggcgaggttgtcgtcaggcaagacgccgggcggcatcctcgcggggttgctctcgccgactcggccgcgaccaggctccctcgccgcggacggtggcgcggcgcctccacccctgccgtcatnnnnnnnnnntgccgggttgctctcgccaactcggccgcgaccaggctccctcgccgtggatagtggcgcggcgcctccacccctgccgtcatcagacgcccccatgcccacacccggaggccctctgtcagggacgcccgaacgcggcccctcgtccacaccgggccacgcatcttctgcggttgggtcaaagtgggcgatgcctggtcctcctcgcgcggcgccctctacgccatccctgagcctctcctctcctctgaccgtgcccgtcctcgtcctcgcgctgcccggcctggcagcgccaggggaacccacgccgcctggtcccagaggcagcatgcgctcgtcctttgccccgtcnnnnnnnnnnccatgccaatcgtccctctctcaccgtccccccatcgcagaagcatcgcttggctcgctctcctcctcctcgatcctggacagcacggcggaccacgccccggatgcacaccaccacgacgcggaggaggaggtcagcggcggacgccgcccgccctgcgcnnnnnnnnnnaggccaggcatcttctgcggttgggtcaaagtaggcgatgcctggccctcctcgcgcggcgccctctacgccatccnnnnnnnnnnnnnnnnnnnnnnnnnnnnnnagacccagcgctccggtaggcggccccgggggtgagcactgcgccctcggcccctgccccgctgccaccgccaactccgcctccgccacaccaatcgccgccgccctgctcgccgcccgccgaccccagctggannnnnnnnnnggacccagcgctccggtgggcggccccgggggcgagcactgcgtccttggcccctgccccgctgccaccgccaactccgccacacgaatcgccgccgtcctgctcgccgcccgccgaccccagctggagccgcaggcggctgaagcgcgtgcccggctcaccgccgacacctggctcgccgtcgacgccatccctctgcgccccatcatgcgcgcctcgggcgtcgcagccccggccctgcttgcctgcggaannnnnnnnnnttcaccgccgacacctggctcgccggcgacgccatccctctgcgccccgtcatgcgcgcctcgggcatcgcagccccggccctgcttgcctgcggaagcctggcggcccagcaggccaccgaagaggctgcccatggccgtgccgaatccacggaacaggccgggcgacttggtgtgggcagcgacggggctgcccggcccgctttcggcgccggagctcctggccacggcagcctgcagcgggcccagtccccgggcgggggaggcggccaccggacccggaccggctgactggagggccagggcggggccgaggacggttccccctgccggcgcgcatgtcgcgggctgggcgccaggcggtccagcagtctgcgagtcgccagtctgcggcctggcctggccagagcctgaggcgtgcgaaggagcagtgccctgcttttgcatcgagccggctgcaccgcccgctccgtcgctgccggctcgctcgtctgcgacgtacgccgcgctgccaatgccctgatgcacccctgggagctccccgatgcccataccagcagcggagccgccgtgttcccagcgcagctggatccgggccgccccgccggcgcgggcccgcgccggcgcgnnnnnnnnnnatcgctgccagctcgctcgtctgcgacgtacgccacgctgccaatgccctgctgcacctctgggagctccccaatgcccataccagcagcagggccgctgtgttcccagcgcagctggatccgggctgccccgccggcgcgggcccgcgccggcgcgccggcggccgagccagagctgccggtgctgtcggcggggctggcacccgactcctggctgcgcgcggtgcggggcaggacctccaggccgggcatggcaggggtccagcggggggcacgtgtggagcgttttgccaccctcgcattgggacctgggtggagaagagggcaatgaatgcagcgcttgcacgtggtcgagtgaggccgagcatgcagggcgcagaaatgctgcgacgcattcacaaacagcccgcagcagggagcagagtcgtgggcgccagcgctgcgcgcggtgcccgaggcttggcccgcgccgcagcgaccatgtctggtggtaacaggggtgccccaggagggtgcatcttcccttcacgcagcctccgctggtcctgcccacagcgttcccgttgcgcctcccttctctcacccgggggtcgccagggcgacttgtcgggcccttcgggcgcaggcgggcgcagggcggccttgagctcctgctgccgcagcaggatcgggtgcaggtcgatgttgggggcggagccgcgcggcgtgccgccccctgcctcgcggcccaggcagccgggaggggtgcctgcacgactgccgcgcgccaggcagctgccgcccgacgcgctgttcgacccgggcgtccgctggctggcaggttcgccgctgggtgcgcctgccgggtggccttgagagctgcgtcgtgggtgtgagtggacgactgcgagtgagtggagtgggtgatgcacggcacacggcgagtgtgcagggtccacctccagggcacagcggcccctgnnnnnnnnnntgggtggccttgagagctgcgttgtgggtgtgagtggatgactgcgagtgagtggagtgggtgaggcacggcacacggcgagtgcgcaggggtccacctccagggcacagcggcccctgcatcgtgcatcgatgccatgtccctcctcccccacggccgccggcactcaacacagcaccttacctgctggcggcgctggcggagggctggggggtatagtgggcggccagcagccaatctgaggcggccttggtcctcatggtggtgatggggttcaccaggcgggaaacggccggcgccggcggggcggctgcgccggccctggccggcttagcgccctggccggccccggtcgccgccgccgcgcgtgccaccaccagctcgcgcacgcgtgcctccagcttctcgcgccgggcggcggccgcccccgcatccccagctgccggacccagcgactccccaaacacggtctcgaaatgcctgacgccgaggtgtgggagggcagagtctgtgagcggcaggggttttctggggcggcaatgctggcaggcatgagatcatcgcctgaggtccagccatggccagtcttccccaggccctgcacacccctgctcctcactctatcatctgcgccgtcacccagatggcggcctgcgtcagctgtnnnnnnnnnnggtcctcactctatcatctgggctgtcacccagatggcggcctgcgtcagctgtcgcggatcggtggcctgcatgctgagctcgggttggagcaggggggggcccaaagtcctggcgagccccttgcgcgtgcaggccgcgccggggacgctgacgaggcgcttgcagtaccgcaccaggcgacgcagcagatctggagagatgatgaggggcatcggattgggaggagtcggcaaggtaggggaacaacggcagtggaattcagtcaagacggggtacctatccatgaggctggcacagagcccaggtcaagagcatgccaggcctacgtcactggcnnnnnnnnnntatatgcatgaggctggcacagagcccagctcaagagcatgccaggcctacgtcactggcctcgttaagcaatatgccgccctctgtagacccggtatcaaggttggcactgcggtgcggtgctgcaagctatgcccagagtgtctccatcaccacttcagacctagccacagagcaaccagccaacccattccaagtcatcaagcaggcgccctcaccatggtggaccccagagcgggagcccatgatctgtgtgaggcaggacagcttcacttgaggtccatcgcgggaaaaagcaaggccgaggagctgctggcacgaaccggggtccaccagcggggtcctcagcgccgccagggacttgatgaccagcacagaaaccgccaccgagtccatgcccggatgcgatgtccctgtgggaggatttgatttcacgacttgattcagagcgagggggaggagggtagtcgttcttcctctgcagcaagggatgctggagccgcaccatatcaaggcactcccactgtgcataagcgtgacaacagagtacactccacaaaaatattctactcaccatgctccaggagggctttctctgccctggccacatcaccgcctttggccatgctgacgaacagttctggagctgtctctggagaaactgcacggtcgtgcgggtcggaaacatcatggagacggcccgcaggcatcagacatccgtcatcagaaagcatcccacttgctagaggatagcactctcatcccggctgcacaccatgcgtttgcaagtactccacggccagctgcagcagtcggaagtttgggtcggcctcctccgggcgggaacgagctgctcgggattggagcaccccccgcagctcgtcccgcatatccattggatgcagcgtccttgccatctgagaagctcaagccatgacttgcacaagcatgcgcgcccacttgcgagcttgccggaaggaggagagtctataacccacagccccggcgatgccaggaaacaaacatggacgatccaaaggttcaatcgatgatcgttgtttgattctctaaaccctttctacacctccgtgggcaccatctcgcgctctttttcggactggagacagatggagcaacatcaaagttgaaatccatcggtggtactaccgcggtttggactccggggatgcgcgagaaggaaggtgcaggactcgtgccacatcagccctctgagcgctgcctggatgcatgggagcccgaacccacgcgatcccagatctctgcgtgatatcttcgagactgcagtgagggcgcgagggagtatcccttctgttgttggtcggcgcaggtcaccattgaccctcctggggcgccagagaccccgcccagtgacttctctggagactgtctgggaagaaagctatgatttgattgcattggtattgcgattgaagtcggcaggtcgccacaggctggtgccagagaaggagtgatctgggcatgtggtgcgcccacaccgcgctctggtgcatcatcctcacacttttaggggcgcagacagtatgtaatgcgcatccaattgaggtgcgcgtgtcaagtgtcgatggtggtgctgccagcgcctgcacaggaccccttcctaacctgcacttctcctcctcctcggcagacatgccctctggctgatgggggcacctggggccaggccacacagagcacggctgcacggcatttgtccagcaaagtgacgaagcaggacctcattgtccgttttaaagcttacaaggttgcgaatgtgcataaagcagccttgtcggaagccctggctggcagtccttacgcttggtcatgggtcagcagggacaaccctgcctctgcctttcccaccgattttggactgctgcgggtgctctccacagagattgcctctgtaacggtgcgtttgagtgctgtatgagcgtattgttcccaaggtgatatggatgggtctgttgctccgccggctcaatctttccctgtgttgcctggtcccaaggcactgcatccatccatgcgtaaccgcccatgtatcccaatgtcggagcgacaggcactgctggctcttgtccccggggtcaaggatgtgcacctggataaagcgatgcggcgggggctggcgctgccctcccctgagcctgtggagcccctggacggcgggctcgtgaggaagcggcctggacgcctgcagacgcgacccaccatcggtctgtgggaggacgactcggccgacatggcatacgggcgtgagctgctggctgctgccgggcccacgctccctgtgcgcctgggcgccgacaagatctgggagcagggccattccggcaagggcatcaagatgggcgtatttgacactgggatccgaggcaaccattcccatctcaggaacatcaagtgagcatgagggggtgcggcaaggtggtgggagggcgagctgtctggggggaggtgagcgatgtcagaggatgggcagggtgtcagggtccacagagtcgagtgtcgaggggtcaggggcgcctggaaaggggtcatggaggtctcaagtcacctgatcggagcaggattgcggtaggctgtgcttgtgcggatacggtagaggagctgttacccaactcttcccacacgctgcatctctacgagcatccgcatccctcccatacctcgacagggagcgcaccaactggacgctggagccgacgctggaggacgggctgggccacggcagcttcgtggcgggcgtcatcgcgggcatcgaccccgagtgcccgggcctggccnnnnnnnnnntaccaactggacactggagccgacgctggaggacgggctggggcacggcagcttcgtggcgggcgtcatcgcaggcatcgaccccgagtgcccgggcctggccccagacatcgacatgcacttcttccgcgtcttcaccaacgaccaggtgtcctacacctcctggttcctggacgccttcaactacgccatagcctccagcatggacatcgtcaacctgtccattggtgggctgatttggattctggtggcaggagggaaaggattgctgaaaggtggagggggttgtttggaggtgctaccgacgtgcatgtacacaccccaactttgacatcattgtccccctctgaacccctcatcacggacccccttcaggaggccccgaccacctggacgccccgtttgtggaaaaggtggcggaggtcacgtctgcaggcatcatcatgatctctgccatcggtaacgacggcccattctacggcacgctgaacaacccggcagaccaggccgacgtgattggcgtgggcggcatcgatttctcagacaggtgtgtgctgggacccctggtgctgggtgatccgcccctcggttcaggacggcgcagggtgaggcccctgggttcactgcctggacgacagggcgcttcagcaggagtctgctccatgcccgcagcgccgcgctgccccgcggcatgcgaggtgctgacgcatggtcagcacggcacacaaatcacatctctccccaccctggacattccacaccccaagtgctcgtccctgtccatcatggggtcacgactccacccgccccctcagcaccctcaccccccctcccctacacctccaaggatcgcgcccttctcctcgcgcggcctgaccagctgggacttcccgcgtggtgtgggccacttcaagcccgacgtggtggcgtacggcaaggatgtgcgcgggtcgcacatgcgcgagggctgccgctcgctgtccggcaccagcgtcgcctcgcctgtggtggcgggcgcggtgggcctgttggccagcaccatgcgcagcaaggccggcggccggctgaaccccgccgccatgaagcaggcgctgctgcgcggcgcggcgcgcctgccgggcgtgcccgccgccgagcagggcgcggggcgcattgacctggccgcggccgccgccgcgctggccgagctggaaagcgcgccgcgcgccagcgtgcaccccgaggcgctggacctcgccgactgtccctacatgtggccctactgcgggcagccgctgtacgcggaggccatgcccaccctggtcaacctcaccatcctcaacggggccgggctggtggggcggctggagggcagcccggtgtatgtccccacggatgagccggggcgggcgctggacgtgcagttcgaggcctcggaggtgctctggccctggtccgggtacctggcgctctacatcaggtgcggagggggggtgcgctggggatgcatgtggggtggcaccctctggtggcgctgtgaaaggcaagggcacgctggcacatgccagaatgggaagttgctatgagtggcgggccggcttgtccatgcgatgtggcatggggaatctccgcatgctctcaggcggccctcattggccaggaatggctgcaaaaaccagtcattggatgcaccatccctcccttctcagagtgaggccggacgatgccttgctggaggcgacagcacacggcgaggtgcggctcaccgtggtgtcggcccctgggccgggggagaaggaggacaggcgctcagacatcgtggtgcccctgaccgtccccatcattcccacgccccctcggtgagtggcggtggggcgagggagatgatccattgcgcaggtgttcttagatcttgggttgttcccttgtcagaagttgtatcacggggtccactcttctcagccatgcgcccagacagtctcataggcatgccctcagccagcctgctccctgctcctcccctcgcctgcgctcaccctctactttccacattcattgtgcattgcaaaaggaaaaagaggatcctctgggatcagtaccattccatcgcctaccctccggcgtacatcccaagggatgacctcaccacgaggcaagacatcttggactggcacggcgaccatccatacaacaacttccatgggatgttggaccatctgaggtgtgtgggttgggaatgcgggcatggcatcacccatagagcagcagtcggtggggagccggtgaatgttcatgagcaagccagctggcatccagaagagctcgtcgcaagtatttgacaatctttcacataaatcttgacatacatctagggagcgagggtactaccttgagatcctggggtctcccttgacatgcttcaacgcatcccaggtctgattgaggctcagggtggtgatgtgacgggcatgctgtacgccatgggtgcattgttggcacactcagccccactagcatctctcggctttgcaatccaagggcgagccgccacctgcaatttccctgcttcgttcctttgcagtannnnnnnnnngagtatttgataatctttcacataaacctcgacatacatctagggagcgagggtactaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgcattgttggcacactcggccccactagcatctctcggctttggaatccaagggcgagccatcacccgcaatttccctgcttcgttcctttgcagtacggcgccctgctcatcgtcgattctgaggaggagttttacaaggaggagattcagaagctgcgtcaggacgtcaacctgagtggcctaggtgatgcgagggctagggtgcaggggttggggttgtgccagccttacatgaaggttgacactcaaggaggacatcccgtactgtgctgactggtgtggtgaacgcattttttgccatggcgaaggcagtgtggggccctgccatcaacatgtgcatgccacctgaccactgtgcaggtctgattgtctttgcggactggtacgacctggagactatgaagggggtgcgcttctacgacgacaacacccgcagctggtgggaggccgccacaggtgggaggcaggggatgatggggtgtgagggatgagaaggtggccgcatgcccggcaggcgcacagtcctctcgcgacagagaagaatcgagccattcttttctccaccnnnnnnnnnncgcgcacagtcctctcacgcctgagaagaatcgagccattcttttctccacctggcgccatgcctggtctctcagaggcaatccacgtgtctggggtcttctcaacctcccccaatgcgacattgccaactggcaggtggggccaacgtcccgnnnnnnnnnnagtgtctggggtcttctcagcctcccccagtacgaaaatgccaactggcaggtggggccaacgtcccggcgctgaacgacctgctgcagccctttggcatcgggctggggggacctgtcctggagggcaccatggagctgcccgggggtgaaagcgtggcgctgcaatccgggacggcggtgatggcagcgccacagggcgcctggctctacaccgccacgaccccaggtgtcttgtggggctgtgtttggggctgttacaccgagtaatttcaatcttttgcagagacaacttgtggtgtctgtcatactgctcgccatctgcgtctggtatcccactgtgcactcgctcggccaccgcaagcaggaaagcaggacaaggggcccggtgtggccactgcggcgctagccctgctgcgctccggcatggggnnnnnnnnnngttgcggggctgtgtttggggctgttacatcaagtagtttcaatcttttgaagatacaacttgtggtgtctgtcatactgcccgccatctccgcctggtatcccactgtgcacccgctcccccaccgcaagcaggagtcaagggcaaggggcccggtgtggccactgcagcgctagccctgctgcgctccggcatggggaccgtgtccgtcttcggcgactccaactgcctcgactccagccaccagaaggcggcgtgctggggcctgctggacgctctcctggcctttgccggcggggtgaggaagcgtgcaccgggatggaggggggagggagagacggaggtgggggatgtggggctggtgagggccacccttctcgagcaccgtccnnnnnnnnnntgggatggaggggagggggagacggaggtgggggatgtgggccgggtgagggccacccttctcgagcaccgtcctcagcccaccaatgcatccccacccaccgatcgccgtcaggagccggaaggcctgagccacgccgacggagccctgggccaggcgcatggctccctggcgggcctcccagctaggaacccagactacgacttcaagctcgtgtcccgcgtgctcacagagcccctgaggtgcgccgcctgagctcctgatcggcaggggggttgatggcgcctggcgctgcggcgagctcatgcgaccccgcccgtggatctgnnnnnnnnnngggggggtgatggcgccgggcgctgcgacgagctcatgcgaccccgcccgtggatctgacccacatccggcgagcccaccgccccgcacccgcccgcaggtgctaccccaacggcgccgcgggtctgcccggcgcgctgcccatccccggccccaggcccggccacgaaccccgaaagggggacggcgggagcgagaccctggactcgcgcctgcgagacgtcgcagcgcaggccaatgccagcgccgaggctggcgagggcgaggcctccaagcactgtgagttcagggcaggctctgcggcctgacttgggtacaagggggtgggaatggaggatggatgggatgggggacgcacaccggacctcaaaggaaggcatgccgcgccgatgcaggaactccctgcataccaaccctccagggtcgttgttgggtccctgtttgggagctcaccgtcccaaccacctgctggtcccccatccccatcacaatccatcattcgttgccccccaccccccccttcatgaccagacgtgcggcagcatcccagcctgctcccagccatctctacgggctactcgaatgccgccctggggttggcagtggccggcgtggcgttgctcatggccctcattctggccagacggcggagtgcaaagggcgccgtgctgcccccaaagacacgaagcctgggagggatcagcggggcgaggcgacgcagcgtcacgaacgtcgcgtcatgattgcaagcggcaacccctgtgcgtgtgacggagttgatttacaagacgtacccaaagcacaatgctgcttgcttgcccgacatgactgtcaatggacctctgagaagcttctctgagtaaaagggcgtagcatgggggctggtgttgacagctcgaccccgccattcattggggcatggaagcgcgatgtatgaaagccaaaattttggcaccagtggtccacgtggtctgtcgtcccatggcgcgcagctcgcagaagggttgatccgcggtaatgcgcctcaccacacaggcgcatacataaaacatggctcgaaagtgcaaacaccatcgcttgtcgtcgactgtggggaacggcattgcctgtactcccgtgcatggacgcatgtcgctgccgtgaccataagtgcatgacatgacggccggcagccccatggcatccaagcatgtgctcattcttgggggcaccggccgcgtggggtcctcgactgcagcatccttgctgcggacgcaccctgacatccggatctccttggggagtcggggcatggagtcccatggcgccgcagtgctgaggaggccagagctgcgtgactgcccctggatcggctgcgacgctcgggacgcgcacagcctggacaaggctctctccagcagcggcgtggacctggtggtgcatgcggccggccccttccagggcgacgcggcctgctcccccttggaggcggccatccggcatggtgtgccctacatggacgtctgcgacgacgcgatgtatgcgcagcgcgccaagcgcctggagccggccgccagggcggcgggggtgcccgccctctccactgccggcatcttcccaggtctcagcaacgtcatggcagcagacatggtgactcgccacgcgggcgggagggcccctgcccgagtcctgtactcctactacactgccgggacggggggcgcggggcctacgatcctggagaccaccttcctcctggcggggcaggatgtggtggtgtaccggtgcgtactgctgagggttggtagtgtggggatggggacttctgaggcagccactggccgaggtcctgccatcgcggccttgtccaggtgcgatgcacccttgcaccatcaatctgctaccgtctgttctctgctaccagctgttctcagataatttacacctactattgcaaaaccaatagggatggcaagcagctcactgtgccagccatcagcaacaggcgtcctgtggactttgggaccactatcgggaccaagtgcgcacatgtagaggaccnnnnnnnnnngtttacatctactttttcaaaaccaacagggatggcaagcagctcactgtgccagccnnnnnnnnnngccggctctgcatgcacataacggctcactatccatccaactgcaggtccgtgtacctctacaacctgccgnnnnnnnnnncgcctcgaccagggcggagtcctgacaatggattgcctgcccacgaaaaccgtcgtgctcaaccatatgcaacccggccctgcatgcacataacgactcactatccatccaattgcaggtccgtgtacctctacaacctgccggaaacgcacactggccgggctgtgttccaggcccccagcatcagtgcccgtttcgggattgaccccggcgtcttcaatgtcgccatgatcctggtcgcccgcctcttgccgaaacgtagggaaggaggtggcgtgatgggcagggtggcacagcattggcacctgcttccctacgatgaccaaaggagcaggcaggcgactatggtcctgtgattgttgttgacatgccaaacattctctaaaggacttttatggtgcaactcagccgtgaccaaatgttcctcaactccaggttggctggaagatcgtgccctggtnnnnnnnnnncatggtcctgtgattgttgttcataagccaaacattctctaaaggactgttatggtgcagctcagccgtgaccaaattttcctcaattccaggttggctggaagatcgtgccctggtgcagaccctggccaagctgactgcgcccctggtggccctggtggatcgctttgctggcgacagggtgggcatgctgatcgaggtcgagctcgaaggtgtagtcgatgagagtgtggatctgtcctactcctttctggttttatctgatcatgccaacactgaacttctacagttcagcaatttttcagttcttgaatactcgacgatgtgtgacaaggcgcactcaatcccaagcgtgcatcattggttcaagttcgatctagggtttggtttccatgtccaactcccaaaccattcacagatggaaaggtgctggccagcctgtacgtgcacgaccacctggcagagggcatgggcgctgcagtggcagcctttgcagcctcaatgctcaagagtgagtggtttcttccttgccccatttctgttttcaaagccagatagatatgcttggctccgctggactgatacaaagctcgcagtgcatgccagctccgtgggcagcatcctccacggaacgtgaattcttccagccctcagccttcccttcctgcccccctcccagaccccccaccccccggtgtctggtacccagaggaggcatgctcggtgcctgaccgctccgccttcttctcggccgcgtcggagggggcacgcaccttccagctgggccgggccgcctgggagatcggcagcaccccccgccgctttggcatgggcatctacctctgagcctggtgtgctgctgtgctgccggcgagtgcagagtgtggggcgagtggcctggacccccttttgtgagcacgcgaggccggcccgtcccttacgttctgagtatgtcacacgcgtgcctgcccaggcatcagcaaggctgcagctgagcgcaggggggtcatggtacagggcgatcaggcatgaatcagtgcttggcatgcccgccctcccagccgtagaccaccgccaggagctggcagaaggccaggaaggagcagacgccgaccagccagatgacggtggcctccaggacgccaaagtaggagtcgtgcgcctgctggcgcaggatgtccagcatctccttcatcaccccgaaccggtcgttgagcagggtcacgcgctgcaccacctccatgtagtcaaagatggagcggtagagggtgcagatgtggtcgtccgcctcgtccagcgcggacggcgcgtccaggagctgggtcagcaggttgacggagcgctgctgcaggaagagctggcccatcagctgcatcaccgcgcggccacccacatcgatctcacccttgtctggggatgggcagggggagggaagtggtggaggtcggggatgtggcagtgtgagagggagcttgcacgtgagccccctccctgtgtcagaattaccacccgcccttcatgatcccaacccagacgctcannnnnnnnnngtgcacgtgagccccctccctgtgacagatcaccactcgcccttcatgatcccaacccagacgctcaccggccatcatggcggggaggtaggacaccgacctcccgaggctgcgcaggtcctcctcaaacacgctgagcttggtggactccgccagggcaaagctgatggccagcttcacgtacagctcgtccgcgtggcggtagtgcagggagatggtgtcgtcctcaatcacggccttggtgacggccgagtaggtgaccaaaacacggtcccgctcgatgcggtcgggcggcagggggcggtccacacacggcatcaccagctcgttcaatatgtacctgccagggaaagcaaggaggggcgaggcagggtgttgggtcccaagacgggcttcacagggtactgcaaggggtactggtgcactccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctcaatccctgtatacacctctgtccctaccaagctgcccaaattcaaccatgcccgctccccatcccttctcacttctctgcgtctgtgtnnnnnnnnnntctcaatccctgtatacccctctgtccctacaaagctgcccaaattcaaccatgcccgctctccatcccttctcacttctctgcgtctgtgtnnnnnnnnnnagtagggtcccaagacggggcttcagagggtactgcaaggggtactggtgcactccccccacttcgatcctgaatctggggcacagcgtgcgtactgcaccgccctcgacccgaccaaatcgcatccgctgcccgccagccgcccannnnnnnnnnnnnnnnnnnnnnnnnnnnnnnnnnncgaggccccagaacacgacgacacccgagtcgaagaagaaaatgtccgcattccctttgcccttgccaccccggtggtactgtatgcaaagcacctgtgcggcgataggggaagaacatcaggcgttgagtgggaagcgaccgccgtgtctggccagccttaagttgtgccggtgccatgcgcgcgccccctcccaacccccacccaccccacgtcaagcatcgagacctacatcagagtaggctcgcaacgtggcattcnnnnnnnnnnttgtatgcaaagcacctgcgcggcgataggggaagaacatcaggcgttcagtgggaagcgaccgccgtgtctaggcagcctcaagttgtgccggtgccatgcgcgcgtccccccccaacccccacccaccccacgtcaagcatagagacccacatcagagtaggctcgcaacgtggcattccgtcgcaggatggcgtcttggagggcgtaccggtcaaacccgtttgcgacgcagtagctgcgcacccgcaccgcctgtcccagcccttgatattgcacgggcacctcaggcggagcctccaccggcttctccacgtccaggggactctcccatccaggacccaaggagacgatgcggcccaggggtcggacagtggaggtggaggagggcagacgctgcgcagtgggaggaaagaaggggaggagcaaatcgcccagtgcggatcctttgaagggggcacccgaagaaaaacctagccctgtggaccacactcgatgcgtgtcccagcccaccctcagctctcggacgctcgggacggatctactcctctgatggtcgacggttctcgtctctgcttcaaccttctcctcctcgacggtctccacggccaacagcacctcctcccctggcgctgacatgcccggcgtgaaaaagctgcagcctcgtcacatgcttcaatatacagaactcatgatgaagcgcactcgatttgcatgcttgaacataaaatcctccttccctgtccctgcgaacccgaaattgcagaaacctggccccgatcgacgggcgacaaagatctcccggcttggcgccaacgctcatgtggccaagnnnnnnnnnngctgcgaacccggaattgcagaaacctggccccgatcgaggggagacaaagatttctcggcttggcgccaacgctcatgtggccaagtgcaggctcgcctgcggacctgcctgggctacctgccctgcatcaccctgctgccaccatatcgagaagaggatagtgtgtgacaggcctacaggcgtgcgagtgatacccgatttccagtgctatcaggcgccatccacctgagccctcttgcgggacgggcgattagggcggtacaacgcacgattggcagctgtagactggcgttgtgaggagttcaggaagtacacaatggtgaagctcgtcaggtaggttgggaatgtgatgagcagcgcgcaaggctatgcacggtggctcgagtgccgtcgcttctcagggcactgctctcggtgctctgaggtgttcatctaccacatttacacagattcctgatgaagctgtcgaatgagaaggtgcagatcgagctgaagaatggaacggtggttgccggcaccatcaccggtgagttccccgcagtctccggcgggattgattgctgggccaggtacgcaagctgtcgtgggtctacctctcaccctcccatgcctcctcccccgcgcgcacaggcgtggatgtggccatgaacacccacctgaagacagtcaagctggtaccccgcggtggcacccctgtgtccctggaccagatgtccctgcgtgggaacacaatccgctactacctcctccccgactccctcaatctcgacaccctgctggtggacctggaccaggccaagacacgacccaaacgtgcagaacggccggcaggaggaagagggcgcggcagggggcgcggccgtggccgcggaaggggtcgtgcttgatatttgggataatggcatacagcaagtcgccactgaagcatggcaccannnnnnnnnngcgcgcagaacggccggcaggaggaagggggcgcggcagggggcgcggccgtggccgtggcaggggtcgtgcttgatacccgggataatggcacacagcaagtcgccactgaagcatggcaccagctgcttcagcggatggcctgccctcatggactattgcttgctcagtcccggcaacccctgcgctccgtctcactgtgcatcacggactcttcgcatgcatggcaactgctgactgtagcatctgtgacactgacgctcaagcacacggcatgggagaggttggggtcccgggatccctatgaaagctgtcgtcagaaggtccctttcttgggatcggatgccctgcgtactgccctgttgatttccccatttccgaccaggcatttggtaccagcctctccgataccatcccgggcagaaccggatgacgccttgactcggcacattcccatcccacgacccctgctgatctacaactaccccaccatcgaacaaactgcgtctgtacgccccccttgcgttccatagccggaggctgtctgggagtggcctgttcaaaaactccgacacggcagcgcaccgtgagacgcgagatccaggcaccatggtgcacggctcgcgactctttctcttgtgtacggtgggacttgtttccctcgtcaccatcggggcggcctggggagtggagggaaggggcaggaattcgaaccccacctccgggtcctcgtggaacgcatctgtgaccgtgaacctgggggcgacccatcccgtcagcaagaccctgtacggcatcttcttcgaggaggtgtgtcttctgcctgcttggggtcgggatcagtccacatcgagcctgtaccttgcaggtttccagcccatcgggggtttgaccgcttcgtctttcccctccccagatcgggcatgccggcgagggtgggctctatgcggagctggtgcaggacaggagcttcnnnnnnnnnnccagtccacatcgagcctgtactttgcaggtttccagcccatcggggagttgaccgcttcgtcattcccctcctcagatcggtcatgccggcgagggtgggctttatgcggagctggtgcaggacaggagcttcgacgccatcgccagggtctctggatttgcctcctccaatgcgcctgccctgccggtggacctcggcaagctggctgcccagcaccgtgacgcctggacacccaccagctgggacctgagcgtggcagaggccactaccaccaaggccgatttcctggacaaattgcgcggcccaggtccacggtgggtgcctggcctggaagagatgccagggctggtgccgcaggagctgggcgggtggcctagtgtgggtttgctgcaggcctgaggaatccccaccaaatcctggcgacccggcccatgctgcctcccccatgcacctactccacacaggaacgacatcattgtggcgtggcaggctctccctggcaccaccacatcactcaccagggacaaacccctgaaccccaccaatctggtgtccatgaccctctccgccaccgccaacggatcggtcggcatcgttaatcatggctactggggcatgcacgtcgagaaggggcagtcctacacggtctcactctatgcccgggccggcgaggtgggatgggcgagattgtttggggtgtgattgccagtgcagagggtgcggagtgagacgcggacaccatgtctgccgtgggtgctttagtactgaccctgggtctgggtcagggctgcagcatgtccatgtctggtgtacccttgtatgccagccaagcctgaccagctgctgagccctacagaccactcaccctccatggcagacgggcccagtccctctgacggtgtccatactggatgcatccctgaatcacaccctggcctccgtggatctgaacccannnnnnnnnngctgagccctgcagaccactctccctccatggcagacgggccctgtccctctgacggtgtccatactgggtgcatccctgaagcacaccctggcctccgtggatctgaacccaccctcggaggactggggcaggctaacggggacgctggagcccaatgccaccgactccagtgccgtcctggtggtgagatggaggtgaacaacagaggtgtgactgattgtgctcaagaagttgtactgctgcgcacatatcctgtgatggggctggccagcaagctacctcatacctcctctcaatcccacgacgccttgtgcccctgccagatgannnnnnnnnntagcaagttacctcatacctcctctcgaccccacgacgccttgtgcccctgccagatgagctttgagggacccggctctgtggtgctggacgtagtctcccttttccccactgagaacgtgaaggaggctgccgagcggggagaggtgaacccctggcccttcagggctgaccttctcggtgccctcaaggcactcaaaccagcgtgaggggctctgaatggtgtttggagctttggaatatgggcttgatggcgaggaacattgggttatcgcagagcatgggcatttgtgcaccgaatacaagggggcgcacgatggacaggtctgttcctgtgcacaggctgtaggctaaaccaaatcatcactgcacttcatggcagacagctcattcccaatcacactctacactctgctgatgcagttttatgaggttccctggnnnnnnnnnnaggctctgattggtgcttggggctttggaatatgggctagatggcgagaagcattggctcatcgcagagcatgggcatttgtgcaccgagtgcaaggtggcgcatgatggacaggtctgtttctgtgcacaggctgtaggctagtccaaatcatcactgcacttcatggcagacagttcattcccaaacacactctataccctgctgatgcagttttatgaggttccctggaggctgctacatcgagggtgaccacctggtcaaccgcttcaactggaaggacagcatcgggcccttggaggagcgatcaggacacatgaacggtggggcttcttggcgattggcgatggtactggtcttgcagctgcacctcctgcgtttcagtcggctgggcgtcacggggagttgccatggctgctgcccctcccaggcctccccttcttcctgaccacccaccgatnnnnnnnnnnatactggtcttgcagccgcacctcctgcgtttctgttggctgggcgtcatggggacttgccatggctgctgcccctcccaagcctccccttcttcctgaccacccaccgatatactcccccatggacgacgcctgttcaggcgtctggggctactggtcgacggatggcctgggcctgttcgagtacatgcagctggcagaggccctggacacagagccggtgtgggtgatcaacaatggcgtggcccacgccgacagtgagcgctcgggggcaggggaggactgcgcagtcgactgcgtggagggcgcctcgtcgaggatcgaccacgcgatatgcagggcgccgcaggctgcaaagcaaactgcacccactggatcagcaacagcgtacttccaaagtctaatgcctgtactcctgtgttctgttcccacagatgatgaatgagagcgccctcactcaaccccacccactatcactctcgctcaaacaggtgtgccggcatcggacatctggccnnnnnnnnnngcatatgatgaatgagagcgccctcacccaaccccacccacaatcactctcgcttaacaggtgtgccggcatcggacatctggccctacgtccaggacgccctcgactctctggagttcatcctgggctcccctgactcccgctggggctccgtcaggtcgagcatgggacgggagcagccctggaacatcacctatgtggccatcggcaacgaggactgcgggaagtggatgtacctgaacaattaccttgccttcttcggcgccctgcgcggcgcgcatccccacctgcgcctgatcagcaactgcgacatgggccgcgatgcgcccactgacatctgggactggcacatctacaccaacccccgcgacctcttcaacaagcgcaatatcttcgatgggcggaggccggaggtggggtcaattagggggatttgggagggggggggttggaaagggaggcgcccagggctgcacgcgtatgaatgcagaactgaaaggatttgggatgggcnnnnnnnnnncggggttttgaaaggggggcgcccagggctgcacctgtataaatgcagaactgaaaggatttgggatgggtcaaaggaagtgctcgagaatcacgcgccgctcgtcgctgcctgcttccagaccatgcgtctatgcaaacaactctcaatcactttgcggatcatgaccacagcccatccccgcaacctccctcccccccacacacacacacttggtatcaggacggccactttgtgtttgcgtccgagtacgccgtcaccgagggcgggggctggggcaaccttgtcggtgagcgcgggagcgctgcctggaggggagtcggctggggcgacgggatgtgctgatcttcaaacggattgaagctgggagacagagaccactgtctcaccacatttttcccctcgcatctttccaccccgatccccggagcaggtgctgtggcggaggcggccttcatgnnnnnnnnnnagggacgtgctgatcttcaaacggatcgaagctgggagacagacaccactgtctcaccacgttttctccctcgcatctttccaccccgatcccctgcgcaggtgctgtggcggaggcggccttcatgacggggctggagaggaactcggaggcggtggtgatggccgcctatgcgcccctcttcgtccacaccagcaaccgcccctggcccaccaacatgattgtgatcgacaaccaccggtgagactgcagaggagggaggggtccacagcggatgctcaggttgaggagtactttcctgctctgacttggccatttggctagaggaggcgctgtgcaggccttttctccccctgacctgatgtctgtggcattaaagtttgggctgcattgctttacccacgtgcatccagccttgccatgattccagcatccacccaccccactgatcatggttctgcccttcaatgctgtgactctcccccctcctttgcgcctctttccatcctcacaggtggtttggcatcccctcctaccannnnnnnnnnttttacccacgtgcatccagcctcgccatgattccagcatctacccaccccactgatgatggttctgcccttcaatgctgtgactgtcctccctccttggcgcctctttccatcttcacaggtggtttggcatcccctcctaccacgtgcaacgtctcttccgtgagaaccagggcgtgcggtatgcagagacggcggtcgccgccagccccagtgcccaggtgaagcaccgttgtgaatgcgataaaggtgcctggcccctgcatacctttgtaatttggtggtcgggtggaggcaggcccagcgtatgctcgctgcctgggggggagagggagaaggtggaggtaacaactttacatgccttgggctgccaaacctacacactgcggctcagctggtgtgttactggtggagggctcccctagggtttctcccacccacaactccaacaccaaactcccaccaaccctcggaaacccctccagctgcatgaggactcggtgnnnnnnnnnnaatgccttaggctgccaaacctaacgcactgcggctcagctggtgtgttcctggtggagggctcccctagggtttctccccccgacaactctaacaccaaacacccaccaaccctcgcaaacccctccagctgcatgaggactcggtggcggcctctgccacctgccaggacgatgagtgcacgaccctggtggtcaaggtcatcaatttttcgtcatacaaccaggtgcgaggattgcggggactgacttggacctctgctgtcccctgtgtgtgagctttggaaggaacacatccctcgctcctccccacacgcgccacagaccatccgcatccagctcgacggcctggccgccaaccagagggtggaggacggcggggacctgacctggctcacctctggccaccctgaggatgaaaacacttttgacgacccacacaaggtgggtggagggcactttgatggggagtggtgtgtggttgggggggttgaatgccccccacttcgttccaatggaggatcaccaggctgcgcttcctacccnnnnnnnnnngaacacttttgacgacccacacaaggtttgtggagggcactttgatggggagtgatgtgtggtgggggggttgaatgccccccactctgttccattggaggatcaccaggctgcgcttcctaccctgagctgcattgccgattctgcagaggtggtgctgggttgatgaaacagcccaggctatgcctgagcctgtatgcatgagcaccgcctttgggttgattccctgcaccccacatcacatcccacctccatcgcaggtcacgccaagatccacctccctctcaggccttgactctgacttccggttgcagaccgccccctacagcgtcaacctgctgaccgttcagctcggctccggggaggcccctgatgcgtacgtcgctgctgccatgtaggcactgttggtgcatcgctttctgcaagtctgtcccaggcatcaggcaacttggcgagggagcagcttgctgcctctctcacaagactgcacgctttttgaggtcgcacgctggctgaagatcatccaatgctgttgctgttgttattcatcaggctggcacaacagcgaatgggtaactgcgagtgtgccatcagatctcaagcgtctgtcaatcggtcgaccaggcgtggccaatatccgtcactcggtcaggggaagagttcaatgcaaacaaagaggagagaagtggtctgcctgcccagctggtgctgagccggagctgcaggccaaagtctggcgtggtcagtccctgcatgcccaatgtcaagcagcggctgtcttggtcgcagatccgggcgtcctcaagtccccctccttgagtgcaggcaggtaggtgtccaccagccagtctacctgctcccagaagtccttctcccggtgcnnnnnnnnnncagtgctggcaggtatgtgtccaccagccagtcaacctgctcccagaagtccttctcccggtgctcggggatgactcgggccatcagacgccaacgccgcttggcctgggtggcggagcggcccttcaccagggcgccccagtccacctcccactccttgcaggcgccggagagccataggctcttcatcagcctccggtcgtccccagtgccccactccccccgggtcaccatggagggagacagctgccggtaccacttgtccaggcactggatgttggaccgggtgcccacttgctgcggcaggatgcgaaagggagaggtggagaggttggcagagcgtccgacttggcacaaccagagctgcgacatgtaccaggtcgttgacgtgcgttgatccagccagctttgtctcagaataggttaatgcagagtccagaccaacaccctctccagaggtatatctcctaaagtcnnnnnnnnnnattgacgcgcattgatccacccagctttgtctcagaataggttgatgcagagtccagaccaataccctctccagaggtatatctcctaaagtccttgaatacaagagcaagtgtctggtacttgtcctccctgtcatcccatccaccacaaactagcagtaaagccctgctcacgtcagagatgattccccagtcaatgtcgtccagaatgacacggcggctgccgaggcccgctccaactccctcctcctctttgtctgccggagagtcagcacctccattgctgtcatggctgtacgaaagcttctgagctgatgctgcactctccgtcgactgtgaggagaggagtgttggggtcacgtcggtgggcatgcggcagaattccatgtgacgagctccagcccatgtgtagcatcccaagtatctgagggcgccagttccttcagtgacgacgcgcacctgccgcgcctcctcgtagtnnnnnnnnnngtgtgacgagctccagcccatgtgtagcgtcccaagtatctgagggcgccaattccttcagtgccgacgcgcacctgccgcgcctcctcgtagtcggcgatggcctttcgtagccgagcaatctcgtctgccgaccatgggccgctcttcttgtcgctcccaagcctgcgcacatggggagtggggcatgctgaataggtgaaggagaacatgcaccccaccgccgcatgccctgccagaggtccagtggcaaacaaaggcaaaggcaggttcccaagtctatttcgcaaagctcaagtacatcatcgaaggcagttccatccccaacaacgcaccaggcccaccttatttcccgccatctatcccggcacgacaccgccatgcgccctagggcagcctctgctttgacccaggatttgccatgctcctccacaaatgcaaggagcttggcatcctcctccttcgtccagcgtccctgtcattggcacaattcaagccagagctaggccttcatcgatagcatctcgcagtgacggtacgatgcatcaaagatgcccctcgatagtgcacatgacccaagactcccaaagatatcacacagacagccatccctcccttcacctgatagtttccggagtgaagcattcgagtggaggcagcccacaccgctttgatagtccgatgtgggaggtaggcccccaccgccttccacaggcctgaccgggaagcctgggggttgaaaacccagtcgaaatctgtctgggagtggccatgctcccctggagatgttgtgggagtagaagagggtgaatggcatctgcacatgccctccagcataggtacccctannnnnnnnnncagatgttgtgggagaagaagggggtgaatggcatttgcacatgccctccagcataggtacccctagatgggcaggccgatcgcatctgctgacacagcaaaagtttctaatcccacatcatacctgcccacttggcaagggcttggcgaatggtatccttctctgcctgggtgaaggggcccgccttcacgtcgcgccgctggacagagtcgcgccatttcaatgctgcgtccccaggcacctcggcgaggggcatgacgctgacacctggaggatctgggatgaggaaggggtgcgcataagatacaccgacgaccgagcacccttctttctttcaaaatctgtctactgcctggacacttctcatgctggaaacaattccagtgagaccccaactctgtagcaccttgactcggggtttcctcacgcagaggctgcgtccctgccgctatgggaacactggctggggaaggtaccgcttccttgtccaccacacgcacaggcgtgccctttcttcgcttcttgggcggctcgctgggggatccagcttgggaactggtctccataggaggagaggccagccggggctttgcagggaagatccgaccatccttaacctccaaagcacctccatgcctgcattgggtggatgcggttgcaaacaggtttatcgagctcagtgcatcgcctctaacgctgctccatttcggaagattttccccacagtgcaacatgcattgcgaaggacaccattgcagacatcgtacctcttccgactactaatgtatgccttgaactcggcggtaagctctgactttgacacagcatgcgtcttgccggcctccttcacgcagcgtttgatggctttactcaaggtgaggcccctcttcgccttgggcgccaaagcactggccagaataggagcccagtcgaccagggtcatgttggaagagaagcttcgctttacatcaggatgtaatttcgcatattgttgcctattgcttgctgtgaaggaatgctagcaggaagagggcagacactctccgatttcggagcagagcagagcgcagcatgggcgcggagaccaccgaaggctctggagaacacaaggcacgatgcgatgagcaagtgcagcgatcatacccttctccgacatttcaaagtatcgctaccatctagtgtgactcagatcagtacggaaagagcgcacttcgggaccgccagcaaacatgtcatcggacgagttgaaggtgggaggggataccttgagcgcagggcatcgtcaccaaattatacgctgagtaaacgattggaatctatcacttggtgggcattagtgatcacgagttgcatcgccgcctcatccgattgcaggcccagggcaacgctgcattttcggctggcaagtttgtcgaggcagctgacttgttcagccaggccatcgccgttgaccccggcaaccatgttctgtacagcaataaatcggctgccttggtgagtccaaaggggtcccaggattgctgacgcgcgctgtgatgcctatgcaactacgttttcgacgtgcctgacatgttgccagccgccacagcctgaaggccagtacccaacctttttacaccctgatgtgtccgcaggctagcctctcaaagtatgatgaggcactggaggctgctgagaaggtggttgccctgaagccagactggcccaagggctactctcgtttgggcgcggcccattttggtctgcgcgccttccaggcagcatcagacgcgtactccaagggtgagaagtggaagaggggtgtgattggcagcctggaggatgtttgccacgcaccgccaaatcacagctgttgggctgctcgggtgtgatgtaaatctcatcaccgtgactttccacgctgcattcaagttccctgcgatgaactgccacgcccggctgtgtaattacacaggcttggagctcgacccgaccaatgagcagctgaagcagggcttggaagacagcaaggctgccctggcccgacccgctccctcctctggaatcttcacctccccagaggtgctgggccggctggcgacaaaccccactacccgtgccttcctgggtcagcccgatttcatgcaaatgctgcaggagatcaaccgcaacccccaggccatgtctgtgagtagctgcgagggcagattgggagacggagggtgatcagagggtgtggtggggcgatgggggataatgattttggtgggcatgggcagagtgtatgacatcaaatacctgcagggtggtggagcagctcttacgaagtgcaagctcgcaaccacctcccgggctgtcaagaacgtcctgggctgtcaccactacccacctgttacctcgcagaactacttgacggacaataggctgcagcaggcgctccaagtcgggctggggctcaactttggcagcgcagaggaggggtccgccacctccacctcggcccatgccgggttcggccctgagcccatggaggtgaggcttttgggagcagggcctggaagccgcagtcggggatcgcatgcgctccctgtgtccattgagctcgcccgaggagtctgccgacccttcccccctcgataccaaatacaggaggacgccgcccccgcgtcggcttccggggcggcgccgcctcccgaggccagctcccggcccggctccgcccccgccccggcgccgcaacccgaggagccggagggggaggacgaggtggctgcggcgcgccgcgccgcgctggccgagaaggaggccgggaacgcagcgtacaaggcccgcgactttgacaccgccattgcgaaatactctcgcgccattgagctggacgacagcgacgtatccttcctgtccaaccgcgcggcggcctacttcgagcagggcagctacgatgagtgcatcgccgactgcgacacggccattgcgcgggggcgggaggtgcgcgcggactacaagctgatggcgcgggccatggcgcgcaagggcaacgcactggcgaagaagggggagctggaggaggcggtggccgtgtaccagaagagcctgacggagcacaggtttgttggtgtagtttgttgatgaatctggttgtttgtgtgtggggtggggtggggattattgggagttcctgagggcatgggagatgaggcaacgtggaggcaaggagnnnnnnnnnncttgttgatgaatctgtgtgtttgtctgtggggtggggtggggattatcgggagttcctgagggtgtgggagatgaggcaacgtggaggcaaggagcccgcaggtgtacataaagatgaatgaatgcatgacaacgctgctgcgcacagggtacatcgtctgcctggcaagcctaggcgctccacactcacgcatggagacgttaccgcctcccccgccacctccaatccccaggacggccgacacactgaagcggctgaatgagacggagaagctgctgaagcagagggtggagaccgcgtacattgacctggagctgtctgccaaggccaaggacgaggggaacgaggccttcaaggcccagaagtgagcagggtggaaagcaaagggtttgccggcgacgctgcaacacgtgggctgagtgctggattgggtatgggcaggcaaagcgctgttcacttcatggtccaattggcggcgccatccctcgtcccctccgtctgcccgcttccgcacctgcccctgcgccccgatgtgatgcaggtaccccgaggccgtcaagttttacaccgaagtgctgaagcgcgggccggcctcggtgaacgaggaggcctacaagctgtacagcaaccgcgcggcctgctacaccaagcttggcgcctggagcgagggcctgaaggacgcggaggagtgcatccggctgaagcccgacttcagcaagggctactcgcgcaagggccacctccagttcttcatgaaggagtacgccaaggcgcgggcgacgtacgaggaggggttgacccatgatccacacagcgccgagctgaaggaaggtctcatccgcaccatccaggccatcaacaaggtgcgtgaggtggatgattatgctgtgtcgtgaatggtttgatgtgccgggtaaatggcacacctctgcaggcccaggcagtatcacccgcccggtgcctcgcagctcacgaccacctgcggccatgtcaagctatcaataggtctcaaacactccactccctgacctcgccgatcccctgactgccgtccacgcgcagatgacgcgtggggaagggacggatgcggagcgcaagcagcagcaggaacgcgcgatggcagatcccgagatccaggccatcctcaccgaccccgtcatgcgtcaggtcagtagtaagaggctgcaaatgctccgcctgaagagggaccagcgtgcgctgtggtctctgtggagtgggtcgagtcccccttccgagtcctttccctagccccagacaacctcaacccgtcctgcaacccacccccactgtccatcctttcttcctaccaggtcctgcgtgacatggaggaaaacccagcggccgcccagaagcacctcgccaacgtccaggtcgccgccaagtttgagaagctggtggaggccggcatcgtccagatccgctgagcgactgggaggcgctcacaggtatccctccaggcgcctactgggaaggcattcaccccgcgccagcgaccctcgaccttggcaggcaccccatgctgcagcgtgccgggtggctcgtgcacagtcctgcaacgacacacagaagaaagacagggaggggtgcattcttggggggaggtgcagaccgtgggaggcagcatgcggggtgccggtcctgggtgcaggggcgagctccccccgggctgggggtgtctcggagcgtccgctgccccggcgcctactcctcttcctcgctgctctcctcctcctctgcctcgtccagcctggggtcaagaaaagagcggtagaagggagtgggaaagtgcgttgtggtgggcagggtgcgtgatgaagtactgggtctatgggtcaggggtgtgagtggaggggttcctgctttcccatgtgcagctgcgggcaggggggaagagatttgaacctcagagccctctttcctgaccatcgcagcccctctgctgccagtcctgcacgctcagactcgcgatctcctctccacttccggccagaacttttctgttcttcgtcagccttccttccgccccacacccacatagatggtggagcctcctcccacctcccccgccccccctggcacagcaggcgcaccactgcatgaagggctgcatgtcctggnnnnnnnnnnaactcgcgatctcctctccacttccagccagaacttttctgttcttcgttggccttccttccgccccacacccacatacatggtggagcctcctcccacttcccccgccccccctggcacagcaggcacaccactgcatgaagggctgcatgtcctggaggaagacgttgcgccccttggcgttggaccccttggtgtaccagtggcggatggcggtctcgccgatgacctcgcagtcgtacaggatcttgacgatgtccttgaagatcttgagcaggcgcgactcctcgtagcacgtcacctgcacggtctggagcagggccgcctccagacgtggcgcgcgcgcaaagcgcgccagggcgggtgcgtaatgccgcaccgtgcgcagcacgttgaattgcacctgctgctgattgcgcccgatggcggaggccagcacgctgtcggccaggcccaggaaggcggcgcgcgcgacgtcgccgtcggccaggctccactcctcctgccgcgcctgcatggcgggaaccagcgcgcccagcgcggcgccctcgccaccctccgccaccgtgtcgcggacgaaggcacgcagctccgcgcagtgcgcgtcgtacagcttgcgccggctgtactccaccagcgtcttcaggcccgcggcgttgaagtggtcctcaaagtccgcccaggactgcttctgctgcgggaagaactccagcaggcgcccctccagtcgtgccttgcgcagcgtctccatcagcgtctccacgctgtcgctggacaggaagtccacgtagaactcggtggtgaactgcaggatggtgcccttctgcaccaggcggtcctccagcagcgtgggcagaacgcggtcgggcagcacgcccaccttcatgcagaagatccgcgccagcgctgttgggggggagggtggggttgggggggagcggggaggtgaggaaagtgtgcaggagggcagagggaccgtgagcatccatgcttcggcaggctagatgctgaatgctcatcacggcacatggaggagaacccggcgaccgagaagggcagagacctcaaggtattcgctcatctggctcaccgatggcaatcttcttcctgcccaggtcatcgtaaaactccagcgacaggatcagcttgatcagcgtgttctccagcgacttgaccaggaaggggcggcgccggatcatggtctgaaaccacttgatgtagggcacgatcgccgccgtctcggcgggcgacgccaggatctggtgtgcggggatgggccagggggaggggtcggagagggggatggagcatgcacagcagggtcaggcggcccctagagtaggtcaggcaacagggatgggggccgagcaccgatgggcatttggaccaggcatcctcagacaccaatcgcgcgacacctgctcatgcacccaaaaggacatgtccgtttcccagagcaatcggcagctgcggctcacgttaaactcaaggggcttgccctcatgggaaacattcccgccagtggtcaggcgggcccccgcaaaggccacctcaaagagcacatcgccgtagcgagagaagtcaagctccgcgctgtctaggatctgcaaggggtgtgcgagaaaggccttgggcaccaaacggcaggggagcagcctcagccagggcgcgacagccggggcacatgcatttgtgcatgccaccagttacatctccagctcgnnnnnnnnnnacaccaagcggcaggggagcagcctcagccagggcgcaacagccggggcacacacattcgtgcatgccaccagttacatctccagctcgccttgtttgctgcatccagggtgcgctcgatgtcatcagactcctgagcatccccgaggaccgcaatgacagcctcagcaaaggactgcggggggatccgggtgggacacgggcgtcagcaggcagccgacacagatcagcagggtcattggagcaacaatgctggtgtcagcccatgatgcgcgcgtctcctccaagcggcacctggggatcgtggggaacgacgatgttcctcttccttgtcttcagacggacgccactgcgaggagggaggcacatgagggacacatcagagggaagggcagcggggtgcttccacgatccgcggggaccacgcttaggcaggcttcacttacgcaagctggggcttctcttctttcgtactgcacatatggggattgagagcggggtaagatgcatcgcggggcttcagaccaatacgtaagctcatcactacaaggcaggggcctgccggaggtatcacccgcacctcatgcagagtctgggttgcgggggcttttccttgggatgtgagacgtactcgagagctgatttctggacagggtacacactggatgggacctcacggacttgcggtggagcactggaccaccagcgtcggggccagcctcccgccaggtggtgttgccgccatgagggggcccctcgcacgtgagccgagggcgcgcgcgacatgggaggagggccagggcagtcacgccctcacgcgccacatagtgcccctgacggactctatcaagcaagactgtgttttgttacatcataacgtgtcgaccgacacagttcttcatcccactcgtcaccatgcagtcttcagccctgggcaacgcccgttcgggtcagctaaccctcgcagtggctcgcccatgccgcgtgacgcgactccaggttggtttgtagcgactcagtgtcaccaaaaacatgcatggcagcgtatcaaatctcgatctgtcgctcaatatctccctatcccagcacccacctcttgtatttgtaccaacaggcggcgtgttcctccgggacccctggattctggggccagtaccgccccaatgccggcacaaatcggcccttcctgagtctgccgaagcttgagagccagcaaaagcctgtgaaggccagcacggacatagccttgccgggcattgggggtggggacagtggacttggcggtggcggcgacggcactggtggcaggggtgagggcgccggctggaacgaggacgacggcgaggagtacctcaacctcgctcaggtagggcccgcgtggttgtgtgtgactggcagcgacggcgtcgcgtaggtgcagccctccaacagatgcctgtcgatgcatggctcgggctgccaggccctgtctcctcccaggagccctgtacttcttgtacagtttcagaagtacatatattcttcagcgcctcgtacgcatgctcccagcgcatggcagtggtatattctcgcgccctcctcgctcgcaggcagaggagctggcggctgccaagaacatcaagctgcccgccgactttgcagccgccgcagtggaaggaggcctacgtttgtccaccctgcagcactatatcagcctgctgtccggcggctggctcacacgctggctggccagtactattccagcattccgggaccggctcattgccgaccgcatgttcctcttcaaggtcctggccgaggtcaccatcgacacaggtgtgcctgcctccaccgtgcacctggcagttggcaggggtccccttgatactgaccgacaggttacggttctggcagaaaggggggcgcagataggttcccccgtgattccccccgcgctgcctcgggccctgagcttggtcgtgagcaatgcgatccccgcagcgcttcgcctgcggcttgcaacacctttgatctcccacgcaccgacatgccctccacagggtgtgcgaccgtggctgaggtcaggaagcgtggcgacgagttctggggcgagttcgaattctacctctcggacctcatggtgggcctggtcctggacgtcgtgctcgtcggccttctggcccctgtggcgctcaagggccgcaagccccgcgcccagaccggatgtgagggcgcgtgtatgatgtccatgcatgctgtggcgtttgggagggtggctgcgtgctctgatgcaggtacatgccggccatggggcagggagggggaggtcggcccgtcagggagggctccatcccttggccgggcagctggcggtggggcctgcactgccccatcgaaacacgccgagccatgcacgccacccaccgcgccgctggacagggatcannnnnnnnnnaggtcagcctgtcagggagggctcaatcccttggccgcgcagctggcggtgggcctgcactgccccatcgaaacacatcgagccatgcatgccacccaccgcgccgctggacagggatcaagaagcggctggccgcgctgccatcggcggtgtttgaggcctccacccccacgcggccgtacaccgtgctcagtcgtctgggctgcctcggggtcaaggcgctggagtactccctggcaggctttgcatgcgggctggtcggccagggggtcgccaactccctgatgatcgtgaagtgagagtggtggaagaggttgggctggtgatgggacatggtatgcactgtggcctgtacctcttcaccgggctggctgtggtctgatgagccgtcagtgatcaacctggggcagcatcagcgcatggtccctcaccatcggtgctccgagatccctgcctgcccacccctacctgacccggatccaccctcgcaccgaacaccaggcgcaagtaccagggcgccagggaggacgacgtggctgttcccccgctgatcggcaccgccttggtctggggtctcttcatgggtgtctcctccaacgtgcgataccagacggtgtttggcctagagaggctggtggagctcaccattgctcggcgattccctccggtgcgacaggaggggcatggggggagggcgtgggaaggtggtgctgctggaacaccacgagaataccaatcatgtcgacaggctcccttcaccatcagcgacgcctcacatacccgccctgctggccccgcagattgcgtatggcaccacggtggccatccgttttgctaacaatgtcattgggggcgagcagtttgtggacctggcgcgctgggcgggcgtgcagtgagacctccttgcaagctcagaacctgtcccttaacagtgcccatgggcagccccgatggaggcccatggccttcccgtgtcataaattcctcggagcattccgcgctacattttatcttgctcttccccccgaagattctcactgcagaccacccgccgtgctcctagcattcggctcctctctcttcatcttgtacaattgctgccgcgcccacgggtcgctggttcaaacgcgagggatctgtccgtaatcacagatgagggcgcaaacagtgcttcaagaccagtttcggagctagaggggacaatgtaatcatcgatttgtgaaatctcgccacatcgcggcgtgaaggaactctccatgctgtcggtgggttcgtaacggcccaatatttacagtccgctaggagctccgagatatcccagatccagccatacacctttggaaccaccatgtcgggtgaatctcgtggcaattgaccgtcgaggatatggcatccggcggttcccaggcccagtccgcctggatggcgtcgtacaaggatgccagggcccatcacgcgctcgactcggccttccacaagctggagggtcacatccagtcgcacacggccctgctccagaagcacgcccagatccgcgtggcgaagtggctggccaaactctctgaagaggtgcgcagggcgcctgcctgtacatcctttctgcgtcgcaccaagttattgccttgcgcatatatacaaacaccccgcacaacacatcccccagcaaccgcacacagacggccaacgtggtgtggaagcgcaataggaacgcctgggcgcggctgctgctcgcccaactccgctgcgggcggcttgaggaccccttccacctcctgcctccggagacggccctcccccccgtgcccaagcatgctgtgttcacagccccggcatgcagtgcctcgacatcccggactccagaccgagcatcgccgagccagcagcccggcaggccggcgttgctcgatactgcagagagctcggcgccctctgcgcctgggcctgcaccgcaagctgctccggtccacaccatcgtcacgctctcctccgacgcaacagccagtcccagccaggagttgcaagcctacctggacacccagggcgtccatgtcccggagtccgaccattcactgcggagcacatgccccggcacacgcatggggacgcaggatgcagcagccctactaacaagccctcctgcacagggtcccagcccnnnnnnnnnnacatggggatgcaggatgcagcagccccacaaacaagccctcctgcacagggtcccagcccagatgcaggcggcgaggagcacgggatgaccctcgccctggtcttggcccgggaggaggttcggtccctggagtggcggctggcgcagacaggcgctgcgctggccgcgtccaggcgccagggcgcgcacgaggcgccgccgccggccgagcgcccggtggccgggcagggcgccggccctgccggtgcccgcagcccctgtagcgccggccagcagcattcgcgcgggggagcaggggctgccgctgctcggcctacggacccggccggtgagggcctgcaggctttcgcggcacgcacggcagccctgcgccgggagctggacgggcgaggccgagtgccgtcgagcctgagctcccggaccctgctgcacgcctcccccgcccagcagcacccttttggcggcgggaggctggcgggcgtgcagtcggatgcggggccccagccaagtcggtcgagcaggccggagccttcatcgagggactgcgcgggggggggctcgcaccggcaggcgagccggagccgcggcgaggcccctctgcagggtcgctcgcgctcgccaccccctgccccggccgtgaggcacacgctcaagtccctggccggcgcggtggcggcgcgcagcgggccgcagggcagggccgcgcagggcgcctggaaaccccacccccttgcctccccggcggcgatgcaggcgcacgtcctgtcgcccgccacaccgacggacggcggcgcggcccggttcccctcgcccgcgagtcggcgggaggttgagtgggacccgcccgaggtcgcgagcacggccagcctccnnnnnnnnnngccgacggacggcggcgtggcccggtccccctcgcctgcgagtcggcaggaggttgagtgggactcgcccgaggtcgcgagcacggccagcctccagcgacgcctggcgcgcagcatcagcgacatgctgctggtcggggtggggtcgccggaggtcggcgccaagcccctcagactcggccagaggctgtatggctgatagaaagggcctgccaataggcgccgcatgatgcctgggtgagatagtgcgggcctcgtcccttcctcgaacccctgcatcaccacgaagtgcccttgactgacactgtacaaagcagaaacacctgtacgtcacacattcattggacatgcacactggcaggctgctgccgggcgccaaaagtacgcagtcaattacaaaaccgaaaacttgtccctatccgctgccatgggcgcaaaagtggtgctcagcgcaaggggtacatgcccccctcacttcttgtccccggggttgccttgcagctgcttgacaaaggagttgaagtccaggctcttgccttcgttctgcttcagcacctgatccacacgctcagatgagaacatcttgcgcagctcctcattgctcatgcctgccgtgatttggtgtgattggtgtcgggtgagagacttgaagggctgcaggaatgcgcaggtgcttccctcacggacccttgttccaatctcagccccataggcttcaagcgagacctgcctggcggtgcannnnnnnnnnatgatttggtgtgatgggtgtcgggtgagagacttgaagggttgcaggaatgcacaagtgcttccctcactgacccttgttccaatcacagccccatgggcttcaagcgagacctgcctggcggtgcagctgctggtggaggagctggaatctcctgggagccctttgactgcaggtgctgctcccagattgtcccattcttgtcgccctcgccagatcccactgcacagtagacaatcgggtcgtatgaatgctaagctcaagccatactgagtgatgctgcacagccgaagcatcgctgcacacaggaaatactgtagcagtaacactccccccgcccaccatatcctatcaccaggttaacacaccgttatcaaagtaggagcccttccggttatagttgcgcctgcgattccggggacagtgggatccctaaattcaacaatctggggcgccacgccctgccaaccatgacgagcatctcgtcatcgcctggcggccaaggataacccaaatagaccttacccagggttgaannnnnnnnnnagggacagtgggatccccataattcaacaatctggggcgccacgcgctgtcaaccatgacgagcatctcgtcatcgcctagtggccaagcttaacccaaatagaccttacccagggttgaacacgtcctgccatgtgttcgtccgaggactcgtagcggtcgttgggctcacaggagtgcctgcatctgtcttggtgtcacctgctggggagaaatcgctgagtgaatggtcccgatggcgcagggtggagggccccgtcgccctggcgtacctcgaccagacagcctcttcagagattccaggatggacatgatcgctctcctactaccctttaatgcggcttcgttaagcttttactggtggagtttgggctttctctgcaggtactttcccgcacgatgatgtcgaagcaccccttcacaattccgagacccagctcgcatctcatcagagtcacggaaagcaagaatgcgaaacaccctccgtgtgttctgctccagcaagacccaagtgctcggtcatccacttggctgctatccccatacctcaattataaaaccatgcacaagcccacccacgtagtgtgagcagagtcaagccttccccttcttcgctcgttttgttggtggctgggcaagcggtgcccctgcatcggcatccatgggagctgggacacgcttggtggctcccgtctctggcnnnnnnnnnnggacccgagtgctcggtgatccacttagctgctatccccatacctcgattatacaaccatgcacaaagccacccacgcagtgtgagcagaatcaagccttccccttcttcgctcgttttgtgggtggctgggcaagctgtgcccctgcatcggcatccatgggagcagggacacgcttggtggctcccgtctctggcccgaggatggaggagaactttgcggctgtcttggcgcgcagctcgtccagtcctccgtcctcagcagccacctctatgactaaccgacgcccgtagagatgcgtgccctggacggcctccacagcgttccttgtttcctgcttgctcgaaaactcaaggaaggcaaagcctctgcatgacgggaaggggtaggtgctctatagtgctcccaggggtcgggtggacgttcgaacaagatcgacaggcacaggttcataccgagcaacgagcttgcacatggcaaattcagccttacgatagagcctcccagttcacaaccgccccaccccgacctcttccctacctgtgggtgccatcaaatttacgtggcagcctgcagctcttcacgtcgccgaaggaggagaagagcccgagcacgtccttgcgggtggcctcaaatgccacatttcggacgacgatcttggtcccaaggttggcgggcacaccccccttgccctcctgggcgtctcgcttctgagaaagctgcagcatcagcttgtggccatccagaaccgagccctgaatgcaggaaagaagggaagaagagggtgtaaggatgccatggttgtggagcgcctcgtgcaaaatcccagcttagccacacggaccttgagcacttccccacaacacatccagacgatccctgttttttctatctgcaagaacgcactcctgcacgaccctgtccacccacctgaagcgcttcaatgagttccctggcggccgcctccgtggcacactccacaaacccgtagcccgcagagaggggcttgccgtccggccccgccttcnnnnnnnnnnccaataagttccctggcggctgcctccgtggcacactccacaaacccatagcccgcggagaggggcttgccgtccggccccgccttcctggccacacgagcgctccgcagggcagcgcccttggcctccgcagcagctgcaaagtgggcatgcaagcccttgtcggtcgtggcccaggccagattcttcacgtagatgctgaccgagtcggcctccgtgtcttccggaagcactgccgccgccgccgtcgcctgcagcccagcctcgggctttatggtggggctggtggtgagcgtcgcagctggcaccgccttggcctcgaagacctgtgcatcgagcaggaagggcaatagtggtgcacagcacaagggttccgctgcaccgaccaggcggctggcgactgctttgggacaccggttgctgtcattctgccctccctttccatcgcttcgccacaaattgtgacgcagcccggccccaggccgcatcgcccccctccatcacacaccttggcagcctttggcttgggggttccggagaatatggagcgcggggcccactccaggtacagcggcacgtggtggtagggcttgtacgccaggcgccggaaggcgcgcttggcgtccgaggcgtcctcgaactcgatgacggccagggccttggtgtctggcagcacgaatcgggcaacctcacctggcaagagaaggacagggaggggaccagggacaggggagggtggggtgagggcatgaaggaaagcgtggcaatgccggcaggcgaagttgaagtgagcctcaaacatactgcgtgaccaatgttttgttactcgatcgagatgaagcccttgtgtccccattgtacgaacatagcttgatattcagaccctcggtcacccccaccacccgctcaccgctctccgcaaagagggactgcagctcatcttcgctcgtcgaccagggtaaattcttgatgaggatagctcgatcgctgcgggccacatcgggccccttatcctgctttcctgctgctgcggcggctgcctccagggcatccacgtccacacctggcatggagtggatggtgtagatggggtgaagaatcaaggctgtgaccatcagttcctttgcgcccggtcagggggcgggctggaggaaagctagacaccctgctgggtgattcccgtgcatgtgcaggagtactctgccatccgctgcccccctatctcccacacctcatcggaccccaaacacatcatcagtccccaaacactcccaaacgccccagcctcccatggtcacccaacccccgcagcacctgcgtcggacagcgcggccttggtggcggcaaacacctgggcctcccccagggccatgcgcaccgccacatccgaggactcccggtccagcagggccgacttggtgatgccaaagtgggcggccaccgcctcggccaccgtgtcgggcctgacgaacagcgagttccaggcggcgcggttggtccccgcgccggccttcaggcttcgcgcccgttcctcctgtataggagagggggagtggtgatgctgggaggagccgctcgtgagtgggatggggaggcaggggagggcgacatcgcgcgctgcactggctgaagtccctctgtgctgcggctagccaagcccggggactgcaacacccgcctgaccggcctccccatggaggtcgccctactactgcccagcaacaaacccaggctccacctcaccttgaaggacttggcatcgctgggaccctcctcctctgtcttgggggctggcctgccgggcaggacgtggaggagcctgccctggaagatggcgccatcggcgcccgcctgcgctgcaaccgctgctgcgggcgagctgaacagcacgtgcgcaaagcccttgctctgccgtgtagccctgggcgggtggagaggggttttggcaggctgtcagcagtgaggatgttatcgacaggcacagaggagggacaggcacagaggagggacacagatgtactcctgcacacatttccatgcatatgacgcccagatgagcagcgcgcaagcagaccagcattccattagacaccgccgggggttggaacatcgaatgatcatgaaagcgagcgagggccaccccacgcacgccaagctgcaaacctgtccttgacgatgtggacctcctccacctcgccataggcagtgaatagctccctcaactcatcgtccgtggcggcatagggcaggttgcgcacgaagaggcgccctgtgtccgacacctcggcggtccgggaggcatgctgcatgccagggtcgggctcaggcgcgccctcgctcgccgcatcgtcaccctcctcgtcagaagcagcatcgctgccgctcgtccctgcacccgcctcggaaccccccgatggcccggtggcggcttccagctcctcctcgtcgctgtcagcggcgccagtggactcctctccctcgtcctcgtcatcactgaacgcagcctttcgccgggccttgaggtagtccagatgggacacggtcgcgtccacaaccagccggtctttctcagctgctggaggcgcagtctcgtcaccttcctcgtctgatgagtcactcctgcttcctgctccggtgcccagccctgcaatcgagatccggggtgcagcaagtcgagcacagacctgcagtctcgagttgtccagnnnnnnnnnnagatgagtcactcctgcttcctgctctggtgctcggccctgcaatcgagatccggggtgtagcaagtcaagcacagacctgcagtctcgagttgtccaggctttctccatctggtaaggagaggaagacaggcagctgcgacaaccacatccctcgcaacctcactcacgctccggcccacgtctcaccttccaggtcctcatactcctcgtcgtctgatccttgcacggcctgttggacagcagctgcactggcagacccagccgctgccgcgacagcgtcgtcgttggaccaggtggctttcttgctccggggtgccatcagctccaggaactcagccagctttgggtcggctgtgcagcatggagccaggaggggccagctggttctctgggaacactgcttgccagaggggtgcaaagcagcaatccctctgtcaccccagatcacaacccaccctcttcgggagctttcttcccggcagccgccttcgtcttggccgccttgatggcctcccgtgccttcagaggcgcaggctccacatcaggctttgcggcctgagacttgtcatgcgcgctcgagccgggcgtgtgcttgctccaggggcggtgctccgtcgcagcccggccgtactgctgagcatactgcacgcagcatgtgccgaagagggagcacaatcacatgcaagcccaagttgccacgtgtgcatgcaggtcgtgtgagggggnnnnnnnnnntccagctgaaaggtgtccatgtagcttctgctaaagtacttgaaggctgccacggcatcgtccaacaagcggtagccaatgaacccaaagcatcgagactttccatccctgtgaatgtgctagatgctgtgtcagggagggcggcttcccagtggggagcgggccattatatatcgcagcacagacccatacagagcatcggcagactggaccgggcagcttcaagtgttnnnnnnnnnnttggaatccttgtttaaacctgtgagagggtgcacgaacagcccccagctcatcccagcctcccacctcgatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccagtatatctggcagcacagacccatacagagcataggcagactggaccgggcagcttcaagtgttgcgcatagcagcgtgctccagaattctaccttgtacgaacgattttggcgtctgttacctcgcccttggccgaaaagtgctctttcagtcgagcctcgtcgacatacttgggcaggttcttaatgcagagtctggagcagggggggcgctctacagctttctgtggatcgtcttgggtctccatactgctcaacaagcgcttagatgtccaaagagggtactgcgcacgcttcgaacgttactgcctctccaaagtcagacggtgccgtctgcatggagcgtcgtcacgcatgcataccgcgctcgactttcgctcgggagttgacgaattggggatagatatacatacatgtgtcatgcatgcgtgtgggcatcaagttcctgctcgtgcatctgcgagacgcgcgaatcaggcgccagcgcgcagacatggaccacggccttctgacagtaaatactcggggtcttgccagaagcatgtctctgctcccatgtcagccgaagaataaactgtatgtatcacacaccctattccattctagacaaatagcaacgcgcttcgtactgaccagagagagaccccgctaaactctcctgttgcctatcgggttgggcggcccttactnnnnnnnnnncataataaactgtatgtaccacacaccctattacattccagacaaatatcaacgcgcttcgtactgaccagagagaggccccgctaaactctcttgttgcctatcgggttgggcggcccttactggcctgcagaagtagacacagagcgacatgggaaaagcaaagaagacgcggaagtttgcggaggtcaagaggatgatgagcctgaaggacgtgaaaccgtgagtgtcggcgtgggcgctccgcttgttgtatgctatgcatgtagccttgtgtccaagctctggtcctgcttcctcttgccacaggcctcctatgaagaagacaaagccagaggatgaggttcgacacatgtacgacgtgcagcttttatctttcaggatcaggagtgggtgttcccgagcgacacagcttgggtctggagaaatctctgtcatccttatcatacaaccctctccccctccaaccaacacccatgcagagataaaacgccatcagctctgttcttcaggtacaatacgcagctcggaccgccctaccaggtcctcatagatacgaatttcatcaatttctcaattcgtaacaaggtgagatggaatgctttgagatcggtcgttgtctcacatggctgtgttccatcgcagtgatgacaagcagtgtgggactcgctggtgagcagtccagcggctcatnnnnnnnnnnctggagtgctttgagatcggtcgttgtctcatatggctgtgttccatggcagtgatgacaagcagtgtgagactcgctggtgagcagtccagcggctcattctcggacaccccttcaacctgtcagattgacctggtcaagggcatgatggactgtttgtatgcggagtgcaccccatgcatctgcgactgcgtcatggcggaactggagaaactggggcagaagtaccgagtggcgctcaagattgccaaggtctgttggtggagctggtgtgaaacgcttgcatgaggagtggcatctccagctgagttccgcagtgagtcactctgatgctcgagctgatggcttgcttaggcccatgacacctacaatgcatgcaggatccacgatttaccaggctgccctgctcacacaagggaacgtatgccgatgactgcatctgcgacctggtgaagcagcatagatgctacattgttgctacctgcgatagagacttgcgccgccggatccgaaaggtgtgtgtgtggcttgctctctggtggagnnnnnnnnnnnnnnnnnnnnnnnnnnnnnnnnnnnnnnnnnnnnnnnnnnnnnnnnnnnnnnnnngctgcatggcgagggtggccgagtgcgctcttgttgagggctggacatctcctcctgtacacgacccttttgatccagctcctcttgtccctcagagtccctcgaggcttgattgcttttgcccaccttcctgcacacagattcctggagtgccaatcatgtacatacagtcccatcgctactcgattgagcggctgccggaggcaacgatgggtggtgcgcctcgcacctagggcgcttggagatgcaattctactgccatttggaggtggcgtgcggtcaatgacctgacagctcttgcaagttggatacacaccttgcacatgcaatcgaccccgccttctccaatgggcttccatactaaaagatacattacagcgggtgaagagacaatggtcaagacctagagagagtgcaaggggtcccacagcaccggcgcacgcatgccagcatcccgccacctcaggcttctttgagatccagctttcgcccactaccatggggtcgcagtcggagccaatattggcggaggcgtgagtaccaggccctggcgctccccgtgtacccagccggcatgctctgcggcgcgattcataaggtgcctcgcacccggtgcaggcacaccgacaaggaggagatgatgagcagcacggcgtagatggctaccgccacccacaggccatgctccgcagccgccctctgttctgcaatgggaaccgggggctcaccgccctcacccttgggctcaaaccattcgccgacgtagctataggaacgcggggaggggggaggaaggtttaggggcgatgctgtttccctcatgagggaggaggtatctccgtgcgcagcaaggtgcagcggcgaaagcgatccgaccgcactcacgggtagtcatttcggatcaagatcgcgaggaaggacaggaacgcgatgccaaaagccgagagtgccagcccaaagacggagcctgtgcggagtgcagggctgacgaggggggtcgagggatcggcaccaacacacacgcgctccttactgaaagcaagcatcctcaacgtacctattgggccgcacatggtgacggctcgctcctctgtatggggcctgggttccaactattcccctgcgggttcccctccagaagcgtgagctgaccggaggaactcggacccttaagctgggactcttggtttgctatcttttcttatttgaagcgccctttgtggatgcgcgcaaggacgacgctnnnnnnnnnngaggggggtggcaaagtgggaatgtaagtatgcaatcatggcatgtagattgggtaagcatggccatccccatcccacctatgctagcatgtgnnnnnnnnnngagctggaactcttggtttgctatcttttctgatttgaagcaccctttgtggatgcgcgcaaggacgacgctgacttcacgcatgccctgcagatccagaccgagagcgcgatcattcgccgagcgcgcgctggttctccttggcaaaccgtgcagggnnnnnnnnnnnnnnnnnnnnnnnnnnnnnnnnnnnnnnnnnnnnnnnnnnnnnnnnnnnnnnnnncattaccagtataagtgaagcaagcccagggcctgcatacacctctgagagcacgacgtctcagataaagagggctttgtcatttaccgcgcctgctgccattgcattgacgccagagcatggtgagttctcctgaacatgccctgaggtgccttctgacgtcatacacactggcctttggccaatgcatgggccttgatatgacagctctgtgacttttgggttaatcaggaggctctgnnnnnnnnnnaaggggtgtggcaaagtgggaatgtaaggatgcactcatggcatgtaaaatgggtaagcatgaccatccccatcccacctatgctagcatgtgnnnnnnnnnngttttcaacaagagccatagagcagccggtcccaagcttttcgtcccttgaggactgcttcagccctgcatttgaaatctggnnnnnnnnnnatgttcagcaaaatccaaagagcagtcggtcgcaaacttttcgtcccttgaagactgcttcagccctgcatttgaaatctggagcttcagcgccctatgcagcgcggcacgtggctatgccgtgcgcgagcgccaagtccgtttccgtccctgcgacgttaatgctgcccatccgcgggcgtactcggcagtgcattccgcattcagccccacgaggccaccgcctctacaccttcacaatcattcaaagactgccaggaccagccgaggctcgacggcccttcctctcaacattatcccccgacgctcccaatcccaatgacgacctgcatgcatgtaccattcagcaccgcgagcagccaccgcggactcagtgcggcggtgcgcggctgctcccacgtcggcgggaaggctgtgcggcaggtggccgcacggtcaccattcctgcagggtcctagtccggtgaggggcagctgcctgaccctcagtccccctgtcaggcagttccagtccgcgcatcggccccggactcgcgcaccacggtgaatttggtgcctggctactgggccagggcggcgtgggagagagcgccgtccctctgaagatgcctccgtcgccagctgcatgtgcctcccccgtgacgctgctggcacatcatccaacaccttccacccctgcaatgcccagggacgtgacgcgtgcctgcggcatcatnnnnnnnnnnagcatgtgcctcccccatgacgctgctggcacatcatccaataccttccacccctgcaatgcgcagggacgtgacgcgtgcctgcggcatcatcggcgtgtcgacgcaagaaagcgacgccaacctggagatctatgagggcttgctcatgctgcagcaccgtggccaggactcagccggcatcgtgaccacggaccgcacccgctttcacgagcacaagggcaacggcctggtcaaggacgtgtttgacagccaggacgtcctggggaagctgacaggtgggtgtgatgggatggggtggagctgggggggatggggtggagctggggggacggggcgttgtccatcgcatacctcatcggcggcaatggatgcttgatctggtcgagtcttggtgcgctcgcaagagtcaggcagatgaacctcccagcagctcgatcgatcgatgcagtctcccgccaatcaagataaacactcatgcacacacgtgcaggcagcaccgggctggggcatgtgcggtaccccacggccggctcgtcctcggtgcaggaggcgcagcccttcttcgtcaactccccgctgggcatctacctgatccacaacggcaacctgaccaacacggacgcgctgcgcacgctgctgaacagcagcacctccttcttcaaccgctgcatgcgcaccagctccgactcggaggtcctgctcaacgtgctggcggacgagatccaccgcgcccaccagcgctgcttgctggaggacgcctgcgaccccaaccgcaagaagctggacctggtggccgaggccgtggcggccaccatgaagctgatccagggcgcctactcctgcatcgccctcatcaacggcgtcggcctgctggccttccgggacccgcacggcatccggtgcgtggagggtatcgttgatggtggtgggaaggagaggggggaggaagggggatccaaaggggggtgagaggtcagaggaagagcgcggagcccctgtcccatcccatgcgcctgtcgtcccgcacatgccatgtcgatccgcagggtgtgcgccnnnnnnnnnngaggggggagggggatcgaaagggggttgagaggtcagaggaagagcgcggggcccctgtcccacccatgcgcctgtcgtcccgcgcatgccatgtcgatccgcagggtgtgcgcctgggaagcatgggcccggtctccatcccctgaccatcccaccacaccccacccacccccccaccccaaaggccgctggtgctggggaggcnnnnnnnnnnccccctgaccaccccaccacacacgccccacctcaccccaaaggccgctggtgctggggaggcgcgtggggcggcgcggcgaggagtggtgcgtggcgtccgaggactgcgcctttggccccatcggctacgagcgcgtgcgcgacgtcgcgcccggggagatgatcctgatcgacgacggcgggaacctggtctcccgccagtgcacgccggtgaggggccggcaaggctgttgggtggtggagcgggggagcgtcccgtggaggggtggctgatgcaggcggaccttgcagnnnnnnnnnngcggcaaggccgccgggtggtggggcggggggggcgtcccgtgcaggggtggctgatgcaggcggaccttgcaggacccagacttggcctggtgctggtggggccacgccgatgggaagcttgcacccatgcgctcaccggcagccggtcgtggatcattggcggtgggcggggagtgccgacccggnnnnnnnnnngctcggcctgggagctggtgggcccacgccgatggggagctcgcacccatgcgctcaccggcagccggccgtggaatattggcggtgggcggggagtgccgacccggaaggatcatgtcgaccatcgtcccccggaaccagggccccgctccgactcacgatccccacccaaccccgcccccccgcagctggtgcccgcgacgccctgcatcttcgagtacatctacctagcgcgccccgacagcgtgctgaacggcatctcggtctacaacttccagctgggcctgggcacgcgcctggcggccagcatccgcgcgcgcggctgggacatcgacctggtgtgccccgtgcccgacggctcccgccccgcggccatccagatcagcgcggagctggggctgccctaccgcgagggcctggtgaagaaccggtacgtgggccgcaccttcatcatgcccagccagcgcctgcgggaggtgtcggtgcggcgcaagctgaacgccatgcccgcggtgttccggggcaagtcggtgctgctggtggacgactccatcgtgcgcgggaccacgatgcggcagatcgtggacatggtgcggcgcgcgggcgcggcgcgcgtgtacctggccagcgccagcccgccggtgcgctaccccaacgtgtacggggtggacatgcccaaccgcggcgagttcgtggcgcacacgctgagcgaggagcaggtgtgcggcgtgctggccgcagacgggctggtgtaccagagcgtggaggacctggtgggggtggggcgcgagctcaaccccgccatccaggccttcgacgactcgtgcttcaccgggcgctacgtcacgggggacatcaacgagacctacatgcgcaacctggaggaggcggggcgggggaaggaccgcggcttcaagcgggcggggagggcgggggcgggggacgcgcccgccaccatcatggcgtgagcgcgatgcccctggcatggcacccccatccatgctttgctgtacacttgacacactctgggagcagggaacgaccactgacacggcagatggtgcggggtgggcgcagtgtgggtggggccacccgaccaccatggcagcagccggtgtcgctgtgacggcgggggacgacggcgaaccccccatgcaatcgaacgaacctgcacctcccatgaccgacttcctgcacggcgagggtcgtggacctccttcacgcgcgagaattgccgtaccaacccaagttcctcgacgtcaaaaggagcccacatcggacttgcgagtgctgctcgtggcagnnnnnnnnnntggggacgacggcgacccccccatgcaatccaacgaacttgcacctcccaggaccgacttcctgcacggcgagggtcgtggacctccttcacgtgcgggaattgccgtaccaacccaacttcctcgacgtcaaaaggagcccccatcggacttgcgagtgctgctcgtggcagggatcgcgactttcattgttcgccaaacccatgggtttggctcttctctcactcccgaggcacagctatcttcagccacgcctctcacaaatgccctggcaccgctctatgtcctcaagctcaccccggactccggcgaccgcattcacaacggagccactggtgcacgacataagaatggggctcaaattcgtcatcaagaccacgatagatgaatggccaccatcttgcgagatagttgatgcctgtgtggcggagcataccgtcggaaagcgggagattcggggtgtttgctgaacacatccatgccaggcccacactgcattcnnnnnnnnnnagcattcacatcggagccactggtgcaagacatacgaaaggggctcaaattcgccatcaagaccacgatagatgaatgggcaccatcttgcgtgataattgatgcctgtgtggcggagcataccgccggaaagcgggagactcggggtgcttgctggacacatccatgccaggcccacactgcattcnnnnnnnnnngcgttcttcaaccaggtgcctgcccgcgtgtgtatttggtgtgcaagtgaaaggtgtgaaggcgagatgggggtttcggtgaggatgcattacgggcccggtgtgggtgtgcccagcaggtgctgcagatttccgcttcacggcggtatggtctgccgtacaggcatcgatgaagatgcatgatggatttcacatcagctcccgtggtcgtgatggcgacttcgagccactatgttgaggaatacagatgatggccatctttgtcctcattggcatggcgcatgtacggaatgggaaagggttgaaagcggtggtcaccccttggtcccgcagcagctacttgaagatgcacagatgtccgcagcccgtcttgcaaacacctcccttacctcattcgtagactgctgtccctgctccgcggcagaatgtacggttacggttggtacgttggatcctcgggcgcacacaaggtatactgtcgcggccggacttaacggcagacggggtgggaagagttggtgacggtgggtaagcaagcattgaatggcgcaagccctgcttccagaagcgcacgtccgcaatgtacggccattctacccttacaattatttggtgactgtcatgtccaggcgtgtgccctaggactcgcgcgagccatctggcttcaagcaggtttgtgttggtgccgacttaagagcttgaattagatcggcccatcgaggatccatgcgcgggaggtttataactcggtgtacattatgagtacatgatattggatacgtgagagatgtggggttccatggtatccatgcatcctgtgccacccgcatagtacccgggagttgatctgggaggaaagctggacttgcgtcatcaatcnnnnnnnnnnttgcagcccgtcttgcaaacacctcccgtacatcattcgtagactgctgtccctgctccgcggcgaagtgtacggttacagttgatacgttggatccccgggcgaacacaaggtatactgtcgcggccggactcaacggcagacggggtgggaagagttggtgatggtgggtaagcaagcactgaatggcgcaagccctgcttcctaaagcgcacgtccgcaatgtacggccagtctacccttacgattatttggtgactgtcatgtccaggcgtgggccctaggactcgcgcgagccatctggcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatccatgcatcctgtaccacccgcatagtacccggggggattttgattggggaggaaagctggacttgcgtcatcaatcgacccgggaacgagtatcagggggcataagtccaccggtctctccgcccaacctcgcagtttggtccagcatttccgtcggctgggccgcggaacctggtgcctcgtgcccatgacaaggtctaggaatagggggaagacacctccgcggacggagagggactccgcgacgctcaggacagatgtcgaaccacgacgcggttttgttccgcttcgcgctacagcttcgcgcgctgctacttcgtaagctggagcttctcgcatgcaaggtgaggagcgggaaagcgttgggagagtgacggtgacggggtgtcagctcccggaagactctagacccccctctgggtgttgccaagctgtcccgtgagccggttccctccccttccctccactgcagagtattcaatcaacatttactttcgcccacaccgtgtgccgttccgcgccgtgacgcagcaggcggccctttgggcgagcacaaggtcgacctctcgaggtgtcttcaggccagtagccgggagagggatgcgtcatgaccaggaccacaggaccccagagcgcaaggagacggtgcagcgacaatcagtgccaagcaggacacccgggttgacccttgggaggaggcggtggacacgcagttgggccacagacaatattgggttacccctgtcaccagagtcaagtttcagtggaccagtactgcttgaggagcctgcgccgcgccagcttgccgccccccccgcaacctacgccatggcctgacccaacggagcaccccgcgccgcccctgagcctgctgagcttcgcatcgcttcccactcaaccacaaccgtcctcgcagtcgtcagtgccagacttcgttcgtggagatcaggggaccaagagcagacctcactcaggagtgctagaccactttcctgtaagctgctgtttgggaaggaggctgcccgcccctgcctgcaccttgggagcgcctgcctgcttcgcaatgcggatggcctgtgctgagctggtttgcccaagctgacgctggacgaggtctggaggagcgctggaggaggcatggaggagccagttctaccttacgcaagcctacggttgagctctgccaaaggtgttgtcctggacgttcggttgccctgcagcaccgcgcccgcaccnnnnnnnnnnagtctggaggagcgctggaggagcgctggaggagccagtttcttcttgcgcaagcctacggatgagctctgtgccaaaggtgttgtcctggacggtcggttgccctgcagcaccgcgcccgcacccctcttcccccagccaccctcgacacagtaccaccggtctcacggcgcaactttcgagtcacttgtcacactggacagcagcatcggtcagtcggtggcggtgtgcctgccagcgtctccccgcgctaccccccttcttggccaccctccacctgcagtcagctggcttccgccgttccttcaccaaggctccagccaccgcctcagccagatatgtgttgcacttttgcatcgtgggccccatgcttggccacactgcttgcacgtctgggcccccgttcgccccacactccccacagtttgcatctgctccgtgcgagatcccactgccacacttggcgtcccgcgcttctttacagtacggtctggagtcggtgacctgctctcgggatgtggtgttgcctgctgcacgcccccctcgcacgcccccctccccatcgacccagtcttgtgcagtccagcattgctagacggcgtcttctacacgagtctgatttgcctcggtaactctttgttgctgcctgcatggggtgaatcacgtatcttctgccgccactgctgtgcgcctggctccgtcgcccccttttcccctcccagaagaaacggccttgatgcccggaggagtgtgcttgcactgagacgatgagggtgtcccacttgtgtagggatgtgtggcaggctgctcccagcctccacccaaactggtgcttcttagcgccccatttcgacggaagataacttttgaccattgcagtgcaattgacgtttcgtcaggtgctgatatgcccacactgctttaaaattacatctggccatggcgcaactggtggtcaagatcttcggcagtgagctggcctggaagccgccgcagtccgttgaagatagaatatgcggagggggcgccggccgcgcggcgccccatgttgaggcccatgagggcgaagagcgtggccaggatgtagatgggcccgaggtccagggcggcggcgacgtgagcgcccaggatccaggccacgaggcatgcccagaactttccgcccgggtagagcgcgaggaggaggggccaggtggggtagcgccgcgcacggagccagcgcaccgcggcccgctgccacgccggcgccgagtcgccgaggcgcagcctgcggggttggccagggactggggccggggttgggcggcgctgcaggtgttttcagagtggcgagcacaccgagggcaccccccggaacgcacgtgacatcgtcctcctcatcctccgcgctggcgcctgcattcagggcctggatcgcggcagacggtgggcggggcaccaccaacgccatgactgtgtctgcagggggaagcaggtttgggatgaggatgttacctgtccctggatgccaggacagcaaagggctgggaggcacgatcagaaccaaccttccaggccgcaccgccagaggccagggctgcgatgtgcttctcattctgcagtgattgccccttcgagaccagcttcaggcggtccaggggcaggnnnnnnnnnntcagggctgcgatgtgcttctcattctgcagcgattgcccctttgagaccagcttcaggcggtccaggggcaggtccagccgcctcgacacagttgcgtacagaacatctttctgttgaagcaggagtgatgggaatagggtgtcccacttgcgcatgtccattacagtacacaccaccactgcctggcttgaccattgaatgcaccacacgcatgtagacttcccacatggcatctggagaagccctggagcaaccccaaacggtgtgctcaaagtgtttagcaccaacatcccaactccaacacaatatactcccaccgtgagctggtcgggtagctccagaggctgtgactgccctcctataacgtacacatttaggtgcatggcagcatgcctcttcccgagcgaggtacactcgaacacctttgctttcgtgaacccagccgagccactttcgtacaaagtttgtcgcactatctgaagctcgacatcacgagctaccgatacaacgtaaattcgcagtagggcgatgctctgcttcgatatcctaggatttttgagtcgagcagcagtgtcgagactaatgcgcctgggaatctattctgcgcgctctgtctgaggggtggcgacgggaggtacaatgggaagggggggcaaatcacaacagttcagctcagtgggacagcagtaaggccacctctatgagaagcaaggcagtcctggtggacatcagggagtcagaacacagcagatcttctcatgacagtctcaatgagcgacgcagtgcatcgccgtttattgctgcactgcgccgcctgtcttctgggctggtgtctctgcccgatttgaatgatctctgggatgttgggacactggatggtggcctgtgtaaaggggtgattgagatgaacgaatagaaaataacacgctctacagatgccacgaaacctgccaggagccaggtgtatgcgtatgcatgcttgggaaaagcactgtgctcaagttccccccgccacaaactcacatgctctggaggtaggcttcgtgctgtgcaacctcccgctcatagtcctggagcgggaagtttgtcttggcactccgaccctgacaagtgtggacggggtgggtttcaggtggagaccaagaatctgctcaggctgtgcctggctgatgccagaacataatgttcctgaaacatgggccttcctgaacattcccctgtcacgcacagtatgcctggctccaggctggggcctgctcctctcatccttgtcccaactgcgaacccagaagtgctccccacagcgacaccaggcacccccaccttttcaaggatgagcgcgcgatcgtattgccgagcggcctcgtcctccgactcaaaaattccaaaggacacctggacgatggtatgagtgtgcagcgtggaacactgcatcgcttggcctggacgcatctccaagccttgccgggtgcgcactcctttcgctgcactgactccgagggcacctgccaggaacccttggaggattgcaacttcccactggctctcccccaaccccatgctcacgttctttcgacccccaaaggatccgatgcgagcctcccagcgcccgttgtgccccgagacgcccctgtacttggacttgccgcggctgaaggcgctgctgcgcctccgcacgtaggccaccacctcgtcctgcgagcgtgagagaaatcgtggtcaatgcatttgcgctcagctcgtcagtggaaccccacctgggtttcaacttggaggtccttggtccagggccacacatccacactggcatccaacgccgcccgtgactcaccctggtgagccccgcgatctccgccagctgctcggtgtactcctctggcgggtgattagtcattgcccccagccccttgcacgccagggccgccaggtcgtatgccgcggcagcctcctcctggccgttaaagccccccaggtacagctgccgcccgttcagccagagggaggcctcccagcgctgggtcagcctgtgccggctcacgccgcggtaggcggaggtccgcccgccgggcggcgcccccgcctgctccacctggcctggcgcggcggccggctgcgtggccaggcgggagcgcgcgccggtccccggcgcagggtccccctgggcctgcgccctggacaccgtgctgcgcgggctggggctgtcgtccgtgaagtagccggacgcgctgctgggccagcgcttgggggagggctccgactctgatgattcgtccccccgcccgcgctttgggctgcccagcgccgcgccgtcctccaggcggccgcccgggaaggggcgctgcagggggggcaggcgcggcggcggcggcaccagatgcaggctcaggacgggcaccgggggtggcggggcggggagggtgcgggggcgcggcgagcgcacggggtcaaacacatggacgcggaggtcttcctgcacgtggtggaagagtgggaggtgagtcaggggtcaggtgggtccagaggggatcagttgatgtggtggcgagggccgaggacagggtcttgtgaacagcagggaactcgagtggcagtgcaagagcaacagcaaggcacgcatctggagatatcaggccaggcatgagagggggtgggcatctcatacgcagcagtgttgggctccctcgcaagcagataatgccctgaccagctgtgccacgacccctgcggcgccctcggatccagacctcagacgggaggtaggagaggttgccgaaatctatgagctcgcccccggactccagggcagcatctgcgtcgcagagttgacgtatggagaacatcatgaacgtgctagtcacactgtcaagccggagcggcaggctgcattgctgtgcacacgacgcaagaggaggcacgcacatcagaatccaggggttttattgtaacatgtactcaggatgagaagcaaggatccaccctgcagactccccaccatcgcgcaccaaagaacaaggcatcttnnnnnnnnnnaacgcaagaggagacacgcaaatcagaatccaggggttctattgtaacatatactcaggatgagaagaaaggatccaccctgcagactccctaccatcgcgcaccaaagaacaaggcatcttgcggtgccagtgacggcagggccaggctcgaaaaggagattgggtgcatggctgcacctgcaaaagcggtgggtagggctgctcagggtgatgacgagtcagtatgtcttgaaaggcaggcaatcttctcttactgcccgccagtgactcccaaccacctcgtaccaccccatgcnnnnnnnnnncgggtgaatggctgcgcctgcaagagcggtgggtagggctgctcagggtgatgacgcgtcagtatgtcttgaaacgcaggcaattctctctgactgcccgccagcgactcccaaccacctcgtaccaccccatgctggatcactctgggcaaccactggacttgtgatccgtaaagtgggaggaagctgctggtggcctgccgcctggctgtctctatccgtcgcaaggcatagccttgagaggtcgagactccccgtgggtaccagctcggtgggacaagtcaccgattttcgatccgcaacaaggccaggactaagcagagggtctttgaactgtgcaagctgggaggatagggatgaaagacctctcaacacaaggatggatcgccagggctcgcctttcttggacattccagcaatcgcaccaccctcaccatcgccccgtcatggggtgagagagcctcaaaagctgcagcaaactcggcatctgcatggcaagaggctggggtgatactcatcagacatgaagtctagcccatggcctcaaccccgaaaccccatcggcaggcaccataccgaagagggtagacggatcatcccactgttcgacgttgtacattcgtcagtcccgttccaaggctgtacagatctgcctcctcctctccgcgacccccgaagttgtcacatgcctcgctggcacatgttggcttgacctccttgcgaacgatggcggtcgccagaagcatctagcccactacaatgttacaccctcgatgtgagggccatgcattgactgggccggtgtgggctgcccgccagtgggattggctgctcgactacctggagagcttgcgcacccacgtgacaggcgtggcccgtctgcggtgtgtttgggacgatcgaattgaagctcgcaggctttcgcgacgcagaggtgcgtttggtgggcatcttaaacaccacagccatcattcattgtaccccgcttcctttgtcgaggcgaaggccggtggctgtgaccgtcactgtgtccctccctagtctgagactcaccagttctgcctggtccggaagggccggatcatgccaaagctcagcgagtatacttcccccaagaaaccaacagcaccaggggtaccatccaaggtgtgcggcatgggtgtcgcaaggccgtgtgttgggaccatgcttgactggtccaccctccgaaacacgcgcatacgcccgcccgaccccatcttgtgtgcagaaatcccaggatgtacctggattagaggagaccaaagcttggggtccggaagtgagcaagcttgtctcagactacagcaaaaggtggggtgaggcgcatgatgggcgtggcgaagggttctgcatcgagacgtgagtctccgtctaccatcccaaaccttgttgcagcatgattccgccaaatcccaaccacttcatccctcaggaccgcgcagcacggcgcgcggttgttccggtggccagacggcagtctgagggacacgccgcccccgcccaacccttatgctgtggtgagagcgtctattcaggcacagggtggatggggggctgggcgtgagtccttcagcccaggtgatgcgcggctcccaatgcgaggcgtcagcacgcatgcagctccctgtccgctgtgctcaggcagcgctgcccgtcactccaacaggccagtcgcaggcgatgggtgccactggtactgcactgtcggacctctggcnnnnnnnnnntgctgcctatcactccatcaggccagtcgcaggcgatgggtaccactggtactgcactgtcggacctctggctcccacgccggcatctccaagacggggcagtccctgcgctacggcgtgggcgtgccccacagcgcgcacggcacatgcctggccgccatcggcctgcggccggagacagacgagcacgggtgagcgggtgggcagccgtgtgctgagatcggaaggagaacttaccgcttgttggttgcatgatcaagccannnnnnnnnnggacgagcacgggtgagcgggtgggcaggcgtgtgccgagatcggaaggagaatttaccgcttgttggttgcatgatcaagccagtatgccaatgtgggacggtgttgggcgagcacgcctcaccgctgtctcaatgcgctcccgctcctcacgtcgcagccattggcacgggtacgannnnnnnnnnagcgagcacgcctcaccgctgcctcaatgcgctcccaatactcacgtcgcagccattggcacgggtacgacccgaccagggaggcgcccctgaaggatcccacccatcccttcaatacggtctacaagcacgcagcttcccaagtgctgaatgggaggagaggacgcctcctgccagtttcgtagactcagaacacgtgctgcgtatgctacattgtcgccgggctctggaaaccctgctggatgccaccatgccttgcccacttgctggtgtgccccatctgacataccttgcaaagccgttcccctcgacatcacatctcctcatctgtacacttcaagaaggcagcacacactttgtcagcatcaccagttctcaaaaggtgctcctgaagcggacttcaccctggcagagaccttgtccagctctgccactgccccgtcactcagcctccagcctgtcgctccaacgatggcttgcacctgatgccagggggcccagcgaggcgaggcgagcagggtcaggcaagcatgcccggtctatcgcaggccaggactacatcgcaagaggcaccgcaggatgagtgagaaccatgcaccacagggcaccacgatgcactggaaacggtgtgatttccaagccacgtctctccccctcgcacactcccaacacnnnnnnnnnnctgagaaccatgcacaatagggcaccacgatgcactggaaacggtgtaatttccaagcaacgtctctccccctcgcacactcccaacaccacctcccacacggaaccacacagccctgcctcacctgggctgcgttcttggccccaggaatgggcagcacccccttgcacagtaaccagttgatggcaatctgggcgggggtgtgatcgccctcctctgcccccacggcgcgcatgaggtcgagcaggcggaccagctcctcgtactgtgcggcgctgaagttgcgccctcgcaccccgctgggtttgttctgtgggatggatgggtggattggggctgagcatcttctcaaggtggccgaaagagaaggaggcgagatgaggtgnnnnnnnnnnagattggggctggggatcttctcaaggaggccgaaagagaaggaggcgagatgaggtggtgaattgcaaggcgaaggtgcacgccctccctgaaatctgtggccgcctcagtacaccgtgctcatcagctctcagacagcctacctctgcattgtacttgccagtctgccaacatacaaagggaaggtgggggtgcgggacggttgagtgggttgaagataaggtcgaccgtgcatctggttcccaaacttgctttaaagcaggaagctttgcacacgccccgagatctcgacctcgagcaacctgcacactggcttttgctcatctgcgctcgcaccatatacctcaactccctgtctaggaaagatggccctccccccatacaggcctcgtgatcccacggccttaccaagaagccctggcaaagggggctgtaggccaccagggtgcttcccgcctcgcggcaggcctccagcactccatttgtttcgggggcacggtacagcaggctgtactgcacctggttgcaggccagggacgtcccccgcgcctgcgttgtccgtgctcacaagtcagtctggtgaccctcaggcaagcaaggcaaactggagcggccacgacagtccacagagcactcccgcnnnnnnnnnncgaagtcccccgcgcctgcgttgtccgtggtcacgagtcagtctggtgaccctcgtgcaagcaaggcacattggaacggccacgacagtccacagagcactcccgcctcccagagcacgatatctgaggacaccaactccagcacacggacatggttggcaaaggtgtcgctcccggacacccgcctccttgcaccactgcaccactttctcgccattccacacaccgnnnnnnnnnnttggttggcaatggtgttgctcccggacacccgcctccttgcgccattgcaccactttctcgccattccacacaccgacctgcaactgctgtgcagcccgcctgaccctgtcagcgttgaagttggacacccccaccgcctgagccagcccctggtccaccacatctgccaggccctggatgtaggcgtcgttggcaaaggcattgaagaagaagccgggccagtgctgcaagtacaacgtgacacgctgggagcccaggcgctccaagctgccctggaaagcgggaatgggtggaaagcggggcgcgtcgggtaccacagccatggcacaagatcagtgcagagcctgctgacaccatgcagggtccatgcacagtggattcaggctgggaggaccgtgggctccctggcccaccccaccttgcaggccttgaccaagctgccggcgctctgcctccaaggtagcggcccaaacttagttgcaacgtcgggctcgagtccggtgctcgcagaaaattcacggatgaagcgctcggagttcccaaacccgtacacctgccaagaatgattggtgttgctgtagtggatggagggcccagtnnnnnnnnnnatcgggtttgaacccggtgctctcagaaaattcacggatgaagcgctcggagtttccaaacccgtacacctgccaggaacgatgggtgttgctgtagtggatggagggcccagtcgtggagaatgtggaccctcaccaagaaactgcaggatgcatgcctggcagaatagcgacccgggaggtgcatcatcccatcccacctcggcggtatccaggaaagtggctccggcctccatggcggccttgaaagcctgcgcgttgggatagtgatgttgcagctccataagaggacaagctaaggaatacatggtctgtagatctgcagggttggccggatgaccctctggttgagggaccccatgcaaaataggagccaaccgcatacctccagattatcactctgaccataggacttgttgtagccccagtacccggaactgtccctccaggaccatgctccaatgccaatctccgacaccctggcatctggggtcggtgtccataggggatctgggattctgccgggagtttatgcttcccaggcatgtgcgttgccagaaggaatgcatgtctatcatgtgcaggcctagacgatacctgagcggcccagctgtactttgtctatgccctgagtcnnnnnnnnnnctctgccgggagttcatgcttcccaggaatgtgcattgccagaaggaatgcatgtctatcatgcgcaggcctagacgatacctgagcgtcccagctgtactttgtctatgccctgagtcttggctggagaggcccgaggggccggaggcccgcgacgagtctgtcgtccccgggcaggcaacccagtccatgctgaggacttgttcgtgctcagtgcgccattttgtaagagcgtggcctgcatggtcaaccccattacacaacacaatacaatattgcactttgtatatgtgcagcccatgatcgcctcttcgcaccccctgcatggagtgcgaggtggagctctggggaagcgatctgcgnnnnnnnnnntacaatacaatattgcactttatacatgtgcagcccatgatcgcctcttcacaccccctgcatggagttcgaggtggagctctggggaagcgatctgcgcgccccggaatcagtggccctctcgccaacagtggcccgggacgccccaacaacgccacgatcacaaccccctctagaataatgtggaggcatgtgaggtttacagtgttttgaaacatgttctgtgcaagaagtaggatcgaagtggctgggcgctgcacgcaaggcgatgaggaggcccggctgcgctgcagtctccgccaagctcccactcctgcttgccagcccttcattgcttgttcggggtgagnnnnnnnnnncctctgccaagctccccactcctgctagccagcccttcattgcttgttcggggtgaggggcgcgaccggcgccgtcccaaaagccgcaccgtccctccagacgtgcacgcgggcccccaccgagccatcgccagctggcgccacctccacgctggccttggcgcggcccttggtgaggacgtcgccctctggcacataggtcagcagctgagggttccgcaccaggaagttctgcagcgcagcatccgagaggccctgggcggtcaggtagtccactaccgctcgcagctggggctctgggacgcggaggatgggcttgcaggaggaagccatattctccacatctcgattcctcaggcccaagcccgtcaggaacttgatctggaggggggggatggggcatgggttgcaagggggtgtgaacgtcgaggatgcgacctgctgagtcttgcacccacatggtagggcttggcccagaggagagacagggggaggagtgcagctattccagcagcacccggggcgtgcatgccaggattggagacacgaccatactgccgcaggcatcccccgacacccagctcacagcggcatcggccttggcaacatcatcgccttcaggcatgcggcagatgtcccgcgtgatgccgtccacccattgtgcgtcccagcctgtgggcgccaggaaatcgaagagtggctcggggctggctgccaagagaccgcatgcacgaggtgtgttgggcaagatctgccgcgcaggctcctggacagcccccagaatggatcccatctacaggccnnnnnnnnnnggcgcatgcacgaggtgtgttgggcaagatgtcccacgcaggctcctggagagcccccagaatggatcccatctacaggcctccacaacccacagaaccccctcttccccactgaccgagcttgaggaggaaggcgcgcatggtgttggcccggatgatctcagtgggcgcggccctgtgtgttgcttctgctggagccgccgccacggtcacgagacgcagcgtctgggacggcctgctcacgatacaaggggggcagtgggtcatcggtcggtcctcttcgctgcgcacaaacaggagtgccacggcaggaatcctgtcatccaatgtacctttgcagatagacccgcgacacttggacgcgggagggcgatgatgcctggaaggctctcattcccatgccgtttggcaatgggcaccgtatcgccagcgacatcccgcaacgctgaactggactaggagcgacgaagacaacccctgccacctgcaatctaaaccagcgctgttaactgtgcgtgcggattgacctgacggttctgggcgatcgttttgcccgtgcatatgcaagtcgaagcctcnnnnnnnnnnnnnnnnnnnnnnnnngctgattttcgtaccctccatcctatataggcaaaggcttgttgccgcttgtnnnnnnnnnnacatggcatctgtctcccagatctcttgcacggtccttggcacggctgtgccaactgtaggcggtttaaaactgagattcgtaccctccatactatataggcaaaggcttgttgccgcttgttcccttcgtgccggcaggaggcagcacacccccacgaaaacgccagctgcagtgtcagccccattgtgcgatgcgagaagtctccgtcgcccatttgttcaaaggatacgatgtagaggtatggtgtgttaccttgagggcattgcatgccccctctctgggatgctccaccgcgattcaactcatggggagccctgccactctcgccctgtgacccaccatcacccacacagactgtctttggcctggtgtacgtgaaccccgtctgcttgaccgagttccacacggcagttaacagggaccctgcagccatcatcccagcctgggacgggagcactgggaccaggaccctgagtttcatgaagtcagtggatgcacctgccttcatcaagagggtgctgggatcagggacactgagggttgttgagtctcagagcgtggcccttgggccggtgcagggcagcgtctccctcgcgtcggtgccctgccccgagatgaagggcgctgacaagttcaagactgctgttgcggtcgatctcgtgccgacaccctgtggctgccaggtatgggcagttcagtgcatgtggaggttttcccaaagggggttcatgggctcctttcaggtgccctgggtgcgatttctccagtcacatcgcgggctcacccccccgccgccacacgcggtgtccatgcaccagcgtttgccctgcgcaggatcctcctgtcaaccttctcaacctgctctttcattgcaggtgcacgcaagggtgagctgcagcgcggccgggccctacggcctgagcggcgcgatcgagggcttcatggcggagaccgccaaggccagcctggtcgagtttttcgagttctgcgccaggttcctggcagcttccggcgcggagcgcctgctcgccggcgcctcggaggcccgcgcgctactggagggcctggcggccccgtcccccgcccagctgccccgcgcggattcggaggcctgggctgacgcggaggcgctgcccctccccgccgccgacagcgactcggcggaggtgctgtacctgcggtacctgtgcagcaccggcgaccaggccgtggcgctgctgcagcgcatggacggccggctcgcgcggctccagcgcgacccgcgccccgccatcccggcccgtgacctggtgctgggcttcgcggcgggggtggtcacggcgtcggcgctgggcgcgctggccctgtcctggcgccgccagtctcgctgactggggttgtcctttttccccgtagcccagctgccaccggactgttccctgcacctcaaagacctcgaggtcgcctgactgtggacatnnnnnnnnnnatgactggggttgtcttttttccccgaagcccagctgccaccgcactgttccctgcacctcgaagacctcgaggtcgcctgactgtggacatgatgtcccgcctcccttgaaccgacacagtgtgtcttctcctcgtccactcccttgttcatcatggccggccacacccatggtgcactctccatgaacgcgcacaccccccaaccgcaccatgctgtacccgttcccttcaaagaaccccttgnnnnnnnnnncgaacgcgcataccccccaaccccaccattctgtacccgttcccttcaaagaaccccttgcacttcacactatttgaccctgttacttcagcactgcatcacagactcacgtgggctcctcgtctccacccccctggtcagcccctgcgcctcctccacctgagcagctcgggcggcaggtgctcctcgccgcctcgcagcaccccctccgccgtcagctgcgccagccaggcgtggtacagcaggccccgcgcccccagcccgctcatcagccagacggggggcagcgccggcgcaggccccagcgccagccggccgccatagggcggcgtgccgtggtcggtgcgctgggacacgacgcgcgtgccgtgcgcgctgtgcaccacgtgccaggccgccaggccgggccacagcgcgcgggcctgggacagcagctcccccgccgtcctgggcgccgtgccggggttctggtcgggcgccgcggggcggtcccaggttgcgccaatgacgcagcgccgggacccctgcgccgcgatgtacggcatggccgccaggctgggggcgccctcgggccagccagaggcgtgcgcgggcagatcgccggcacagcgcgcatctgggctgtgtgcgtcgggttccaccgccgtggtcgcggtggggggctcggctccatggacccgctcggggggcactgcaccggccgagccctcggcccccagctccagcgtcaggctgatgccggccaccatgtccatgaaggggggcaggtgatccttgaccccggccagataggccaccccagcccccatggccaggacgatgccagcataggggcccttgccagcgttcagctccgccaggtcatgcacagtggtgttctcatgcaacactgcctctgtgcctgcttggcacaggaggacgaggggtttggtatggggatggatgtactgcagtgggtgcaggcgtgacagggcagactgtggcgaggaacaacacactcgcctgcaacaccaagcataggagcgtcacagacagaaacccatgatgaatatggagacactcccggaacaagccagagtccaagccaggtcgcaccgagttccctggcgcgccgctgcgtgtcggcccagagcccgtccaggtatccttttgtgtcaagtgccatcccgtcagagaagaggagggcccccagccctgcgctggcctcctcggtcagcccagccaggacggcgtccagttgtgaggccggcacatagcgagctgagggcatggtctctgcggcagcgcgtagctgcnnnnnnnnnntggcgtccaggtgtgaggccggcacatagcgagcagacggcatggtctctgcggcagcgcgtagctgctcatcctgcacatggacaaagagcgtggataaggacatgggtggtcgtgtagagcagtgagtggggcacatcaggggctggaatccaagccctgtgctccaccgcctcgctacctgccgctgggtctgggccaagcgcagaacgccctgacgccatgcaatctgtttgcggccagcggcttcagccacatccaccaggcgccgggtcgctaggaaagcctcatcacctcgccacatcagtttgccacgggggctggtggggtgcaggaggccggcggcggcaccgctggcgccgtccgccagtccctccccctggacgatcaggtccagggagaggggctttgtggggctgcttgcctgcaggaggtgccaggcaacggccactcctgccagcccacccccgatcacggcatagcggggggagtgggccgaggtgaggtgccgcccgccccggatcctgccatgggaggcaaaggaatcgacgcctcacgtagtcatgccaggcgtccaatgtccacaaagtatctgcgccatcgcatgcgtgttctttgccacaacgttacctgctgcagagcggaaagtcaggacggaaccaacnnnnnnnnnngtcctgccatgggaggcaaagggatcgacgcctcacgcagtcatgccaggcgtccaatgtccacaaaatatctgcgccatcgcatgcgcgttctttgccacaacgttacctgatgcagagcggaaagtcaggacggaaccaacnnnnnnnnnntgcgcaccttgtaccataaagccatgatattgccatgataatatcatggagcgcaaggacgccgtcgagctgggcgaggaaaagccatgtacagtgctcaacggcagtgcgtgggttcctcccgctgaacccagcaacgttgtagaacccagtcccgagctactctgccgaagtattccagtgccagactgttggtgtgggtgnnnnnnnnnngccgcccagcctgacagggcatcaacatgaagcgcgcgatttgacaagccagacatcctggtgtggagctcttcagataacgagtctcataacccaacctgccatcgtcccatcaagagcagtgtgtggtgaggaaggatggtcccggacccatggccactctcacgcagcacgcgaatcttggtggaaccctcgacaagatgtcgacatcatggcaagtgacatggcgcaccttgtactataaagccatgatattgccatgataacatcatggagcgcaaggacgccgtcgagctgcgcgaggaaaagccatgtacagtgcccaacggcagtgcgtgggtccctcccgctgaacccagcaacgtggtagaacccagtcccgaactactctgccgaattattccagtgccagactgttggtgtgggtgtctcgccaggcagctcgcctccaagacgcctgagaaccctggacgagccttcttcacatgcgcgaggcgaagaaaggagtgcggtttttactgctgggccgacgaggtgcctctgccacccgtccagaaacccgaagcggcctttagccttgctggtgcggcgtgaggggcctgcattcggcatcctgtcaatcaggagtctgcctgctcatcacccttggatcatactcatgcgctgccctgagaagtctccaggacctcggggccccccacgacagcaaccactggccaagtttcacccgcagagactcctggcgagaaaggacgtactgtgccttcaactcctgcggcctctagaggccatgtaccagcccctctttgcgaatgtggggtgtcctgcgcacgcctcatctcgcggactgagcgaaaccccgaccgccccttcttcagatgcggggtttccaaacctggtttcagcagaagcaagggctgcgatttcttcgcctgggttgacgaaatgggaggcgagtgggcgggtcatctgccgcgacgagctttcttcgctaccagtcccacccttgtgtccccaacggctgtagcctatgggagcattcccagcaattatagttgtgcaagcaccgtcaagaagtccctggaggaggtgagaggaaagctgatgttggaggatgaaggatgttggaccccagccatggcccaccatggcggagtcctgtggaactggcgaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatgccgtgcggcctgagcctaagaatgagggcctcgaagccgcagttgatcaatcaacggacgattgcttgagatgtgcgtagccggaagctcggctggaatgttgctggtatgcctgactgtgcttaatcttgctcgcgcacggctgctacatcgactctcaccactgtatgctgcatgtgcaggtggcaagnnnnnnnnnnatcaagcaaggcgttggggttggcccagaatctgtatatgaactgctttgtgattgtgtgccatagcttattggacaagaattattaaaccacatgtcatcaacctcattcaggcatacagccagccggcgcgtgtcaagatggactcgtgcagtggagannnnnnnnnngtcaagcaaggcgttggggttgtcccagaatctgtatatgaactgctttgtggttgtgcgccatagcttattggacaagaattattcaaccacatgtcatcaacctcgttcaggcatacagccagccggggcgtgtcaagatggactcgtgcagtggagannnnnnnnnnnnnnnnnnnnnnnnnnnnnnnnnnnnnnnnnnnnnnnnnnnnnnnnnnnnnnnnnnnntggacgattgcttgagatgtgcgtagccagaagctcggctggaatgtagctggtaggcctgactgtgctttatcttgctcgtgcacggctgctacatcgactctcgccactgtatgctgcatgtgcaggtggcaagctgggacagtaagtgtcgtccgcatggagtttgggttccgtctgatgtttgccattagacctggttggtccatggggtgattgtgggagtttgtctgttgatgcccctcgacagcaattctcccggtttcccacacccgcatcgtgcagttggatggcacagtgcccggaggtaggtcagaatgcaggtccaacaatgcagtcgccgagtgcaagggctggtaaggtggacaggccaccattgcgcaatcaatgtgatggcactcgtcaacccaaaaacaaaggtacatttcgagcaggcccggattttcgcatgcgcagattgaggtgggcattcgnnnnnnnnnnaaccattgcgcaatcaatgtgatggcaatcgtcaacccaaaaacaaaggtacatcttgagcaggcccggatattcgcatgcgcagattgaggtgggcattcgcatttggacgggcagcatggatgacgctgatctggaccccatatttgatagtgacagggcttccagccggcggcggtccccgtcccggagtatccgcacgtgccaagaagaaacagaggcaaagggagcggaaacgacaacgagcaatgcatgctgcccatgtccaagccatgcatggggcgtcgtcctgagggcaacgcaacgagcacacctgcgttgcaaggagaaggtgctcgctctcatcccctcaaccaagcctcgagacttccatcatcctctccttgacttgtgagatgatactgactctgaacgaaagtaagaaacaaggacagtgcgtatcaagtgtcaagctgccannnnnnnnnnaacttccatcatcctttccttgacttgtgagatgatacagactctgaacgcaagtaagaaacagggacagtgcgtatcaagtgtcaagctgccagggcgaatgtggtcagtgggcagagggcaggtattcagggtcgacaggtgggcagttcacatttgcaggatggcccccctgggcgtgtggtcagaggggacggtgctgtttggaaggctcgcatgcggtgccccatgcctcagtcctgccggcatgggatccagcacggccaccacacgcccccctcggctgtaccagatgaagtcagtgtctcggtatggcacctgcgccttcccctggggcaggcgctgccccgcctggtaggcctcctgcagagggaaggcgtgctccaggctctcccgattgagtcccacctgcttcagacggcaggcagagggtgaagcggcatgggcggcagcgccttgggaaagtctctgacagcaagtcgtgtggcgctgggctctggacctgtgaaacacagcctttgcccctacagactcagtactgcaacaggccacgaagcagcatgccagtgtgcagactcagggttgacgaaaacacctagtcccacctcccataggccccagggtcaccaagccactcctcacctttggcaggccggcctccgtccagtgcgcgtccaccctgccagaagagaggaatgcgcagggggaagcctgtcgcgtgctgcccaggtcccccgccaggacgagctgggcggcggcagcggccttgcggcttcccagcttctcggagagcagcccaaggatggccttcagctgatgcaggcggctgcctgggagcaggggcgaggcctccaggtgaacattcacgacgtggaggtagtcgctgctcctcagcgacgaggcggagggctcctggcacggcgcatcgtccctgtgctgcaggcagaccagcagcccgtgctgcgcctcctgggtccactccagggcaaacttggcatccttgtaaaagaccgccagcacgctgctgcatgagtcagggggctgggccgccgaccgggtatgcaggaccggatgatacccccggctcgagagcaggtccaccagctcttgccagctgcaaagggcagggcaagcgcatgaaagcgggttggcgatggggcagaacatgttgcccgaagggccagcagccagtgacaggcattcttgcaagaataccatgaacggcagccaggatgcagcggggtgcgcctacaaggcagtgacaccagattccccaagaaaaccgcacctgtgcatggacannnnnnnnnntgtcagccaggatgcagcgggttgcgcctacaaggcagtaacaccagattcccccaagaaaaccgcacctgtgcatggacacctcctgcagacagatgatgtcggcgtcactcccactgatctgggttgacaggagcctccagcggtggctccagtctaacgcttccggggacacggccctcagcgtcttggcacgcccgggagcatcagtgagcatgttgtaggagagcactgagagctgcccgagccccgaggtcagggactggccggccgcaaggagcttggcccgagcccggacatgttttaacttccgatgaaccaggtgcaggatcaggcccgcggccagggaggccagggtgcagtacgtgaccgacatcgaatcctggagggctgagacatcagtactgatgggccagcgctgcagggtcagccaggtcggctgtcgccgtctggcggggtgctgcgaacccagtggaccagagggctcctgccccaccaacacgatgagcccggagaaagagaccgaagagtgcgagaatgcaggtagcagtgtggcgagaggcagtgcgagcgggacaaggcattcgtacagtgggtgttcgatgtggtcgggatttgatgccgccccgagtgggaggggtaaagaggtccgtcccagaaacccatccctcggtgtcctcgggcaatatgtgtacattccaggctgcaggnnnnnnnnnnggaggcccgtcccagaaacccatccctcagtgtcctagggcaatatgtgtacattccaggctgcagggcagcgcaagacttagcacgggaacagagacggcaccaccaactcggtcggtgattatctccggaacaattatcagggtttgactcccccgcccacttcgggcagggtgaacgccgcaggcgcctgggactactgctgggagcaggccacgcgctgtccccgctgcccgccctcctcatcgctgtcactgtcgtactggccacctggggagcatgggagggtgggcactcagatcagtgagcagagccttggagtcacctgtcgccctgcagtatgagtcccagccatgcagatgcacggctatgacagccttgcaccagccaggccctgcataccccgggtccggcaccgtgcatgtgctcagtccagcccctgtgcacgcatgccccacctccgtcgcggctctgcctcgcccccgccacaccccaccaaaccatttttgcccacccacgccggcactcaccagtgcgtnnnnnnnnnnccacggctacgacagccttgcaccagccaggccctgcacaccccgggtccggcaccgtgcatgcgctcagtccagcctctgtgcacgcatgccccgcctccgtcgcggctctgcattgcccccgccacaccccactaaaccattttcgcccacccacgccggcactcaccagtgcgtcgctcatgctccctccggaccttgatctcggcctcgatgtccttcacgggcgtcagctgcacctcctccagctcctccatgggcaccacaccgttggtgtgagcgggctcccccaggagcgagcgcagggcggatgccgcgtcgggcgccagctggtccgggaactccaccgcaaagtggatgtagaggttgcccttctcgtacggccggccgtggatgggcatgccctcgttctgcaaggggggtgtttggagttgggggattccgagcctgcacactggccagaccatggctgccgccaaaaggacagcctcgaggccaaggcatgccgacgtggcggtgcataaatcccggccccaaccccgcgggagcatgagtgtgcccctgatacaaagtgcctcatctgcaggggaccagcacccctgcaaccccatccagtcgcccggccannnnnnnnnngggacagcctcgaggccgaggcatgccgacgtggcggtgcatacatcccgaacccaaccccgcgggagcacgagtgcgcgcctgatacaaagtgcctcatttgcggggggccagcgcccctgcaaccccatccagtcgcccggccagcggtgcatgcctcctcctccacacacacacacacctttttccccccccgccgcaccttgatggccatccaggagtcgggcttgatgatgctgccggcgctgttcacctccagcacccggttgtcgaggtgggtgatgtgcagcagcgcccccgtcagcgcctccaccagcgacaccttcttctcgtagaagaggtcagagccgatgcgcttgaaggtggggtgttccttctgctccagcacaaagatgaggtcgccgggaagaacgtcgggggcatcagcccccgcctccccccggaacaggaccttggagccgtggcggtgcccgggctcgacgtggacctcgaacaccttgcgatcggagaccaggcccttgccggagcaggcgccgcagcggtcggaggggggtgtgaaggaccccgtgccggagcacttggagcagcgctgctggatctgctgcatcatgccggggcccagcgggcgcagcttcacctccacgcccgagccgtggcacacctcgcaggtgtacttcttccccgacttggacccggagccctggcaggtggggcacttgatgctgcgcgacatctgcagcttgcgcacgttgcccttgtacatctcgtccagggacaccttcatcttgtgggtcacgtcctcggagcggcgctcgcggggcgggccgccgcgccggccgccgccgcccatgccgaagaggtcgaagatgtcggcggggccgccgccgccgccgcccatgccctccttcaggccctcctccccgaactggtcgtagatcttgcgcttctcggggtcgcgcagcgtctcgtacgcctcgttgatctccttgaacttctcggggtcgccacccttgtcggggtgctccttcagggccagcttgcggtgggccttcttcacctccgtctcgctggcgttgcggtccacccccaggatgtcgtagtaccgctggttgtccgggggcttgccggcaccgccgcgcccgccgcccatgccgggcatctcgccgtaggggaagccacctgggaatccaccgccaccgaaaaacatgctgaagtgagctcggctacgccctgcaggtcgaggaggcgcgtcagggcgtgaagaatggaacccaggtaggaaacaggatcgaccgagccgagaaggccatgttggacccggggctgctgccccgcagcgggggatgcagggggatgtctcaggaaggcagagcgcggcaagcggccagggcactctagtactggcacaccagacatcagtgcacccatactgcggtttacctggtctcaaatgggctagaaaggcccctgctgcgctctttcagtcagcggctgcgtgatcgacgccgagacaccgtcctaatctcgctcgaaagatacctagggcctctttcacgacggctattttacctgaagagtgcttactagaatacccctaatggtgtttggggacgacatccattcgcaagcctggcaagggctctgaggtttcacccgcttgaccttctggaaggggggcgctggaaagccggagtacagagaccctcttcattttttgggcgctcctgtcgggcatgtataatcaactccgagtttctatcttcattcaacacactttatgagagaatctgtgccttacatagtgttgatacttggtatgggcacatacaccgtctgcaaaaccaaaatggtgccgctgagcagtcttcctggagcagtgtatacatctggcttcaattttaacattctgcatcactgctgcgtcagcacgcccttggagctggcgatttggccttgtcgtcgaggatccacctcacatgctcgccgcagcgctcgcgcgaaagccttgaaggccgcctctactatgtggtgcgagttttgtccagcaagctgcgagcggcgatggaagcgagcgtgcagtagacgatgaggagggaagcaacaggagaaatgatgacagcatggcagcagcacccctccagggaccagggctccaggagcatgcacaacaagatattctgggaacacgagaacaacccctgaaacccggctcacacaccactcctcactcccacacctgacgaatgtgcagtgtcatcccactnnnnnnnnnnaaagcaacaggagaaaagatgacagcatggcagcagcacctctccaggaaccagggctccaggagcatgcacagcaagatattctgggaacacgagaacaacccccgaaaccccgctcacacaccactcctcgctccctcacctgacgaatgtgcagtgtcatcccactagtgtttgccagggactggaagaagtgctccaccagctgcacctcgaacctgccgatgttctcggtcctgaaggcaaggtcgtagcccaggtagggcctaccagacaggtccagcaccacatccacgagagcctcatccagtggtgctgcagcaggggggcggggggtgcagattgaaggcttcaagacgtcatgggtcaccgagaacttcccccttcatggcacagggcatacatgagggtggcaggcacgaaccttgtgtgggtccgtcctgatgcaaacaacgctcacctgagaagtttccaaagcggtggatacccttgcgatctcccagggcttgggacagcgcggtgccaaaggccaaagcaatgtcctcattggtgtggtggtcatcgatccatgtgtcgccctgttgttcagtgattaggaaggtcgcgcttgggaaaagcgtcttgggcctttgtagcgaatgggatcccaatgctctgtggctgggnnnnnnnnnnattcagtgattaggaaggtcgcacttgggaaaagcgtcttgggcctttgtaccgaatgggatcccaatgacttgtggctgggacctgcaacaaggcaaaggagcagacgcacctttgctttgactgtgaggtcaaacagaccgtgcgaagagatctgatcgagcatgtgatccaggaatgggatgccagagtcattgtcagcctggcccgtgccatccaggttgatggtcacctccacccttgtttccttggtctcacgcttcacagtggccacgcgcactgaagagggaggttgagagcattcaaccacgcaagtgttcgggattgcagaccatgctcagatcgtcaggagcaagcgctgcacccacgaccacatnnnnnnnnnnctcaaccacgcaaattttcggggttgcagaccatgctgagatcgccaggagcaagcgctgcacccacgaccacatacgtgaaaactctcaccgggagccatggctggggcagctccattcatggcgacgcccgcgaacacacgcaggccccgtttacttgcagagaccgaacgtggaatatctcccgtaaacgccgggtatgtccttctgccagctcgagagcccgaagccaggctcaacctggacatgctcgtcatggtcacggtgatccggcgggtcagtcggactcttgcaattatgtaaatgctatgcccttacgatggcgtatggtaatgcttccgcccgtgaacataataggaagccatacgctagagcttcccacacgttcgcgccccgactcnnnnnnnnnnctgatccgaagggtcagtcggactcttgcaaagatgtaaatgctatgccctcaggatggcgtatggtaatgcgtccgcccgtgaacattataggaagccatacgcgagagcttcccacacgttcgcgccccgactccacttggaattccgggggtgacattcgcagcccgctagaagcgctgtcaatgggcgtttggttgacctgcatgcatacttggagcacacctttacatttctgaattgaatttgattcagcttagaatacgcggagggcttcctcaacgtcgtatataaacacagccgtgcccgacatttgtgccctgttggccggcgttccgcctgnnnnnnnnnncctaaattgaattcgattcagcttagaatacgcggagagcttcctcaacgtcgtatatatacaccagccgtgcccgacttttgtgccctgttggccggcgttccgcctggacctcactttctcctgacatgggttcgggaacgacagagatcatggccgtaggacatgagaaggacggaggtatgaagagtgggcctctgtggtctgcgcgcgacacatggtattagaggtcggccccctccaacctccctcagcctgcccaccatcccatccatcccatccattgcctgtacgcagacttcctgggagtcagttccgaagaggaggatgtggaagatcaaggcacttgtagtgatgcatccgaccctgagacagatccagagcccagcgggagtgaggatgccagtgcctctgggggccatgacgatgacgactttggcgacgatgactcacaattggatgaaggtgcgctgaaaccctggaaggccttcccctgggtaatcatcttctgactgctgatgttgcacatgcagtagcagccatccctgcgtgccctctggccctgcatgtccctcnnnnnnnnnngggtgcgctgaaaccctggaagaccttcccctgggtactcatcttctgactgctgatgatgcacatgcagtagcagccatctctgcgtgccctctggccctgcatgtccctctgcaccacatcgccttgcgcccaccatatactatctcacctggcgccccgcctcgttctcctatcagagagcgcctctgacagcgccgttgaagacgaggaggaggctggcgggggcggattgctggcagggaagcaggcatccatcgccaaggcctttgcaaaaatcttgaacaagcagctgccaaggccggcagtcggcaagggtcaggcgggggaggaggccccggggtcctcggccccggcccccatcctgatctcgagcgtgacggtcgccaagcagaaggcagaggacgaggcagaaggcgctcggacgaaggcggcatggaagatgatgcaagaaatgcgaaaacgtggccacgtggtgagtctgtgatgtaagctgtagaatgagctctcatgtgcatcccctctcctgattgcaatactctgttgagctcctggcactcttgcactgcattccaaaccacggcagcgatgcggtgaataaccgnnnnnnnnnngctgtgatgtaagctgcagaacgagctctcatgtgcatcccctctcctgatcgcaatactctgttgatctcctggcactcttgtactgcattctaaaccacggcagcgatgcggtgaataaccgccagccccccccacagccccggctgtcgactctgtttggcaggcttgcctcacaatcccccacacccaccccggccccatccccacctccaacagatccctggccggcgcggcgaggatcccgaggccgacgcccgggagaaggcgctgcagcggtctgccacacgcggcgtggtgcgcctgttcaacgccatcgcgggcgcgcagcgaaagcgacgcgaggcggaggcctccggcgcgggggcgtcacaggcggcgcgcctggggcgcgcgagtctcctgtccaagctgcgcaacccggggcccgccccagagacgcgcctggtgcccagcgcgcggggcgcgacgggtctcgtccccggagctcccgccgcaggcgctcgggagcctgccagcgacagcgaggaggagggaggcgcgggccagggctgggaggtcctgcagcgctccttcaccgggctgcagggtggacgcaagatgaaggactgggaccgggcccaggcggcaggggaggaggaggcggtggcaggactggactccagcgactctgagtgagggaatgattcctgtggaaagtaaacaagaacgtcaggcgacaggggggagggggttcagcagggttatcgaaaatggaaaatggaannnnnnnnnntggctcgaggaaagtaaacaagacaggcgaagggggggaggggggtcagatctgacacgtgagacacgtggtgctcgatagactagacttcccgccagcgaagtccggcatccaannnnnnnnnntatctcgcgccgtttacctcgaaacccgtaatttcggtaaccctggggttcagatctgacacgtgggacacgtggtgctcaatagactggacttcccgccagcgaagtccggcatccaattgagaggggacggcctggagcacgcatgggccgctgctctcacatgcattacaatctcatgtggcgagcaaaactcatgcaagcgctcgcctcgattggggcgcgaatggctgcagcgcatggggccgagtaggaagggcgaacctcccgggctccttccccctcattaaggcccctctccacaccgcgatgtctctgcgtcgggttttcagccggccccagtccgcggggcaggctgcaaacacatactccgactcagaggtgggcctccctgcattgttttcacgacatcataacgcgagagtttccttgtttggtacgaacctccgtggccccacccccctccgccccaggcccacgccgtacgcttcgccacacccgccgaacgggtgatagagcagctcacggcagacctgttggacgcccagcgcttcatcgccaagttgcaacaggtgtcctggtgtggtgggtggtcgtgcggtcgcctccccggtcctgctcgcgtgccatgctcacattgcgccatcgcccgcccaacccgccaggcacagcaggattccgaaacccagattcggaaactgcgaggtttgggcgactacaaggctgcgcatgaccgcctggccaaggagctctcacaggtgtgcatgaccggggttccggccatccgtccgtgcttggcaagggggccgggcgggtgtccctcagatccccacgccaaggagcacacctgggcacctcccctccctccttacagagtcaaaagcagtgtcaatcgctggcnnnnnnnnnnggcgggcgggtgtccctcagatccccacgccgagatgcccacctgggcacctcccctccctccccacagagtcaaaagcagtgtcaatcgctggcnnnnnnnnnnctttgtcagatctgaacaattttgtttgctgagcaggacacagggttgtagaatgtgccgaggcaggccggcagctnnnnnnnnnnagcccagctgcaggccacacactcggccctcaaccactcccaaggtgcgtcatccaggggggcggccatggcatgcacgccccttggccctcccctgcgcacctgcagggagcttggtccatttcgaaacttttgtcagatctgaacagcttcttcgctcagcaggacacagggttgtgtagaatgtgccgaggcaggccggcagctacccagccactctcttttcccaggcacccatactactgtcagttctcctcccctcaccctatcacatcctcgaccaccctcacctcactaggggaagctcacactctcatgtccccccccccactcctcgcaggtagcacggcccagnnnnnnnnnngggcacccatactactgtcagttctcgtcccctcaccctatcacatcctcgatcaccctcacctccctaggggaagctcacactctcacgtccccgcccccactcctcgcaggtagcacggcccagaccctagctcagcagagcgccatgatcgaggagatgcgacgcaaggcccggtcccaggactccgagctggctaccgcccacggcacgctggccagccagcaggcggagctggaccgcacggcgcgccggctgctggaggcccaggccgcgctgcgcgccggcgcggccggcgccgccggtgccgacgc

SEQ ID NO: 47272 - DNA, 61 bp, Chlorella protothecoides
ggcccgaggcacctgcgggggctggcggggggaacgccgactacggcacccacctccgacc

SEQ ID NO: 47273 - DNA, 77 bp, Chlorella protothecoides
gccaagtgccaggaatcctgcctgcaccgcctcctcccccttgcacccccagccattttgggagccttgcctgcagg

SEQ ID NO: 47274 - DNA, 68 bp, Chlorella protothecoides
cgggggcgtggcgcgccgccgcctccaccaaagcacgaacgatgccggcgttgatcttgaacaggtcg

SEQ ID NO: 47275 - DNA, 74 bp, Chlorella protothecoides
ccttcctttcttcttgcccacctggaaattgtgtacgacgctcatcttcatgctggagcctccggactcgtaat

SEQ ID NO: 47276 - DNA, 61 bp, Chlorella protothecoides
gtgcgcgacgtatgtcttcggagtggagggggcgtcccatgactccgagcaggcacgtgac

SEQ ID NO: 47277 - DNA, 61 bp, Chlorella protothecoides
tgtggcggcgagggagataggttaggaagggggcgcattgccgccgcttgaagacagggcg

SEQ ID NO: 47278 - DNA, 61 bp, Chlorella protothecoides
ggtatgccctggacgtgtcatgcggtgcctttggaagtgaacttccctcatcatcacacgg

SEQ ID NO: 47279 - DNA, 61 bp, Chlorella protothecoides
tgtgctcagagccccgccgcggctgcaggtaggtgctggggctggctggggctttctgatg

SEQ ID NO: 47280 - DNA, 19495 bp, Chlorella protothecoides
  modified_base (100)..(248): a, c, t, g, unknown or other
  modified_base (479)..(488): a, c, t, g, unknown or other
  modified_base (655)..(664): a, c, t, g, unknown or other
  modified_base (1176)..(1185): a, c, t, g, unknown or other
  modified_base (1689)..(1698): a, c, t, g, unknown or other
  modified_base (2143)..(2152): a, c, t, g, unknown or other
  modified_base (2424)..(2433): a, c, t, g, unknown or other
  modified_base (2855)..(2864): a, c, t, g, unknown or other
  modified_base (3735)..(3744): a, c, t, g, unknown or other
  modified_base (4255)..(4264): a, c, t, g, unknown or other
  modified_base (4565)..(4574): a, c, t, g, unknown or other
  modified_base (5039)..(5048): a, c, t, g, unknown or other
  modified_base (5458)..(5467): a, c, t, g, unknown or other
  modified_base (5834)..(5843): a, c, t, g, unknown or other
  modified_base (6788)..(6797): a, c, t, g, unknown or other
  modified_base (7705)..(7714): a, c, t, g, unknown or other
  modified_base (12674)..(12733): a, c, t, g, unknown or other
  modified_base (12911)..(12920): a, c, t, g, unknown or other
  modified_base (13006)..(13015): a, c, t, g, unknown or other
  modified_base (13658)..(13667): a, c, t, g, unknown or other
  modified_base (14521)..(14530): a, c, t, g, unknown or other
  modified_base (14979)..(14988): a, c, t, g, unknown or other
  modified_base (15378)..(15387): a, c, t, g, unknown or other
  modified_base (15764)..(15773): a, c, t, g, unknown or other
  modified_base (15876)..(15885): a, c, t, g, unknown or other
  modified_base (15946)..(15955): a, c, t, g, unknown or other
  modified_base (16822)..(16831): a, c, t, g, unknown or other
  modified_base (17195)..(17204): a, c, t, g, unknown or other
  modified_base (17939)..(17948): a, c, t, g, unknown or other
ccgctaagcgcagggctcttgcggagaaaacgctggttccccctcgccagatggccctgtgtgtacatcgggcgtgggcaggctccgctgaggtcacctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcctgctggcgcaatttggggcaaaagccatttccggaggaaagtcggcagccacggtcctggcccatgcgccaggttggtccatgggagcggcgtgcggcagggtttcgtgttttgcaaaaggtcagtgtctgcctgctcagttcagaatccggcacagaatcacacccgcacaaagttccctccccccaccggataatcaggcactcaagatatgctgagggaggtnnnnnnnnnntgctgggtccccctcgccagatggccctgtgtgtgtattgggcgtgggcaggctccgctgaggtcacctatcgcaatggcaagagcctcgagccctgatccccgagtccgtgcacaccctttgcccaggcggcagcctgtatgaccactacctgtcttcctaccggnnnnnnnnnncgccaagagtctcaagccctgatccccgagtccatacacaccctttgcccaggcggcagtctgtatgaccactacctgtcttcctaccggaccagcttcgcggcggtcctgctggcgcagtttggggcaaaagccatttccggcggaaagtcggcagccatggtcctggcccatgcgccaggttggtccatgggagtggcgtgcggcagggttttgtgttatgcacacggtcggtgtctgcctgctcagtacagaatccggcacagatcacttccgcacaacgtccctttaccccccacgggtgatcaggcactcaagatatgctgagggaggtggggctgacgatcgatgacctcaaaaccatggagcggcatgatgccacttttgcaggctgctatgatgcttcggtacgagccggggatgagcaggagtgtgactggccttccccaagggctcaacacatcctcatgtcctctgcctcaacattctcctcttcgtcaaccatctcgtcnnnnnnnnnntgagccggggatgagcaggagtgtgactggctttccccaggagctcaacacatcctcatgtcctcttcctaacattctcctcttcgtcaaccatctcgtcgcagggtctgtgcacctgctgcttcctactatcgtgtccacgcctcccaacccggggacgaaaagggtcgagcaatgggccctcgtccagacttgcatcgcagaggccaggccaggccacatctccgctgtccaactttgaggaggacgtgacccaagacgccgtcagagaagtggcgctgggcatccagccctttcagttcgggtcaagggatttccctgcaccacagctcaacacagtagaaggtcgtgtataatagcggcattctcctatctgtgtgcaagttcttggaataggtagtcaggaaccaccttcagggtccaaatatccatatgaccatcacgcattcaatttgtgtcgatgtatggagcatttacatgcccatactagtcatcgtgtgtttnnnnnnnnnnatcgtgtttaattgcggcattctcctatctgtttgcaagttcttggagtaggtagtcaggaacctcctgcagggtccaaatatctgtatgaccatcacgcgatcaatctgtgttgatgtatggagcaattacatgcccatactagtcatcgtgtgtttttggtgggtttgtatcgtatcgttgacgtcacccttgacatcatcttcaacctttcctgcggtccgtgctggggttgtgcgatcagtctcttcgatattccattactccagtgatactaccgtcgatgcctagaattcctcatctaagcattatcaagtcataataacatttgctcctgctgtcgcacttcctataaagtggagcggccgtctgttgtgctgaaaaaccgaacaccctagtcgctgttacagaagaatacccagaagtgccatggaaggccgtgcgnnnnnnnnnngttcctcacctgagccttatcaagtcataacaatattcgctcctgctgtcgcacttcctataaagtggagcggccgtctggtgtgctgaaaaggcgaacaccctagtcgctgttatagaaggatacccagaagtgccatggaaggccgtgcgccggacgctgatgtcgaagtaaactttgatgagacttcatcggcccatagcccgcgcgacaaggaggacgtcgccgtggagggcgatgttaagcgtgccgacctggaacaccctagcaannnnnnnnnnaaagtaaactttgatgagacttcatcggctcatagcccgcgcgacaaggaggacatcgccgtggaggacgatgctaagcgtgccgacctggaacaccctagcaactccgtgtccggcaaggaaaatttcgagaaggcgtccacgggaatcagcagctccatatccccgcattataatccggactcagatgtcatagtcagggcggagtggataggcgaacgctcgatgaaggtgcgttgttggaaaatggaacatggagatccaacagcaaagtgatgatgtggatcctgtgtgcatagtagagcacaacctcttggctttggaacgtcttgggcttcaagcatgacagtcctgctcaatgtccccccgccagaatattatcctctctgtggagttagctacgttggcgggcatagcacttnnnnnnnnnnatcttggctttggaaacgtcttgggcttcaagcatgacactcctgctccatgctcccccgccagaacattatcctctctgttgagttagctacgttggcgggcatagcacttctcttcgtcgggatctactggaaaacgaccaaggtggggaaggacagcaactgcacaccaaccactgcattcccgcctggtacctcttgccgtgtgcagcgttccattgacagcctccctggacgcctgatcgccctggctgcccttgtcacgtgcaggaggctgcattctacctgcacatgaacacggtccccttgatcaacctggccattggggcgcccttcctgctcgccctcttcctcgcctgtctgggcttcatgcgccgggtcatacgctcgaatcgctccggcaagagatggtgcgcgactgctgggcctctcttggtgtgtgctgcggcccgttgcaggccaccgccctcgtcttgagtccccaccttccaaaagcagcccagggcttgggcacccgctgtcttgaccagagaggcctttgcaatccctgcgctgagcccatcgcccccccatccaggtcgcggcgacggcgacggggcgtgaccaacgccggaattgagcaggtcgtgcagatcatcaacctgctggcctttgtggtgtgcagcgcgtacgtggttgacaaggactgtgccgtcctttcctacaccgtgatctggggcggcttcgtgcagtgagtggtggggccagggcggggatgcacatgatgggcaccccagcaatgtctacagggagtcggccatggcctggcgcacccatctcctgatcgctgcccccacctaatgcaccgttcgcagatggacgtgttggaacnnnnnnnnnnacacagggagtcggccatggcctggcgcgcccatctcctgaccgctgcccccaccttgtgcaccgttcgcagatggacgtgttggaacaccatcttcctgttgcagtggatcggcagtgcgtccatcctccccctcaagggcacccgctggggtgtgtggactgggtgatttcagaagggctgtcttttgtgctcggtgctgtgtccgtctgtgttccctctgcgcagggttgctggggttatctggagcgatctacacaggtttgcctaaggacactgatgaggtcgtccctcccccccccaaacaatccaccattctgcagagcactacaacacagccagggacgccatggcgatggacctgccatatggcgcacactggcgcaagctgttgctctgggccgtggtccagggcctcatcatcgccactggcatcatcttcagtagagagattagccatgctgtcggtggcatggagaacggcatgtgcccaggggaagccaccaactgnnnnnnnnnngtcgccactggcatcgtcttcagtaacgagatcagccatgctgccggtggcatggagaccggcatgtgcccaggggaagccaccaactgccacatcccctgtgagtacatggcgcctgccgcttggggaaggttgtctgtgtgttggtaggcaaagatggtatcaaactggggaccaggagcattgttttattctggagccgtggcctgaaaagcttcgcaggcgcttgccgacggggtgacttgacgtcatgcttaactccaagcatccctgatctcactgggagaactccgtacgcccnnnnnnnnnnatgtgagtacatggcgcctgccactcggggaagggtgtctgtgtgctggtaggcaaagatggtatctaacgggggaccaggagcattgttttcttctggagccgtggcctggaaagcttcgcaggcgcttgcagacggggtgtctggacctcatgcttaactccatgcatctctgatctcactgggagaactccgtacgcccttgcagctcacttggtcgtgctcatggtgctctgtagcgtggggatcctgttgtatcagattgtctggatctggaacatccgccaggggttcatcttcctggctgggcagccctacaacgaattccgcatgggtaatcagatcattcggctgcaggtgtggtcagtgaggggttgaggtattgtgtttgcaagcactgggagagctagataaggtgaaccttgaatgcatgaatctttctggctgcctcggcatccatggcannnnnnnnnnatgggagacctagataggggtgaaccttgaatgaatggatctttctggctgcctcggcatccatggcaatgtgtgtgtgtgtgtgtgtgtcttttgggaggggtactccgcctttagtaggccgaaagagtatggctgagtgagtgcccgtgacaaatggtccgcgccatgcatggctcacttccactcccagctctctccatccaggtccggcttcgaggcctggccattgttgtcttcatggcttccatgatcatctacacgtaggatgaggaggggtttgggcagcatgagggacgttcagtcctgtatattgcggaatgtattggatgccgcaggcacatgatggtgcctgtcgattcagcagtgtcctccctctgctgccctcaccttcctcctcctgcctccannnnnnnnnnttatattgcgaaatgtattggatgccgcaggcacatgacggtgcctgtcgatttagcagtgtcctcccccagctgccctcaccttcctcctcctgcctccattccttttctcagattcacagacatcaactcatgtggctccctgctgctctcctggctagggtaccagccaatgcaggtcggtgggtggaatgggggaagattcttcactccctgatgaagcttgctctcagagcagctgcttgaccatgtcctgacaatttgtatggaccctggtgcatggtggggggcagggcatgcatttcatgccactctttgctttgaatcactcaacggtgactccaccttgcccaccggctcagatcgnnnnnnnnnngcatgtcctgacaatttttatggaccctggtgcatggtttggggcagggcatgcatttcatgccattctttgctatgaatcactcaacgttgactccaccttgcccaccggctcagatcgtgatgacggccatcgtcctcgccaataccattctcatgacgccaaagcggcctgacgcaggggccatcctcggggtaggaagagtgttgtttgtgtgggatcgggagaatgggaatcctgacggctggaccgcttggaataatgtttggaaatctaactgcatacctatccagtgccatccctgcagtctcagtgctttgcggcctttgcattccctgccgcatctgccacaggtgtggctccaggagtttgcctggaccgagcgggagatcgagaacaagaaggaggagcgcagctcctccctgccacctggcacggacactgagcagctgaatgcagagcccatatggtgctttgaggtgcgtgtgggtaggagtgtgggcatggaattccgtggcaccccaggtgtcaaggggatgaagggttcgtgcggggtaagcaaactcactttccttctctccccccatacacaatctttccagacggccatcaagctgatatactggtgcttcctatgctatggtacgtggtgaggggcagtcagggtgtgccagcatgcctctgtgtcgtggcgacaggcatgtgtcgactctggtcgccacctctcgcttcagctgcaccgaccgcatccttcccctgcacatctccatgctgaaacagactacgaggagaacaagtccaaggcagcgtacagcgtagacacggcgctgtcgctctacgacctccattcgtttgagatgctgtgggaggaggagatggtgagaccctggggatgagtatgcaggcctgcagatgagggggtgcccgattgtctcatcttgtctnnnnnnnnnngtgagtgtgcagccctgcagacgagggggtgcccgattgtctcatcttgtctactacctcatgcttgccaatgcgtcctgtcccaggacaccaaatgcctgattggctggaacgacgacaccatggtcatctccttccgcggcaccgccagcatggcaaacgtcgcctcggacctcaaggtgggtggtgcggggccgctctgggagtgtgcatggctgcagccacatgcaccagcagtgttgtgcccatccccaatggcctcgctgcgtgtcttcggttctcccctcaaccagtcgcccccctctgcctccccacatcacccttctcctcaggtctggcgcaagatctggcccaagaacatcagcaccaagcggtgctggaagctgggcggcgtcccgcgcgtgcactccggcttctaccatgcctacaccgccaacggcttcaacttccagttgatgaagcgtctgaagtcgttgctcatccgcctgtccaaggacaacccggggaagcgggtgcgggtgtacgtcacgggccactcgctgggcggcgcgctggccacgctgtgcgcctacgacgtcatgacgcactgccagatgaaccatgccgagcactacgaggtgtcgtgctacacctttggcgcgccacgcacgggcaaccacgcctttgccaagctcttcgccggcgtcgtgccggacacgtggcacatcatcaacagcgacgtgaggcctctgctgttgtgtggggggagggggccatggggtggtggagcccggaaaggttctacaccgtcacccgcccttccaaagactgtgcggaggggggatcgggtgtgtcagaccagagggatcacgggtgccgcgctgccgaccgtgcatcggctgtgctcaggcccctgctcccaacccacnnnnnnnnnncgcggagggggggagcgggtgtgtcggaccagagggatcacgtgtgccgcgctgccgaccgtgcatcagctgtgctcaggcccctgctcccaacccaccccgacaggacacggtgacgcgctctggcaagttcttcttcctgtacaagcgcgggggccaccgcgcgatgatcaacccgcggggggacctgctggtgcggccgccatacgtcgagcagtttgtccatcgcatgcctggaagtaggtccattgacgtggatgctcggggagggtcgcagggaggctggggttggagaacagggtcagacggcaggcctggtgtgataccgccgttgtgtgtcctgatgagcatgtgctcaatggccagcggcgcagagcaggtgcccaggcccatatgcgactcgtggcctctcgtccagcagatcctcctcccacagcaactcaaccctctccgccatgcgcagccggcagcctgcgcgaccactacctgacgtcctaccagcgtagcatgatggcggtgctggccgcccagtttggccgcaagtcgattatgggtgggaaggacggcgtgaggaacctgacgcagactgcaggcgcgcctgggctgggtggggtgggcttcgatttccagggatcgcggagtgacttgcgagtgaccagagtccatgtacaggagcaggacagatttccgaactggcttgttgccgcacacaatgttccttggtcttatctcatgcgattcttcgtgcctgccccccacaggcacgcgggcggtgctggagaaagctggcctcacctgggcagactttgagcggctggagagggaggggctcagcgccgggctgcgcagcacgtctggcctggtcgactgctcctgcggcaatgtggtgcgttgaggggcaggagggtcccggtgaacagccagatcccgaatcctccttttccttcagaggtggtggtgggtcccctggcggacatggagttgcctcatcccattcgcgtcgatgcctgggcatctccgtgacattccctgcctctgcaaccaacctcccaccccacctccaaccccctcccctccccccaacagtcgatcccaagctggccgcggcagtgggtcgaggccttcaagccctgcaagcgagcgcgggaggcggccacccgccccgccccgacccaggacaccgccgtggccaccgctgacctggagtcgggcggggaggtgcttgaccccggcgacggcgaggtgtgtgtttggccccgcgcaatcaagagggagcagcggttcaggatgcgtgcgtgccaagggacggaggccagcaccgtctgcaccgccatgaagagcttccggatgaaaggaaagcgggcgcagtccacctggtgcgacaccagcgtggaggggggcaccgcggcggagtccgtgggcgatctgcaggccgctgacgtgccggccgaggagagcatggacagggaggaggtgagtggttttggctgaggggggaatgtgtgcgaggaaaaccggctgtctccaaaaggtgctggcgaacaagggcggggaagtatgccgaatctggagttcccacgtgaccagttctgtgcttggtgcctctctgcatgttcgaccgctctatacagaccaatgaactgcatggtggcgacggaatcgagtctctcgcctcctgattgtatcctctgcaggtaagcgaacctgcgggcgcagatctggcagatctggaggacgtggactacaccttcatctccgctgctggcgatgaccgggcgcgcatgtgcagcttcatcatgaagcgatgacgctgagggggaagcgaacatcacttcactcaatccagcgatacttgtgtccttcaatggtcgattgatctccagcagggaaaaacctacgcctgctgcatccccggatctcacaggctgcacagtccagcggcgctggctcctgacccacaccagactgcgtgtcctatggcaggttgatttatattgtttcttcaacgcagacgcatgcatacccggcaaggtacctctttctcctactatttcaagaatctgaatgacgccatcaagggtttgaagtgacgtaagatctggcgacccctacaacacgctggttcccttcagcgtccgcgtaagagtggcacaaatcgacttttttattcccttctaatgtaatttatcgatctctggctgcatggaggacgcacgaggcatggacgggagggcggatggtctggacaccgcctcgtctatggagtcgggcaccttctccgagacgccacacagcgagagcgggtcatcggggaggttcagcgtcaagtgccctcattacaatccggatgaggatgtcatcacccgcaccgagtggatccaggagcggggcatgaaggtgcgttgtgacgaccaccggaatggcccgcgggatgcgcaccggcatgtatatccttttgccagaccctcacttcctcgccaaacattgcctgcactcaggtcagcatcgtaggagttcagatgggcaacatagcgagcctggtggtcctgtcggtggcgctgtactggaaggtcaagaaggtgagccttttgagagtaggtgctgcactgtcaccatgcaggcacaagctgctgcagcaggttgttatggcaccagatgacccctcccacacctctgtcttaggatccaagcttctacctagagggaaatgacgtgccaaagatgaacctggggtttggctgcgcctgtttactggcagttggcggcaccttggtggggttccttcgacgcgtgtaccgctcctacaagtgcaaaaagcgatggtgggagggggatggtgaagctgctacactctttgctgattagggggtgaattgactggacttgcctatctgctgcgctgagattgtttgccagttgtcatccacagagcagttccttgcatgtctcgtgtcccatgagccaaggccctcatgtcactcctacttcctgcatatcattgccgtcagccagtggccgttcctgctccctcacttattccttgttcaggtcccccagacgtaagactgcagtgacgctgtccctcttggagcaagtggcacagtgtgtcaacctcatcgccttcatcaccagcaatgctatcgccgtgcagcgcacctgcgacgtcctttctcccttctccatctggggcagctttgtgcagtgcgtagtgggggccatggggctggtcagctctaccttgagtctctccttgcatggcctcggcaatcaactcgtgcatacctgatccgaaagtgtggctccagctgacgcgcgtctgcaacaatcgagggcacatgaaacccaccattcccacattccatctgtctgcaggtggacttgctggaatgccctcttctcagtgacatggctgtatgccttcaccctcgggccgaccaagggaacacgctggggtgaggaccagaagtattcgtctgggatcttgctatgtgcgggttcccgacaagcactctgcattcctgtcacatgggcgcatctgtactcgtctgcagcatgaattttttcaagcaatgcatcttctcccgttacctccagcctcatgccaagcatcctgtcacatgcatgtccacagagaacgacgtgaagcgtgcggatgccctgctggccgatctccctctctggaagcaatggcgcaagctgtggctcttcgtcatcatgcaggccctcatcgtcgccgccaccaccctcttccttcaatttttcagcacggttgcattcgaggcctgcccgggcgcagactccgactgccgcatgccaggtgatgaggcgatgcaaaagttgacggggtgcaaggcaattctgcctccagtcctctacaagcgcaaactgtcaggttggcagtttgtgcctgctggccagaacaggtatatctagctgaagacccttccttcctacctaacgttcgcagctagggtcgctgcaatggccatcacccccccatcattcttcctcgtctacctcgtcttcatccttcacagcctgttcaaatgctacgcgttcttcaactcccagccctacaacctttaccagattggcaatcagatcctgcgactgaacgtgcgtggagcaagctgtgtgctgcggccaccggccacccgaatgcgccctcactgtctgctttgcatggatttaagctcaaatttccacccccccccaacccctttgcagacaaggctcaggtccctgtttgtcgtagtcatcctcctcaccctcatcgtgtactcgtgcgtggggaaggcgtgttagggggcccagtgtccatgatgtcacatgggctgtgtctgtgcagcactagtttaatacagtcctccttgatcatcgattcccccctctcaaatctccaatgcgcacagcctcatcaattataacacctgtggcagcatcaatctggcttccctcggctatcttcccatgcatgtaaggattacactgggcatgctattgggggcttgttgcatggtccatcaagccaggagcaatggcaatgagcctgggtgaactccatgtccctcgcaaggctcacccatgcttggccccctcctttcccccctggtcacaccagattgcaatgtcggtcgtggtggtcgtgcaagcgtaccatgcaacccccaaacgtcccagtgacgcctccatcctcagagtgagcaaggggatccatggtccagagcgttcccgggcttaacccatgcagaatcaattctgccagtgcacatggggcccacccttgaatccctatcaacacacaggtgtggctccaggagttctcgtggactgaggggtccctggaggccaacaagaaggagcggagctcgtccctccctgccagcgcagccggtcaggctcgtgagctggatgcagagcccatgtggtgctttgaggtgagtccagtggtgtttgtgtnnnnnnnnnnnnnnnnnnnnnnnnnnnnnnnnnnnnnnnnnnnnnnnnnnnnnnnnnnnnaacagacggcgatgaagctaaactactggacgttcctgtgctatggtatgtgcccctgcagtacggacggttgagtttgggagaactctgtcgccaggtcagacctgtcgtttgtcatgcgaatccacatgagatttgtgcctcccccatcttcacctcacttccagactacaaggannnnnnnnnngggcagcaccgtgagcgggttggctgggtgctggtaggatggcttgtcgtgcgtcgcccatctttccttcctcatgccccttgccnnnnnnnnnnttgcagtacggacgcttgagtttgggagaaccctgtcgcttggtcagacctgtcggttgtcatgtgaatccacatgaagtttgtgcctccctcatcttcacctcacttccagactacaaggagttgaactccaaggcagcatacaatgttgacactgcgctgtccctgtacgacctgcactccttcgagatgctttgggagaagagcctggtgggtggaatgtcgcttgacgagcaggagggcgtcgggacactggcagcgttgattgcgtggtgtggggaggaggggcgggaacgttgtccgtcccttctggtcccagccaggcagaccagaacgacagccacacatggggtgtctctgttggtcccgctgcccacccctcgacctgccccccttgtccaggacacaaagtgcctcatagggtggagcgaccgcaccctggtggtggcattccgtggcactgccagcatagccaatgttgcctctgacctccaggtgctccctctggtctgtgagatgtgggtgtgggtcagggcatcactcacccgcgacaagccagctgtgcaagaggcccgctcacgcgccgctgccatgcacaccccgagctccctcacgcccacccctcgcaggtgtggcgcacccnnnnnnnnnntttctggtctgggagatgtgggtgcgggtcagggcatcactcacccgtgacaggccagctgtgcaagaggcccgctcccgcgtcgctgccatccacaccccgagctccctaacgcccacccctcgcaggtgtggcgcaccccctggcccaaggcccccggccacagaacactgctgggggcgctgcggggcagagcccgcgtgcacgccggcttcctgcaggcgtaccgcgtgaatggctttgatgcgcgcatcaaggagtgcatcgccggggtgctggctgggctccagccagactgcgccggtcggcccatcaaggtctacgtcactggccacaggtgaggtgcggggcaactttggctgctctgggatctgccagaccctgtgcatggctggaagtgggggtggggcatcgccgccggatgcacagggccgatggccctgccaggatgtggcgaaattcaagggtgcctcgcacattcgatgccaggctccattgcctttggcacccttcctccggcccccctttccactgcttcacagtctcggtggggcgctggccacgctgtgtgcgtacgacattgcagtctgcgagaggctgtccgggtcggtggacgtcagctgctacacctttggcgcgccacgcaccggaaaccatgtctttgcggagctgtacacgcgtgctgtgccagacacgtggcacatcatcaacaacgatgtggggactggagctgccagcgtgtttgtggggaggggggtgatgcattgctcatgggtgaagccagtcctcgaggtgcccctgcctcacctccaccctgtgaccgctgaggagggcgacgggtcgcctcgtgctcnnnnnnnnnncccccgaggtgcccctgccacacctccaccctgtgaccactgaggagggcgacgggtcgcctcgtgctctggccgctgctcatcccctggccgtcatctccctaccaaggctgtacctccactgcaactcaccacaaactcgcaggatgcggtgacccgcaacggcaagttcttcatgctgtacaagcgggcaggcttccgcgtcctcatcaacgcccgaggggactgcatcgtcaggcccaactttgtggagcaatttgtgcaccgtgccccaggaggtgcgtggtgtggagctgtcagggtggccccgggggtgatgaacaatgtctgtaggctctatgcccctccagaagtgggtcttgttactcggcatgggccccctccatgttccagggacctcctgctgtcatgtccctagcatcctgtcgtatgagtcacgggctgtccannnnnnnnnnactggttgctcggcatggggccccccatgttccagggacctcctgctgtcgtgtccctaacatcctgtcgtatgagtcacgggctgtccacaactcctccacaggaggcagcctggcttcgcactttctcacctcgtaccagaagagtctggtggccgtgcttgctgcccagtttggaaggaagtcgctggtcggcggcaagcaggccgtgttcatgctcaccagcaccgcaggcaaggcttcatcatgtgaaaggggcgtttacaggcttcatatcatgtgtttgcagctactctggttcaagccagcagcaccagcggatacgtgagagccgtgagcacaggctggatctgacacctggctggagtgttgatcccagctgccctgtcnnnnnnnnnngaggcttcatataatgtgtttgcagctgctctggttcaagccagcagcaccagcaaatatgtgagagccgtgagcacatgctggatctgacacccggctggagtgttgatcccagctgccctgtccatttggcttccctcaggaacgtgtgccgtgctgaagcaggcgggcctgcgctccgaggacctcgaacggctggagtctgagggtctcaaggacccttccctcgacgaatcgtgctctgaatgctcctgcatggaactggtgggctggtatcgatggactgggagcatgtcgaggccgatgtgcctgtccaaatccatgacaagactgccacgtgtttcagtcgatccctggtgcaatgtcaatcgagtgcnnnnnnnnnngtggatggactgggagcatgtcgaggccgacgtgcctgtccaaatccatgagaagactgccacatgtttcattcgatccctggtgcaatgtcaatcgagtgcnnnnnnnnnnttatcaccgtcaattaccccttccccccattctccctccattccacctgcagcacgtgccnnnnnnnnnngtatccccgtcaattcccccttgcccccactctccctccattccacctgcagcacgtgccttccccgctgcggtggtggcagggcccgcgccgggcgcggcgggctatcgcgcgcaccggccagcccgactgctctggtggggacgtggaggttgggggcggggacggccttgccatcaagcatgaggtgcggctgaatgtgcggcccccgcgccaggggtccatgggcggcctcatgcgctggtccagcctgcgcgccaagctggggcgcaggtcttcgtcccaggccagcaccccgcccgagccgcaggaggtaggggggacgtggggtgggttgggcggatcggttgggtgagggggcgtcgggaggcagctgcaggggccttccaaatccctgctgtggcactgtcctccgcattcaacatgatgagacaagatcatctggccatccccacctcgcgccatgcagagccctggggctgggctggaggccacctactcagggcccctggcacaggtccgagaggaccccatggacctctcggtggtgggggacctcaggcagcggtcgttgatcgtgctggggtctcacccagctaagcagctcaggctgcgggtgccccatgcagggcaatgactgtcttcctactcttcagtctgccaaaacgttgtattgtcgacattctctcgtctacaccaatccatactctacacctttggatatgcggatgaatacgaattcagatgtctttgggaccatttctcatggatggttctgtttcaggaccaaaccaactttcttgagttgtttgacccggctcccttatagttgttgtacctctccttgccctctcatctcacagcttnnnnnnnnnngttgtcgacattctcttgtctacaccaatccatactctacaccttgggatatgcggatgaatacgaactcagatgtctttgggaccatttctcatgggtggttccgtttcaggaccaaccaactttcttgagttgtttgacccagctcccttatagttgttgcacctctccttgccctctcatctcacagcttccttacggtttctgatttacattttttggcgcctgctgctccttgtacatggtggtgaaaagcagtacggaggccaattcagacttcactggcatgtgtcactggcaatcctccatttcatgcttagaccacaaatattcacccaggggcctgttcaagcaagcggcgtgnnnnnnnnnnagcagttcagacttgactggcatttgtcactggcaatcctacagttcatgcttagaccaaaaatatcaacccaggggcctgttcaagcaagcggcgtggacgtagatatctacagtccactgtctttctttgaattcgccatgcatgccaaagctatcagggtatacacgatcttgcatcatacctcccttgcctccaaccgctcagttcgcgcgcgctcgtgtcggccgtgacagctgggagaaatccgttaaattttccgaggagtgcatcgggggaaatgtgcgtgccatacttgtggcgagaaagtgtcgcactaccttcgcgtgcatgttataatcggaaattatcgccgcaaaatgtccaagtacgctgtgtactgggaggagctggtggcagccctgaagggtgctcccaagcaccaaatattcctgccttccgtggtcggtctggccatcgtgttgctgactgtcatcgcattcagcgccctgacgtccaagaaaaagtccgcgcggaagggtaaggggcccaagtcccccgctggcacaattattgtggacggcgttcgaaggagcactcggtgagagaagggcgccgcacctgctcctgatcgggccctggagaagcccgcgaagcccttggaaaacttcagggatgttaaaaacgccatccatgccaacctgcccctcccttgtcccccaggacgcaccgtgctcccgtgagtgacgacttccnnnnnnnnnncatttcagggatgttaaatacgccatcaatgccaacctgcccttcccttgtcccccagggcgcaccgtgctcccgtgagtgacgacttcctgtcgcccatcacagccaaggtgtgggttgctagctggtaaaggcagcaagttccagtacagtctcatcacggtggcgtccttgccttcctctctccaacttcgacctgcatggtccaaattctagcccattccttcatgaattcacgcagaagacagagtccaggggcgcctccaccccggcgggcagcgccagtgcctctcccagcccacgcaagcgtcccaacagggcagctaccgtttcagagaccgccgctgccactccgcgacgcagcacacggcgaagcacacgcgagctgtgaggggcgggcggacgagtgactgagcgggctgtcccccaccccttcctcgcccccctgactggtctgttgcccaggaccccacagaccatgcctcacacccgacaggcctgaccgaccacatgacgtctctcatgctcgacatgaccctcactgaccctgccgccttgccttgaaacaactggcatgctatatacagcgtcagcaggcaaccgggctcgtggtcttgctgtggctgtggcgcaggccccatgcatcggggagcagaaacagctcgtcatggccgtgccattttgcggcgcatgcggtagacgtccgcccccgccgcgccccccgccatgtgcccgtacccctcctcctccccgctgtcgctgccgtagtcgggcttgcgcttgggcgcgggcggctgcatgccggccggcaccgcgccgccggggccggcggcgaaccctggcgccgcggggttgccgtaggcctccgcctcgcgctgcgcgcgctgccgccgccgctcgcgcgccgccgcgaactcgtgcgcgtcgatgccggcgggtgagtaatcgttggccatgatcacgctcaacacctggtccacgtcgggggtggggccgtccactgcagaggggtcgattcattattggggctgggggtctgctggttacccgtgaagtgcatcgttgactctttgggcactcccgatgcccaggaatgtgcgagagagtggtgctccaatggaaagaacagaccctcccctcgctgtggaaggaagcaccacctcgcaggctccccttgggacccgggcctggtccacaggcatgggacaaccaaagacaaagagagcagggaaaaacacccccatccccccgggagaattgccactcacgtgcgtgggcaggcggcaggtcgcggatgaatgcctggagctcgcgcggcaagctccgcggaccctctgtcgcccggctcggcgaggcggggcgtagcgcgggcgacgccctgtcgtggccgcgcgtgcgggccgcgctttcccctccaaacgcgccatgcctcggcccccggggagggaccccgccatcctcgtccgagctgtcggcgtcggagggcgccggggcggcgtcgccgccgtcgcgctcgcccagcgcggcgcgccagctggcggccgcgt

SEQ ID NO: 47281 - DNA, 61 bp, Chlorella protothecoides
acagggagatggcccgtgtcgagaggggggggctggatcagatgctgagcatggagcggca

SEQ ID NO: 47282 - DNA, 61 bp, Chlorella protothecoides
taccagaagggtctcgaagaactcggcgggggtgtcgagcagctcgacatcatcccctgtt

SEQ ID NO: 47283 - DNA, 61 bp, Chlorella protothecoides
tctgacgcgagtgagtcttggcttgcaggggtgcaaggatcacgctggtgttggagcttca

SEQ ID NO: 47284 - DNA, 78 bp, Chlorella protothecoides
tagttatagatcaagacgcatgcctgttgtgccggcagaacatctgcgtcgacccccgccctctcttccccctccatc

SEQ ID NO: 47285 - DNA, 61 bp, Chlorella protothecoides
gcccagggccgagaatgcatagtcggcgggggggctcatccctggcgaccacctgcggcga

SEQ ID NO: 47286 - DNA, 65 bp, Chlorella protothecoides
gagccgcgcccgcacgccaaccacatccctgcgtggtggtcggggggggcaggctgaggcagggg

SEQ ID NO: 47287 - DNA, 103 bp, Chlorella protothecoides
ccgcagggatgctccctgcacccgctgatagccgcctctaccaaacacccacccacccacccacacccacacacaggcggccctggcatggctgagtgcccag

SEQ ID NO: 47288 - DNA, 61 bp, Chlorella protothecoides
ggcagcgcagggcactcttgcactgaggggggcgggggctgtagcgtgcataccgcatgaa

SEQ ID NO: 47289 - DNA, 171 bp, Chlorella protothecoides
gtgggatcggcaaggtggattggttttgcataggtcccatgaggtcaggctagtgaaaaggcgagcacaagccgatgtactggcaggctatcaccctctgcgtcgagtcattgtgcttccatgctgcctctccgcagaggccgtcgcagcggtcgcagagccggctcccgt

SEQ ID NO: 47290 - DNA, 61 bp, Chlorella protothecoides
cgcaggatgtgcaggtctgcattggctgggggggtccagtccgccaggcgcctggggcctc

SEQ ID NO: 47291 - DNA, 79 bp, Chlorella protothecoides
ggctcctgcagggggtccatatccggccgcgggcggggccccatggggttcatagccccctgcctggggagggggaccg

SEQ ID NO: 47292 - DNA, 63 bp, Chlorella protothecoides
acaatgcccccgagtgcctcgggaggtcctggatgtacatccataacctcaaattttgatcag

SEQ ID NO: 47293 - DNA, 61 bp, Chlorella protothecoides
ccaggccggcagcacgacgtgcggcgcgcgactgcgccgaccccgcggccccttggtcccc

SEQ ID NO: 47294 - DNA, 4904 bp, Chlorella protothecoides
  modified_base (873)..(882): a, c, t, g, unknown or other
  modified_base (1642)..(1651): a, c, t, g, unknown or other
  modified_base (2228)..(2237): a, c, t, g, unknown or other
  modified_base (3856)..(3865): a, c, t, g, unknown or other
  modified_base (4372)..(4381): a, c, t, g, unknown or other
  modified_base (4631)..(4640): a, c, t, g, unknown or other
cggcgcccgcgccggcgcgcaccagcaccctcctgcgcccggagggcgaggcccagcaggccagcgcgccgtgcatctccgcggccggggtcgccgcggcgggcgccccggcctccagccccgtctcggacaggcgggcgtgcaccaggctccggcgctgcgtgttggcggccaggtcgcgctgcgcgtactgcagcgccagcaccgcgtcgccgccgggccgaggggccagccagccgcccttcaggccggggatggacagggccgcctccaggaactcgcactcccgctccagatgcgaggggggctgcctcgccgggccagcctcggcgccaagggccttcgaggggtggcgccgccggggtcagggcattgagatggggcaggcgatggggggagcgctggcgggcagcagtcacgggctgtgcgcatgggccagacattggaatccaccctggcagcgcaggcatggcctgagccctgaggccggtgcggcacgccgccagcctcaccacacctgcagttcagggtgacgagtcatgctccgtcgtcccgcgaaactgtcagaaccaaggcggggcgcccttcggctgtgcaaatgcgggcctgggatcctgagtgagcgggaaacgtgagatgtggacaggagggagacctgaacgacgcgccgtgctcggccgaggactgccagtgtgtgcgtagggagagggcggtgagtctttcccggtgtgagacaaagcaatattaaaatgtccacgatcggctgagatgaggaggagcacgggcgaagtggaggggtgcggagccaaaatctcatcctgagagaccgcatgtcgataggtattgtgcgccctggacatggtccggagaaannnnnnnnnncttcccggtgtgagaaaaagcaatattaagacgtccacgatcgggctgagatgaggaggagcacgggcgaagtggaggggtgcggagtcaaaatctcatcctgatagaccgcatgttgaaaggcattgtgcgccctggacatggtccggagaaaggcccggtggaaccctctatgcatcttgagagagggcttcatcacatccgttgattacctcaccaagctcgcgagctcttccagctcctgagcgggatctggtagcttcaagtatccataagcaaagcttgctgtcttggccaaggtttgctgcagcgaggatggcgccgcacagacgaacaaccttgtcagacgagatgctcgactcactcagcgtgtagcttattgcagaggtggatcgcgggacggatgtattccgtggtaagaactgcactcactgtcttcccccttgctcggtgacgtcgtgaactctcgccccccatccatcccaggctgcgtgcttgcaatatttcttctcattgccggctgcaacgtgggggtatgttggcggcaacgggaatgttgaatcatggcctttgcctcaagagcgacccgcaccccagtccgctgtgtccgcatgtaatccggacaaggtgaagagagaggacgtattgccatttgccagttcgcacccactcaagcaagtgtggatgcaggaatgcgtccttccccatcttgaagcaggctgtcacaacagcgtgcttgattagtcggtggactggcgannnnnnnnnngtcaatactcaaagcgtgctgtcgtggccaaggtttactccagcgaggatggcgccgcacaaacgaacaaacttgtcagacgagatgctcgacttactcagcgtgtagcttattgcaaaggtggatcgcgggatggatgtattccatggtgagaactgcactcactgtcttccccattgctcggtaacgtcgtgaactcccgcccgccatccatcccaggcttcgtgctccttaaagttcttctctttgccggctgcaacgtgggggtatgttggcggcaacgggaatgttgaatcatggcctttgcctcaagagcgacccgcaccccagtccgctgtgtccgcatgtaatccggacaaggtgaagagagaggacgtattgccatttgccagttcgcacccactcaagcaagtatggatgcagggatgcgtctttccccatcttgaagcaggctgtcacaatagagtgcttgattagtcggtggactggcgagagtgtgttccgcaaactcgtggagggtgcagaggctgtggcgcatgcaaagatatccacctatctgtcagagcttggtgccagnnnnnnnnnnaaaagctcgtggaggatgcagtggctgtggcgcatgcaaaggcatccacctatctggcagagcttggtgccagctcgcctactcagagcccttccaccttgccctctcacacgctagacgccacgcagttactattggggctgggaaggctggctgacctctgcaaggatggtcttgcctcccttatgcactgggtgctgggccgtggcacccagcataacaccggcggcttcatctgccatgctggtccgcagcaatgcagcgttcttgggcaggccttgcggccaaagggtgggacgtgcactacagcagcggtcgctgcagccaaaccccgtctgggatgtgatcttaaggactagcgttcactgagtgacaaggggccaagagtgagaaggactccacagtgtcgcacagtacattggccagcacaggccatggagatcacctgggcctttgcgttcacaggcctgatgctgagtctttctttgcatcccttgctcatgatgtgctgtgtgtggttgaccttgagctcgcaccatcgactccttctgcccgccagtcactgtccaccctagtacctgcaagcgtcaaccctgatgcacttcttcactccatcttcaagccacaggcacgtccctggtgctattggagcgacccctccgtcgcaagctggtccgatccccgttcggctgcctgttggaccaagcactggtaggcgcactgggcgcgctggagtctgggccctgcaaagatatgccccgcgatcagctctggcagtgtgtgcatgcaacaccggcaatcgtcactgaaatggcaccatgtttccagaattgctccccacaggtgtcgcggacggcatctgcttggaacttgctgcatgtgggcctgttgcaacggtgaggaccatgccttctgctctgcggccagcagtaaaagcgcacagatgccaaggctgcattgaccagcggactgctgcatgccaggtcgactccaagcgcgtggttttcgtgccagcgaggtagaggtgggaggcccttgcaacctgcatgggctcacttgcaaatgaacaaaggaatacaaaggtgcagcagcatccttaagataggctcttccatccatctgcgcatggaactgaatgcagctgagtaagacctacgcatatatctccatgtgaggatacatgctgcccttgcggagtgaaagctgacgagaaagcttgaggcgaagtgcagaatgagatgacaccactggggggtcctggtccctgcagagggggaagtgcagcaacagggtggcaggggttggttccgtattcgtcagagctgatgcagaaccacatgactgtattcatgtttcgacgtctcaggggctgagtaggacgtcaaggatttgcagcttcccctagcttccctccgaggggagataggagccttccggccggcgtcgttcagccgatccgcgtcccggtcaggacgtgatgccggggggctcctgtagaatatcccgcatactgttgtgccattagcgacagagtgcctgatattttcagtggacattgttgcattttcgaatcgattggagtattcctattttggccaaaatttggcgcggcaagatgnnnnnnnnnncggccgtcgtcgttcagccgatccgcgtcccggtcaagacgtgatgccggggggctcctgtagaatatccctcatagtgttgtaccatcagccacagagtgcctgatttttccagtggacattgttgcatcttcgaatcgattggagtattgcgattttggccaaaatttggcgcggcaagatgccgtcgcagcgacagacacccctctggagcacaatgctcctcctgttgagccttggtgttctctcacgggtgggtcaaatggactttgtttgcaagcacaatatttgcccagagggagggtgcacgttacgtatcatatccggacggtgacgcccacacgcctcctgctcccaggacgcatgcacaaccaacttctacccacttccgaaggtcatgtgagtttctgctggattttctgggtttgtttcgtcaagtcttttgtccgggagggcgtggagcctgggtgacgatagattggttgtgccgtggtaggccggctgcgnnnnnnnnnngctgggtttgtttcgtcaacgttttcttccgggagggcgtggagcctgggggacgatggattggttgtgccgcgggaggccgactgcgtccggatacgggcagctgcatgctccaccccgccacacactcccccttcctcacgcagttacggtccccatgtctacatgctcgaggccagcagcgccaatgacatctgtaggtgcgttatgaggcgatttaagttgtggctttgcaaggcaagtccaagcnnnnnnnnnnagccagcagcgccaatgacatctgaaggtgcgttatgaggcgatccaagttgtggctttgcaaggcaagtccaagccaatgcatcgcaccaagtcgtcagccacctctcaacagtgccatgtgctttcatcatgcaccgcaggtggatgggctacgccaaggcaggttctttcagagagaccacccttcacaccctcggtgtttccgccagcgccatcaagatgactccctttgaggtcatcaaggagcgatccaccaggatcc

SEQ ID NO: 47295 - DNA, 5047 bp, Chlorella protothecoides
  modified_base (179)..(188): a, c, t, g, unknown or other
  modified_base (725)..(734): a, c, t, g, unknown or other
  modified_base (1128)..(1137): a, c, t, g, unknown or other
  modified_base (1676)..(1685): a, c, t, g, unknown or other
  modified_base (3165)..(3174): a, c, t, g, unknown or other
  modified_base (4270)..(4319): a, c, t, g, unknown or other
  modified_base (4636)..(4645): a, c, t, g, unknown or other
  modified_base (4745)..(4944): a, c, t, g, unknown or other
ggggcgggaggggggcagcagcatcagtgcttgtactgtagtgtgcggcaaatgatgaaccagggggaaggacggcgggaggacaccaggtctgtggaaagcaatggcgtgtctgtcatgggagccgcgatgcccaggcacgacgagtaagcccctgccctaccccacaaagccccacnnnnnnnnnncggaaagcaatggcgtgtctggcatgggagccgcgatgtccaggcacggcgaggaagcccctgccctaccccacaaagccccaccatgcctctaacaatggcccagcacccgtcctgaattttaaaagggactcaccagaaccctcgggcgccaggttgccgtacaggatctgcaggtggccctcggtcttgatgggggactccacgggcataatgacctgctgcccctccgccagcggccggcaggtggccaggttctcggccagcgtgcgccccgtgcaggtcagggtgctgccgtcaatcatgttcttctccagcaagtacttgagcacggcgggcgtgccgcccacctgccaggcagcgcagggagcaaggatttggtgtgtttgtggagggggtgagtgggggggaactggggaggcgcgtgcagagcgtgtgcctgaggagtgcagtccttggcgcagtctgccggcgaggggaggcagcgccaccgcgagaccaagtccgacggtgagagtggcagggaaaaacagtgannnnnnnnnntgcgtgcagagcgtgtgcttgaggactgcagttcttggtgcagtctgccggcggggggaggcagcggcaccgcgagaccaagttagacggtgagagtggcagggaaaaacagtgacgatggaccagggagtgtttgtttggaccacaaatacggttccaagagacaagaagcagggggcgctgatcagggtgtctcagagggtgcaaaaggcagtgtatcatcacacgcacgggggcgggctgccgcaccacccgcttatcctcgagcagcttgcgctgtggctgtgcggcgcggcctggcgcgggcggcagggtggcgaagtcggccgggagctgcgcgcccatgctggagcccatggaattacggcgcggcggcccccgcctcccctgctannnnnnnnnnagcctggcgcgggcggcagggtggcaaagtcggccgtgagctgcgtgcccatgctggagcccatggactcacggcgcggcggcccccgcctcccctgctacccttgaaccccctgtccccgccaggatctctggtgaggcatcaggggtcccagggtaacaggggaggcgggggcagccgcgccgctggtccctgcagcatccgcgagggggcgcagccaccggccggcaaaccctgccggcccgagtgtccgcccatcggggatgggcgggcgccttgccaggccacgccgggggtgtcatgaatgatgatggcaagcaaggaagcaggtcgcaggccgggaagcaaggggcatgatactgcagcgtgctagagcatgcaactctgcacgagctgttcggatgtttcaagagtggaagtgacaggcggccgcggggcctgcccagcccagcattacccagaaaccttcttccctcctccttccacggaatctcacgccatccccccctctcttcaacactcaccttgtgcacatcctnnnnnnnnnnacaaggggcatgatgctgcagcgtgctagagcgtgcgactctgcacgagctgttccgatgtttcaacagtggaactgacaggcagccgcggggcctgcccagcccagcatcacccggagaccttctgccgtcctttttccccggaatctcacgccatcccccccttctcttcaacactcaccttgtgcacatcctccatgacgtacttgcccgagggcttgaggtcggcgaggaagggcgtgcggtccgacacggcctggaagtcatcaagggtgagggtgatgccgcaggccgcagccatggcgacgaggtgcagcacggcgttggtgctgccgcccagggccatgaccaggaccatggcgttctcgaaggcggcgcgggtcatgatgtcgcgcggcttgatgtcacggcgcagcaggtccagcaccacgccgcccgccatgcggcactccaaccgcttcagcgggtcctcggcgggggtggaggaggagtggggaagcgtcatgcccagcgcctcgatggcgcaggccatggtgttggcggtgtacatgccgccgcaggcgccggcgccggggcaggcgtggcgcaccacgtcggcacggccgtcctcgctcagcaggcccgcggtgaaggcaccgtaggactggaaggcggagactatgtccagcgtggcgccgtcggcggcggcgtgcccggggcggatggtccccccgtacaccatgagcgtggggcggttgagccgtgcggcggccatgatggtcccgggcatgttcttgtcgcagccggggaggcaaacgttggcgtcgtaccactgcgcgcgcatcaccgtctcgatgctgtcggcgatgaggtcgcgcgactgcagcgagtacgacatgccgtcggtgcccatggagatgccgtccgacacgccaatggtgttgaagcggtagcccaccaggcccgccgcctccacgcccgccttcacctccgccgccaggtcgttcaggtgcatgttgcacgggttgccctcgtaccacatgctggagatgcccacctaacgatcagggcagggaggggggttcagcgcttctagtcgagttttggcaatgccagtcgggccgtatggcgacagccgagttggggtggggctctgagcaccggggagccgacacacgcggtatgcatgacgatgcggaggcagggatcgtaccctgggacgtcatcccatgctctccccctccccgtcctataaaagcaatggcagggcacgcggcatcgaagggtgcaatgcctggagacataagtttcatagtacgtcgtatttattcacggaattcacctggggtcggttcatgtcctcctcattcaggccggtggcgtacagcatcgcctggctcgcgccctgagacttgggctgggttatgcgggcgctgtacttgttcagaccctcagggacggccggacggtgagcctgagcaggggcatcggccacatcggnnnnnnnnnnagcgctgtacttgttcaggccctcggggacggccggacgacgagcctgagcaggggcatcggccacatcggccgctgcgcgaggccgcacggtcaggcgcctcagtgtacgcgctgggacccgacacgtgaggggtccaccgcaacaccgcatccccgccatgaggctagatcaggctggatgcggatttctgaacagcacggtgttgggtcgatcatgcatgcactccccacgatgccgcattctaggcgtgccaccgcggtgtgccacggctgggatgcggtggttccttgcagtacccttccgggggcatttcgtacacacacccgtgacggatccaccaaaacttgggcccagcgacagccagataccgacattgcctattccttgcctcatgctatcttctagctgctgcccgctcgggtgagcccggcgggatggagctcggccacgctccatcacggccaggccttcaaggccagctgcagtccatcgttgagttcctgcgatctgagggcctgtatgccgcggaagaggttctcacacgtgagctagaggaaagattcccacacaaggatgttggccaggcgagatcaacggcctcggactcgaggccgtccaccccaggggaggacgcagggccagtgcggggcctggcgcccaccgtgcgtcgctctgggtccaacaaggccctggacacagccgagaggtgtgttctggggactgatcggggcagtgttgtggtgttcatggatgcaggtgtggcgttcctcgctgtgcgcctgcagccggcagggggaagccatggtgcaacctgcttgccgcgcacagggtgctggagatttggaggagcaagtctgcgaccaccaccccatcaccacaaaagaggctgacgccggggcacagccagtcgccgcctggtgtcccggcacctgcacgccccccctcgccccaaggtgcatggctggcttggggtccttgtgcatggccctgcaggttgaggtcagcccttgccgtggcttgccaggtgcccttgcctgccaccttgccgctcaagtgcacctgcctcggcctgaccgctgtcgccacccgtttnnnnnnnnnnnnnnnnnnnnnnnnnnnnnnnnnnnnnnnnnnnnnnnnnnacaccgacgacgacgacccgggcttctggcgcatcgacatgacgggccaggagtcggcgttcgatggtgcgggcgctctggcaatggttgagcagggcggggattgggtgttgccctttcagcacttgcgcggccacggcgcgtcggctccgggcgtgctcttcttccaccgcctgggcttagccggcgtgcctggggcccccagacccctgcactctttccacccctggcggctcacctactctacatcacctccctgcttcccgccctgtcctccctccccactctcccctccctctcctgccccgcagacctgnnnnnnnnnngcctgctcgccccccctcgccccaaggtgcatggctagcttggggtccttgtacatggccctgcaggtcgaggtcagcccttgccgtggcttgccaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcgctccggcaatggttgagcagggcgggcattgggtgtcgccctttcagcacttgggcggccacggcgcgccggctccgggcgtgctcttcttccaccgcc

SEQ ID NO: 47296 - DNA, 120 bp, Chlorella protothecoides
gcaggaggcggcgacgtagccggggcgcgcataccaggaggggatgaccacgtggcgcgctgctgccagctgcgcgtcctcgcgcagcaagcgctccagcaggcgcagggaggagccgga

SEQ ID NO: 47297 - DNA, 61 bp, Chlorella protothecoides
aagcggtgatcagtcttcctgagcattgtaccggtgacataggcccctctcagcctcccgt

SEQ ID NO: 47298 - DNA, 61 bp, Chlorella protothecoides
ggcagcactgccgcgcggcgggcagccagggacattgccgcctgcatgagggagatggagt

SEQ ID NO: 47299 - DNA, 76 bp, Chlorella protothecoides
ggcctgggtggacctgcgggtgggtgggtggttggggccggggctgtgtgtgtccgcggaggtcctgcgtggtggc

SEQ ID NO: 47300 - DNA, 90 bp, Chlorella protothecoides
caagtccaaaactggttgaaaggcaaggggggtggccgggcaaaggtcatggcccctgagccgcaactctgctcagggggatggagatga

SEQ ID NO: 47301 - DNA, 62 bp, Chlorella protothecoides
ggtcatcgtggcggagaaaagctgcgtgcgccgctcctgtgtggggtgtgtgtgtgtgtgtg

SEQ ID NO: 47302 - DNA, 61 bp, Chlorella protothecoides
gcctggtctggcttaccaggacgcggcggggctttggaaacgggcgccaagccccggggct

SEQ ID NO: 47303 - DNA, 61 bp, Chlorella protothecoides
cagaactcatccgagtgctgaagtgtcggggatgtgtgtccgaggcctattgtggtgcggc

SEQ ID NO: 47304 - DNA, 125 bp, Chlorella protothecoides
ccatgatggagcttctggaagtggaaggaatgcccatcttagaggccatttccaagccaagctgtccatatggatggtcactacgcggaagtggctccagcagccgcctccgccttccatgcagc

SEQ ID NO: 47305 - DNA, 61 bp, Chlorella protothecoides
ggtgtagagaggggagggggtgggggggggggcacacatggtattcgtccccccgtccgag

SEQ ID NO: 47306 - DNA, 91 bp, Chlorella protothecoides
gcagcacagcccggcagcgcagagccggctacaagaactcagcaggcagaggacctggtggtggtggagagcgccaccctggagctgaggc

SEQ ID NO: 47307 - DNA, 61 bp, Chlorella protothecoides
gcgacacaagggccaggcggagggggagagtgaggaggacagcgaggaggaggagagtggg

SEQ ID NO: 47308 - DNA, 61 bp, Chlorella protothecoides
ccggtgagagtgcgggatcacggtgcattgtcgggtatgtcgcgggccggagggcgacccc

SEQ ID NO: 47309 - DNA, 10670 bp, Chlorella protothecoides
  modified_base (93)..(102): a, c, t, g, unknown or other
  modified_base (714)..(768): a, c, t, g, unknown or other
  modified_base (1953)..(1962): a, c, t, g, unknown or other
  modified_base (2546)..(2555): a, c, t, g, unknown or other
  modified_base (3065)..(3074): a, c, t, g, unknown or other
  modified_base (6109)..(6118): a, c, t, g, unknown or other
  modified_base (6534)..(6543): a, c, t, g, unknown or other
  modified_base (6800)..(6809): a, c, t, g, unknown or other
  modified_base (7118)..(7127): a, c, t, g, unknown or other
  modified_base (7657)..(7666): a, c, t, g, unknown or other
  modified_base (7787)..(7796): a, c, t, g, unknown or other
  modified_base (8452)..(8461): a, c, t, g, unknown or other
  modified_base (8940)..(9021): a, c, t, g, unknown or other
cggcgcctcgccagcaggccggcctcctcgtagtgccccgccgccgcgcagtcgcgagccgcggccaggacctccaggtatcccgcgtgcgcnnnnnnnnnncgacgcgcgcgacgtgctccggcgtcacgcgcggcagcaccgggtcccgcctcgcctcgccgcccagccttgcctccagctcgccgcggcgcctcgccagcaggccggcctcctcgtagtgtcccgccgccgcgcagtcgcgcgccgtggccaggacctccaggtatcccgcgtgcgcggcggcgcgcgcctcggtctcctcctcgcaccgcgcgcggcgcgcgcggtgcttcagcacccgcaccaggctgccggcctcgtccaacacatccagcgcgctgtccgggaaggggcgggccgggaggtggcggccggctagagccaccgccgcaacaagggacgcgtcggtgtacaggcagcggtggtgggcctcgtaggcgggccgcgagccgcgcagcatgcccagcgtggccgccgcgtcgggtgcctccacccacaccggctggaagcgcctgcgggggggtcgttttgcatttggtccggcgggatggagggcaggcaatacggtgaggggggagcccggccacgcgccgcgccgagaccggcgagccggggcaaggacgccagatggggcggctcctcctctacacatccgcccctccaccccccccnnnnnnnnnnnnnnnnnnnnnnnnnnnnnnnnnnnnnnnnnnnnnnnnnnnnnnngtagaacaaaatccaacgcagacctctccagggcagggtcgcgctcgaagtggcgccggaactcgcgctccgtggtggccccgacgcaacgcagccgcccccgcgccagcgccggcttgaagagcgcggcgaggtccgggccgccgccgccgcccatgccgccgcggcctgccagcgccgcgccgccgcccaccagctggtggatctcgtccacgaacaggatgacgtcgggcgcggcgccagcctcggccaccagccccgtgagccgcgcctccagctcgccgcgctcacgtgtgccggccatgaggcgggccaggtccaggctcagcacgcgcatgcccttcagaaacaggggcaggggctggcctgccaggccgccgctccccgtggcgatgcagcgcgccagcccctccacgatggccgtcttgcccacaccggcctcgcccaggagcacagggcagctcttgcggcgccgggccagcacctgcatcagcctggcaatctcggcctcgcggcagaacacctgtcggggggttcgggggggggcgaatctgagcggcgaggattcgagacgaggaggaccaagggaggactctgggattggggcgaacgaccattcccagtcggcgtccatgcaggcaggcaggtttcggccacgcaagcatgcatcagatgcagtttccacggcgaaccagtccgccccgaggcgcacgcaccggatcgatgcggccagccagggcggcggcggtcaggtcgcggcagtacgtgtccagcaccttgccccgctcgcccgcgccggggtgctcgggcgctggccccggcgcggcgcggccagcgcccgcaggggccatggccgcctccacaccgcgccgagcacgctgcgtcccctcctccacggcctggtcccgcaggcgccccagcgcctcggccaccatgcgccgtgggtccaggcgcagcgcgcgcagcaggcgcagcgcggcgtcgtccctgcaacccaccatgcccagcaccaggtggtccggggtcacgaaggacatgcccatgcgctgcgactcctgcatcgggtgggggaacccaggggttatgggttgacacaggggttcagtttgaaagggtgcacgtcgacaggggttccaaccttaccctgtcagtggtagactgatcagctctcagggacgaccccannnnnnnnnntgggtgcatgtcgacaggggttccgacgttacactgtgagtgctagactgatcagctctcagggacgaccccaaatgtcacctggagtgcgacggagaagacccgcctggcgtcccgggtgaagtgaagctcgttgggggggaatcgcctgcgggatctgctgtgcatgcccttcaccgcggccttggcatcctccagctgcagtggggagggcggggggcgcgtttggggcgcgcagggggtctgggagtatgctgtcacgcatgatgccgacccctcctgatcccataagattgtgcactccagaccgttgttaccccagcccggcgcacctgtacatgcgtcgccaggctgcccgccgacggcttgttggaggcttcagctatgagtcccaggatcaagtggtccgtgcccacctgttggagagcggggttgccaggcatcagagcactgaaggaaccagatagcccaggtctggtatgccaatgcatatggccttgcccagcgccagcatgctttttacaggcatcgccctgcagtgttccggaatcaaagtcttccagtctcacctcgttgctgctcannnnnnnnnnattgccaggaattagagcactaaaggaaccagatagcctaggtctgatatgccaatgcatatggccttgcccagcgccagcatgcttcttacaggcatcgccctgcagtgctccgggatcacagtcttccagtctcacctcgttgctgctcatgtcccgggcgagctgctgtgccagcatgaccgacttgatggaccgttccgtgaacttctcaaacagggctgccacgaccacctgagacctcgctcgagacggggatctcgggagtcccgccccggaaaaccgtccatcatggttggagcttccgttgggagacaaaaggaggcgagaaccgcggaagaaggaacgcgagggaactccgagacctcgccaggttttcacgacgcgaggcggcagtcccactgccgagacgtgtagtgttccactgatgaccattcttatttgtttcatatatccatgcacagaggggatgcgcggggtcgtacataggtcgatgcgagttcctgtcannnnnnnnnncagtgttccactgatgaccattgttatttgtttcatatatccatgcgcagaggggatgcgcgggatcgtacataggtcgatgcgagttcctgtcagtggcttccaccttttgaatgtcatcgcgcgcgcgcgctcgtgctactcgccttgctgctggtcccagtgacaggctctcaggaattcagaggatcaaggtcacaaagagagaagatgtattcgagttgcgaaataacttctacatgtaaatgggtatcaagtgggagttttcaacctcttctccaagattggggattttttgggacctgtggaagaacgggttggcatgggatgcaggtttgaatgtgcggcgtcaagtcaatggcagtgccccgtggaagtctctatgaggcaggaccatagagatcgctggcccctgctccatcgccctttcaagccaggtcctcgtccccatcagcaagctgcttggcgccggcctcggccatgccggccacggtctgcagctcgtgccatgctttcctccgctcataccacagcccacagtcagcagaggtgcaggcgatgctccctgcgcacaacggtggtgggtttggttgagtgttgaacatcagattttgcaggggtgttccaacccacccacgcagctctgctgagcaccagtctcaaatctgaaccctctgggcagcttgccgactccgtattgcctccatggacaccgccatgcagcagggccccaggcttcatgaagcccactccccgcctctcctcattccaatcctccaaccacccctcctcctccacgcacacggcatccccccaaacccaaacactcacagtcgtttcccgcgccgccctcccccgtcgcgccgccgccgccgcagtgcgcgcacaggcgcaggaggtggctgttctgcctctccagccggttcaggcgcgccgccagcacggccgcggtgagctggggctcgcccgtgcagcgtgggcacagcggccgggaggccgccgtcagctcgtcgcagacggcgcagtggcgcgacaggtagtaccggtcgatggtgctgccgcccgtggcgctggcgtcccgcgccgggcgcttgtgcggcaggaggaggccgggccggggcatgccggcaaaccaggcgcgcacgtccacgcccatcagcgcaaagacgcggtccagtgccggcacgatctgcttggtgatgtagtagagggcgtgcaggcgcaggcggccgcgggcctccaccagcgcggagggggggaccaccatgtcgatcaggcgcgcgccaggcgcgccgtgcacaaccaggtactgcacccgctccccgaaccgcggctcggcgctgcgtgggtgtgttggagggggaggaggatgtgagtgggcgttggggatgtggggtggagagatggggtggtcgagggaggatgatgtcgggggagatgactgcacgggaagttgttccatgcatggcctcggtcactcgccagctgcaggcatgccagcatgaggatggaggacgcaagcctcctcgtgcgagaaaacccagagcagggagcgcgccagcgcctcccaatgcccttgcctgctgctcaggccaatcacaatacactcttcttggaagcagcctttgtcccaatcaatatagtctctccccacgttctctggcatgaatttcctccgcacccaccgtggatccatggacatcgcccgtgtggcaatgagggcggcgggggggatgatgccgtgcctggcagagtacgtacccagccgcacctccttggcaaacacaaagtcctggatggagacccggcctgacaggatcttggtccactgccgttcgcagtattgcttgacctggggaggggggggtgttgcgatgatagccatttgaatgaggccagagacttcggcgcgagtggccactggcagcacaccagtgaaagaccgaaccgaacactggggtgcagctcatgcgcgctcatcaccaagcttgcttgcgtgcatggcaagccattcagcccattcaactgaggaccatcgcgccctgcccacagtctgcagcatagcatgcgcagcacactacctgcgacaggtccttcgtggtgaagaggaggcgcaggctgcgctccatcatctttgccacggcgggacaggtgtcccggcgcaccgtctcgatgcccttggcatcgaaggcgggggtggcctggctgtgggactcatatgcaaagccgacgtagcgcttcttggtgaggagcacgcaggggtggtacacctgcgcatgcttggtgtgtgagactctgcgcgttcaagatctcggagacccctctcgcccgagagtaacccctggcacaaaatcacaccttctcaagcttgagcaggatggggctggggttggcagccgtcaccaccctctgtatctcggctccgatcttgaaggccgcctcgcgtgacttgccggggacgaccacaaacatgctgtctgcggcaacaggatgtggtgatatgcttgagtcataggggtatgcctagcacatgctctacatcatacttgacgacccttggtagggggaaagcccgaagcatcgggccaacagcattcactcccccgccgtgccggcccctgcgccacatcattccacagtgcttacatgcccaggagtccatacctgtgtcgccgtacaccaccctggctccccagtctggatgcttgttgatgacatcgatggcattctcaagggtggcccgagccagggagacaatggcgtcagctatttcggccatgggcatgcggcctgaggagggagcaggggagaagcctcaagcagggaggggatccaagggaagaggtcctatgcttcctgacttgcatgtgaggcctggggctgggcgccgatgcactgccatctgctatgcagccctggaatccctatgctccctccaccagtttcctgacaggatttctgacccccgacctgcttattacctgagaagccggcagacgtgtacccatacgtcacgttggcaatcagcttcaggnnnnnnnnnnggtttcctgacagaatttctgacccccgacctgctcatcacctgagaagccggcagacgtgtagccatacgtcacgttggcaatcagcttcaggccaaactggcgggcgttgaggcagcgcaggagcaccttggctgcgggcggcagacgcttcattgcccccttgacctgcgcaggtgggggttccggaggcggagagaatggcctggtgaggggtgcggatgggggcacagacatggtatcgcgagtcttgtcgacggagcaagctcccctacagctccccgctaccccttgcaggccagaagcatgtgcccgggctcaccatcaccctggtgtccagtatctcagtcagcaggcgcggcagtacgcctggccgcctcgaggacgggacaaagcctatgccgttgggcgagatnnnnnnnnnnatccagtatctcagacagcaggcgcggcagcacgcctggccgcctcgagggcgggacaaagcctatgccgttgggcgagatgaggaggtctgaggggtgcaagccatcctccagcagcgttcctgggcaagggtgccgggagtggggctgtctgtgggaaggccacagctgcatgtctggcagaagggaatcctacggcccaggggccagcatactgcagcccctgggctggggtgttggggcgctgcgtcgccatnnnnnnnnnnaggcaagggtgtcgggagtggggctgtctgtgggaaggccagagctgcatgtatggcagaggggaatccttcggcccaggggccagcatgccgcagccccttggctggggtgttggggcgctgcgtcgccatgggcactggcatcgagatggccacatccgccccacccggcactcaaaccctgggccccaggcctcaccgtgcggcagggcgtactcggagcacccaaggcggatgggcttgtctgctgttgcagcggcgtgcgccaccctgccgacgcaggtggagtagcacaggttgtaggcgatnnnnnnnnnnaatgggcttgtctgccggtgcagcggcgtgcgccaccctgccgatgcaggtggagtagcacaggttgtaggcgatgatcatggaggggtagagggactggaagtccagcacgatgaccgggtcggcgtagaatcgcgactccggctccatgacgaggggaatgatctccatggccggctggcgggccacctgctccttggagggggccagggccaggaagttctgggtgtgtgccagccgcagcatcatgctctccacccggtactggctcccccgcgacagcactgcaaagaggggggggcggggactatgtgtgtatacaggagtataaccttgtcaatgggtggctgcaccccggaaaagggagtttatatagccactgacgatagagagccaaccccttctgaggtgcaggtgcagcaagccattacaacagccacatggactcatggcaccatgcctgagaagaagtcgatgccaaaggcgcgggcaagctcgctggtgcgccccaccacatccagccggtccannnnnnnnnnaggtggctgcaccccggaaaagggagattatatatccactgatgataggtagccaaccccttctggggtgcaggtgcagcaagccatttaaacagccacatggactcatggcaccatgccnnnnnnnnnnaggttaagccgggctcgcagcaggcaggcctccaggcaccgccaccgaccgcctgcaagtgtgaatggagaggggatgtgggaacctaggcaggtctgaggaggcggcaccccatcatcagctgggtgagtgggatggcgaggcataggcaattccggctgccctccgtgcatgaacagggggaccccccccgcaacctgcagtcaaaatcaagcactgcactcgtccaagatccccacatggcgatgccaaggtaattctacaacctcatcacatcccgcctcacctcccggaccagcctggtaccaggcgtgcagctggtgctgagggatgtgagggacccgcagctgcagcaccgctgccgacaccgcctccagggtgtagatgttcagcttcacctctgtgcaagtggtgtttggggaggggcaccttttgtgcccggggtcgcaagccggagcaggggttacatatgatgagcgcatgcgacgcttggcggccaggtcactcacgagtgtcccttgccactcgcaggtatctggatcccaggcacagccagccgacgcgcctgcccgcatgatgcgccagacattgagcacgatacggcccgcgatgtgcaggcccgagacgttgagccagccgtactcgtcttcttgggnnnnnnnnnngcgacgcgcctgcccgcatgatgcgccagacgttgagtacgatgcggcccgcgatgtgcaggcccgaggcgttgagccagccgtactcgtcttcttgggcctccttcacgcttgccagctggtgggtggtgggtgggaggagggggctggtgcatggggggggagggggctgtcgggcacggccccggttgtgggcatgccgtgcccatcggcttccctgtgtcgtcacatgcagagagcaacctccttcccggcgcgatgcatgagtctgtccgccctcctgtacctcccagattcactcccccccctcacctcccccacccctccccatgccatcccccacctcgggcgtgcgggacagggcgcggaggaagtgtgcgtcccccagcgcggcggcgcggtcgttgaggtagcccagccccccgcactgaacctcgaaacccagcaggatgtcggggtccagcgcgcgcacgccctcnnnnnnnnnnnnnnnnnnnnnnnnnnnnnnnnnnnnnnnnnnnnnnnnnnnnnnnnnnnnnnnnnnnnnnnnnnnnnnnnnncgctggcgtacaggtccacctgggcggaggtcagcgcgtcggcccccgcccagcgccgcaggccccggcccatcggaccccggcccggggacacgcagggcacgtcgcgcgccgtggaggccaggggtggggaggggaacggcgcaggcgaccccggcgaagcctgcccgcccggcggcgtggcgcacccggccggccccgcgccggggtgggagggcgccgcgggagcggcgggggtttgcagctggggcgcgggtgctggggacgcgctctccggtgcgccctggccgccgtcgccgggccgccgcatccccaccttgtcgtcccagagcaggatgcgcgcggtgtacttgcctgagaggtgggaaggaagcgggagggcgacgggtttgggtttggcatggcgtgctggactggcgagccagtttctcctcccaaacatcctcctggcagctgcgaccacagaatcctggcccctcaccgtcgtcaacctcctcgtcgtcgtccatgaccacgaggaacacagcgcgaacagcgtcgtgccgcgggtcgggcagcaggaggcccctgagtgatgcaggaggagacaggggctgactcccaccggccagcccggaatttgcgaggggccagctgctgcctggcgcgcagcgtagggcactgagcagttcaggtgcaaatcccctgccccatctcgcatggacccccccttcccacctgctctcggcgtgcacctcgacggacagcagcgtgagctgctgccccttgccgtccacgacgcgcttgaaccccgtctgctccagcggggtgtcgccgaccgccggcgcagagtgcgcggggctcagcatgcttggcagcatggcgggggggaccccgtgtcgcagcggcgatgcgctcggcggcgcggcaggcggcgagactcgcttcttgccgctggaatgcgccgcgcctggcggggccgcggcctcgtcgcggccctgggtgtctgcagccggcggcgcgtcgccgtccctccctgcggccggctgcccaaggcggctcggcaggcgggggctggtgccgggggccacgtgggcgccggccagcgccgcaaatcgcacaggccgttgcgcccccggcgtgcgcagggcctccggggcggctggaggaacccctgccgggcgcgggggggggacgctctctggactgtcggcgtggcgtgcgacggagaccgcaggcgactcacgcagctgggacgcgtggccgcccgccgctccgtctgcggcggccctggcggcggaccggggtccgtactgctgcgtggcaaaggggttggagaagaagaaggtccgttcgtcgtacttgggcgaggcggggcgcacttcctcctcctcctcctccccttccacggtggcgtcgtcggcgtcggcgtcgtcgccgcccctcgcaaccgcaaggggcgacgcagccgcaggcgacgcgaaggccctctgcgcgccgcgctgcgacggcagcgtgcacagcatgggcgtggccagcaggtcgtcggcgccgccggcgccctggctggcgccggccgtggagagagccgcgctctccaccaccagctgccccgtgttggggtccatgcgctggcgcggcgccgcgaggccggccggcgccgcgcgggc

SEQ ID NO: 47310 - DNA, 68 bp, Chlorella protothecoides
caatttgccacttccgaaagtctcggggactgctgggatgatgacgtaatgggggcccggtatcacgt

SEQ ID NO: 47311 - DNA, 128 bp, Chlorella protothecoides
gaaggcgggtgtggagggtatgcaaggtcactgatgggaagtgaagcagcacgacattgcaagcgggtcccagggcgaggcgcacagggcgagcatgcctttcctccacccaatggcagcatccccca

SEQ ID NO: 47312 - DNA, 61 bp, Chlorella protothecoides
ctccacggaggcctggctggccgccgccatccgcaactcctcccacgccgcgcgcgacgtc

SEQ ID NO: 47313 - DNA, 61 bp, Chlorella protothecoides
acgtctggaacaaggcgaggcgccatggcgagggggggggggcggatgtgctgggggcggt

SEQ ID NO: 47314 - DNA, 61 bp, Chlorella protothecoides
catcgtggtggaggccatcctgggttggcgttgggcggcggaggaccaggcgctgggcgac

SEQ ID NO: 47315 - DNA, 76 bp, Chlorella protothecoides
ccccccccccccccccccccccctcccccctgtcacccacgtgaacagggcacgccctgggaccaggagtcggcca

SEQ ID NO: 47316 - DNA, 61 bp, Chlorella protothecoides
gcgacccacctgatctggcggtgatcaaagcgcactcgagtccttttcccacgtctctctg

SEQ ID NO: 47317 - DNA, 80 bp, Chlorella protothecoides
ccccccccccccccccccccccctcctcatcacacctctggtccgggataacgccgctggtgcgggtgaccatgccgctc

SEQ ID NO: 47318 - DNA, 445 bp, Chlorella protothecoides
  modified_base (83)..(338): a, c, t, g, unknown or other
gttggaggggtgggaggggtgggagagcagggacccaaggcgggcagagggtgtgatctgtgtgtgtgtttgcgtgtgttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggaaaggggggaatggggactggacgaggcagcccctttgcagcgcttgcggcagaaccctggtgccgcagcctggcctccctccgggccccgcccatcgaccgcg

SEQ ID NO: 47319 - DNA, 104 bp, Chlorella protothecoides
atgctcagtggtgccctggggagggcatgcgccaccccaacagggaccctttcccgggcacgaccagaggacagcctcccccctataccccccccccccccccc

SEQ ID NO: 47320 - DNA, 76 bp, Chlorella protothecoides
gtgtgaggtggacgcgcggggctcgggcgccgatggggcggggccagcctcggtgctcctgctccgatctgcaggc

SEQ ID NO: 47321 - DNA, 79 bp, Chlorella protothecoides
ggtcttggcatgcttccgaaggccccgctattccagccatgaaaccgtatgcagcaactgacctgacgatggcggtctt

SEQ ID NO: 47322 - DNA, 65 bp, Chlorella protothecoides
acactgggaaccgcgcctccccatcggcgggcggcccccctcctctccagccaacgccagccatg

SEQ ID NO: 47323 - DNA, 61 bp, Chlorella protothecoides
agcagcagatcgccatgatgcaggcgggggggcgcctgccagactatttgttcaggggatt

SEQ ID NO: 47324 - DNA, 61 bp, Chlorella protothecoides
ctaggtcatcatggccgtgggttgcggcggtacgggtgtaccccgccccgctgccggcacc

SEQ ID NO: 47325 - DNA, 36455 bp, Chlorella protothecoides
  modified_base (94)..(103): a, c, t, g, unknown or other
  modified_base (485)..(494): a, c, t, g, unknown or other
  modified_base (2062)..(2094): a, c, t, g, unknown or other
  modified_base (2270)..(2279): a, c, t, g, unknown or other
  modified_base (2722)..(2731): a, c, t, g, unknown or other
  modified_base (3219)..(3305): a, c, t, g, unknown or other
  modified_base (3590)..(3599): a, c, t, g, unknown or other
  modified_base (4050)..(4200): a, c, t, g, unknown or other
  modified_base (4263)..(4272): a, c, t, g, unknown or other
  modified_base (4846)..(4855): a, c, t, g, unknown or other
  modified_base (4947)..(4956): a, c, t, g, unknown or other
  modified_base (5385)..(5394): a, c, t, g, unknown or other
  modified_base (6304)..(6313): a, c, t, g, unknown or other
  modified_base (6414)..(6423): a, c, t, g, unknown or other
  modified_base (6518)..(6527): a, c, t, g, unknown or other
  modified_base (7366)..(7375): a, c, t, g, unknown or other
  modified_base (8424)..(8433): a, c, t, g, unknown or other
  modified_base (8554)..(8563): a, c, t, g, unknown or other
  modified_base (9266)..(9275): a, c, t, g, unknown or other
  modified_base (9508)..(9517): a, c, t, g, unknown or other
  modified_base (9728)..(9737): a, c, t, g, unknown or other
  modified_base (10908)..(10917): a, c, t, g, unknown or other
  modified_base (12855)..(12864): a, c, t, g, unknown or other
  modified_base (13429)..(13438): a, c, t, g, unknown or other
  modified_base (14054)..(14063): a, c, t, g, unknown or other
  modified_base (14724)..(14733): a, c, t, g, unknown or other
  modified_base (15075)..(15084): a, c, t, g, unknown or other
  modified_base (15659)..(15668): a, c, t, g, unknown or other
  modified_base (16502)..(16511): a, c, t, g, unknown or other
  modified_base (17053)..(17062): a, c, t, g, unknown or other
  modified_base (19157)..(19166): a, c, t, g, unknown or other
  modified_base (19529)..(19538): a, c, t, g, unknown or other
  modified_base (20307)..(20316): a, c, t, g, unknown or other
  modified_base (23162)..(23171): a, c, t, g, unknown or other
  modified_base (23263)..(23287): a, c, t, g, unknown or other
  modified_base (23807)..(23816): a, c, t, g, unknown or other
  modified_base (24122)..(24131): a, c, t, g, unknown or other
  modified_base (24632)..(24641): a, c, t, g, unknown or other
  modified_base (25412)..(25421): a, c, t, g, unknown or other
  modified_base (26053)..(26062): a, c, t, g, unknown or other
  modified_base (26505)..(26514): a, c, t, g, unknown or other
  modified_base (26828)..(26837): a, c, t, g, unknown or other
  modified_base (27491)..(27500): a, c, t, g, unknown or other
  modified_base (27720)..(27729): a, c, t, g, unknown or other
  modified_base (28079)..(28088): a, c, t, g, unknown or other
  modified_base (28246)..(28255): a, c, t, g, unknown or other
  modified_base (28533)..(28542): a, c, t, g, unknown or other
  modified_base (29014)..(29023): a, c, t, g, unknown or other
  modified_base (30870)..(30879): a, c, t, g, unknown or other
  modified_base (31292)..(31301): a, c, t, g, unknown or other
  modified_base (31919)..(31928): a, c, t, g, unknown or other
  modified_base (33648)..(33657): a, c, t, g, unknown or other
  modified_base (34240)..(34249): a, c, t, g, unknown or other
  modified_base (34577)..(34586): a, c, t, g, unknown or other
  modified_base (34991)..(35000): a, c, t, g, unknown or other
  modified_base (36158)..(36264): a, c, t, g, unknown or other
gccaggtggtgtggcctggacagccaggcagatggggcctacccttaaaaaatccatcgtacaccatctacccatctcaccgtcctgtatgtcnnnnnnnnnnaagaacatgtttgcgagaagaagacggaggcgtgggcagggctcggagggtggggccaggcgctgcccgcagcagcaggtgtgccctctgtgcgtgacggccaggccaggtggtgtggcctggacagccaggcagatggggcctagccttgaacaatccatcgtacgccatctacccatctcaccgtcctgtatgtcagcccaggccagggcggaggccagctcctcgtcctcgtcaaagctgtcctcctcctccgagtcctcggcctcgctggtggcaggcaagggggaggcccgctctgccgcctcaggggtgggcaacgcgatagccttcacatcgcgctgcttggtgacagtctctccatcactgtcggagccgtacnnnnnnnnnngcgcgatagccttcacatcgtgctgcttagtcacagtctctccatcactgtcggagccgtaccgcaaagccagtctatctaaagagacgtcctcgccacacgcctgcatggcgcagggcaaggacacaggggcccgccagaaggttgctcgaaatggaatgtgtcgctcagtattacgacttcagtattgatagcaggaggagcttcaccctgacgattgcaatgtgggcctgggcaccgggcgaggtcgaaagccagggcgcgctgggataccgtccgtgaatatggcgccaaacaatcgccgctgcggtgagtagccgtccagaaccaagaagtgacctggttcccacgtaccgccaatagacctggaggtcgcagccagctcgataaacaatcggtacattggttggtaaacaccccgtcacaggcggtttcccccgcagcgaggggccatggcggatcagaagtcggacgccgaccagcaggtcgagatttggaaagtcaagcgggtgagtggggatgataatttgcatcggagggtatcagggaggcgccttgctctctggcgagctcccgcggtgagcaccccccccacaccgccgtcccctgctcccctcccaccccagctcatcaaggcgctagacaatgccaagggcaacggcacttcaatgatcagcctcatcctgccaccaaagtcccaggtaggtgacttgaattctcttcttcattactttcgcctcctgtctccttgtgaagggtttggaggggcctgcctatcaccacagccccacccccctcccaccctcctgccacttccccacatttccccgtttccaggtagcccaatctcaggccatgctggccaacgagtacggcaccgcctccaacatcaagtcccgcgtcaaccgtcagtcggtgcttgctgccatcacgtctgcccagcagcggctcaagctgtacaaccgcgtcccgcccaacgggctcatcgtgtacacgggcactgtgctgacggaggacggcaaggagaagaagctgaacgtcgacttcgagcccttcaagcccatcaacacctccctgtacctgtgcgacaacaagtttcacaccgaggctctgaacgagctgatggaggctgactccaagtacggcttcatcgttatggacgggaacggcacgctgttcggcaccctgtccgggaatagccgcgaggtgctgcacaagatcacggtggacctgcccaagaagcacgggcgcggcgggcagtccgcgctgcgtttcggccgcctgcgcatggagaagcggcacaattacgtgcgcaaggtggccgagctggccgtccagttcttcatctccgcggaccaccccaacgtggcgggcctggtgctggcaggcagcgccgatttcaagaccgagctgtcgcagtccgacatgtttgacgcccgtctacaggctgtgattctcgcagtggtggacgtgtcctacggtgagcctggacgagcgcagggggaggatttccgtgcggagggtggtgatgaggggtggggagtgaccggcagcttaccctgctcagnnnnnnnnnnnnnnnnnnnnnnnnnnnnnnnnntgtgccaaatggactggctagttgaacagcaacccacaacccacgctgcttctatagagtgcttgcttggcaaaagttgcatacgtttgtgccctccctattcgccctactgcactatatgctgcttcatcttgaccgtcctcacaatgagcccagtgcacgagcaaaacctccannnnnnnnnnggttgcatacgtttgtgccctccctatctgcctgactgcaccacatgctgcttcatcttgaccggcctcataatgagcccagtgcacgagcaaaacctccacattttccgtgggtgcctttaccagtttcctgcctatacaccgtggcagcagattaaatggcggccaccccacaccatgcatgcggcaccctcgcacgatggcagcccccccacagggctgccaccagttttaagggtgttgtacatcccttctccaatcacatatcctcccgtttcttttatccttgatgtctaggccccccaggtcctccttgaagaaggctttgcaaagaatcttctacactgggcacatctcgatcgcacatggcctttgtacagtcccttaagtcccacacacctttcttcaaacctccaggtggagagaacggattcagtcaagcnnnnnnnnnnaatccttgatgtctaggcccccccgctccttcttgaagaaggctttgcagagaatcttctacactgggcacatcccgatcgcacaaggcctttgttcagtcccttcagtcccacacacctttcttcgaacttccaggtggagagaacggattcagtcaagcgattgagctgtcggccgacaccctgtccaacgtgaaatttgtgcaagaaaagcggctgatcagcaggtacggtatatggccggggacttgcgtgcatgtgtgcacagggctctgtgcgatgctgatgcctgaaggtaccctcaccccactgcctgcagtttcttcgaccagatcagtcaagatacgggaaaatatgtgtttggagtgaaggacacgctggcgtgcctggagatgggagcggtagaaaccctcatcatctgggagaacctggaggtctcccgctatgtattcaacacctcatcaggtgagaggttgggcggggtgtcnnnnnnnnnnnnnnnnnnnnnnnnnnnnnnnnnnnnnnnnnnnnnnnnnnnnnnnnnnnnnnnnnnnnnnnnnnnnnnnnnnnnnnngaccccggatgctctgctggcgctgaagtgccttgccaagcatgcccctgcaggagagcaagaagtaaagatcctgaccaaagaacaggagacagatagcaagctattcaaggacaaggtcactggacttgacctggatgtggtagagaaggtgggcggactgggcgacagggtgctgcgagcgctctggggtcggggataccatgcagcccatgcaggggggagccgtggaacactcgccaggcgtgaggtccccaatgacgtccccttccttcccccaccccnnnnnnnnnntgtggtgctacgagcgctctggggtcggtgataccatgcagcccatgcagaggggagccgtggaacactcgccgggcgtgaggtctccaatgacgtccccttccttcccccaccccctgcagcaacccctgctggagtggcttgccaacggctacaagaaattcggatgccagctggagtttgtgacgaatcggtcgcaggaggggtctcagttctgccgagggtttggcggcatcggcgggctgctcaggtatgcggtgaacaccgccgagtttgaggagcccgacgacgtggaccgtcccggctcggacgaggagtggacgtcagacgaggacatctgacatcccagttttgaccggcccccttgccagagacctgccctgaacccccctcagaacctctgcatgcctggctgcatgacacgttgacatcctgtacgatactgtccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagggttcaaatcagagatagtggtgtgcctctttggggcttgaagtgtggagacagctgagnnnnnnnnnnccgcccctgaaacccccttagaacctctgcatgcgtggctgcatggcacgttgacatcctgtacgatactgtccttgggatctgagcaggactggacgaggcacagcagtgcaatcacaagggtgcaagattcttcggcgtgggcggcgccgtggcatgcccacagcgccccctcacacgtgggttcaaatcagagatagtggcgtgcctgtttggggcttgaagtgtggagacagctgaggcgtgcgggcacgcttggaaatgaagtgctgcgttccgagggcggggtatgcatgtgcattcggcgcgcgagcagcagcgccggacgcctgggcgctacttgcaccccagtgttgaacagaattgctgtcgagccttgagctcgactcttgcggtgaggagcaggacgaggcttgctccgacggccagcaagaggcgggaggccaggacggttccccacaggttgcctgcatcgagcacagcgggggtagcatgagcacatgggctgcacatcctcgtatactcgagcaaaagggaaagtgccgcggatggtaagctgcatgggtgtgtacannnnnnnnnnaacgcctgggcgctacttgcaccccagtatcgaacagaattgctgtcgagccttgagctcaactcttgcggtgaggagcaggacgaggcttnnnnnnnnnntaagcatgagcacatgggctgcatatcctcgtatactcgagcagaagggaaagtgacgcggatggtaagctgcatgggtgtgtacagtgaccaccctcccacatgggcacgtcatcaccagacgtggggatagggggcccagggacccaccttggagaaccctgggttggtaccagaggaggagcacgaagtgtgcaagaaggagccacatgtggactcggaacctggcccgcaggccaaagggtagcgcggtcagcgcggtcagggaaagcgcggcaaaggtatggcctgcggttgtgagggtgtttgaatgtgagagctgagtgctttgactgcccctccaagaggatctgcatgttgcagagggcaagagcagaaccccaggcagattctgtgcactggcttcataccgtaatgtccagcatccannnnnnnnnnggcacagggcaagagcagagccccaggcagggtctgtgcgctggcttcataccgtaatgtccagcatccatgcctggcctcccgctgcgcttggactgacgtccactctccatttcaacccctcgtcggcaacaaaacaacctcaccttcaggccctgctgcgcgtctgccctccaggatgcagacaacgagcgccactttgtgtgccaggtggcagaacacacagagcgagtcccgccagacagcatagacagcgtggcggcgcaccatgatctgtcacaagtggcattgtgctggttcgggcaggggcgaggggcagtacgagaacggccggcgttcaatcggggcacacaaccgatcacatcacctcccagcactcccacaccaacacccctactcctcttccctttcctagaacctcaccacgagcacagcagcgtgcaccaggctcaagccgagcagcaccgccgtgccctgcatgctgtgcctgctgtgcagcaggccgagcacccaggacagcatggacaggcccaggaggatcgtgtctgttcccccctgccgctccgcaaaccaggtgccaaaccttgcctccagcgccggctcgacaaatgcgaggcaggcatcctgcacattggttgttggggtgcatgctggggagcactctgggccacaggcgacttctcgcgcccgcctgcctcccggaaacgcattggcaggcatcctcgagtcgccagccgccacgaccccatccctgctcaccagttgtgtgtcttctaccgccagcaaggggtctcgctcaagcctgccggtcgaggatgcggagcacacctcctcctcctgctcgggcgcgagagggcgcgtgatgagccagcgcctcgccttgcaccaccccggcccctcagcccccccnnnnnnnnnnttccctgctcaccagtcgtgcgtcttctacctccagcgaagggtctcgttcaagcctgccggtcgaggacgcggagcacacctcctcctcctgctcgggcnnnnnnnnnntaactcccccacccgactcgccagactgctgtggggcgcatgacagtccacacccaccgctgcccccagctcagggtgctccttggacagcctgnnnnnnnnnncaactcccccacccgactcgccagactgctgcggggcgcatgacagtccacatccaccgctgctcccagctcagggtgctccttggacagcctgcgacgggcctcgggcccgtccgccgccagctgcagcagctgcgctgcgtcgtggggtccgcagcacgccgccactcgctccagggtcagggggtgcgacaggcggacggtgcaccctgcggagggggggacgagcggaccgcttagggggggggttgctgcgagacatcgcgactcgacacgccgcgccgcatcgcccgctcgccgtgcatgccagtcacatcccccaccgcagccacacaccggcctcgctcagcgccttggccagccggatggcggcggcgggtccggaccccagggccagggccagggcggtggaggggggttgggccctcgccaggtcatcgtccaccgccgccagcagctcgctgggcgggcagtcggcgcaggcccccctcagcgccaggggcagggcggcgtggaggttccaggcgaccagggcggggagggcgaggcggcgagcggcggcccccgtcgcccgccgctcctctcgggagcgcagccggccgccggccaggcccagcgcgaagagcagaccgtcgagtgccgtggggctggggttggcgcgggacgcctcgtggagggatttcacgaggacctcgtccgtgctcaccagcaagtactgggtgaaggaaaagagggtgggattgggagggtgagcgcggaagacctcggggatgcgcgcgatacccacagcctccctcccgatcttcatgaataacaacgcaccaggggctcagacaggnnnnnnnnnnacctcgtggagggacttcacgaggccctcgtccgcgctcaccagcaagtactgtgtgaagaaaaagagggtaggattggaagggtgagcgcggaagaccttggggatgcgcgcaatatccacagcctccctcccgaccttcaggaataacaacgcaccaggggctcagacagggtgtctccggctaggacctcgcagcggatgcaggcggcctgaatgggcgacggcaggcgcgcctctacgacgaggtgccaggccccaccaccgccatcgtgcgtcacgctcagcagcttgtgctccagatatacccctgtgcatggagggggcggagaagaaggggagggtgcacccttggattggccttcgagcgtccaggcaggtctcccagccctgcacatatccactcaggggccaagccttccctaacacacacacccccacacacacagcacacacatagccagtcgcctcaccctgcgatctgaggagcaggcggtcgcggcgcaggtcgcaggcgtgcagcgtcaggcgcagctccaccgccctcgaggcggggaggggcagggcgcggcgggccgcctcgacgcgcggcgccccctcccctgccaggtcgcgcacgccggggtccggcacgccgcgtcctgcgcgcgccagcaggcccccgacctgcacgtgcatggccggcacggccgcccagcccgggcgcgccgccaggtcggccaggccgcgcagcaggctctggccgctgggcgggctccctgtggcgccgcagtccaccaggcagtccagggtcacgtgcacgcagcccatgcgcacgaagccctccagcacgtgggcggggatcatgtgctccaggctggagcgtatgtcgcgcggcagctcctccggccccgtttcgtacagcttgaaggaggcacgggtgagcagggcagtgggcgcactctgcgccaggcgcagcggcggcggcgccgcgccgctggtgggcaccggcgcggtctggctcgggaggagtggcgccgccacgggctggcccggcggcggcggcagcgnnnnnnnnnngctctgcgccaggcgcagcggcggcgccgccgcgccgctggtgggcaccggcgcagtctggctcgggaggagtggcgccgctacgggctggcccggcggcggcggcagcggcggcagcggnnnnnnnnnngggcaggctctgcagcagcggcgccaacagcgtgtcgccgcccagcgtcggcacgggctggcccgccagcaccggcccaccctccagcggcaccaggcccaggcccgaaaggggcgaggagggcgacgccgtgcccgcgcgcagttcgtccagccccgccagcgccggcgggggggcggcgggacgcacaatcccggccgccggctcgaaggctgaggcgggcatggcggcctccaccgccacggcagaggtcagcggggagcgggggttttggccctgggaggaggagggggcgctgggatgctccgacccccaggacgacacggagggcagggaggaggggtcccccgacacggagcgcagggggtgtgctggtcgtgggtcctcgaaccggctccagccagcggcctgggtgggttgagaggaagagggggttgggggggtgtctggggaggggagggccgacctgcgccagggatgctgcgaggcgcatggacaccggcgggcaaggccagggcgtcgggcgtggggtccaaacacctttccagtcccccctcatcgccggctcgcctggtggaaggggcccacgaggccgagcgagggcgcaacctggcctgccaatgcggggcccgcggaggcatcccccagctccagggccgggaggggcaggccggggggcgcctccagctcgtcccagggcagnnnnnnnnnngacctggcctgccaaggtgggtgccgcggaggcaccctccagctccagggccgggaggggcaggctggggggcgcctccagctcgtcccagggcagcccctggtccagcagctcgtcgctgcagaagctggccggctcgccggcgccgccctcgacagggctcagccccgaggactgccgccccgcaaggtaagccccgctatccgacgtctcctgccgcgcccggcgctgcnnnnnnnnnnaggggggcagcgccggggagcaggggttcagggcagtgtgcgtgtgcagggcaggggcgccgcggcgcgggtcggggtgtcaggcgctgtccagtagggagccaatgtgaggtgcggggtgggccctccccaggagcatctgtggacccccccttacctgctccgcacacatccaaacatggggaaagtggtcattgcccccactcccaannnnnnnnnngcggcgccgcccttgacagggctcagccccgaggactgccgcgccgcgaggtaagccccgctgtccgacgtctcctgccgcgcccggcgctgctgctggcgcagggactcgcggcggggcaggtccgtgcccgaggacagcagctcctcggattcctgcgtgccgggggggcagcgccggggagcaggggttcagagcagtgtgcgtgtgcatggctggggcaccgcggcgcgggtcggggtgccaggcgctgtccagtagggagccgatgtgaggtgcgggatgggccctccccaggagcctctgcgggacccccccttacttgctccgcacccgtccaaacatgggggaaagtggtcattgcccccactcccaaacccatccacactccgacggccctgcccacctcagagctgggtcgggtcgcgctggagcgccgccgccgcccttgccgccgcgagcccccgtgggaggacgcggcgcggcccttgcgcgactcccgccgcttggagttgtgccgcgccaggccctcgcggcaggagcgctgcgtgccctcgaaagcctccagcgggtggaacacgccgtgctgctggcagaatcgctggagggcgccctcgtgcgtcaccgcctcggcgcggcggtgggtggagcagaccttgtaccgcacgtcgtaccgcgccatgctgcccagggacgaggtgcaccccgcgacctgagcgtggggtgatgaggggggtgggcagggggcagggggcagggggccaggtaccccaggggacccacgggtccagggcatttgggcgccatgggcccgttccaaggccctcccggcaccgcgagcaggccagccccacctggcaacgtggattggtatcggtcgtgaatggaaccgtcacgttctgggaggaagtggccaagaccgccgccgcagggacgacctggacgttgtaggggtcccatacgaggcccgtggggggccccgcgcggccgtccgactcctccgcagggttcatgtctgcgggatgagcgggacacaggggtggttaagcggcatcggcaccgaacaacgccatgaccgatcccatgggcgccgtcctgtgcccattaccacgattgacattgcagcaccaccccgcatcgtggtaagggcgaccacagcgtccgtaccatnnnnnnnnnncgacattgcagcaccactccgcatcatggtaagggcgaccacagcgtccgtaccatgtaccgacccatgaccctactctccggcctcaactaagcatcctggggatgttgatgggggtcacatagggagaacctgcgtccagaaccaggcatcattaccccagacctcctgcccagcgcctgcactcgacagaactcgaaagagcgcacaaggatcgacatgtcaaagcggacgctttcaagggcccggcccccctataatgttaatgacgatccttgggattttttgtctgactgtagcagggcccaggatgcaacttgccgaagctgagtgcaggtacctctcccacaggatcccaccctttcttctggcctgaaccgtccgcagcagatcgctgggcgccgagggccccggggcccccgggagatcagatgtcgatttgcgctgagtgatgaagatggctcggcacgccaagtagaccctgatactggtgtatgctgcccggaatccgtggctgtatgcgcaatggcgagccccgatcccctgttctccgtccgtaacaacttttacctgggagcctaccagaccgcgatcagcgatgcatcatccctcacgggcctcagcgaagatcagaagctggagcgggacacctttgtgtaccgctcctatgtggagctaggcagctatgaggtgcgggggcccgccattccattcccatgcgcttccccctcccctcccttctcgcagccccaccccagccggccgcccccaaccgcacgcccacagatggttttgtctgagatcccggccgacgcccctccccccctcgccgcggtccgccagctggcctcctaccacaaggccggcccctccccctcctccccggtccccgacgccctggaggctggcctgtcggacggggccctctcctccgaccccacctacctctacgtcacggcgctggtgcgcttcctgcggggcgacgccgcgggggcgctgcgcctggccggccccgcccgcacgctggagctgctggcgctgagcgtgcaggtcatgctgtccctgcaccgccccgacgccgcggagcgccagctccgcgccatggccgccatcgacgacgacgcgacgctgacgcagctggcgggggcgtgggtggcgctggccgcgggcgggccgcgcgtgcacgaggccgccagcatctaccaggagctgggcgaccgcttcgcctggacgccgcgcctgcacgccggcctggccagcgcgcaggcgtgcatggggcgctgggaggacgccgaggcggagctgctgcaggccgtggaaaagaacccaaaggacccggactcgctggccaacctggccgttgtgtccctgcaccttggcaagcccgccggacgctacctcgggtgcgcagggtggacggcggcgtgggagggggggaaggggcggttgcgcgccgttctgtgcagaccggagggggagggcccttcggagtgcgggcctgtacggcgcaccacgagggccccagagcctgaaggaatcgccccttccactcgcagggtgctcaaggatgtggcgccatcccacgccctgctggagcggcgggccgccgcagaggaggcctttgaccgtgcggcctccggcatcacggcctgactccctcgcggcgcaatcatgcgtcccctgggaccggactgcgctgcttgtatggaaggcgcagcgctccgcccccccacccttgcgacccccaactttgcccttcccccctgtcccgtgccctttgctgccccggcactggcgtcccctgctgtcaacaaggctggtgacgcccaaacaaacacgcggcgcggctcgtgcatgcgtgactccagccccgggaaacgcagtcggccgagccccggtggggggtgcctgggcctccagctcgcagcccgcccttcnnnnnnnnnncacgcccaaacaaacatgcggcgcggctcgtgcatgcgggactccagcccctggaaacgcagtcggccgagccccagtgggtggtccctgggcctccagctcgcagcccgcccttcaggtgctcttcggccgcgccccgcccaccccccggcgcaggtgctggaaggaggccagggtgcggcgcaggccctcatccagcgacacggcggggcggtaccccagctcccgcttggccgcctcgcagctgaaggttctgtccacgctggccagcttgatgctggggtgtagggaggggaggggatatggagtgtgggtgacaaggggaagggggaagggagtgggtgacaagggaagtgggggtgatatcaaaggcatggcagcacaaagtgcgccaggccaggggcctccgagggcagtgggagctccaattcatggcttgacactgcgagactgcggtgcgactgggaccgcccagctgctcgtgcgtggaggactcccatccttccccccctctgtacaacaaagaacacatgctcaatccctggacaggctcaccggaaggggnnnnnnnnnntagctgctcgtgcgtgaaggattcccatccttccccccctcagtacaacaaagaacacatagtcaatccctggacaggctcaccggaagggggtgaagtcggagtcgatcctcttgaagggggccagcaggggcagtatgacgtattgcatgagcagcgcaatgaagtagacgaggtggaaggggaggcggacggaggggcgcgggtagcccagcccctcgcacaggtcgcccatgaagccccagaaggggcgcgggtcatcgttggtgacgaagaaagcgcggcccgccacgcgccccacgcggcgcgcgtcgcccagcgcggcggcggcgtccaggtgggcctgcgccacgttgcccgcataggtccagtccatgcagttccggccagacccgatgatgtacttgagcttgccgcgcgccgcgttgctggccacgctgggcacgaggagcgtgtcgtgctcgccgaagatgccgctggggcgcagcgccagcgtgcgcaggccgccgcgcccgttcgctgccagcaccgccacctcgcctgggcattgagggggggtgggagtggtagtgagctgaatcgaaggcaccgccccaagcgcccaggtccaaggccnnnnnnnnnnagctgccagcaccgccacctcgcctggtcattgaggggggttggagtgaaagtgagctgaatcgaaggcaccgccccgagcgcccaggtccaaggccacccgccgccatcccggggacaccgtgcgagagccaggcagacatggcagccccaccaccagagacgcaggccctaccgcgccctataacaaaaccctgcccaccttgggccttggtgcccgtgtagtagtccatgtggcgggccgcgtatggcgtcgactcatccaccttgacgagcggcgagccgtcgaagaccacggaggcggagctggtgtagacaaggcgcgagacgccatggcgcgcgcacgcctctacgacagagcgcgtgccctgcacgttcaccgcgtccatcagcttcaggttggcggcgttggcggcagtgggggccgctgtggcgcagtggaacaccacgttcttgcctgcaggtttgtcatgtatgtggttttgggaggacagtggatgtcaatgctttctctgatgtccctgcatcgatgctctcatgaatgcacccaggaggtgcaggcctccgacgccatgccgggacaactcctccatgcccacctttgcatgcggcgtccacatcgacctcctttgtcaggtcgccggtgatgtacttgaccccgnnnnnnnnnnacaactcctccatgtccacctttgcatgcggcgtccacatcggcctccttcgtcaggtcgccggtgatgtacttgaccccggggaaggggatgacaggtgggcgaatatcaaagaccgtcacctcatactcgccgctgtcagccagctgggcgaccaggtgctgacccaggaagccattgccccctgtgaccaggcactttgtcttgctcggagccattacgaggagctccgggtgggtcttacttttgcttcttcagcagctgcaaggatagtttaggggggctgtcaagcaagtgcgcattggtgcgaaccccagtctcagtcccactgcttcatgccgnnnnnnnnnnctgcttcttcagcagctgcaaggatagttacgggggctgtcaagcgagtgcgcattggtgcgagccccagtctcagtcccactgcttcatgccgcctcacctcctgcagctgctcagcagatggggggcgtggcgcttccggggggtagacgacgtacgatcgctgcatgatcggaagtggaagcccatttgagcatcgggactacactatgcagactcgatcgtccaccacgcatcgacaagacaagcctcacgttgcggatgatggcttccaggttctcagggcgatagacgatggctcccactagcaggattgggatagtaacgtacacgccgaacttgaatagctgcaatggatttgggtgggaagggatttcagacttggtggacacaccgccgctttaggccccgcaacaccgcacagaaacagccttctcgatttcagcctcctacctccaggctcttgtaacgcgacatgctgaacttaagtctcaggctgctcaagatggggatgggcttatgtgcgtgatcgaggcccagcccgtgccgtgcgcctggttctcctccaggcgcgnnnnnnnnnngagtctcgggctgctcaagatggggatgggcttacgtgcgtgatcgaggcccagcccctgccgtgcgcctggttctcctccaggcgcgcggagatccatgccgggacggatcacatccgatcggccgggtgtaatagaccgtgcatctctgcatatcagaaaccaattaaagagaattcccgctgagttgcatgatggcgaatcccagacagacgctgcgggagtggggtgccgagccggtgccaccgaatggacgcctggggcctgagtactccctccagcctcccagggccagaggcttccaggggctgtatgacaaaccagcaggggtgagagcacgctttcatgatggcatgtgttccagcatgcgctgcttgagggtcatgggcgcctgactaaccatgtctgagccggcaatgcctttgatcgtatgcagggcttgctgggcctctggcagcgcaccctgggaaccttgaccctggacctcaagagacagatgtaggttgcatttggaagggagggatggaaaacagggcatttacttgtcctggggctgatgaagaggcactggcatgatttgaagccggcaaaacatggtccatgttgcatccctcccttcccctccctgtgcagcttgcccaaggacgacacagccaggccttccctatttcgactacgtcgtcaggatcctgtgggctctggaccaagaacttatttagggacccctgtcaggtgggctctggggaatggtttggatcaagtgcgattcatgctgtgaaagcaatctaatgaatgctgccctacgacgcaaagcagaggttgcatgcctggtannnnnnnnnnaaatgatttggatcaagtgcgattcatgccgtgaaaccaatctaatgaatgctgccctgcgacgcaaagcagaggttgcatgcctggtacacgaccacaagatgtatgctcgtaaacacttggcaatgtagagaagaatggcttggccgcttgtgccggaagcgtgcctgcaggtgcacacaccataccaacccacaccttccatcccgctccacagggcacgtcggcgtggcagctcccagttcatcatcccacagcagcagccgggcgcggagatcacattcccagaggtggcctttgacgacagcggggcgcggttgaaggtcatgcgccacgtccagtttggccccgccttctaccccctgactcggaaggtgggggccccggacggcgcgccgtccccctgcttcgacctgggcgtcggcgctcagctcgaattcgatacggctgctgtacatgccaaggtgcggagggtgcggcggaggggggtgggtggtggtcacgcccttgccacggggtggctgatcatcctgtgcttgacnnnnnnnnnnggccaaggtgcggagggtgcggcggggggtgtgggtagtggtcacgcccttgtcacggggtggctgatcatcctgtgcttgacgcaaggaatcgatgtgcaggaacagggcattggtaccggcctccctgcgcacggtattggctgcagtgaagcataatcaaagaagcagtgatcgccggctcttgacccctgacaatatcctacccccccgggcaggcccgtatcaagttccaggactggctgtccctgaaggcgctgccggagcccgccatcaagctgcaaaagcgctttgcgctgggcgagtccggcgccggtgtgcgcgtgagctacgagtgcccgctgcgcgcgctgggcacggcctggcagccgccggcgcgcctcctggtctccatcgacagcgcggtgccctccggcctgaggctgacacagggcggcgtggagttcgaccaggccctggccctgccggggaacagggcgctgatcaggggggcgggccgcctgggccttcccagccgcctgccgctggaggagggggagccgtgggtggaggctgacgtgcgccgcctgggcctcaaggccgtctggtaggcgggcggcagcgctcgggaagggggagatacctgcgatgcagtcctagatgtgttccctcggcccctgctcatcgccaacacgagaaggatatgtcccattcttgatcaggcctgtacagtttgcaagagggcaggcacgcgccggagttcaaaagagatgttttggagggtattgttcggaggccagggagaaaaggcaagtgcaagggaaggtgacggtgcaggcgaggcgcccacaggccactcgctctgcaagtgggtcgccgcctgcccctccccatggagcatgcgcgcagcacatggtgtgcaggcatgcgtcagggccaagcctgcgccgcaggcgcctctgcttgccagatgccggcggacgaccccacccacccatgccggccggcagggcagaggggcctgcgccgctgcagggatgtccgcgagacgcccacagccctggatctggtcgggggtcggggaccatgtcctcccccgggatcaatcagctccccaggaccagcccgatgcccaggcccagcgccgcccccgccacgacctgagcgggggtgtgccccagcacctccttcagcttgcgccgctccgaaacgggatggtgggccagcaggtcggccaccaccgcattgagcacctcggcctgcagcccagcgtgtcgccgcacgcccatggcgtcgtacatgacgatggagccgaagcagaagcagatggcaaagaggggggaggccaggccgtgctggagagccacggccgtggacagggactgtggggaggggggtggaatcaaggaggaagcgcatgggtgaggcactgggctctgtccaagctgggaatgccatgtagctcctagtgctcaaaccatgtccagggaatccagtggggcagaatggtggggaatgcgaagaagaggatgaggcatgcaacgccactctgccaacctcccccaggtacaaccccggccctcaactgaccgagcagagggaggagtgggaggagggcatgccgccagagtcaaggatggccatcagggagaaggtgcccgtcttccgccacttggtgaagatcttgaggaactgggccaggaagcagccaaacatgccgatgagcaggaggcggttggtgcacatctcccccaggacctgctgccctagaagcaggggtgcggcgccctgcagcagtagggatccccggctgctccattggctgcaggcgtgtggaaggctatgggtgctgggtgggttttgacatggcgtgcagtgtggctttgttcaaactttggacatcctcaggaatgccacctattcaaactcacgacatggcgtccaagccacagacccacagcaaaccaccaaaagcagccaggaatgtatccaggctcaccgcctgacgcccaagatggaggatgcccagatggatttgggagtcgcgtccccagtgccgaccagggggttggccgaaaagggctccagacacgatgcagcgctgcaggcaactggnnnnnnnnnntgcccaagatggaggatgcccagatgaatttgggtgtcgcgtccccagtgccggccgggggggtggccgaaaagggctgcagacacgatgcagcgctgcaggcaactggatgatccgcacctatccttacttggatgaatcgggacctagactttagacgaatctgcggtagggtcttcgcagacctgaaagatgcccaggcagggaggttggagactcgagccccgcaagccgtgctggtgaagtggcccgcaaagccatccatgggactaacggatggccagatcatggatcatatgtgttcatgctatccaaacctggctaaatccctagtacgaaaggatgtgggagttgtgcatccannnnnnnnnnccaagcctggctgaatccctggtacgaaaggatgtgggagttgtgcatccacgggcaaagtcacaatcacagaggagggggtggatggcccctccctgcgcgcgcattcctctccatgcgatcggatctaccgcaggttcctcgctgtgacaacccaaaatcagtgcaactccgggacacttcgtactgttgattctcttcagggacataacatcatgagtttctcctccatgacctgccgcggcacatgccacgcaagcgtgtcattgcgagttctgccggcactcgggtacgctcccaaactcgcacccgcattgagggtccggagggcgctctcgctgccgaggcggcttgcctgggccatcaaagcggatccaagcaacggatcgaagcaggtcaggggcaagcatgtggatgacaggaggctcagcgctgggaattcggaatccctccagcatgaatgtggaagccctcaccctgcgatgaagatccaccccgaagcccgtcctctgttgcagggggaggcagacgaggagcccatctgggccaggagcgagaagttcgccggtgctggcttgggaacccccagtttaggatttggagtgtacctgcttgggtctgcaatcgtttcgatagctgcagtgagtgggtgggtcggggactgtacaggagcaggccgctgcaagcatcgtgctccactgtgcagcctcctgggcaagatcccacctggctccccttgagtatgtgccacgtccatctcatccttctnnnnnnnnnntgtttcgatagctgcagtgagtgggcgggtcggggacaatacaggagcaggccgctgcaagcatcttgctccactgtccagcctcctgggcaagagcccacctggctcccctggagtatgtgccacgtccatctcatccttctgccgcgcaggtcgggtccatcttcgagtttgcaaacaagaaggacttgttcggcttgattcccccagagtcgcccctctgggcgcccatcctcctcttttttgcggtcacgggcctcccctcagcaggtcagtgaggttatcaggcgtcactggatggtgctcattcgtgccttcttgtcgttgcatcctggtgccatgctcagcccccccaactctcaactggtccctggaacccgcaggattcctcttcgttaaagcggtgaatgcggccaacaaggaatcagagaggctggacaagctggatgggcagtagaggagtggcagctggggccatgcatcttctgggatccaggggctcccacgctgcccagcaggggataccagacgtatgaacttgctttcagggccctgatattcagctgcaccatatcttgcgctcttgagggacgcactcacgcgctgtaattgcctaatctggacggttccgcttcgaggcatgtccctctggaggtctatctgttgggcggggcgtgctctcgtcatccttcacccatgcggtagccttttgtcggttgctcttgagcccaggcagaccttgatcctgcgcttccatggctgctccgtgccatgccggcgggggttcaacctgctcgcttgccacctccccggggtactgcctggccacgccgaactgagacaggggaaacgggaacggctgcgcatctgcgagggcaaaggggggagagagtgaatatacgcaccatgaattggaatgtatgcgctaatctaaccatcgagggggacgcggcacatcacatggggcctgcgtcccctactcgcaagcgtcggtttagccaccaccccctaacctcctcccagcgaccgcacattcggtggcgacgtccagatcctctcgcaacgttccgacggcccgattaatctccaccaagaatcgatgcacagccaccgcagtggcctcggccgctgcctcgatctcagcctgccgctgggagggttccttcccgcctgggccctgcgacattctgctcccctcgctccaggtccaaaagcagatcccgattcttgccccctgctcaagctagatgttcggcagcatgcctgcatatcgcactgataacctcgtagggcggggctggagcggttgagcaccatccgagaatgcacaacgaagcccgtgaaggcgcgggagccgggcacgtgggggggcccgaggggtcctttggttgacccgtcttgtccagccggggttcacagaccactggagccaggtccagcatcacgcccttgccatctcctcatcctcgtcgtcagaggagacgtcctcccaagccgcctcttccgcccaggggtgtgccgctgcatcgctgagcttgacgccgggcgccatggtcgtcatcaacttttccagctgctgctcgggaaccagcatccccacgatgcgctctggggggtcgtcggtggtggacacccgcaccagcctcagtcggcgcacggagtcctggtctttgccgagggcgtcctgcatgggtcgccagcagcgcagcaccgaccccgtcaccacgtgggccctgcggaagcgcagcgcctctcgattctctgaagcctggctagctgccacaaacgccttgagccacagggccctggcggccttggcagagagtggctcatgcttgaatcgcaggtcctggggagggggcgggtgggctagtcggtcgaagcgcgcgtgtgatgtgttgagacttgcacctgatccaggggtcacccgagatcattggcagccttcccctgcctgtattggctccagacattccctcattcaatcttcgccgccagcgctggacagcctgtggaaggcttgcagccgcccccacccgcccagcacgctgaccgagagtgccaagggctgggccagcctgccgatcgtgggcctgacgatcttgaaggcggcggggaaggcgccgtgcatgcgcagcgcgagcatgacgtgcacgcccccttttgaccccgggtggccggactggtagtagccgctctcgcccatggcgtgcactgctgccgatgcgcttgcccctgagagaagagggggcatggcacctgtgtgatggggcgcgcagctgcagatccagcccgagactcccttggcaagtcccgcacccgaagctcgttatgccagccatcacaggccaacacggcaagctcccccattccacactctggctcaccattgctcgccgcgtttgtggggctttcgctcgcatcctcgccacggcggctcgcgccagtgcccgcccgtgcagccctgcagccggggctggcgccggccactggctgcctgggtctcgcgccggcttgctcccttggtgacacggccctctgcgaccccgatggcacggcgggagcccccgcatccaccctggccggcgagcgcgggtttggcgctccgggcgaggtgccatcctcgccgcccttgtgtgcggccagcatgcgctcggcggcctcccagctcatgccacgatctaaatgcacagtgtgcagcaaggccgtcgccccactggcctcatcctgcaacaatggggacccggtgtgctcaatcgtgtgttgctgaggacgtgctctgacgatacgcgctggctccatgcgtcacacaggtcggtctcatttgtcgtcccccatgtggcaannnnnnnnnngatcgtgtgttgctgaggccgtgctctgacgatgcgcgctggctccatgcgtcacacaggccggtctcatttgtcgtcccccatgtggcaannnnnnnnnnnnnnnnnnnnnnnnntttgagctctgcacactagaaccccacctctcaccctgaacagctggaccgggtcgggctctagccgcacgcgcgtggcgcttagcgtctgcgtgcccacgtccagcgtccccgcccggccttgctcccgcacgtgcagctccagtgccgcctggaacatgtcaaacagttggcgctgctggaccggggccagacccagcaggcggttgaggaagcggggcacgtcagagcggtccctctcctcgatctggcccagcctgcggggcacgccaatgtcagatgccaggaagttctggatggcagaggacagcgggtgctcctcctgggccggagatttaccgggcccggatgaacggaagggacccagtcgcaggatgcccaccgccagcaggtacgcccgcagcctgccgaggtaatgctccgcaggtaccgcggggggctcgccgttggggcctggtacggcacacagggtggggtggggtggggagcgtgaggagatgggtgggaggggagtcgacgnnnnnnnnnncggggcctggtgcggcacacagggtggggtgggctggggagtgtgaggagatgggtgggaggggagtcgacgagagcggctgcactcgagaatgggccgagggcaagcgggagaggggcacgtggagttgccccacggtggacgcctcctgatggcgcatgcatgcagagcccaaccatgaggagctcccgccgcagggcacaggcccacctggatccactccccgccagcaccccccgaccacgcagtgcatggcaggcaggctgccccccaaaaggggagcgcaccggtaggtcccgcaacgannnnnnnnnncggacccactccccgccagcacccccccaccacgcagtgcatggtaggcaggctgccccccccgaagcaggggagcgcaccggtaggtcccgcaacgatgacctgccgccgtcaccagcccacgtccccggctcgcaccccgccctggcacccaccttcccggcaggtctcggggagcaggtcgggcttgtgtgactgctgcaggatgacgctgtacatggtcctcagtgcctgctgcccggcgcgcgactcgtagttgaaccccaggttcccggggccggccttgcggtcgccctgtaggaggaagggggagggaaagggcggctggaagtgggtcggctggcgatgggcgcggtaccgccaggccgcaccatctgaaattcatgtgcccctcctgcatgggaaccccaggcaagcaccccatgtatgcctgccgtgaccgcctctcccacggactgcacttgcctggcaacatatacgtaaggttttcctgtcccctgnnnnnnnnnntggaagggggagggaaagggtggctggaagtgggttggctggcgatgggcgcggcaccgccaggccacaccatctgaaattcatgtgcccctcctgcgtgggaaccccaggcaagcaccccatgtacgcctgtcgtgaccgcctctcccatggactgcacttgcctgagaacatatacgtaaggttttcctgtcccctgtgacgcactcgggccccccccacccgagacacagcaccctcttcacacctgggtcagggcacccagggtctccaggcggcgcgacacggcggcggcaaagcgcgcctccccgcccaggggcgtgaccaccagcttgtactccggccccgaggcctggttggcgcggtggctgcgcccaaactgctggatggccttgtccgccgaccagggcagctccagggtgaggtgcacgcgccggcgctgattccctgcacgccggtcggcgtgcagggagatgccggcggaggcggcctcgctgatgatggccaccagcttctccccggccatgaaggactggcgctcatggatgttgatcatctctagcgtggcgcctgcaggaaaggaggggaggggttgtttgagattcccatcatcccaaggagggaaagtcaggatgagtactcgaaccgacacctgggaccaggggcttgctcctttccatcaaataaagcctgggccacccaggcccaggtctctctgcacgtcagccctccagacccccgcgtccactgcacttcagccctggcagacannnnnnnnnntgtactcgaaacgacacatgggaccaggggcttgcacctttccatcacagaaagcctgggccacccaggcccatgtctctctgcacttcagccctgccgaccccagcgtccactgcacttcagccctggcagacactccctgccacacagggaggccaccacatccagacagcaatactcctgcgcacccttctcgacgcccgaggcgttacgcgcctcgtacgtgaccgtgcgagacgacttggagcgcacaaggcgacccttcctccccgtcatctccgccaccttctccggcccccccagctcgtcgatcagcacgtccagggggttgttggggaggcccaggttccccacagccgccaggatggcctcgcgccgttccagtgccgtagcgtgggcggcggcaaacttttcccggcgcaggatggccagcgccgcctgttcctgcctctacagagcgaagcaagaagaaggggggcctttcggtgggaatctcctgtgtcggccatgcatgggcgggggccacatgccgacgcaggagcggattggcacgggcgccaagtggaaggaggcagcagtgcttggtgccgctcaagcatgcgatggcatgaataagttcgaccaaggacttnnnnnnnnnnagcgccaagtggaaggaggcagcagtgcctggtgcccctcaagcatatgatggcatgaataagttcgaccaaggactttaggtcccccattgccagccagggcaaacacccacaccccgcccagcaccttggctgctgcctcaggggtttctttgctgtcttcctcactgacgccctgcttggagctctcagagtcggactcgagaccaatctcggcctcactctcctcactctcctcctcctcctctccggaggtgttctcagttttaccgtcaccagagtccttgcccgagacggaggcatccgaggcggatgactgtagcgacagtgggtccgaggggtggccatcagttgagggacgatttcggtcatcatccaggcagcacatgctgctgacagggcatctggtgatctgccagacacgtgcagggtgagcaggagannnnnnnnnnaggacgatatcggtcatcatccagggagcacatgctgcttacagggcgtctggtgacctgccagacacgtgcagggtgagcaggagacccctccacccacacgtcgacaccctacccatacgctgactggccaggaggcaaagcatcctgcttgccaggtcaccccacccacacagccgacggcaccacatcccctcaccctgcgctgacgcttgctgggcggctgcgacggctcgccctccatccgggaggaggacagggaggacgacggcacatcgctcgggtccgagccatcctcctccgagtcgctgtcnnnnnnnnnncgactggccaggaggcaagcatcctgcttgccaggtcaccccactcacacaaccgccggcaccatatcccctcaccctgcgcggacgcttgctgggcggctgcgacggctcgccctccatcagggaggacagggaagacgacagcacatcgctcgagtccgagccatcctcctccgagtcgctgtcctcctcagaggtggatgtttcagagtgcacgccctcgtcctcgccaaactccttgtacctcaccggcttggccttggcggaccgccccaccgtctccctgccctccgccgcggagcgctggaggccctcgctggcgctccggccgtggtactcctcgtcggatcccaggtccgattctgggttgggtgagggaggactggtgcagtgaagagcctgaggggcagacgggccatgcaagcatcacccaccctcgcgctcccctagttctatgatcatcagctgcgacgcaccgtcctcctggtcccacagcgcggggctggctggcatggggtagtactctgtaacgagccgcgagagcagctccttggggcctggaaagcgcgacagaggaaaatcagatggcaggaaagggtgatgcagctggggtttgggagggcgagcatggtaggcagcaaggagggaggatcnnnnnnnnnnaagaggaaaatcgggtggcaggaaagggtgatgcagctggggttggggagggagagcatggtaggcagcaaggagggaggatcaaagagggttgtgcgcatggaaatagagggattgaatatgcatctccatggggagccaagcaccctcgagttgccctaagagagtcgcgtggatggccaggcccctatacccactctacccgtcggggagcggcacnnnnnnnnnntgagatgccctaagaaagtcgcatggatggccaggcccccatacccactctacccgtcggggagcggcacgccacacgccctactcccctctttcgccaaacacacctgacacaaagtcatcgagctcgtctcccttctccgccaccacgtcattggtgcgggcctcccccgtggactgcagcccgatgacgatgcacttgccctcctccaccgccgccctggacatgcgcacgacggcggggacctgcggcgcgtggcagcgagggggaaagcgggtctcgattgaggccgcggggttcccaggcttacttctcggggtgccggtgcttcaagcacgcgagccctgccnnnnnnnnnntttggggccgcggggttccaaggcttacttctcgggatgccggtgcttcaagcacgcgagccctgccggcaggaccctacagtgtctcgcctggccttccccatcctccctcaaagccacttgcgtcgctcaccttggcagccatgcacatgtagcgnnnnnnnnnngccgcagtgtctcgcctgtccttccccatcctccctcaaagcaacttgcgtagctcaccttggcagccatgcacatgtagcgaaagaagcgctggtgggagccccagaaggcacgcaggcgcagtgtgcgtgcgtcctgcaggcccgaccccttcttagtgtccaccttggccagtcccgtgggcccaagcgcttccagctgcgcacgcgagggggtgagggggaccccgatttcgactgctcggacgatgagtgccagacctgtactgcagcgtgtnnnnnnnnnncgtgtccaccttggccagtcccgtgggcccgagcgcttccagctgcgcacgcgtggggtgaagggggccccagtttcgactgctcggatgatgagtgccagacctgtactgcagcgtgtcccttctgcaatggcaataccctcctcctcccccctcttccaaaattatggacaggccgcacctgctcctccgcatacatgaactcccggtacagctccagccacatgcgagcagcatcagcgtactgcgaggccacgggctcctccaagggcaccgtcacggtgaggaactcggagccggcgtaggagagcgtgcgcgagacgtacatgccctgcgccttcatgtccatggcgacgagctccagggtggccatgttggccgcctgggtccccttgccctgtgtgtgtgtgaagaaggggagtttgtttggtattattggggagttgggagaggaaggggcttgaacacagcnnnnnnnnnnaaggaggggagtttgtttgttattattgggaagttgggagaggaaggggcttgaacacagcgagcaatggtgaagggaatgggagcccggagcgccccgaggacctggggccaaaggtctgaaggggatcccaaaggtatgcaggccaacccgggtgttggccccttcaaccgcagggccctggtcataacacaaacccttcaaattcagaccctgtgtttctcgcacccacctgcacggcctccagaaacttggcaaaggtggggaaggcagagccacccaggccccacagtcccagccggaccatgtacctacatggcaagggatggccgagggtgctcgatgccggcgtgactgctactcgctcagaaagggaattaggttggccagcggcagacgtcaggaaggcggtgtaggccctcaacccattgcactccaagcaccacctctccacccaaccacccactcaccccatgttgcgtggttcggaggctccagtggccgagcagtacaccactctcgccagtggcagagcagcctgcaggttgctcacttgaaggcccaccttggtggcgcgcgtccctgcttctggcaccaggttcttggccttgtgacctgagggcgagcaggaggccggggcgggagtatgcgcatgggcctgggcaaatgctccgtggcaggcaagggccgagcttgtgcttctctgcctggcgcctcgacggccatgcccccgtgaaaccttcacactgcctagcccatctttagccccggcagcacatcttgacccctgcccaagccgcctccccacacgctcactctcgtcaaacaggatgaggccgtcgaagtccttcccgcaccactccaccagctgcttgtaccgcgattgaagctgcgtcatgggcgcgagagcttgagggtgaggggctggcatgtcatcgggcgtggcatggcctcatccatcggctcgccacaactgctggcgaccttggctggccctgcatcatccatgcagcacctttgacctcgactctagccccacacaggagtcaagaaacggcatatcaggaagcctatgcccttggccctgcaggttcaccttgtcagactgggagacgagagaggcataggtcaggaacacaacaccctccttgatgccgatgcgcttggagtccagcttgccgtagggcagcttgttcagcgagtgcagaggaatctcggtggctgccggttggtgtgggaggtgaatgtgcgtaggtgaatgcccagctggtcccaaacaagactgcaggcggctccctccggcccatgccgaccccaatgcccctcctccccatcaccctccacgccaggcgggagccaggcccaagtgcacaccgacctccaacgtcgtcgaggtcccgccgcgcgtccacccgaaggtccggcccgatggtcagccagaggtggcgccgccggccgcgccgccagttctccaggattagcccggcgatggtccggcccttgcccacccccgcgccgtccccgatgaagaaaccacagcgggagccgtcaggcaacagctgcgaggggggaggggagagagggatggagcatggaagtgcggcgtggggcgcggtgccgcgaggatggatggatgctgtatgctttgggcgggggtgtgtgccatgcggccacaggacagaggcatgcaccccatcatcgtgtttcatggtaaccccttcccaagcctcccaccgtcacatgcagatgtgcacatcccttgttgccaggaccgggtttcctccttcccctaattccttcgcccccaaacaaaaagggaagaatgacctgctcgtggcgctggcagnnnnnnnnnncagcctcccaccgtcacatgcagatatgcccatccctagttgccaggaccgggtttcctctttcccctaattccttcgcccccacacaaaaaaggaagaatgacctgctcgtggcgctggcaggcatacaccacgctctccagctgcagcgccgacagcacccccgcgtccaccagctctggatgggcgccgaggctgtatttgacgtcaggcggtggcactgcggacagagaggacgtctccaccactgggtcggggtgggggaagccgtaggggagcttggccggctggtaggtctgcgcggggggtgggggggtgcgaaaagggttcatacccagctgcgagtggcgtcgtgcgggggcagcggcaagggttgcgccttgtcagcactcatgaatccaggatcgccagcnnnnnnnnnnttcatgccaagctgcgagcggcgtcgtgcgggggcagcagcaagggttgcgcctcgtcagcactcatgaatccaggatcgccagccctctgagggctggtaaataacgaagatggagcccagaagggcaaggtggaacccgccaccacaagcgtgcaccgccagaaatcctggcacacaaacctacttcccacctcgaagacctccccatcctcggcgtggtgaccgacatcctcaagctcgacatcctcctccttctcctcctgcttttcctgggcacccgggacagcctggcaagggtgagcggccactgggatggcgtgggcaggagtccacagagtgggacatcgaccaacatcgcggcctcatgctctgctgactggcacccggggagcccatggagagccggaccccgactgcacgcccagaggcatgttacctgctggaggacagctggaggtacggtgggctgagccctggcaggcccggcctcggctggggtgggtgcacctgcctgacttccatttgcctgggctcccgcggcctgagcttgggcgtgttttcgcagagcctcctgtagcatggagtgggggctgacacatcgcacaggtgggcaccnnnnnnnnnnctgggcgtgtttccgcagagcctcctgtggcatggaaggggggctgacacatcgcacaggtgggcaccgcacaacgtctgtcggcagcagccgatcaaacaggccttgtctccccacgcccgcgccccattcccacaggcctcaggcccctgcgcctgtcccggggagcaccccgtccacacctgcaacctcgaaaactcgagccgcgaactgtacacaatgcgcgtggcccggaagcgcacatccttttcgcgctcgaggtccatatccagtcgctgaattgtggagcagtgggggcagacatactccttgtctgccagcaccaccaacagcttccccaccaagactgggaggtgggggtgcgggtgctgggtgttcctccggagacagggcttcctaggcaacagcaaggggcttctcaagacacgacacaagccccatgctggcacgaggatcccagcgccatcaaccactctcccgcacgcactgtcgacgtttttatggcagctcccacactgaatctgaagcacgacgggattcagcaggcgctgcatgtgctcctgaaacgcgacctgcacccttggatccgccattatgtggatatgtcacggcacgccggaggcaaaccggtgtggatgctcggcgaagggattcctccgtcaggtttcgacagaggaggcatttagcaagggcacacttcccatgtcatgcacagcctccagctccaatggtagaagctgttgtgtgtatctcgcatggattagggcctgcatgaatggtcagtcgagcgggctgggtgcagcgaggggggcccacacctgtccttcaaattggccgcaggggtgcgaccgtgctgggcatgctctccagggttccgacccacgtccatgtcggtgggacgacgaatgcccgcaaggccatgcacaatcagagcgatatcaagttccaatatcgagaaagggaacataaatatgctgctcacgccctgataatcacctttggggacttgttatcctcgcacgagacgatcacaatggctttcgactgggcagggtgggccctcaaagttggtagcatggtgagtgctggcaggcaagcacgcgatctagatgccatacaaaacctgcaatttttcatttgttccaatgtatccatccagggggcgggcgtcacgctcgcgctgcttgctgccctcgtctacttccaggagaagctggtgaggggtgccctggccatgggaggtgctgtcgagccggaacggccgccctcgttgcccccttcccttaataacgccctcctgctccatctcataccacagatatacgtcccgcgcctgcctggcatgcctgctgcctaccagttcttcccagccgagtttggactggagcatgaggacgtgtggctctcggtcccagatggcgtgcggctgcacgcctggttcatgtggctcaagggtttgaccccggagcagcgccgccggcgacccacggtcgtgttcttccaggagaacgcggggaacatgtcgtaccggtgaggggagggaataggggttaagctggggatgtgggtttttctgcatgccctcctgttcccaggggggacccaactctttgtctgaggacgtcaacacttccatggtctcaacctttggtgtccaagttatgccccctgcccacctcccaccacaccctgccaccctgcccacctcccaccagactcnnnnnnnnnngagctggggatgtgggttttttgcatgcccacctgttcccaagggggacccaactccttgtctgaggacgtcaacacctccatggtctcaaccttcggtgtccaagttatgccccctgcccatctcccaccacactctgccaccctgcccacctcacaccacactctgccaccctgcccacctcccaccacactctgccaccctgcccctctccccacaggctgcacttcctaggtcccctggccgacctgctgcaggtcaacgtcttcatcctggggtaccgcgggtacggcgagagcggcggcgcgcccagtcagcgcggcttccagatggacgccgaggtggcgctgcagcacgtggctgcccgggccgacgttgaccccgccaagctggttgtgtttgggaggtccatcggcggcgcagtggccctccacgctgcagccgccaccaccgtcaaggtacgctgcctggggtctgggaatggaggcggggttgatcccatgttcggcgtgaactttgctgcgtctccatactcttgctgggctcagtatctcatcaccaatgtctcagatcgcgggcctgnnnnnnnnnngtcggcgtgaactttgctgcgtttccatactcttgctggactcagtatgtcatcaccaatgtctcagatcgcgggcctgatcatcgaaaacacattcacctccctggaggacatcgtcccactcaagatcccgttcctgggcttcctcattgggcccaatcggtgagggacccgagcatgcatgtactgggttctggtgtcgatggactgccctgctcgcatgacgtcagagcgtgggcaggtcccagcattcataagatgcgtcgctactcccatcacatcacaatacccatggcgctccgtgcaggtgtgccaactggctgctcannnnnnnnnngcgagcatgcatgtactgggttctgaggtcgatggactgcccggctcgcatgacgtcagagcgtgggcagatcccagcattcacaagatgcgtcgctattcccatcacatcacaatacccatggcactccgtgcaggtgtgccaactggctgctcaggagcaggtgggacaacgtcagcgcagcaaagaacctcacgggcacccccatcctgtttctgtcctctctgagggtgcggtgtcggggcggggtcgaaccaggggtcccagtagggtctcactgtcctcgcaagcacttccccccccccgtgcgcgcgatggaaggagcctatgcatgggcttcacgcgtccttgcagtcgcatccggcctcgtgcagaaccctgaggctcatggccctggacgtgcannnnnnnnnngatggaaggaacccatgcatgggctttacgcgtccttgcagccgcaaccagcctcgtgcaaaaccctgaggctcatggccctggacgtgcagcggaaaaccctcacctccattccatctttccacccggccgccacaggacgagatgctgccgccgtcccagatgcagcgcctgtacgccctgcacggcaggacgccgtggcgcatgctcaccttcccgcaggcgacgcacatggacgcctacatcgtcgcccggcgggagtactggcccgccctgcaggctttcttctacgacctctttgcggggcaggcagacgacaggcctccgggggatgcgccggggacgcagacggggagcagcggccacggcgtggccccggactgggactccgacacctccaacacccccttcgactgggaggcggtgccccggcccggggagtgagagtggcgggcgagcctgtgggctcgagggacccagcaaacgcgtgatcgtctctcggagggtgggagcgtaccgaggacgcaccaacagtcattggggaccaacccctgtactcttcagcgctctcgatggcttgcgggcggggcgtgccagcgaaggagcgtgggccacgcacgaacgaaacgagggcgtacactctggtgcaccctgctgctgcctgcgctgcaccccctatcggcgctgttttccctttcacagggcgtgtaccgtgcatgtacgctgtgcaacgccgcgtcggggtcagagtcagtcagtgccaggcctgcattcactcgtcggtcagtcgccccggtccgcctgccgcgcccgggccaggttgttccggctccggatggcacccgcccccgtgcccagggtgggcaggcagtgcacggacatgtagggggcccgggcgccgggtgtctgcagcagcggccccggcagctccagccgccccagctgcagggtgtccacccccgccagctcagcgggcggcaggggggcgaggagcagcacccgccgccgctcgccgtccacggcccggacgatgccgacgcccaggcagcgcggccccagcagggtgcggggggctctcggtgctcgtactacagcctcggcaagcagcggcactgcgtcttctcgtgatgcacactgcgcccgggcgcagtgtgcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgcagcacagcccaaccacgctgcagttcagtgcgcgcgcagcctggtcggcggcgaggggccgcgtgaagagggactccaggcgcaggtcgtcccaggccgcctcgtgcggcacggccgcggcgagcgcgtcgcccggcgccgcgccatgggccagggccacgccctggcccatggcggccgcgcagc

SEQ ID NO: 47326 - DNA, 61 bp, Chlorella protothecoides
agggaggcagagtggggttgttaaggcagggggaagtgggatgcaggcttcgcaggcacca

SEQ ID NO: 47327 - DNA, 67 bp, Chlorella protothecoides
ggtccacttccctaccacacgaccctgtctacatgcagcgcgagccgctcccggccactccagcttc

SEQ ID NO: 47328 - DNA, 94 bp, Chlorella protothecoides
ggccgccttcctggccggggaggccgagggccccgccgccgcgcacggcatgcgcgccgtgcgccacgcgcggggcctgctggccgtcgcgcgg

SEQ ID NO: 47329 - DNA, 61 bp, Chlorella protothecoides
ccccgtcgtccaggaacgagtcctcctgcatctccagcgaatcctcgcccgcgcccagggc

SEQ ID NO: 47330 - DNA, 61 bp, Chlorella protothecoides
ggggagtgtgaggcgttggctggggggggggccccggcaacacatcacacatgcacaccac

SEQ ID NO: 47331 - DNA, 69 bp, Chlorella protothecoides
tccctgcccggccatgcccctcgggaaggaagggctggactgggacgcgggcgcacagccgcacctgct

SEQ ID NO: 47332 - DNA, 61 bp, Chlorella protothecoides
aatgatactcagtagaatcggccggggaggggctggcatcatgcccttgcggccgggcagg

SEQ ID NO: 47333 - DNA, 64 bp, Chlorella protothecoides
ctggtggagcgaggcgatgaccacgcgccctccggaggccacctggtgcagcgtgcgcatcagg

SEQ ID NO: 47334 - DNA, 61 bp, Chlorella protothecoides
tcagtatgttggccgctccgttcacgtcgcagttgacgacgttgaccttgcagcctctgtt

SEQ ID NO: 47335 - DNA, 68 bp, Chlorella protothecoides
gatgccagggcaggcctggagcgcctccaggaaaggctggcggaggccaacaggcatggcgggggggg

SEQ ID NO: 47336 - DNA, 61 bp, Chlorella protothecoides
aggccccacctcccccaccacgaaagagcctacctcccccaccacgaaagagcccacctcc

SEQ ID NO: 47337 - DNA, 73 bp, Chlorella protothecoides
atgcgagaagtggaggaggatccctgccgccgtggccgagagcctggacgaggagacaccatggtgtgcagtc

SEQ ID NO: 47338 - DNA, 61 bp, Chlorella protothecoides
cggcgcctggcccccacgggccgccgccgctgccgccgggcccccacccggcggatggtgg

SEQ ID NO: 47339 - DNA, 72 bp, Chlorella protothecoides
tcaggacacggaacccttgcatcaattaggtaagggttcagtctgagcaggctcctgtgaatacatcagcac

SEQ ID NO: 47340 - DNA, 63 bp, Chlorella protothecoides
gtctgcagctggttcttgaacagcacctggtcgggagggaggggatacggtcatacagggggt

SEQ ID NO: 47341 - DNA, 61 bp, Chlorella protothecoides
ccgcgctcgggggagaccaggtgcggctggtacccgtccgcctcgcggcagatctcgcgca

SEQ ID NO: 47342 - DNA, 61 bp, Chlorella protothecoides
tcgacagcatcacgcttgtgcaccggcagggaccagctcgcatccagcaccttgacatccg

SEQ ID NO: 47343 - DNA, 61 bp, Chlorella protothecoides
tgatacactgattcggacaccaacggcagggccgcatagtaacccctgtgcatggtagaaa

SEQ ID NO: 47344 - DNA, 102 bp, Chlorella protothecoides
caccgccgccgcccctgccgaatccgcgacaaggcagcccggcccctgcgccgttgtccgactcgctggcaggccacgccgcgtttaggccgctagacccgc

SEQ ID NO: 47345 - DNA, 72 bp, Chlorella protothecoides
aaaccgggtctggaagatgtcggctgggggctgatggagttgatggcacagacatttgtaatgacggaaacg

SEQ ID NO: 47346 - DNA, 72 bp, Chlorella protothecoides
cgacctgcaaaagtgcgtggactacgccgcggcccacgggtccaggccacagcacatcgtcgcctttggtga

SEQ ID NO: 47347 - DNA, 61 bp, Chlorella protothecoides
cccgaatcgccgggtgattctacggctcggggaattgcgggtccttttagatccattatcc

SEQ ID NO: 47348 - DNA, 61 bp, Chlorella protothecoides
ctgtccaagtgagcaatgaggaggggggggggaagaggtttgtggcacagctaggcaacca

SEQ ID NO: 47349 - DNA, 61 bp, Chlorella protothecoides
agccctcataggccgcggagtggaggggggggtttccggccgcctccacctcgttcacatc

SEQ ID NO: 47350 - DNA, 84 bp, Chlorella protothecoides
ccccccccccccccccccccccccctcaacatcaacagggcagcacacccatgccagcccccccgtccagcgccttgcatgtcc

SEQ ID NO: 47351 - DNA, 21724 bp, Chlorella protothecoides
  modified_base (199)..(250): a, c, t, g, unknown or other
  modified_base (1007)..(1075): a, c, t, g, unknown or other
  modified_base (1199)..(1208): a, c, t, g, unknown or other
  modified_base (1273)..(1282): a, c, t, g, unknown or other
  modified_base (1347)..(1465): a, c, t, g, unknown or other
  modified_base (1711)..(1720): a, c, t, g, unknown or other
  modified_base (2123)..(2132): a, c, t, g, unknown or other
  modified_base (3691)..(3700): a, c, t, g, unknown or other
  modified_base (4401)..(4410): a, c, t, g, unknown or other
  modified_base (5986)..(5995): a, c, t, g, unknown or other
  modified_base (6087)..(6295): a, c, t, g, unknown or other
  modified_base (6400)..(6529): a, c, t, g, unknown or other
  modified_base (7599)..(7608): a, c, t, g, unknown or other
  modified_base (8231)..(8240): a, c, t, g, unknown or other
  modified_base (8455)..(8464): a, c, t, g, unknown or other
  modified_base (8722)..(8731): a, c, t, g, unknown or other
  modified_base (9163)..(9172): a, c, t, g, unknown or other
  modified_base (10215)..(10224): a, c, t, g, unknown or other
  modified_base (10937)..(10946): a, c, t, g, unknown or other
  modified_base (11565)..(11574): a, c, t, g, unknown or other
  modified_base (11998)..(12007): a, c, t, g, unknown or other
  modified_base (13497)..(13506): a, c, t, g, unknown or other
  modified_base (13934)..(13943): a, c, t, g, unknown or other
  modified_base (14977)..(14986): a, c, t, g, unknown or other
  modified_base (15120)..(15129): a, c, t, g, unknown or other
  modified_base (16949)..(17062): a, c, t, g, unknown or other
  modified_base (17150)..(17159): a, c, t, g, unknown or other
  modified_base (17248)..(17257): a, c, t, g, unknown or other
  modified_base (17399)..(17479): a, c, t, g, unknown or other
  modified_base (17893)..(17902): a, c, t, g, unknown or other
  modified_base (19099)..(19166): a, c, t, g, unknown or other
  modified_base (20192)..(20201): a, c, t, g, unknown or other
  modified_base (20569)..(20578): a, c, t, g, unknown or other
  modified_base (20955)..(20964): a, c, t, g, unknown or other
acgagcgcgacggcgggccgcaggccgcggcgctggcgcagcagctgcgcgaggcgggggtgccgcgcgagcgcgtcgcgctgctgggcacgctgctggcgcgctgcggcgccaaggagcgcgtgtccgacctgttccaggaccgcacgttgtcctcacgctttgcggtgctcgccaagcagcacatcaaggtgtgtgnnnnnnnnnnnnnnnnnnnnnnnnnnnnnnnnnnnnnnnnnnnnnnnnnnnngggggttgggtggttgtgtgggggaggagagtgtcgatgggggggcagggggttgcccaggcagggcagaggggggtggcatgggagccgcacggatggggctgtcgattgtgcgtatgacgggcccacctgcgcgtgggagcaggaggggtatgacagatgccggtggggggcccttgtgccagtcgtggcacattaagcatggtggcaggaccccctgtccacccctggcccgtaccttgctttgcaaccccagctgcccctcagctgccataccacccccgcaccccctctcccccctctcaaagggcgtggagaatgtgtacacgcagcatgtgccgccgctggtgggcaccctggagcggctggccaagggcaagctgtcggaggcggagtaccccgccgcggaccgcgctgcgggggctgggccgccgccgccgccgccgcgcctcatcgtggccttcgtcgtgggcgggaccacgtacgaggaggcggccgccgtggcggggctcaacgcggcggcggcgaagggggaggggccgctgccgccggggaccagagtgctcctgggcggcaccggggtgcagaacagcagctccttcctgcgggacctggcggaggtggcggccgccacgcccgcgccgcagggcaggctggggcttcgatgatgcgtcagccgaccgtgctgagattttgtgtcccgaggtccgttgctcgagggcacaggccctgggagaatgggcacaaggagacgccnnnnnnnnnnnnnnnnnnnnnnnnnnnnnnnnnnnnnnnnnnnnnnnnnnnnnnnnnnnnnnnnnnnnngagcttgcgaccagtgccctctgagccttccctgaacgccatgatgtagccaccctctatccccgagaatattatatcgctatttaaacaaaggtgtcctcctgagactgcgcagccttgacannnnnnnnnntgtcacttcccacctgctgctcacccccccctcccccccttcctccctcgtcgcgcgcgatgtcnnnnnnnnnncgttacttcccacctggtgctcaccccccccctacccccttcctccctcgtcgcgcgcgatgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagaatactatatcgctaattaaacaaaagtgtcctcctgagactgcgcagccttgacacagctcaggcgctgaccacgggccagcctcccgagaccgccccggccccacccccgcgtgccacggtcatccaggcccccgaccgacccctgaagcgcgatcatataccggtatcccccaatcctgttccttgcgaagttgtagggcgtctgctgtcgatccaggctccgacatggctgaggcaggnnnnnnnnnntcaatcttattccttgcaaagttgtagggcgtctgctgccgatccaggctccgacatggctgaggcagggcccagcggccggtcaccggtcgtggaggccttgcgcgacacccccatgttcttcagggtgggactgggaacctggcggcggcctggtgggttgaggatagctctccaggtccatcatggatcgatgagaccgggttccatgcatcatgcaccccaccccaacaggagctcatggctggaagcctggccggcatcaccgggaagacgtgcgtggcacccctggagcgcgccaagatcctgttccaggtctgcccagcgtcgaggcggagggcggtgtgtgttgggaatcgcttggcagtgtggccccttgtgtgaccagttcctgcatgagctnnnnnnnnnncgcccagcgtcgaggcagagggcggtgtgttttgggaatcgcttggcagtgtggcccccttgtgtgaccagttcctgcatgagctcccaccccccgcatgccagcctcagaggcactccactcccactccaacacgcgcagacgggtcgcctgacctcgggcagcctggctgcaaccctggccgccatctaccggcacgagggtttctcgggcctgttcaggtatgctggcgcgccggggcccatgcatataatgccgggacggtgtgcgcagcttcccgccaaccgcttccctccgacacgcaagactcctccaaaccgcagggggaacggcgccagcgtgctgcgcatcgtgccctactccgccatccacttcacggcctacgagcactaccgccgcctgctggtggagcacgtgatggcggccgggccgccggggcgcagcgtgccgcccgtctgggacctggcggccggcgccggcgccggcgccagcgccgtcctggtcacctacccgctggacctggtgcggacacggctggcctacaccagcgaggcggccggcgaggccccgcggccccggtacctgaacgcccccgggggaccgtcggccgggcctggggcgcagaacccggcggcaccctgggcagcagcgactccctcggccgccccgacggcgtccacggtggcaacccccgccgcacccagccagacacttccaccgaaagcccctcccgcccgggcgcggctgggcatcggcgccatgctggcgaccacgctgcggcacgagggcctgcgcggcgcctaccacggcgtgggcgcctccatgtacggcatcctgccctacgccgggctcaagttttacgtgtaccagagcctgaagcagcagtaccaccaccgggccgccggcgccagtactgccgccggcgacggtactgccgccggctctacgcccaacccaggggccgcccacccgcgcctccccgtccccgtcatgctcacgtttggcgggctggcggggctggtggcgcagacggcgacctacccctttgatgttgtgcggcggcgcatgcaggtggaggcgctgcagctggagagcctgcatgcgggcatgacggggcggctgtccacgggaggcctggctctgcgctccacgccgcaggccctcctgctcatcgcgcgcgtgcagggctggcgcacgctgttcgtggggcttagcatcaactacctcaaggtatgctttcgggggggagtgtgtgtgtgtgtgtggggggggggttcaggatgaggttcaggcaggtaaaccgggggtgggaatcgccccaggcgctgtgcgggggatggcatctggtcggatggcaagctaccacggccaggatgggcatgcgttccctgggcccggtcagcactgctcggcagggactggcaagccgctgccgtttcgttcggtgacttcactggactcctggtgccaacttttctccgaaatgccgcgacccagcgcattccgtcgttgcccccagggtccaatcccacaaacaacctggccccaactaccactgnnnnnnnnnnagtcagcactgctcggtagggactggcaggccgctgccgtttcgttcggtgacttcaatggactcctggtgccaacttttgtccgaaacgccgcgacccagcgcatgccgttgttgtccccagggcccaattccacaaacaacctggccccaactaccactgccaacacaggtcgtcccctcgaccgccatcggcttcacggtgtacgaccacatgaaacaccttctggctcttccttccaacctctgatgctgggctgctggtccagccatgtaccccctgattggttgcacacacgagttacagcagggtacagtggcagaggcacaagaggggtggtgtaggaagcgagttcgacaggctggccaggtggcagagactcgagccagagcgtggcaggtgctgagcagcggggaagggcccttgggcagcgcgacacagtgtatggggtggtttttgagtgcttgaccgggacagggtggtctgcgagcccaaccccccatcggccacctccagtaccttgcgcatcaaaagggaagtgccgcaagcaagcttggggctggggccggggtcggggagcctgcccttccagcggattcccagtggccaggccggcatcagcagccgacgaccagggtcacgggaggcgacgtacactccattcagcgggtcactgcacgctgcagcacccgcccttggcnnnnnnnnnntaccagggtcacgggaggcaacgtacacgccattcagcggatcactgcacgctgcagcacccgcccttggcagaggcgacgtagtcggcatcagagaaagtggtgccttggctaaagtgtgagtcgcgctccttgcccttgccgtagcccttcccctccagccggcctgcagaagtcccattgaggggacccgcgccccgctcctgcacgcgctgcgagccattgccctgtgcgggagcccatccggctggggcctcctgttggtggtggggaaagtcgaagggcgagggggcctggggcagcgccgagtacgacaggggcacacgagccagctcagcccctgatgagtgcgaccggagggaggtggaggaggtggtcgagggcatggtgtggcgcgaggctggcccgcgcgacactggctccttctcagagccgctgtcaggcttggctggggcttcgggggccctgcggaccaaggggtccgcctcagctctcggactatgctgtgcagccgattgagcagcaggtatcgcaatgtccggcatggggtgccccgccccgatggcctgagcctgtggaagatgtggggaacctcagatacgtagtccgagagaggtgctccacagtgcggccagcccgccactatccctttcgtatgctcacttaggagttttaaatgctatgaaatacgatacagtggcttacgaatgaggacccagcctactatatccggacaggggaacacctggcaggagggttacggggccagaaacggatgcgcggatttcggcaatacgcgggaccgcctgtcgaggtgatcaacatgcaggaagcagaatcatcacagggtttaggtgctcgccccgacatgagacgttaatcccaggctccgcgccctgccccgtgaacggctcccggagaagatttgggcgcgcgcacactgttcactagagtgtgggcgtgatactacagtacagggaggcatgcggagggcggagggcacggcacccggggggcacaggcattgatggacagatgcactgattgctctttatcctaagaatacaggacggggagacctgctctgctcactcaaaggtgagcttctccgcctcctcgcgcagcgcggcaaagagaggggtggagaggtagcgctcgccataggaggggacgatgaccacgatggtcttgccctcgaactcggggcgcttggcaagctgcccgggacaagggtggtgggggggtgggtgagtgagagggttgggcggggggacaaagcctccgagacccggagacattggcatggtacagagctacaccggcccgcgacacgcggcgcattcctgcctccccttctccctcatatacacaccgtgagggcagcctggactgcagcgccggaggagatgcccacgaagatgccctcctcggtggccaggcggcgggagatggcgatggagtcctcgctgctcacctgcgcgatgatgtattacaggtcgggggaagtgcgagcgtcagtggaccggtgaatgcatggtgtttctttcccttttagaggggggggggggggggctgnnnnnnnnnnccacaggcatctgcggacagatgcactgattgctcttaatcgtaagaatacaggacggggcgacctgctctgctcactcaaaggtgagcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagacattggcatggcacagagctacactggcccgcggcacgcggcgctttcctgcctccccttctgcctcatgtacacaccgtgagggcagcctggactgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatacaggtcggggggaagagcgagcgtcagtggaccggtgaatgcctggtgttcctttccttcttagaaggcgggggtggctgcggcccctggaagcagacgatgcaggatgcatggtgagcatccctccgcgctctccaccccccaaacaccacctctgcatggcgcccctcccttccacaaccacacctcccccaccccaccttctccacgccgtccaggatgggaacgtccaggttcttcgggatgaacccggccccgatgccctggatcttgtgcgggcctggggagccacccgagatgacgggggactcggtgggctccacggcgaataccttcagccccgggttcttctccttcaggaagcgccccgcccccgacacagtgccgccggtgcccacccccgcgacgaagacgtcgacgtcgccgccagcgtcccgccagatctcgggccccgtggtctcatagtggaccttcgggttggcggggttctcgaactgttgcaggatgtaggagtcgggcgtggccgccgcgatctcctctgccttcagcagcgcgcccttcatgcccttggccgggtcggtgagcaccaggtgcgcgccaaaggcgcgcagcacgatgcgccgctccagcgacatggtggcgggcatggtcaggatgagcttgtacccgcgggcggcggccacgaaggccaacgcaatgcccgtgttccccgacgtcggctccaccagcgtggtcttgccgggggcgatgcgccccgcgcgctccgcgtcctccaccatggccaggccgatgcggtccttgaccgaggagttgggctccattgactccagcttgagcaggatggtggccttggcgccctccgcctccgcgatgcggttcaggcgcaccaggggggtgttgcctgtgggagtgggccgtgaggatgggtgtgcatcggcaccctgcggcgagagagggcgggtggcgccagggcctccgggcacatgccgtcatgtggctcgggcgcgtggcgcccacatgacgggggggggggccgggctcgcgccggccgtgaccggggactcnnnnnnnnnntcgcgtggcgcccacatgacgggggggacgggctcgcgccggccgtgaccggggactcaccgatgagctgggtgacgttgctggccacaccgtgtttcttggccggcaccgccgcggtgtcggtggcgcccaggttcctggatggcttgttctccagaacagtcacgagggggtcggcaggcgccccggccttcttactgcacgggaaattcatcaaaggccatgagatcctcatcgcattggcacgaacaccggtcgcattccggcatcgcgagtttcccaccacccatcgcgcggacgaagtcgcacctgtgtgatccgcccatagtgccggttcgccaatgtgcgcttggacacgagcgaaagaatgtttcagtgggtttattgcagggtctggtcggaacgaggggtagatctcgtgggattgggaggtacgtccccattttgctggcacaggcttcgctcgctcctgaagcgagaaatctccgacttggcgcgcgctacatgaaacatgccgggggagtcagctggaactgcagcagtgattatctgtataaccatctcgcgactgatttatgttttgagtacctttcaaattaggatatggtaagggtacgggccgnnnnnnnnnncaaccatctcgcgactgatttatgtttacgtaccttccaaattaggatatggtaagggtacgggccgtcttcctaggtgagcgactccgctggctcatgcacctgccgtcggtgactgggtacctgaatgcagtattagatccggacccatctctaaattgcagaccttgatgacaccctggtgcttacatccaagggtgatgtgagggccttgnnnnnnnnnngttagatccggacccatccctaaactgcagaccttgatgacaccctggtacttacatccaagggtgatgtgagggccttggaggaagtggcccaggcagcgtcgcagcactgtccagcggtggacccgacgaagttgctggctgactggcgccagctcttcaaggaggcgccctgggatccgacacaccgggtgggtgcacgggggggggtggtattggagagtatagcgtccctggccagccccggcctgtgtgctnnnnnnnnnnaaagttgctggctgactggcgccagctctttaaggaggcgccctgggatccgacacaccaggtgggtgcaccgggggttggtattggagagtactgcgtccctggccagccccggcctgtgtgctgacagcggcctccccctcaagcccctgccacccggggctgcgccagcacagcaaacccaaaacagagctccccaggtttcgctgcttcaagactctagcagtggaaagtattatgggccatacatgagtacgaatcatgccatttggtgtgactcccgccagtatcgcatgccgatttgtgcccccctgcggatgaactagttctcttgagttgaatggtgatcttgccgccccatcgcacctttgtggtcagataatcgtttgccgccgtacagtccccgaattcaaccttcctccgccccctatnnnnnnnnnnagcacctctgtggtcagataattgtttgccgccgtacagaccccgaattcaaccttcctccgccccctatgggtcaggtggatgtcgaagagtggcggacaggcctgtggctccaggccctgcaagcccagccctcagtggtgctggaggaagccgctgccacggcggccgccctccagcgacgcttctgcaccagcaggatagaggcctttcgcttcctacccgctgtggcgtcgatgctgggcacgctgcggtccagctgcctcaccaccgtcatcatcaccaatggccactctgacgtccaggcgtccaagctggaggcctgcggcgcccgcaacctggtggattatgtcatcatcgggggtgacgaggtggcggccgggcgatacgagaagccgcaccgctcgatctatgacaggtgggaacgctgaggggtgggtgggcctgaagagtgccacccacgcgtaggggtgcccagggtctggtcgccgagtgcagcaacctggcgggcttcctacatgccagactgccctccagagttgcccgctgcaccgctgagtgtatgggcccaggcgcacacaccttccctgaattgcactcaacatgacgatcactcctgctttccctcgctcaccccaacaccacagagcctgccagctggcgggctgcacccccgatcaggccattatggtgggcgacaactacatctgcgatgtggttgggggtcaggaggctggccttcttgccacagtgtggatcaatgaaaccggcaaggcggtgcccgaaggcgcagccgtgatgcccacgttcaccgtgtccagtgtcgtagagctccccgccctgattgatcagctcaatgccggcccgccgcggtgacatgtgggcaaacggtgccatcccagagacactcgtcgacaccccacaatccagaactgcatgtattattctgtcccttgcaccgtggcaactttgcctcgctctttcttgggtcgatctgaggcctcactttggcacccgtagtggcgctgccgccgagtctcatnnnnnnnnnnctttgggtcgatctgaggcctcactttggcaacccgtagtggcgctgccgccgagcctcatcccagaaatgtgcaataccattctttggcatagtgaataatgcagtacatcctgctgatgatggtggcacccttagctttagattgagaacctctgcctcccatgagcaagcagctgctgccatggtggccgtccctcacgtgatgatgtcatgccgagcgccgatctgagattccagctgatgtgacgcttcaacacagcagctgtatcaatcagagccggcgtttaaaggcacgattagccttaccagttgagccgacactgtgttccccttataccctcagagcctgccgaggtcacgtcgcacctcggtgccgtccgtgaagggcaggcagggctgatcctcgcacacatggctccacaagtccattcgaatggctctatcgagctagaccacgaggaagaggccctggctcgcctgcacctggtgagtgtgcggtccttggcgggtggcacgacctctgtgccagcgaggggtcttcgggatgggcatctactcaaagcaacgagtatgacgccagacctcttccatctactccacacaggatgatgcgcacacagagctgagggcgaacagcaatggcaaggggggctaccggtatgagtcgcccgaggaggtgaaggccatgaaagcccagcgtgccgcggtgtnnnnnnnnnngtagcaaggggggctatcggtacgagtcgcccgaggaggtgcaggccatgaaagcccagcgtgccgcggtgtggcagtggctgaagggcatcggcgtgcacatgctgaaggacggcctgagtctgacgaacatctctatgccagtcaccctcttcgagccacggagctggctggagcgcatgtgtgacaagtgtgtagaaatggggggtggtgtgggaggggtccagggctgatgccagtgaggacccccagcctccatgcatggagcagagtgctgcatgcaaagcatgattgagaaggtgggaatgcggctcgtgctgaacgccgcctcctccccggtgcgctagctggagctacctgcagctgctggagctggccgccgatgcgaaagacccggtggaccggctgaagctggtcgtcgcctttgccatctcgggcctgcgccagcaaatatcttttggtgggtgtcggggtcacatgagctcgggaccgctggcgccgggaggcgcgacgcgccgtcggccacactgggctccccgtcgccgcgccggcacgatgtccccggccgcccttgtcaggcatggccgtcacggccgtcgccccacctgtcctacccacnnnnnnnnnntgtcgccgcgccggcacgatgtcccctgccgcctttgtcaggcatggccgccacggccgtcgccccacctgtcctacccacctgctcccttccatgcacccgccacaggcaagcctttcaaccccatcctgggcgagaccttccagggggcctaccccaacggcacacaggtgtacatcgagcagatcgcacaccaccccccaatctcctcctggcaggtctacgaccatgacgcccgggtgagggcggtggtgggggcctgagaggtcgagtccatggtgatggcagcatgcccggccccggcttggacccagtatgaagaggctgcacccttgcgaagggccctccctgtgaaggtggtcgctgcttccgcaacccacccccaaccccccttccgccccccaaagtaccacttcttcggcannnnnnnnnnaccctcccagtgaaggtggtcactgcttccgcaacccacccccaaccccccctccgccccccaaagtaccacttcttcggcaacgggacgtgggcggcctcggcgcggggcaacagcgtgaagggccagcagacgggggccaacaccgtgcgcttctcccatgacgacgcggaggtcagctgggagatgccgtacctgaccatccgcggcgtgctgtttggggagcggtacctcaagtacgggggcagcatgcgcttccaggacgcggcccacgagctgacctgcgacgtggacatcgacacggaggggccgggcttcttccgctccttcttccggcgcaagaaggcgcacgcccaggacgcggtgcacggagtgctgcgaggaaaggacggcgaggagctggacgtgctgacagggtcctggctgagccacctggagtgggagaagggggtgagcgtggacaaggggggagggggttgggagaagggggtgtcccctcggcacccctgtgggcgggcgggcgagggagtggagggttgtatgccccgagtggcctcccctccgattgcccgtgaagctgcggcgcggcctgacccccgccgtcctggaccgacgcgccaggtgtgcaacgggaagctgcacacggtgtgggacgcggtgaagacgccggtggaccgagcgatcgcggagcgggaggctctgccctcggactgcaggtgtgcgactgtcccttcctgtttttgtttttctccttggggagggggggggggcctggctgtgcacagacttgccagcttgtgtcgagcatgcggggccacctctatcccgcctaattttccaagtacagagtgattcacatcaaacgccacaccctcgcacctgcaggttccggaacgacctagtgcagctgaagaccggcactctggacgccgcccagcgcgccaaggtggagctggagcagctgcagcgggcggaccggcgcctgcgttcggagggcctgaagtgggcctcggcgtgatggggtggcctggaggggctcgcgggcagcccctccccaccgtgacttccaaaagcactgtgtcgtgcagagtaggctcacgccagccgagggcgtcagaccctgggaagcatcgaataattcttgaaagaaatccagctcaccctgcatcatccagacggaacgctccgtaagcgcacacatgccaccccttctggtctgtgcgctggtccagcaccctccctgctattgatatgtctacaacgtcccatgcaagagctcacgcgatatcagctggcagggtgacagggggtctgaatgaatggggaggccaccatacaggggcggcaccaaagggtacacagaatatacagagcggcatgagggaggcgtcggcgcgtcctcctgagccggccatgcattgtcggatcatacaagcgagggctggcgcgacaggggtgtcatgggcgtcgccaccaacttcagttgcgannnnnnnnnnggcattggcggatcatacaagcgcgggctggcgcgacaggggtgccatgggcgtcgccaccaacttcagttgcgaaggttttcctgccagatcctggccgccctttccagcagctcgctgccgagcacactctggcgcagctctggcggcgggaagggcgcgtgccctgtctcgaaaaacacctgattgtcgagaaggagggcaggttgacaaccgatcgaagaagggcctaagagcgggccaaccaggagggcccgggcctctgccgtgcggtgagcagcctctcagcctgcagggacccctgccctggaccgttgcgcagacacccacctccagattgtcctgcagcttgtgcacgccctggcagccagcacaccgcgcaaagacggagccggcgtgccaggcgtgggggttgacgcgcttggtannnnnnnnnnaccctggcagccggaacaccgcgcaaagacggagccggcctgccaggcgtgggggttgacgcgcttggtattctgtgtgccgcagaggttgcatgtgaacctcacctgcaggagggtgttgcgagtggaaagggcagatggcgaggcagttggccatgcaaaatgcacggcccggggattggtgaatcggagacttggtgaagggccagatccttcctcggaagatcctagccctggcaccccgggccggccagcaaggactcagggttccagtccactgcttgcaggcacgcaccttgcgggtgcgccgggcgtggtttgtggccgccgcatctccctcactgctaccctcggtccgaacccagaccaggccggtggaggtggggcttacaagcgcctgggcctccacgtcgatgacgatccctccatccaccaggctccgccctgccagccaaaaggagggcctgggcctcggtcgggccaccgcgcctgccctgctgacgggcgtgagggcggaggatgcggcctggggctgggcatcaggcgtggggggacggaacaggacgaactggtccccgaacacgatgcctttggcggggtcggtctgccgggtccaccagacacctcctccaggaagccggaatgcgttctcgcatcggcatggagcgcacaagtggcgggccggggcgcggttcctcctgctctgcgtgacccctctcttcggtgcgaggctcgcttgcgctgatggaggacaaactgacatcgttgctaaggataaattcttacgctattgctgcaacgatggcttgcaagggagttccctccgcaagagaaccaaacgttccgggatctgtcggtgattctgctcattggttcgcgcctcacgtctggttgcaaaggatctcaaccggatgcacttcaatcagaggtgcagcaggccaggcactccgtctcaaatatcgagggtagggtacctacagatagggccaaccgtggaaatcagtcagcctcgcagcgactgactgtttcagatnnnnnnnnnngagcgtgacccctctcttcggtgcgaggctcccttgcgcggctagaggacaaattgacatggttgctaaggatgaagttttacgctattgctgcaacgatggtttgcaagggagttccctccgcaagagaaccnnnnnnnnnnaagggtagggtacctacagataggggcaaacgtggaaatcattcagcctcgcagcgactgactgtttcagatcgagaacctgccagcagccacacaaacactcccaacatgccggtatggcccccctcatgggaacacgcatgcctcgcgcatgccctcaccctgggatcttcgtcacatccaccgctgccaggaagcctgcccttcggatggactccattcccaggggggcatcctcgtaccccacacagtcagccgggtcgactcccagcagcgctgcggccttgaggtaggtctccgggtgcggcttgccgtgggtcacgtcggtgcaggtcaccaccgccttgaagttggaggtgttgtctggggtccagaggcctgacttggccagggaggggtacacctggaaccggtccccgcccgtggctatcgcacagggcagccctggtttgcggtgaggacgggcttgatcatgtgttggccccctgatttgccgcaagaccatctccagagaaaacgacgggggatggaaagcaggagcatggagcgacagacgtcgtacatcgacaggccttgtgatccaggcgggaggacgtcgggtggcgacctctccagcacctcaccgcccgccccatgacccccaatcccacccactcacccctggcgagggcagcctgcaggatctctacgaccggcttcaccagcttggtgtcgtcggcaacctcatggtacctggcgttcttcagctcaaccgcagcagggatgtcgatcgtcttgccctgtggagggagcaggggttaggggaggcagggggggttgacagagcttggttgctgaaggggtggcggcctggttgcatggaaagggtctggcgagtgcaggactggaggagcaatacatcgacagccggcagccgcacatagggagcacaaagagcaccaggctgggggatgacccagcccgttgtcggcaaatttgtaccctcatcgaattgccatccctccaaccccaaccccctcgtctgcctcacctgctcctcacagaggctggcaaagatgccggaggtgggccgcccagcaaatcccaggaattgctcgggggttatggtcaggccaagctcacgggtcacatcggtccaagcccgccagtgggccgacatggtgtccatcacctaatcagcgaggttgtggtgaggtgacagcggtgtcatgcatccgaccattgcagggagggggggtagcaagaattagcagcaaaggcttccacgcacatggccatgaaggtttgggctgaagttggacacccacgcccaggggcaactggggggtagccgagcgccggggaccccggttgaccagctccctacccctcatcaaacctgccgcacggcacccactcactgtgccatccaagtcaaagaccaggcctgcacagcgtgggtgggtggccatcacgcatcagctcgggttcctgaagccacaatcacgacagcaccaaaccctttggaggtaagcggcacagctatttgatgcccgcgcacccaccctttgcggctgcagggagatactcctcgggaatttgggaagccatgacggagactgatctgcgcctgacacgaagttgtagctcggggttttgccgtcggcaggcgttgcggggagcgccgaacgtggcgtgcgtgggccttgctaagacggtgccggacacagtggacagtacgaagctgtggcaactcgagaatcccatgcgccacttttcctagtttgaaagcgatttctcggtctccaccccagaacaagtcaatgtactgggtggaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcccattaataatccctcctcctactatccttttccaacaaagcttcaactatgggaatggatacgatgaaggaatctaatccttnnnnnnnnnncctccctttaagaatccctcctccctactatccttctccaacatagcttcaactatgagaatggatacgatgaaggaatctaatccttnnnnnnnnnncctagtttgaaagcgacttctcaatctctacgccagaacaagtcaatgtactgggtggaaggggtggcgtggtaaggaggacgctctgagctatgtcgaagcacgtgagggtttttccgccgtcacaggttaagcaatgatnnnnnnnnnnnnnnnnnnnnnnnnnnnnnnnnnnnnnnnnnnnnnnnnnnnnnnnnnnnnnnnnnnnnnnnnnnnnnnnnnacaaagaattgcagcttttgagtgcatgctcgtgggcaaaagttgctaggctacattattgaatatggaacaatcagatgctgccgaagagcgctccctggcgaaccacctccagtgccaggagactcgcaaatccgatcatggcagcccttccattcagcttctcggcgaccacggtgaagatgccgaagtcctcgtacacggctcccttgaggatgggcacgaggctggcgtagatgatggcgaggaaggacacagcgatcagggggttggggtgctgcgcctgccagatgatgccatgcccgctcctcagctcttccaagactccggtgatgactgcgagcatggccagcctgccgttgatgcgctcgggggcgggtccgtcaaacctcatagcctctggagaggggtatnnnnnnnnnnaatgcgctcgggggcaggcccatcaaacctcatagcctctggagaggggtatcgggtggtggatatgagggacagagggaacggctgacatttcaagccctgatttcataccagccagaaaaacaattgccccatcaccgcccctgccccccccgtactcaccccacagagacttcttgttcgagggcttagtctccggcaggggaagcttcgactcattggggtccaggggagcgagaggggtggtggacgtcggggccgtcggtctcacgatgggcacgtctttgacggcctgcgtcgcgactgagtctttgctggccggcttctgccccttggggaactggttgttggaaacacacacacagactccacgaagggttgacacgggcctcgataccccagatctaccggtcaagggaagggaccgagatgcactccatgagtgggtggtgggggtaatagttgcaaacatgttgggaggaggttgcggccggtcacgaacgaggttatagaaaattaaattaatgaaattgtgaaggacccctgctatttatgtggcttgaagctaacttccttcgcggccctcgcggtatgcctggccacccattcctgccagggggcgcacccagggtgtctcccgaggggtcccgacttcttcgtggtgtcagttttgcagtcgattcctgacgacacacactcgccgcatgacagattgattacagaatataccgaaaatacattgagtacgattatgcatcgcgccagcttttgatctctccattctctacaacccgcacgcctggctttcctccacccttggctgcatgaaaggacgtgctgtcttgtactgccaagtgcgccacctgactcactgggacgcccttgaggaggaaggagaaggcgcgttcagcagtgcgcgctttgtcaccacgggccagcaggccgggacgaaggatggtggtgtaggcaaaaccctgactcttgacagcctcctctgcctgtggttggatggggagggggggtcggaggtgctgctgtggatgttttctgcccaccgcagctcccaggcatgcagactaaccgattcttctcaggtattgctggagcactgcaggttgtgtgcctgccttcacccgcataccagtggtcaacctcctcaccagtcccttggtcttgatgtataggagtgagtgggcnnnnnnnnnnnnnnnnnnnnnnnnnnnnnnnnnnnnnnnnnnnnnnnnnnnnnnnnnnnnnnnnnnnnttggccccttgagccgagatgagggagaagtgggacaccttggcctgcttcgcggcctcagcagcggcccggacgtactcgaggtccaccttctggaaagcctcggcacttccggctgtcgcgcgggtggttcccagggcgcagaacacagtgtcggccccctcaaaagctgagctcgcctccgatgccaagttgtccatgtcgatgaccttatgttgcagcttggctgggtcccagcccttgtactcgggagggacaggtgcctctcgacgtccaacgaccacgacctctccccatgcggggttcacgagcagctgacccaggatctcccctcctgcgatgtcaaccataggtatgcagcattataaggggcatgatggcgcaagacgacctacctcggcgtgcgtcccctacactactcaccgactgcgcctgtggcgccgacgacgacggctttcaaattcttagttgccatgattcgaggtgacaccaagtagtattcttgcagaaaatggcagccgaaatcctgcttgcatgtgtcctgtcgaataacctgtgtttccgcatatgtctcgtctcggccctgcgcgcgcgcaggagcttgtagcgatctccgactgagagctatgttggcatgtgtccatcccacccagcggtctccaacggcagaaacactcggtgctatggcaaaaaacaacagtacattgaaataggggctgtgctgtggtgagggcgccgatcaaggttgtcgcagcctggaggcaccctccatggcttcggatgcccgcgccagttccctcctgtgaccgagtcttccgagcactcgaggactgcagtcgcaagcaccctcggcaaccggaggtttgctcccagctcagtgccgcggcgggctggtgcgcggtgcgcagtgtatgcccctctgagggtgagctggctcggggctatgggatggaggggcaccgacacgctcactccatggccttggaccagacctcccaactctctgtcgcagtggatgcggtggannnnnnnnnntgacgcgctcactccatggccttggaccagaccctaccaactctctgtcgcagtggatgcggtggaggcctgtgcgggcaggggccccggcatgacccctccccgggtcccccacacatgctccttccaggtccagtgcctggacgaatgcctggaggctcacgctgagcgcctggaggctgatgctgagctcccaagagtgtcgcggggccagggtcgtaacccagcatgatcctggccttggggattggcaacgatgctgtggactggcaggcggtgggctgtgaacgtccctgtacacaccactcgcgtaaccaaccccctcgtagtaaactgtggaattccaagactacttctacaacaaactnnnnnnnnnncaaccaaccccctcatagtaaactgtcggaattccaagactacttctacaacaaactcacacacaattgtgggcgggggtgtgacaaagccgggcaagggaaggtcataaaatcaggcgtggcaatcatgcaggaagactggacgggtgcatcgatcgacaggagcagcacggcatggctcccaccacccaccaaagggggaggctttcgacaagggaaggagggatggctgtgggacacctgtggccgcggggggaggggaatgcgtctgcacccccccctcgcaccaccacacttccttcatcacggcttcacagaccagacgtagaaacggggaacgttcactgcgtccatgccgttgaaggccgaggcgccgnnnnnnnnnnaaatgcgtctgcacccccccctcccaccaccacgcttccttcatcacggcttcacggaccagacgtagaaacggggaacattcaccgcgtccatgccgttgaaggccgaggcgccgcagatggtgtaggcccccatgtcgggccacaccagccacgagccgacgcccagcccggcaggcagcgggtggccccgcaccagcgtgtccagcccgtcgcaggtgggcccaaacacggtggtggggaccagaccgccgcgcgcgcggtcgtcggtggccagcgcacgcggcagggggctggcgtggtcgtacagcatgcagttcatggagccgtagatgccatcggtcacgaagagctcgcgcgtggtggggtggagggtggggtcctcgacggtgggggtggcgatggcgtccacgtccctggcgtcaccgcccgcgctgcgctcgcgcgcgccaaacacggcggtggcaagcgtggcgatgcgctccgcgaagaagcgtcccggctcggccaccacctccacgcccgggaagcgcgcctccagcgcggcgttgatggccggcgcgatgccgcccagcgcgccgcccgggaacccgccgccgatgtcgaggatggagacggcgtgccccgcggcgcgcaggacctcggccgcgtcggcggcgacggcgatggcgttctcgtaagcccccgccgcgtcagcccccgccccggacccgacgtggaaggcgacgccgtcgacgggcaggcccaggcgcgtggcctc

SEQ ID NO: 47352 - DNA, 61 bp, Chlorella protothecoides
cgcgaccaggcgcagcgcggcggcggcggcacgccagaaggggatgtgggagaaggcggcg

SEQ ID NO: 47353 - DNA, 79 bp, Chlorella protothecoides
cagcatcaccgcctgcaccgccgtcacccagcgaaggcgagcgggggacacgcggcggatgcccaggaagcggcgacgc

SEQ ID NO: 47354 - DNA, 61 bp, Chlorella protothecoides
cgctgcacctgagctctcggcctccgagtcgccggcctctgcgccctcgtcccctgcggcc

SEQ ID NO: 47355 - DNA, 61 bp, Chlorella protothecoides
atgtgtgtccagcgtcaagggactggaggggatggttctgaggcctggctggattttgtga

SEQ ID NO: 47356 - DNA, 77 bp, Chlorella protothecoides
agggcaggggacttgttgggagccgccaagagattattgttgttttcttgttgtttgcggtgttgaggctggccctg

SEQ ID NO: 47357 - DNA, 95 bp, Chlorella protothecoides
gcccgaggcgacgcacagggcctcctccccttcaggcagagccttggtgctgacaggtgggtgggtggggggggggtacgaagtcagggagaggt

SEQ ID NO: 47358 - DNA, 61 bp, Chlorella protothecoides
tttgcgtttgctacgttggcttgcgtgggggggagcgctacactcctccgggatggtcttt

SEQ ID NO: 47359 - DNA, 61 bp, Chlorella protothecoides
ggtactgtcgggtttgtggcagtgtgtgtgcgtgcgtgcgttgaggggtgggaggtggagg

SEQ ID NO: 47360 - DNA, 61 bp, Chlorella protothecoides
caagacgccgccttccagcgtgcctcctccacccaccccctacggcccatctccttccccc

SEQ ID NO: 47361 - DNA, 76 bp, Chlorella protothecoides
gccgggggggccgccggcgtcctgcgcgtgtatggaggcctggggaccgtccgtgccgggggctgcggcgcgcttc

SEQ ID NO: 47362 - DNA, 77 bp, Chlorella protothecoides
ggtaccgtgaggggcccgccgcccgcccgtgggacaggatggtgagtggctggtaggccgcctgcgcaagccgcgcc

SEQ ID NO: 47363 - DNA, 63 bp, Chlorella protothecoides
tggaacaggaggggagcaaggaccttggggagccttgggtgggtgggtgagggatcgggcacg

SEQ ID NO: 47364 - DNA, 80 bp, Chlorella protothecoides
cgccgctgtcctcgcgccgcccctccacgccggggtcgatcgaggagcgtgggtcgcggctgaggggcgtcagccgctgg

SEQ ID NO: 47365 - DNA, 36751 bp, Chlorella protothecoides
  modified_base (730)..(739): a, c, t, g, unknown or other
  modified_base (1278)..(1287): a, c, t, g, unknown or other
  modified_base (1803)..(1812): a, c, t, g, unknown or other
  modified_base (3724)..(3733): a, c, t, g, unknown or other
  modified_base (4027)..(4036): a, c, t, g, unknown or other
  modified_base (5378)..(5387): a, c, t, g, unknown or other
  modified_base (5564)..(5573): a, c, t, g, unknown or other
  modified_base (6934)..(6943): a, c, t, g, unknown or other
  modified_base (8515)..(8524): a, c, t, g, unknown or other
  modified_base (8956)..(8965): a, c, t, g, unknown or other
  modified_base (9604)..(9613): a, c, t, g, unknown or other
  modified_base (9802)..(9811): a, c, t, g, unknown or other
  modified_base (9881)..(9890): a, c, t, g, unknown or other
  modified_base (10721)..(10730): a, c, t, g, unknown or other
  modified_base (11245)..(11254): a, c, t, g, unknown or other
  modified_base (11477)..(11486): a, c, t, g, unknown or other
  modified_base (11539)..(11548): a, c, t, g, unknown or other
  modified_base (11930)..(11939): a, c, t, g, unknown or other
  modified_base (12203)..(12212): a, c, t, g, unknown or other
  modified_base (13229)..(13238): a, c, t, g, unknown or other
  modified_base (13479)..(13499): a, c, t, g, unknown or other
  modified_base (13942)..(13951): a, c, t, g, unknown or other
  modified_base (14225)..(14234): a, c, t, g, unknown or other
  modified_base (15353)..(15362): a, c, t, g, unknown or other
  modified_base (17099)..(17108): a, c, t, g, unknown or other
  modified_base (17390)..(17399): a, c, t, g, unknown or other
  modified_base (17585)..(17594): a, c, t, g, unknown or other
  modified_base (18166)..(18175): a, c, t, g, unknown or other
  modified_base (18795)..(18804): a, c, t, g, unknown or other
  modified_base (19407)..(19416): a, c, t, g, unknown or other
  modified_base (19687)..(19696): a, c, t, g, unknown or other
  modified_base (20210)..(20301): a, c, t, g, unknown or other
  modified_base (20369)..(20378): a, c, t, g, unknown or other
  modified_base (20978)..(20987): a, c, t, g, unknown or other
  modified_base (22038)..(22047): a, c, t, g, unknown or other
  modified_base (23262)..(23271): a, c, t, g, unknown or other
  modified_base (23630)..(23639): a, c, t, g, unknown or other
  modified_base (24437)..(24446): a, c, t, g, unknown or other
  modified_base (25731)..(25740): a, c, t, g, unknown or other
  modified_base (25931)..(25940): a, c, t, g, unknown or other
  modified_base (26625)..(26634): a, c, t, g, unknown or other
  modified_base (27354)..(27363): a, c, t, g, unknown or other
  modified_base (28528)..(28537): a, c, t, g, unknown or other
  modified_base (29748)..(29757): a, c, t, g, unknown or other
  modified_base (29826)..(29835): a, c, t, g, unknown or other
  modified_base (29912)..(29921): a, c, t, g, unknown or other
  modified_base (30247)..(30256): a, c, t, g, unknown or other
  modified_base (30464)..(30473): a, c, t, g, unknown or other
  modified_base (31946)..(31955): a, c, t, g, unknown or other
  modified_base (32478)..(32487): a, c, t, g, unknown or other
  modified_base (32782)..(32791): a, c, t, g, unknown or other
  modified_base (33281)..(33290): a, c, t, g, unknown or other
  modified_base (33668)..(33677): a, c, t, g, unknown or other
  modified_base (34288)..(34297): a, c, t, g, unknown or other
  modified_base (34976)..(34985): a, c, t, g, unknown or other
  modified_base (35348)..(35357): a, c, t, g, unknown or other
  modified_base (35554)..(35563): a, c, t, g, unknown or other
  modified_base (35676)..(35800): a, c, t, g, unknown or other
  modified_base (36429)..(36438): a, c, t, g, unknown or other
ggcgacgtgattgccggtcagggtgtcacgactccagcggccggggtcgcgacgcgggcgccccagccctcgcccaggcccgcccgacgcgaggcgaaggacgcgggcgccgcccccgcgggggaggccccgctgtccgccgcgcagctggaggccaggctggagggcgcagacgggaccgcgcctggaagcggcggtgccgcgccggggctcgccagcgttcctgcagcacccacgccgagcaccgtgccggggccccccggcccgcccatgccgtccgcctcgctgctgggcggcatccgaggcgtgggggggtccgtgcctgtcgaggccgccagggcgccgccggcggccgccggaccggcacggcctgcggaggccgtcaccccgctggccttctgggaactgctgcagaatgccagccgcgccccctgacacccctgcgctctgaaaccagtcccctgtggctcgaggtcatcgaagtgtgcctgtccagcgtgttacaggaaaaccggggcatagagctgaatgtaaaaagggcaggcgtggacgtgaattgcttgtaagccacacgactgggacagcgcaccgcaatgctgatcagaggatgcccttggaccggagcagctcggccagcttcccgctctttgcggcggcctgcaaggaaggggtgagtagtggataaaaatccgcaggtgcacaggtggtggaggacacgccagcgtacacnnnnnnnnnncaaaagggcaggcgtggacgtgaaatgcttataagccacacgactgggacagtgcaccgcactgctgatcagaggatgcccttggaccggagcagctcggccagcttcccgctctttgcggcggcctgcgatgaaggggtgagtagtggatcgaaatccgcaggtgtacaggtggtggaggacacgccagcgtacacagctactaccccagggactgtgggaatgcttgcgtgggacagacggccagtaggggcctgtgtgaggcagagaagtaccaccactcccataatctcacatcggtgtcgtcgccacccccaaagaagtcgccgtcgatgaatacgcggggcacgctgcggccaccggtgagctccaggagagcgtcctggattgcgttgccatcctcccgggtgtccagctcgatcaccttcagagcgtcgcccttcagccccacgctggccagcgcagccttggctgcaggtggttttgagaggaatccattttagtgagaagtcatgtatgcaagcaagctactcaatcannnnnnnnnnggaggaattcatttgagtgaggagtcatgtatgcaagcaagctactcaatcaggcgtgaggcgcgcagccctttcgcccgggtggtccccgcggaggcaccaccattgagaatacactgcaaccctctcagtggtgatccatgccccggcaagctcacccttcttgcagtatgggcagaaggtcttgctgaaaaccaccactcgtgtctccgagatggtctgcttcacaaactcggcgggggtcgccatcttgggaggagttggtgtgctgcccagggaccggagggatacaaagaggtatacactgactgcggcgaggatcgtgacgtacaaaattctcatagtgacaagtaaacgctcctgtcattcgccaagaatgttccaaaacctgcgtgtcttgaaatgacgtaacctgagaacgtaaatcacacacatcatgggtatgggtttgcccttggattacaacagccacaagttgtgcttataaaagccaaaacaatccgtggctctgtctcnnnnnnnnnntctgagaacgtaaatcacacacattatgggtatgggtttgtccttggattacaacagcaacaagttgtacttacaaaagccaaaacaatccgtggctctgtctcgcatcactctgtcaagcttacaccaacccatcaatactgtgggagtgctcctgtcagagcactcaggatggccagcccagcgactgccaaggagatccagaggaaccagttggcgcccagtttctgcaatgggtggcttgcacaatggtgagctgcaaggcctgccacctaccaagatgcctttctcgctatcaccacattggcccacttcctaagccccagtaccgttcacctacccggttcggtgagcctccgagcgagtagtactccttcttcatcctctcagccatggcaggactcacagtcaccttgggaacctgcatgggtgggttgggtggtgtcacagttggatctttaggtgcccactgtggatgacaggcactcactagagtgtgtctgagtgcacttataggctacacacataagcttccaacccttcccccggcgcacccgatcgatgtcttcttcggcatataggggtccatcctgcttcttggtgtcctggtctgcaccctgggcatccccatcatcagaggccccattggcagtggctcgctccgagtcgctcttctgctcatcactggcacgcacaaagcctctgagcctaggctgccctccatgctggaaaatacgtcgaggagtcgaccgtaaggcaaacccgaaacaaggagtaggggccctctgcgcctgcaagcatcccggagtggcgataaaaagcttcatgatcccaagtatgctttaatcacagaagggtctgtagcttggatccgtcatgaaggcgcattgccttccatgcacagaaatagaggggtgctttacaccctcgggatcgtgatccggcgatcgacctttgacgcgcgctgggaagtcggacagcacgtcagtccagccatcctattacttgaccgggcacgaatgcagactttgatcctgaggttctcactcagatctcgggtcaagcagcagtctcctccgacccggaggttagagcaaggaggttgatctccgccagccgctgttgacggcttctttgccgtctttttcgagaatcttttctctgttcctgttcgtttagataacattctcgctcggaatggcattccggaaccagaagctcagcgtttcagcgcagcagaatgacgtgcacaagcggatcctcactggcctcctgcgccaggaagagaaccgccgatgcgcagactgccatgcacgtggaccaacatgggccagtgtgaatctgggcgtgtttgtctgcctcaactgctcaggtgacgagcggatagacgagggcagggtggcttcactgtatggcaggttgattgtgggagccccctccacggcaacccatacgccatctcagcttacacactatccgtccactgccaggtgtacatcgcagtctaggggtgcacaacagtaaagtgaggtccaccaatctggtgagcacgggtggcggggcaggagaataagggtcaggtttcgtgccccgataaccagggagttccatgccttgtgttgctgtttgagcctctgatgccgcagatggcagcaaggctcatgaccacggccttccctccccatcaatgcttcgtcccaggacacatggctgccagagcaggtcgcctttgtccaggccatggggaacgcacgtgcggccgggtactgggaagcaaacctcccgtcaggcttcaggcacgtgcggagggttgtgtcggtgtagtgcctgtatgagcctcacctccctcttcaggatcaagactggctggttcattgttttgcgcctggtgtgcgctgcccgcacgcccccnnnnnnnnnnacacctcttcaggatcaagactggctgattcattgttttgcgcctggtgtgcgcagcccgcacgcccccaccagccgctcgatcgccctcctgctttccatccatgcagccggccccccgacagcgacatgggcctgctgcggaccttcatcaccgacaagtatgtgcacaggaggtacgcgctgcagcaatcctccgagccacccagcatcgacaacttcgccgctcacccggtatgtgtggatgtatgtgtgggaggggggggggggctcctcatggtggttcctgatgcannnnnnnnnnatgccgctcacccggtatgtgtgggtgtatgtgtgggagaggaggtggggggctcctcatggtggttcctgatgcaccataagtacccatcaaatggctcttcctgagggctggggacaaaatgcactggcaagcgccccaatcccccactctaaaccgctgcaccggagagccctgccgttctggatccctgctcatagggaatccggccccaaatgcttccacccatgtccttcccgcagtacatggcgcagtacctgtcccccgcccgctccgcccccccggcacctccgcggaaccaagcggcgctggcgcagcgggtgcccagcagcgcacctgccgctgcagcgcccgcacctgccgctgctgcgcccgcacctgccgctgcgcaggtcgacctcctggactggggcgcggaggcggcgcccgccggcggcgccggcgcgggccctgccggccctctggagcacgatgtgtgggacagcttccaggcggcccccgccccgcccccgtccgccgcacaggacccctttgccgctctttcctcccgcacgcccagtgcctgcgcgcccgcgcagcgcagcgacagcggcaccagcagcgtgagcctggtgggggcgggcgcctccagcaccgcttcccggggcagggcaagccagggtttcagcgcaaacggcggcgacccctttgtcgccgctttccccgccggcggcgccgacggcgccgcgccgcgccccggctccggcgcctcgtcgagcgccgcagcagacccctttgccgcgctggaggcccggcaccactcgcggggggacagctggacctggggcgccgtggccgccgagctgcctgcgggcggcacttcaatgacggcctcgcccccgcgccgccccgcgtcctccccaggcccagccgcggggccggggcggcagcatgccagcacgacgtcccacgaggacatcctggccctgtttgacgcggcgccggcagcgtcacttcgcagcgctggcctcgcgcccggcgcgtcggcccactcctccttcaccagctcgcagtctggggcgggaccctgggggccaaaagcgcaggccagcggaagcctgccggccgggctggatgcgctgggtccgcagggcgggcgggggccgatggaaggcaatctgctgctctgatccccaggccagacatcttttatggggttggcgggagaggggggggggtgttcagtgagacctgccctcctgcctgccctcctcggtgtcttacatgggcagctagcctggtggggaacctcggtgtgaacaacagccagttgttgttgtaacactgggtgaccagcaacacnnnnnnnnnnatagcctggtggggaacctcgatgtgaacaacagccaccagttgttgtaacactgggtgaccagcaacacagcagagggggattgctccaggatctgaagcagggggttgcaccacaatttgaagcagtgaccttcacctttgcgggtgattatcactgcggagtgtggcaagcccnnnnnnnnnntggatgtgaagcagggggttgtgacacaatttgaagcagtgaccttcaccattacgcgtgattatcactgcggagtgtggcaagcccctttgcaatccatgcctaggcacatcacaggccctccagcgcctcctctggcacggggaccgtgtagttgagtgccatgcgcccgccgtcagcatagaggatctggcccgtgatgtagctggagtcgtcgctggcgaagaacttgaccacctgtgcggtgtttgggcgaggagagagggtgggggagtgtgtggtgagtgaggccgagcacatctgggatgatctgcgacgcctgaatcaggtacacaccgccagagggagacgcggccaaaggtcagcgcgtgcgacagacgccatcgaccagcgcttcccacagcacaagcaccttgggcccctccctcccacccctcccactcccccggggcccacgtttccgatctcaatgggttcgccggcacggagcatgggcgtgcgggacagcaccttggccatggccgccttgtcggccaccacctgtcgcagcacgtcggtcatgattgaccccggacccactgcgttcacgcggatggcgtggggcgccagggacagcgccatggcgcgcgtgaggttgttcacgccgcccttggaggcgttgtagttggcgatggtggggatggccatgacgccgttgacggaggagatgttgacgatggagccgccgtgcccctgcgccttcatctgccgagcggccacctggccggtctgtggttggaggaggggtgaaaagaggtctgctgacgatggggctggcagcatcagggccgcagccctcagtttgagacggctgcgcactccatgggcacccgcggatacatgtcctggaagcggcaggcagaacaggcccccgtgaggcaggcgcacgaggaagacgccggtgaggttgacccggatgaccgcatcccagtctgcatctgtgagatccaggaaatccgccgcccgcacgatgccggcattggccaccgcgacatccaactttccgaaagtcttcaccgtgaagtccaccgcggcctccacctgggtcctgtcgccgacatcgcagaccgcgctggcgcactcgatgccctcggcccccagatcacgctccgcgctcttcaggtcttcggccgagacgtccgcgatcacaaccctggcaccccctcgccccagggcctgggcacatgccaggccaatgcctagtagatgttgcgtacggttgattgtgaatacatatgcttgcgaggcggacccagggagtatcgtaattgcacccaggcaactaattctgtgtttacgtacccttggcaccgccggtgatnnnnnnnnnngggagatgttgcgtatggttgattgtgaatacatatgcttgcgagtcggacccagggagtatcggatttgcacccaggcaactaattctctgtttacgtacccttggcaccgccggtgatgaaagcgacacgcccgacgagtccagacatcctacaaggctacttgcgatgtcggaactacatcctcgcaacagcgattgcaagtacttggtgggtctcggcatccgcggcacgcggtggtctcgatactttgggcgcccgtcgccaactttgcgcgcccagcacaggtttcgatcctcgctgaccaccagcgacctccgcatgccattgtgctgcacccttgcgagcctaggttttgtggagccccatccatgctccttatgacttagtcaaggcacctccagggaagggcgcctgtcgagaacaccgacctcggtgtgctcgggcggtgagccgaatgctacccttttgagaagggcatcgctccccttgcgatggcgacggcggatccagcggaacctcctgagcttaaaacctctcgggtagagtatgacgagcttttgagggacctaagagggaccctgggctcccagagcttgacgtgtaggcacattacggagtgcattgcccgacaccagactctcttggagaacttgcgccggggcacggtggacgtctccaaaatggaagcccgcatcgaaaagctgcagaagttcctgaccctgcagcaaaccctgggggaggagctcgagagagaagcccaggtggttcaagttgtcgagaagagtttgaagtctctgtgcttttactggtattgtcacgtccaaacgtgtgtcacaggcgagccttgtggcacataatccctcttctccactcaatcatccaggttcaggtcttgctggagagcaccccggcccgaaccagttctgctctgcacccagccacatccagccagcaggtgcgtggatgcagaacatcctaggatgcgtcgatgaagtgtccttgttattcagggcatcagcccagcaatactcttgcaatccacaccacatcccaggacccagcgtccatgcgcgtgagcagcagccgcaaacgcggcgccgacctcgtcagatctgcgcggcaagaaggtgtggggtcccggctgacactgcctgaacaggattgggaaggactttgagtgtgttggtcagctccttgttgccaggaacaggagcacagatcctgccgccatcaatttccctgcagatggtgctcgcccatctggctcctcggcccaacccctgctcccaccctcgagtctgctcagcctccggcaccccaccgcctcgcctgccgcacctagggcctgccagctgtgcagcgctgttgcaaacctcagggactgcagggtgcgctggggtggagggcctgcgtcaaaggtcaatggcgggggaatcggagttgcttgtctcccccataaacaaaagactggcaagcctgagtgcctgtgaggccagggacagccatgtgccacattctcccctgcaccaagcaatcctttcctccttccctccaaactcctttcatccnnnnnnnnnngtgaacaaaagactggcgagactgagtgcctgtgaggccagggacggccatgcgccacattctcccctgcaccaacctatcccttcctccttccctccaaactcctttcatcctccgattggcaggagcgtgccacccaggcacctgcgacgctctgcggcgtctgtctggaggcgcaccgggagatcttcagcgtttcgtcctccctccttccccgcgccagcgagggcgtgggccgccgaacggccccacgcctgagcctcacccccgtgccgccctcgaagttcatgggtccggccacggcgttgtcaccgagagccgcgccccatgccaaggcgccgcggctgctgagtcgtcactcgcgtggggtcggggagcgtgggtcggcaccccctggaggaaagaactcacatggaacagaggtgcatggannnnnnnnnnattcatgggtccggccacggcgccgtcaccgagagccgcgccccgtgccaaggcgccgcggctgctgagtcgtcgctcgcgtggggtccgggagcgtgggtcggcaccccctggagggaagaactcacatggaacagaggtgcatggatgacagtctcttgcactgtccagcggagcaggggagtgactctgcatgcttgcatttgaatgcgacacatgccaaggctatggcggcggagctcgtgcaacacgttctccatgccctcttggctctgaggccttctcatgggtggcaaccccaccgctctcccctcggatgatgcccatgcaggagaatccaatccgactggactcgtctgatgaggagggcacaccctcgccacaccgggctccgccaacccaggcggtggacctgagcagcaaccccgaggcaggggtggtgtgcgagacaagcggtatcgcccggaagctggcggtaagctggtgcctggtcgttggagcctgggggggtgcaaaccagcctcgtgtgacaggaatggcaagacgaggcgcacagggcatgtatccggaatgcttgtttccttccgactatgcaaggttacccctccgactttgtgaatacagggcttgcagtgtgtnnnnnnnnnngagcggcatcgcccggaagctggcggtaagatggtgcctggttgttggagcctggggggttgcaaaccagcctcgtgtgacaggaatggcaagacgaggcacacagggcatgtatccagaatgcttgtttccttccggctatgcaaggttacccctctgactttgtgaatacagggcttgcagtgtgtnnnnnnnnnncccctctcccctcgcatgatgcccatgcaggagaatccgatccgactggactcgtctgatgaggagggcnnnnnnnnnngtatccccgagagggaggtcctgggtctgtgcaggtcacggccaatgatttggtgagactggagcccggcagtttcctgaatgacaccatcatagatttctatctgaggtgagcagaggcggtgctggaagggtaagagatgttttgttttggagtgacccggtgatgggtttgagttgagatctgtgagcctggtactccttgccttcaggttgatcagtcccctgcatgagtaccagtgtcattgacccgagccctgcctgtacgcaagcaacttccgcaccctccatcccttgccacaggtacgtccaggatcggctgagctctgccacgctcagccgctgttacttctacagcacctttttctacagcaagctgcgggagaagaggggtgaggatgggacgagggtcgggcacaagctttcgtccccgccggagtggcccgtgtcggccttgccgggtggctcccagcagccatgcagggtgctgtggtgcagcagttgcctcacaatcctctgcccctgtgcaggaggtgagataccagtagggacgagactgaagccaggcgccactgccgccgagtgccaagccctgcgcaactaccacaaagttcaaaaatggaccaaggtgcgcgatgggtttggcatccctgtatctggctgggtgacccgtgctttggacctgcgagtgtggggtcagtcatggcagcacattgcgcctctgacctcatgcatttgagtttggtagggccataaggccgatagtccgtgaaggcgacattctcttgtccagagtcccctccacacccaccttggcaccccgcccgccccnnnnnnnnnngtaaggccgacagtccgtgcaggcgacattctcttgtccagagttccccccacacccaccttggcaccccgcccgccccggctcccacaggacgtggacgtatttgagaaggatttcctcttcatccccgtgcaccatgctctgcactggagcctgatgatagtctgccacccgggctgttcctacctcagcaatgccgccacgggccccaccccctgcatcctccacctggactccatgcaacgtgggtggcaatgctggtggggtgatattattaccggtcgccttggcgtgggggactaggaacctgacagtattattcccttgctagagggagtatcatgccagatgccagcgacccggcaggtcggcggcgtgcaggtcgaatggggttcattcgtctgtggtccactgagatgctgcgtcgtatcccaggtccattctgtggtgcaggctggacgtgtcccatctccaacccctcatctcgcagacggccacaagagtgcagaggcagnnnnnnnnnntgaatggggttcattcgtctgtggtccacggagatgatgcgtcgtaccccaggtccattctgtggtgcagcctggacgtgtcccatctccaacccctcaattcgcagacggccacaagagtgcagaggcagcgcatcgcatccgctcctacttagaggccgagtactccaaacgggtgggaagggtgagggatgcttgtgtggagattgcggttggtgggtgnnnnnnnnnntttgccttggcatgggggactgggaacctgacagtattattcccttgctagannnnnnnnnnctagaggccgagtactccaaccgggtgggtagggtgaggggtgcttgtgtggagattgcggttggtgggtgcccagccgcgagtccgctgtgcatggaggggaggggcccagccacaagtacttgccgtgaaatccacaggttcacagccgcggggaggaaaggggcgacggttccaggagatttgacgccacgacgttcccccacaagcgtatcaaggtgcggggctgggcaagcggtggtaccttcgcatgtggttcaccagatggatttaagacaacatcgaggggaatgtcctgcacttggtaagatgcgctgaaggtcgttgatgaggcctgggcagcagagtgcctgtctatgatcactggagcatcctgcacacnnnnnnnnnntgtgtgatgcgctggtcgctgatgaggcctgggcagcagagtgcatgtctatgatcactggagcatcctgcacacccgctgccacaacgcgcaggttgtcaagcaggacaatttctgcgactgcggcctttttctctgtgcctatgccgagtactttgcgaggtacctgccgccatgtgagtgtgcatggcgagggaagctgggggtttggttgctggtatgggtggaatgttggcacatgcgtgtcaacaccataaaccctgnnnnnnnnnncggtttggttgctggtataggtagaatgtcggcacatgcgtgtcaacaccataaaccctgtgggacccttgtcatgttcacagctcagctgttgacctgcatgccgagcacaccaggcaacattgcatggtggagggtgggagcccaaaggtcttacagcacatcatcgcttggatgtgatcccccccaaaccccatgcagatatacatgccagggaggcctatgaggtggcatatgagtacaagaagaccaaccgggatctattcgagggcacgcctgcctgctaccctggtgagtgggaatgtccaataaactagggcagggcatctgcgctcccatcctgaacgtgaccaggctcaccagaagtgtagacaacagtccccccccccccttcccactttctctcccgtcaaaggccgactgaccgagcactggttccgcccggaaaatgctggggcactgcggctccacatccagaagctcatcctccaattgatcgtggtgagctggtggggaggggtcctggtatctcttccctatcaaggccgctttgaaaggctacagtggcggccttcaagcgcacctcataggagattgtgttgccgggagcacactgtaagcgcttgcaattaggtctgccaccctgcaagtgtgagcccatgcaagcccggactcatccctgccgcactctcatctcaaaggagcaaaatgacttgtgcctggggctgggatccccgcacccgctctggaaggctgtggatccccgggcctgcagcgcgcatgcagccctggagcagatcgcagagctggaacaggtcgagaaggtgggtggatgcagtactgggcagcgattggaggagaggggcactcatgggtggagcgcatgtgatgcatttttgatggaggacatcttccagctcccttctactccccattcccccgtgcccctgctccccaatgcgattcttgataccccttcaaactgccgcagtacatgggccccgaagagtggctggnnnnnnnnnnctgatggacgacatcttctagctcctttctacttcccattcccccgtgcccctgcttcccaatgcgattcttgatgccccttcaaactgtcgcagtacatgggccccgaagagtggctggagcatgctgggatacagaagctgctgcggcaggagaaactggatgccgggaccagcgaagcattccctggaacgcaggagcagcggaggccattgccggcagccagcgagcgccaggtgcnnnnnnnnnnnnnnnnnnnnncatgctttccaacaaggccaaggccccaagtgcccagcctctactgcccactgcacatgccaggatgtggaaggccgaggaaagggcgccgggagccagaaggctgtgcctgcctcagccctgggccggcccccggtcaagctccccagaatagagacggcctccttcttcacgcccaaggcgccggcgagtcggcccgcgcgctcctccagcaccgtcagcgactccagcgaggaggcggggccttccagtgggggccgctggcgaggcgggagtgccgtcacctcgcctgtcaggcgagttggggtaaaggatgggctgccgcgcatggaatgtggaacaggcacctgtttcctgcaccagcattgcctgacctggacgcctgggctgctccagaaccccgacactcaatgcccatatccactcaccctttctttccacannnnnnnnnntgcatggaatatggaacaggcacctgttttctgcaccagcactgcctgaccttgacgcctgggctgctccagaaccctgacactcaacgcccatatccactcaccctttctttccacagggatgtgcgaggtttgcccatgggcggttcaccttccagtgcagaggtagattttcctggaggtcgacgacaagtgcatctgtggttatggggtggggaattgcatgtcacacactcgtccttcacagtggtgaggctgggtactatccttcttnnnnnnnnnnacctctgtggttatgggatggggaatttcatgtcacactctcgtccttaacagtggtgaggctgggtactatccttcttcataaccttctcatccactgttgcaggtccagcccagcccagagatcatgcccatcggtggactcagtcatccaccactcaatcctggggtcaaagtttatgcccgcaagcagcggtcctcagcagacacggcgcagctcttcccagggaggggagtgcgtttgggcactgcagaggatgcagctcggccatctggttttgcagcccaggtcatggttgactgcaccgaattcctgagaaatccctaggtttagtactctattcataccaaatttgcttgctacctcatcgtaacctcggaagggtgtactgaaattacatcagaccagtgccgcgctgttcgtttctaggagcatgctgagcaatgtctatataggaagggcactccagtgggaccccacagctggagacacatacgtgcgggtagggcatggtgtgaacgtgtcaaaaaggggttaggggggttgcagtgacaatatagcacacgcagcccgtcgcttattcagggctttgggaaacaaaagagcttattgctcggcggaggcggcgaagcccttggagacggtgattttccgctcgacaggggtgtgggccacggccttagcctgctcctgctgctccgcggccgcgagctgcatggtcatcatgcccaccccgctgccgaccgccacaccggcgccgacgatgcccaccaggccgatgagggacagggaaacgtacacggactggttcatggtgtctgcgaggaaggcggggatcgagagtagggtaagccaagcgaactggggagcaagggtcatgagcagcggaaacaaaccataaaatctcaagaaaacgttagtcaaggtcaaaaagactgtaagcaacacactgaatgtgcaaaagcttaccgttggtggtgagtggtgaggacgggggatgagtagggttggaaggactgcaagtgtcttgagactctgatgaaggtgtgaaagtatatatgctaaatagtggatggttttgagatacggggggagtttgttcttatacacgaggcgagnnnnnnnnnnaaaggactgcaagtgtcttgggactctgatgaaggtgtgaaaatgtatatgttggatagtggatggttttgagataccgggggagtttgttcttatacacgaggcgaggggtcggcgcggaagcagctgagcggagaccgcggatgagtcaacactgccacgggttagaaatgccatcataaactggtggtcctgctgaggtggaaaccgggcgcgtgccccaatcgctggcgcgcgcaggcgctgctgctgtagtcacccgcggacgcagcccacgatccatcccctcagacccttcgagagatgctacaaacaatcacagcatactttgattataaattataatcgtcaatacactcgagggcggaacctcgccttgtcgaccctgttctccctacttcctcccttgtgacaaatttgcaaccactcttccaccgagtcgagcagcgagtctcccgaccctgtgcactgctcagtggttttcctggaagtaataacctagttcccaataatgagcggtctgtccctgaggcagcgtgcggcagagggcatgtactttgccggcgaggagcgtctggctatcacccggtacctggagcgcctcgtggagcaggtgtgttatagaggggggaaggatggttgggatgtgggcatgcattggatgtaccggcttgaggtgatgacgagcgagtggactggcaatggaaagagcacaagctgcccctgcccaggagttgcaccgtcccttgcactctggtacctgccccacccgttgctcacccacccactcaacaaccccccacctcttcccctcccacagggcaaggtggaccagtcggtgctggatcgcgtgcgcatggccgacgaggccgggcccacactggtcaagggccggtcggagtacgtgtttgactacacgcccggcgtgagccgccccccgccccgcgcttcccacatgacccacttccagctgggcacccaggtgtcctttggccgctcccgctggtcctccgacaacacctccatcttctccgtggccgacggcaagcgcatggccgccacgccgcccaaacccctgaacaactacgaggtcatccggcatgccaagatccagcgcgccgcgctggagtctccccaggtggcaggcctgcgcctgctcccggagttcacgcccggccgcgctttcttctggggcagcgtgctcgctttgtggggcacgctggccctggccgtcggcgccgcgcgccacctggagatcggcaacgcggaggaggcggcgccgcgcttgcgcggcgtggtggcgcccctggtcggcgcggcgcgggaggggctggcgccgctgcgcgacagcctggcgcttgccgcggggcgggagatgggcgccgacgcgcagcagagcgtgctgagtcagcgcctgcgcacgctgctcggcgcccggcagcaccagtagtcgcgggcccgtgcacctgcccggcctggggggtgcagcctgacgagccattgtacacatacctatcccttttgaccccggagcggttgcatgcatggggggcgtggccccatgaaggctgccactctgaacctgatacccatacccggcctgccagccggagcacttggcactggtccgtgtagcatgtacatggaatggtatttgaagcatgtctcgaccagcagcatgatggaacggggtacagtgagcatgcagcggcacccgcccgatcaccagtcctcctnnnnnnnnnncagcatgtctcgaccagcagcatgatgggacggggtccattgagaatgaagcggcacccgcccgatcaccagtcctcctcctcgtcgggctcggcccccgtggcccccccagccaggcgggcgccgtgcagggcgttgtactgctcgtaccgctccacctcgctggcctgcacgctgggccgctggctcctggcggccacctgggatcggggcagggaggggcggaagggatggacacgcggtaacggccggccgcgccgcggacagtcccggagcgctccnnnnnnnnnngggggcagggcggggcgggagggatggacacgcggtgacggcctgccgcgccgcggacagtcccggagcgctcctcacccagtgccgcccgtccctcgaatcgcatccagtccatgcactcacgccctcttgacggccaggtctcggcctgcccgagagcatacacacccgcacacggtccaggcnnnnnnnnnncgacggccaggtcccggcgtgcccaagagcatacacacccgcacacggtccaggcagcacctgaaagtcgcgcaggctgaccggacgcaggtcgtcctccctcagcgccgccacgcccgaccccggcgcgcccgcccccgccgcggcagccaccgcctcgcgcaccggcccggcgcaagcctcggccaccagaccccgcatgtccgacccgctgtagcccgcggtgcgcgccaccaggcggtccagctcgctggggtccagccgggagcgcacgccgcgcagcgcgcgctggaccatggcgcgccgcgcctcggcgcagggcagcgggatgtacagctgcttgggcatgcgccgccgcgccgcctcgtccagctcctgtgtttttggtcgggcggggggagggggttcgttgctgggcgctgatcgatctccaggcccaccatgccgtgccagctgctgcaccccacgtaccctgactggggtgacaagtgctccaagcagcgagcatgttcccaccgtccccccttccagcatgcctgcgccccccttttccctgtcgacctctggccgannnnnnnnnnggctccaagcagcgagcatgttcccgccgtccccccttccagcatgcctgcaaccccccttttccctgtcgacctctggccgattggtggctcctatgaggaggacgcggcgggcagctgcactggggtcgcacccctccatctggatcaggagctcagtcttcagacgccggctcgcctcgtgctcgcctgcggcagaggcaggcagggaacaaggggggggggtgaggccggggcgggggggtgcctgggtgtaagatctcggtagactgtgtcgaagggcactgcagagtcctgccagtgcaagcaccgcgccagcaccctgagggggagccagggacaaggccacaggctgggaccgggcacaagaaagcacggcacagggcggctcccacgcaccctccgccttgcgcgcgctgaggatggagtccacctcgtcgatgaagatgacggcgggcgccagccaccccgccactgcgaacagggtccgcacctgggcagggaggaaggggtgcgatgatcggcgacggcagcttgcccctgggtcatgggacgagtgtcaggccggccccagcgaaacaaacaccacgaagcaggcgttccaccggaggatgctctcnnnnnnnnnnttgcgataatcggcgacggcagcttgcccctgggtcacgggacgagcgtcaggccggccccagcgaaacaaacaccatgaagcaggcgttccaccggaggatgctctccagggagcatgtcggtcgggaagccattcatgaagccacaatcctcccaatcgaactccgctgcagcagaccctcccccgcctcaccatcttctcgccctccccgatccacttgctggtgaggctggaggctgagatggagaaaaaggcggcctggatgttggatgccaccgcccgtcccagcagcgtcttgcccgtgccgggggggccaaagagcaggacgccgcgcggcggcgcccgcacgccctgcgccaccgcggcgaggagaggggtcagagcttgggggcttgggcggggagctcctgccagggtgatgggcatgcaacaaccccccggccccccgcattcccaccctaccctggtacctggaagatggcagggttcagcatgggccacacaatgacctcctggatcagcttctttgcagcttcctgacctgcacggaaggatcacaggcacattgcatgcggcagccagcacggtccgggcaggcacnnnnnnnnnngcggatcacaggcacattgcgtgcggcagccagcacggtccgggcaggcaccctcaccctgcacggaccccacacctgcgatgtcatcccaggagacgccgccgccgctgtcgaccacgtcgtggcagatggcctccaccagctgcaggtccagcttggcgagctcgtccggcagcgcctcgccggggtctgtgagcgtgcgagggggcattgaaaaccatggctggcagcaagtggacacggggtggccacggctgagttcgcgacacgnnnnnnnnnntcatggctggcagcgagtggacgcggggtggccacggctgagttcgcgacacgacgcacactgcctgagcctcgcatgcatatggatccggtgcaactgggctccctgtttgggacgtatcctccgggttgcgttcacctcgaacacccttcatctccccaagcacgggcatttgcagcgcattccagcccctacgtccgaaacctgaccaacagacagccaaagcccgggaaccccagcccctcccccctcccctgaaaccccaactcactcagacgcaggagggtcattgtacgctgactcagcaccccctccgtctcctccccgccgcccccgccgcccccagtgctctgcagcgccttcttcaggtatgggggcaggaacttggagccggtgcccgtcccggccgcgccctgcccgccgccgcgccgcaggccgttgaccttcagaccggcgacgtccctttcctccagcgccgcggcctcggcggcgtgcccccccttgcgcagctcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccccgccggccggtggtcatcgggggggtcacccccgccgcggcgcgaggcctggcgcccccgctnnnnnnnnnnccccccgccggcaggtggtcatcggggggctcgcccgcgccgcggcgcgaggcctggcgcccccgcttgttcctggcgcgctgcctccgctggtcctcgtactcctcctccggcgtgggctggcgtgggcgggcaggggtcggcgccggggcccggccgggggcgggggcggggcagcgcgggggtggctggaaggcgcggcgcccgctcctcgcggcgacctgcgcctcggtcagcgactcctcgccggcagcggggacctgagccaggggcggttgatgcgctgcacggcccaccttgtgctgtgggtggacggagtgagggcggcgctgctgggtgggggaagggccgaggaggagacgggagggcgagagggctgcagcactggcattcccatcaaagcaccgaagctggggcactcacctcccccagcttcagcagctcctcgatgagatcgttgctgtggaacggctcgtccatggcgctgtgtggggcgggggcagcacggtgatccagaagcagcttgctcagcagcactgcacaacacctgcatgaacatggcacccccacgccaagcgagcaaacctactctaagccatnnnnnnnnnntttgcatgagcatggccccccccgccaagcgagcaaacctactctaagccattcgcggggggggctccgtccctcgcatgatgcccatagatggcatgcacgcctgtgaggtccacggcgggctccggtctatcaggggctgggcccgctcggggaggccaggcgggcactgagttcgggaggggatgctgctgaggcaccgcatcgggctccctcgcctggttgaatgtgttggagttttccgcatggcctccaaagtagtgctgcagctgggatttcgcgaggttgcgcgcggactcaaacttgccagccatgtctcggggtcgtcacaggctgcttgatgcgatctggagatggcggtcatgcatactgagacttacattgcatcatgatatctgcgatcgaccgacaaggttccctagaatgcgctgacccgtcgccgatgagactgtcaccctgcatcctctgtcccttgcatcaaaatcgtacttgcgcacgtgacacctcagggccactctgggttgtcgaaactcgcgaaatagttgagagtccaccttagcagatcgcgatatccaaaaatatcccattatggcccagaaatctcgaacagcagccaggtgtaagtgtcagcacagacccgtggcatgctccgctgcaacatcagaccatggggcaggaaggcggggctgtgtccgccgccctcctcgtcgctacttatcaagattcagcctgtcaacccagcagcccaatctgcctctaattaacagatattatactcagttaccatcgagtcgttccagagattggtggccggggcgtccgagggggtcgaagtacctggctctgggccctgtagaaagtgcaaatgcggttatagcgagtgtatctgtattgccaacacaacccgacagagaacgcatttcatcggtggaatggatgtgaggaagtgcaatggcatgccgccagatcctgcggaggcggcacagtgagagcagagctctgtcactgtaagacgcttcctacatgacctcctccgctatctttggatatnnnnnnnnnnattatcggtggaatggatgtcaggaagtgcaagggcatgccgccagatcttgcggaggcggcacagcgagagcagagctctgtcactggaagacgaatccatacatgacctcctccgctatctttggatattttcaagaatcgcgagaactgacaacccctgcagggccaaatgcctcaggactgaagcatctccttacaattataaatacaaacagcaaggttcagctccaaatcacgcataaaactcactaccatctctgggtcagggaggcaagcagttgcataaactccagaggaccacctgcacgtgtggggaagaagaaatccaaggtttctgcccagcgatggcatggggtgtccagccctccttccctcagggcagagcatacctttcctgtccttcctcctcctcagctcctcgcctggtgtcctagcaggcgcctcctgctcaatggggttggtactgacaagcatgaggaatccacgatgaagcgccaagatgccaagtcatcctctttccgctccagaggaagggcgatttctgcctagctcccccccacccatcagactcaccatgggtccagccagtgcattgtacacagccctccagctggcaaggaacgccccagtggaggccagggagaccaggacaaagctcagcgcaggcacatgacccttggcgagggagtggagtccgatcccaaggggaacccccaccgcccaggtcttgaacagctgttcaggttttcgaagcagctcctgccttgagtacgtcccgaggagcagggccgtcccataccaggctgcaaggaaggggcctgcggtgccgagcaggctcaggggggccaggccctccccatgctgcatgcgtccgacagcagcaaacaggaggaagcacgccccgtcgccagccagcagtgccgcaagcgtcctgcattgagaagtgagcactctcagtgatcttgcaccgacagcacttgggagcatgagagcggcagtgtttgccagaagcacgcacccaaggtctagtgtcgattcgcctctgtcaactcctgcgacccctttgatgacttcaccctggagatgctggatcctgtgcacctgtacacaatagcaggatggattttgcggatgttgtgccccggggtctgatttgatggcttgacaggattgcatggccttccatgcaatccatgcaccattgatcctggtnnnnnnnnnncaccaggatggactttgcggatgttgtgccccggggtctgatctgatggcttcacaggattgcatggcctcccatgcaatccatgcaccattgatcctggttgcggacctccatgcgcacctcaatcgcagggcgatctggattgtcatttgtcatttcgtcatttgtcgcctccatacttgaaggggggcgattgtgcgcagctctgggcacgaatcggggtgcagaggaatgcagggaggggtccctcgcgacgattgtccctcgatgcggccggcatggtacccagccgccccgatatctggcgatagaataaattgaatgcatcgagaccctgaatgatgtccgcaccgaccaannnnnnnnnnctcatttatcagttcgccatttgtcgcctccacacttgaaggggggcgattgtgcgcagctctgggcacgaatcgggctgcagaggaatgcacggaggggtccctcgcgacgattgcccctcgatgcggccgacatggtacccagccggcccggcatctggcgatagaataaattgaatgcatggagaccctgaatgatgtccgcaccgaccaagttatcggaggatttcgcgttgtaaagggttcgggcatgagcatggcctttccaccctttctaatgaaagtggtgcactttcccgcctccgggaggagcgaggacccctcgccgcccaggctgtgagtggcacgacggacatgtgggagtctctttccaggcgactggttcctctgtcgcttgctgtgcgttgaagaggagtgatagcgcggggaggctgaggagcaatcatgccgtccatctcttgctaccgcaactgtgagtgctgctgccggccgggggggaacggctctgggtgggtcagggcgcatcccgcctgacattggagctgcaggggtggctgggtcctgatatattgatcagaggcgaggcgcgaggggcccgcttatcggtggtccctgcgtttgtcccttctgccacgacgcgagcacggcggggaggtgtcgcggtgcacggtgcacttagtgccacccgcgctgagttcggatgcggtacaagctcttcttcattgcctttggtgggcccggttcctgcacaccgagcacccacccctgtatcatcggccactcccgcagatggcaagnnnnnnnnnncagtgccacccgcgctgaggtcggatgcggtacaagctcttcttcattgcttttggtgggccctgttcctgcacaccgagcacccacccccgtatcatcggccactcccgcagatggcaagaccttcaagaagccccgtcgtccgttcgagaaggagcgcctcgacgccgagctgaagaccgtgggcgagttcggtctgcgcaacaagcgcgagctctggcgcgtgcagctggtgctgtccaagttccgctcccgtgctcgtgagctgctgaccctggaggagaaggaccccaagtgagtgccatcatgggagggtgtggagagtatgtgtggtgggggcgccagaggaccaacgggatggcagaaatttcagtggggcgctctggatcagatcatgcgtttgctggtgcagtcccttgcgctgctgcaagtcctggttgctcggtagatttcaagccgcatgcccccagaccctccaagcttcagcctgatgtctttctcctccctcgtgtgcgctcgccttgttgaggagtgtaagctccattgcagctgagcttttctgtgaccccctttcccccccttctccccccctgcccaggcgcctgttcgagggcgaggccctgatgcgtcgcatgtaccggtacggcttcctggagacccacgaggacaagctggattatgtgctctccctcacccccgaccgcgtgctggagcgccgcctgcagacccaggtgttcaagctgggcctcgccaagtccatccaccatgcgcgcgtgctcatccgccagcgccacatccgcgtcggcaagcagatcgtcaacgtgccctccttcatcgtccgcatcgactcccagaagcacatcgacttcgcgctcaactcgcccttcggcggcggccgccccggccgtgtgaagaggcgcagcctggccaagaagggaaacgacgccgaggaggaggacgaggagtgattgcacgcgtgtgctgggacgaacgagatgcatgctccccctgctgcgctgagaggcatgtaggcagcccagggagtttggggagagcaggcatggcagggaattgggtgtcgggggagggcaggtatagcagaatagcaggtttcgggggagggcaggtatagcagaatagcaggtttcgggggagggcaggcacgggtttgaaggccctggatgtgaggggggtgccgagggggttgcaggggacggccctccgatatgctcagcttccaccagagtggtaggcccgcatgcgagcgctgaaacctttcagagcnnnnnnnnnnaggggggttcaggggacggccctccgatgtgcccagcttccaccaaagtggtaggccgcatgcgagcgctgaaacctttcagagcgtcgaggagcccacgccccgacacagacacttctccgaagagcgcttacacagagttagaaagaggctgaagacctcttgtactcattccttgacgacagcggcgnnnnnnnnnntcgacacaggcacttctccgaagagcgcttacacagatttagaaagaggctgaagacatcttgtactcattccttgacgacagcggcgcgtttcgaatcccacgacttctattcgcaaacgggatggcggccactaacttgatgatccacacctttctcatgggcctggttcctctcatcacatttgtggtggcaaagaggggcaccctggacgtgctgctcgagatcctgagcgcggaggaggtcagcgacagcaatcggacggtgctgggaggcctgctggccctcctgggggtgaatgtggtcatcgtctccttcatgatctgcgcttggtacgagaccccagccatcgtccccgcgaaaaagcgggagtgagggtcccgggatgccagttccagaccaggcccaggcgtggcctggccttcaactccagcagcaacgacgacaacatcagagtgagccacctggcttgttctcattggcctgcctacgggccaggtcgggcaggcaggcgtcttgcacgctacagcagcacctgcaccctgcggccttggagcctcaggcaggcacctcctgagagcccctgcgggcgctgagcgtgtgaccgaaccactgttgccgcatgtgacacgaaatgacagtactctcttgctaccccccactccccaaccatccggacagtttnnnnnnnnnnacacctgcaccctgcggccttggagcctcatgcgggcacctcctgagagcccctgcgggcgccgaatgtgtgaccgaacaactgttgccgcatgtgacacgatctgacagtactctcttgctgccccccactccccaaccatccggacagttttgtgtgagcactgacacctgctgcacgccaggtgcatgcacaactgtacaaaggcatttacctcgtggccaagggaggggagggtttgacagcaaggccctaatggccggccagctcaagattttcgcagtcgatccagcctggcctggaggtcgtcatccaacccgccgccgccgccagcatcgccgctgggttccccgccgccgccgccgcctccaccgcccggcggcggtcgcggcggcggcgagccttgccgattgttgccgctgccgccgcccactgctgccccgacggcctgcggcgctgctgcgacaggcgctgccgcgacgcccgcccgcgccttgggagctgacaccaggtctgcatccagggagatcccgatctcatccaggacctggaggcgagggaggcggagcgggtgggtttgaagatgggggcaagggggggagtcaatttggctagactgagcgagtggtggcaagaggcactggggactccacagggccgatcaatgcccagtccaaagccgtcctctcgcagcggcacaggccgccgcaggccccaccnnnnnnnnnngtggtttggctgacctgggcgagtgatggcaaaaggcactgggaactccacagggacgatcagtgcccagtccaaagccgtcctcttgcagcggcacaggccgccgcaggccccacctgggaaacaagctcgtctgtctcctcctcctccccgccctcctcaaaggcgccgtccacagcgtcacccatcatttcgctggtcatctccatcttctcgttctgacgctcaaactcccgcatgatctgtgaatcgatgaggcggagggggatgtggcgggtgtgggagaggtttgcctgtgcgctccaccacagaaggagcacgctgacgccacagaaaccaggcccatccccccctcccttgccatcgcccgcttcaccttggccagggctggcaggttcatcctcttgttcatcatgcccatcgcccgggtggctcccttcatcgcgtcagccatggcgtgcgtggacttgagcgtctgtgggatggggacagtgtgaagaggggtccagagtgagggcgagggtgacatcgttgagatgatgttgggatggaggagaccccacagccccaagcttccgcatacacgatacaagatgccattcccggccagggtacctcaagcaaaatcccgacatcacatcactcaagcgactggatccattgagatgcggcacagaaacaactcgcaccgctatccgcaatgacacggcctgcagctggctcttcagcgcaaacatcttgttgacggcgtgccgattccgcaccaaggacttggccatgaccttgacagcgtcctgtggagatcagggggcggactggtggatctgggaaggatgtgcagggtgggttcctgctcccttctcccagtctcagtacggcattgggataccaggcaggataaagctcgggggcatcctcaccatctggccctccttggccatcttcttgatctccatcaccagctttttctcctggttctgcaggcccgtgcgctcccggtccagctcccggatcgaccgatcaagcaggcgcttgttctcccggagcagctctgggcatttcaagggagtggcgatcaatggagaccgcgcgtactgtgctgcctaaaagccatcttgggatctcaaaggagacacgcgctcgagaaacacacctgctgccgttnnnnnnnnnngttcaagggagtggcgatcaaaagagaccgcgcgtactgtgctgcctacaagccatcttggaatcactaaggagaaacgcgctcgagaaacacacctgctgccgtttttcgttttccaaacaaccacatcctggtctcgctgctggaccgctacgcgcagggccaggaggagtgaggcaggggcacgaggcgcatgccctgggccaaaacactgtaggaatgccgatcgaatgtttggatctggagaacaggtgaaagcaacttccagctggtaggctgtcggacgaagctgggcatggaatgaccgcgtttcggacaggcatggcgcgaaacgaggttttgagcgcggagcggagtcctccgacacctttcccacgagttgactccctcaagcttgcggacgcccgtgtcgatgcccagtaaccaagatgtatgcagcagcagtcgttcccaaggtgttcatcgtgcgcgatgacgatgacaagagtcgcagagagccggcgaagaagtacacggccggctcgcctcgggcaccccacctgaagtcgagcacccacttaatccctcgatcctcgtctctgtccatgagctcatctccaacacacgtgagtctggcaacgatgcgttcggcactctacacgcgtagagcttgcctcccggcttgtcccttaactgtcctcgtcgacgacactctcccttctcaaccctgacgccaccttgcagcacaccggcgccaacagcctgtttgacatggagctgtctctttcgcctgcggagctgtctagggagatggccgtcagcgctctgcgttcacatcccgtcgacgtacagtgagggctgcgtcgtccccagcccgccctcccgacctatgtgagaagattccccaattcagcatagcggttgcggcgctggcccagtgtaatatagcagcagacatagattgtacatgctctccttgagccgagcacttcccatctgtaagattgtgatacgggaaaggaatgcaaaagtggggaacatagacgggccaatcacatcgagagggtagggttgtttactcagcgatggcgtatgtgtcattcaggtactgcacgatggaggctgattcaaacatggccacgcccttgttcgggtcctgcgaatggtttggagtggagtgagtgaagtcatgttgctggactttccacacgtgttgtgtgctgcttgggccnnnnnnnnnnaatacgggagaagaatgcaaaagtggagaatatagaccggccaatcacatcgagagggtagggttgttnnnnnnnnnnatagcacccctactctgggtggaaagaatgacacttttaccccttcctctcacctccaggtacggggcttggaaccnnnnnnnnnngtagcaaccctactctgggtggaaagaatgattatttaacccctttctctcacctccaggtacggggcttggaacctgcccctcttctcgaacaagacctggcgtttcggtgacccacggccagccgtcacatggatgtgtgggatctccagctccacgagggcctcccgagcaatctgatttggggcaaagccaagcatcagggtcatgttcagccagacctgtggtttgctacaattgtgaccatcacaatcaatgctgtcaagccatctgagtgcaaggtgctcatatccctgccagctcgctcaccttgcagaatgggctgnnnnnnnnnncgtgaccaccacaatcaatgctgtcaagcaattcgagtgcaaggtgctcatatcaccgccagctcgctcaccttgcagaatgggctgccctcaaaactccacagcaccaggggcttctccgggagacgggaggggcgatatacggttcctctgttcaccctgtggccacagggtgagagttttgtgatcatggtgcgggttggccagnnnnnnnnnntgggagacgggagggacgatacacggttcctctgtttaccctgtggccacagggtgaaagttttgtgatcatggtgcgggttggccagacagctttgggaagggcacacgcatcgcgcgaatcaacacattgtgcttcacctcgtcgccgactttccaatccagaaatgatagaacttccatgaaaatgaaacccatttcatcaccagctaccttgctatcatggccaaggagacgctgatgttggtgaggatgcccaggcgcagggggaggggcaccgtgccatcaccatacgtatcacagaggtacttgatgatggcgtcactctcaaacatctccacgcctagaaagtagggggcatgaaggtttgtctaaaatggcatcccagaccacaagtagagtgtctccacatgaatcacactcttcgcatccccccacactcaggcgctctccctctcatccttcccccctcctcgcacccaccagtgttggggtccttcatgtaggggaactgcgacttcccggtggtctccttgacctgcttgcgccaggtcggcccattcttggggcaggggaagaacttgacgtcaatgtccagcacattcacagcttccctcaccttcctgcggggtgcggagcaagcatccagcaaggtaaggtattgcctgtctatggcaagtagtcctagatggatatgactgacaagtcaatgcacaagacggtccaggatccaacctctctctgttcagcaaggctagaacatgcactgggcagcccccttgagatcctgggatccattacccatgtaaaaccctgtcaccatcatgaaccagcccatcgctcacctacagaagggacagctctcaaactcgtacagctctatcggcagctctggacgaggaaaggtcgcgacgatgctctcctcacgaactgccttgccaaacatgtggcctgatgcatacttgctggggtcctccggcaccaggctcacgtggtagccctggttgaacgcaaagccaggccggaggatgaactggagggatgctgtgaatgtctgggggaagaggagggaagcattactgattagcaagagagacgtttggcggtgcatgccatacgagcagcacggtgccttattgcccgcctccagcacagcacgggcagagcactgcccgattaacaaggacaacaaaaaccacaacacggcagccgcggatgctcaccgccaacttcccgcctcccaggccataggtctgaggatccttcccgatcatgcgcagactggtgtccggagtgttgaagcgctccttgggagtgagtttggggacgatctgtacaggggtgaagctaggcagatgctcggcggaacattagggggagccggggttcgaacatccaccctccgtcaacgtttggaccatcgcataatgtattgtgccatgatgcgagaccgtacctgggccgtcatgctggnnnnnnnnnngtggaacatccaccctccgtcaacgtttggatcatcgcataatgtatcgtgccatgctgcgagaccgtacctgggccgtcatgctggtgatcgatgccttggacgcgaccaatgggcgagagcgcgtggtgtctgtgaagactctcgtgggacgcagtccgcccgccaacatcaaggagattgataagagggtaatatgtatttgatagttctcaagagtaaagtaaaggggacaagctgtatcagacaacaagaggcggtcatcgagctcgatgtacccatgcagtgtggaatgattggcgagacgaattctcgcgcccagcccacgcagcatggccagctcacccgtgcatgcaggccaagggacgggatcccctacagcatcgtcacagcgaggcaccatggcccatatacagaatgctgtgtaacggaatgatgactcgggtactatgagtattagctgactctggacggcacccggcggccgacccgatgtcttcggacagcgagcaggaggaggctnnnnnnnnnnatgtgtaaaggaatgatgactctggttctatgagtatcagctgactctggacggcacccggcggccggccccatgtcttcggacagcgagcaggaggaggctccgcgcgccaagcggccgcgaacgcacgtcttcaaaaccctcacacagcaaattcaggaggtagttggttgcttttacattgtatgcaggcgtatgatgggtctgggacaagtgagtcgccgcatcgagctcaggacccacccactcgtttcctctcctctgtcgccagatcgaggtcacagtgttcctgagnnnnnnnnnncgtgtgcaggcgtatgatgggtctggaacaagtgagtcgccgcatcgagctcaggacacacccacccgtttcctctcctctctcgccagatcgaggtcacagtgttcctgagccaggagtactcccgcaccgaccccctgcccggcttctcctccttcttccaagagaatatcaccaagtggcgggagctgaatgccgccgaggactttgtgcaggcggccaccgccctcacccacctgacgcagacgctgccccagcttctgcacaatgtcgagccgatcctggacatcctgctcggccgtctgcacatcactgccggtcagtttggggttgaggatcttgcttgcgtgattccctccaaagtatcttttgggggagggattgctgtcgtacggcggccatatggcgatttggcagtgcgctgcatggtatagcaccttgcaggtatgatgtcgcgtggagaaggactgatctcagatccccatcccannnnnnnnnngagtgtggggttgaggatcttgattgcgtgattcccccaaaagtatgtttttggggagggattgctgtcgtacggcggccatacggcgatctggcagtgcgctccatggtatagcaccttgctggtatgatgtcgcgtcgagaaggactgatctcagatccccatcccacaaaccccacaaaatcctgcagagctgtccctggagccgctgttcgtcttgatatccacgctggccagggacctaggggtcgaatttgagccccacttcccccgcgtcatggccgcctacgcagccctggtcgcggagggtgagcgaggttgtgaactgagatggcccggcgttgatctcatggggaggctgccagcctgccactccgnnnnnnnnnngagtgagctgagatggcccggcgttggtatcatggggaggctgccagcctgccactccgttcgtaggcggcctgggtcggcgggtgctgggcggggacgggggcctggtctttgacccacaggtccatcttcagctggtatccctcccctccacgcccccttccccacacgcatcacgccaggcctggacaggaaaccagagtcgctgcagcacctgttctcctccctcagcgccatcctcaagttcctgtccaagcagctgatcaagaagttcccagccgtcctctccgccactgcccccctgcgctaccacgccgcgccccacgtgcgccgcctggccgccgccgcgctcgctttcctcctgcgccagatgcatgcgcagcgccggctgggcgcgctgaccgccgccgtgcgcctggtcctgcgccaggccaccgcgtcggggagcgaggcgcgactgcaggccggcgccgccctgctcttccacgcggcgcggggcctgggccacgacctgaacagccacgcgccggaggtcctgctgcgcgctctgcgtgggctggagaccggcgacgccgaccttgggcgcgtgagggggccgagtggcgagcagnnnnnnnnnngctgcgtggactggagaccggcgacgccgacgccgggcgcgtgagggggccgagtggcgagcaggaggccaccggcctggcgggggatgagtccgtggcagccgagggcccccagcccgatgagggtgacaaggaccccctagaccgcactgagtcagccacgtccccggcggcgcagcgcacgctgcgccacgccgcggtggtcgccgccctgctggacctgctcctggagcatgtgcggcgagatagcgcggcgcagctctgggccgcgctgcactacgaggcgctgctgcgcctggaggccgcacaggcggcgcccggggacgacctggccgcgctgcgcgccgccgcatccctgggtcacgtcgcccaggcccttgccttccacggggggtcccgcgtcggcgactacgggccctccctggacctcatggcgcgcgcgctgggcatctccgccctgctggaaagcgaggcggggcggggggcggccctgcgtctcgccgccgccctcgtcgcgggccacagccaggcggccggcgcctcatcgggccccggggcctacgcgggcatggcctcccagtgggcgggtgcgtctgcgggaggagaattggggcgtcggggcagacggggtgtgagatgtcatggcggcggcacggagtgtggcggacatgcctccacnnnnnnnnnnaggccacagccaggcggccggggcctcatcggggcccgtggcctacgcgggcatggcctcccagtgggcgggtgcgtttgcgggaggggagttggggcgtcggggcagacgggatgtgagatctcatggcgccggcacggagtgtggcggacatgcctccacctcgcgcgtcccactgctttccgacatctgccatgggcctcacccatcgctgccccattgcatcccctgtaggcctggtggggagtgtggacgatgcctccctgctgacattctgggacggcatcttgaacagcccggcgcccagcgaggtcgcccgggccttcgggacgctcatcgtgtcccacctcctgccgctcatgnnnnnnnnnntttgaacagcccggcgcccagcgaggtcgctcgggcctttgggccactcatcgtgtcccacctcctgccgctcatgcagcccggtgaggcgggtgtgggggtgggagggctgccggccctggtgcgtcgcgattctcgtgcctgtccccagagcagggaaggggcaaaacttcctcactcccaccccgagatgaccnnnnnnnnnnacgcgcgtcccactgcttcccgacctctgccatgggcctcatccatcgctgccccattgcattccctgcaggcctggtgggcagtgtggacgatgcctccctgctgacattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacgctgccggccctggtgcgtcgcgattcttgcgcctgtccccagagcagggaaggggcgaaacttcctcactcccaccccgagatgacccaatgttgcacgtcagtcaaagaggggcggcacaacacccccctgctgctgatgcacacattcactggctgtggttctgagggtccatgcgaggcagggcacccgcctcttcctctttcgtcctgcgcgcctgtctgcatccctgtcacccactgggcaatgatgacaacctttcgctattttcatacacggtctcgtggatctcacagaccgatgatgagccaatgacacattggctgtggtactgacgccccccccctcatacttctctgactgtcttcccgtgtccctcctgggataccatcaactcttagttgctggtccgatgtacagctagatcctctcatccaatccttcatcctcgtgcttggtgcacatccgaacaaggagcacacacacttacctgcactttctcccccctacccccctcccaaaataaccctgcaggtagccccatgcacgacgaagcctgggctgttgcagtaaacctctgctcgaggctggaagaggccgaggaccatgcccctgccgcccctnnnnnnnnnngcatccgcacaaggagcacgcacacttacctgcactttctctcccctaccccactccttaaatgacactgcaggtagccccctgcacgacaaagcctgggctgttgctgtagacctctgctcgaggctggaggaggccgaggaccatgcccctgccgcccctttggcagagcctgtgctcgccgccctggcgcggtttgaccctggcgactgcccgctggcctgggccgccctggcctgcctgcctgcggccctgcccgaccgggcctccgccggcgcgcggtgcgccgagctggcgcgggcggcgcgggcgg

SEQ ID NO: 47366 - DNA, 61 bp, Chlorella protothecoides
tccttgcaccctcgagggggcggccagggggttgacagatgggtagcacagctacacatgt

SEQ ID NO: 47367 - DNA, 79 bp, Chlorella protothecoides
cgccgcggggccgcagctgacggggtcgacactggaggggtggaaggctttcaagcgggtgttccaggagggcgtggag

SEQ ID NO: 47368 - DNA, 61 bp, Chlorella protothecoides
ccagcatcccttgcacggacatcggccggggcggccctcaccccgatgacgccccgtaccc

SEQ ID NO: 47369 - DNA, 61 bp, Chlorella protothecoides
ccatgcgcacccgaggcggcagaggcggggggggagcagtggtaccaccagtcgctggagg

SEQ ID NO: 47370 - DNA, 77 bp, Chlorella protothecoides
tgcaacccccctggggcgctgtcatggcgctgccagcccctttcctggcaactttcacaccctccacctccatacag

SEQ ID NO: 47371 - DNA, 79 bp, Chlorella protothecoides
cagccccgttctcccagctcccatgctcgtactcctgccctgcacccaccctcccatgctcaccgcggggtcgatggcg

SEQ ID NO: 47372 - DNA, 64 bp, Chlorella protothecoides
gcgctcggcatgcaggtctggccgtgggggtccaagggaggagatacccagggtttgtgggagg

SEQ ID NO: 47373 - DNA, 61 bp, Chlorella protothecoides
gggcgcccgccgcccgcgcgtgctcaggccacgcgtgctcaggccgcgttccgcggtccca

SEQ ID NO: 47374 - DNA, 74 bp, Chlorella protothecoides
gagaggacccccccggcccggcgaccccccaccccgccccccaaacgccccgaagaccagcggcaagcgcaccc

SEQ ID NO: 47375 - DNA, 68 bp, Chlorella protothecoides
caccaccacccaacactcctgcgtgaagttttgtgtggaggatgtgtgtgtgtgtgtgtgtgtgtgtg

SEQ ID NO: 47376 - DNA, 61 bp, Chlorella protothecoides
tcccaggccgtctttacagaccggcggaggggtgcgcggcgatgtgcaagcctgggtatcc

SEQ ID NO: 47377 - DNA, 61 bp, Chlorella protothecoides
gctggtgagggccggggtgcccatgcgcaggccccccgggaccatggccgacacgtccccc

SEQ ID NO: 47378 - DNA, 61 bp, Chlorella protothecoides
ctccctccatgcgtgcactttgtctctctttcctgcctcacactggacaggcccgtgctca

SEQ ID NO: 47379 - DNA, 61 bp, Chlorella protothecoides
acgcagcctgccccgcggccaccacacacaagggcgctcgttcatcgctccggtggcaagc

SEQ ID NO: 47380 - DNA, 78 bp, Chlorella protothecoides
ctcaccacgtggctggcaggcgcgggggggccctgtcgcgtgcgctgccggtgggagcgcatgcacacggcgtggcgc

SEQ ID NO: 47381 - DNA, 61 bp, Chlorella protothecoides
tgacaggcgcaacacagctttgatgacctgggctcgtcaaccaccaccaccctgcacaccc

SEQ ID NO: 47382 - DNA, 61 bp, Chlorella protothecoides
ggaagtcctccgcgcgaggctcgcggcagggttctgagccgatcattcttcatgtactcta

SEQ ID NO: 47383 - DNA, 61 bp, Chlorella protothecoides
gcgcgcgatcagatcctgcccggccatggccggctcaaaaacacgcttctggacggggaac

SEQ ID NO: 47384 - DNA, 61 bp, Chlorella protothecoides
acatgcacatccagaaggcctgcaggggggtggggggcgggttgaggggagattctcaggg

SEQ ID NO: 47385 - DNA, 61 bp, Chlorella protothecoides
cgctttgcaggcttgttatccggaggctggggccttggtcctcacccccgctgaggagcag

SEQ ID NO: 47386 - DNA, 89 bp, Chlorella protothecoides
tgttggaggtggaccccaccacgcccgcgccgcggcgcgaggcggccagcgccagctcaaacatctctcccggcacctcgaagtgcgcg

SEQ ID NO: 47387 - DNA, 61 bp, Chlorella protothecoides
ggaaacgagctcgctcgccacaccggcgggggcggggctgggaggcttgccagccgaatac

SEQ ID NO: 47388 - DNA, 61 bp, Chlorella protothecoides
gggcgcggccgccaggcccaccagcaccaggccgcggcgttggagcacggggagcggggtg

SEQ ID NO: 47389 - DNA, 61 bp, Chlorella protothecoides
tggccagcgcaacctcccatcggcttccccccgactataatgtgatcaagaacgatgagag

SEQ ID NO: 47390 - DNA, 61 bp, Chlorella protothecoides
gccaagcccatggctgaagatgacggctggacggccgcctacgtccagggcgggcgccagc

SEQ ID NO: 47391 - DNA, 61 bp, Chlorella protothecoides
gcgagctcggggcaggagccaaagtggagggggatgtaggaggccagggtattgcgcacgc

SEQ ID NO: 47392 - DNA, 61 bp, Chlorella protothecoides
cgccgccaggagctccgcgaagctgtgtgtgcgcgccgcgcccagcgtgagcaggctccag

SEQ ID NO: 47393 - DNA, 61 bp, Chlorella protothecoides
cacacatgctagcccctcagactgtggctgggcaatgcctgcagctacgacccagtgccgc

SEQ ID NO: 47394 - DNA, 61 bp, Chlorella protothecoides
aacaccgcgggggtcctgcgccgccaccccaccccccccccgatttaaaattcattcgccg

SEQ ID NO: 47395 - DNA, 66 bp, Chlorella protothecoides
gcggcggcgggggccggcgcagcagccggcagggctgcctcggccgcctggggcgcagcaggcgcc

SEQ ID NO: 47396 - DNA, 72 bp, Chlorella protothecoides
ggcgggtactgcgggttgggcgggtactgctggtattgctgttggggcgggtactgctggtactggggctgg

SEQ ID NO: 47397 - DNA, 61 bp, Chlorella protothecoides
caagtcagacacgatcgcgatcctcagctcctgacgctcgtctccgtcgcggctccccccc

SEQ ID NO: 47398 - DNA, 72 bp, Chlorella protothecoides
cgcctccggcgccaggctggtcctgcgaggaatatggaggctcagggtacctttggtgggagggggctcttc

SEQ ID NO: 47399 - DNA, 94 bp, Chlorella protothecoides
gacataggcaggctcggcctcgccccgcccgccgcgcgggcctctggtggggtcgtcgtcccctcgccccgccgcaccgtgctgcgcccccggg

SEQ ID NO: 47400 - DNA, 61 bp, Chlorella protothecoides
gcagggatcgcgagatcgccggcggctcgggctgccaggaagactgccgaaggcgagcgtc

SEQ ID NO: 47401 - DNA, 61 bp, Chlorella protothecoides
gccctgcctgtggcttgctgctttccagggggcaaagacaaggtccagagcccagtgcagt

SEQ ID NO: 47402 - DNA, 61 bp, Chlorella protothecoides
aatgtcggcgcaccaattgaccaaaggctcaccctgcgcagccacgccctccaccagcagg

SEQ ID NO: 47403 - DNA, 61 bp, Chlorella protothecoides
cgccgtgcccgccgcacgcgaccccagcgtcgcgctgccggccgtgctggaggccctgcag

SEQ ID NO: 47404 - DNA, 65 bp, Chlorella protothecoides
ctcgccgctcccccgccgcccgccgtccgcacattgcccacgcctcccaccgcggcggccgcccc

SEQ ID NO: 47405 - DNA, 61 bp, Chlorella protothecoides
caggttgtatctgatcggcagatggaagggggggccagctgcattgggacaccgtgcgctg

SEQ ID NO: 47406 - DNA, 61 bp, Chlorella protothecoides
agattgacaccttcctacaggcagggggggggcagatgtgggaaacagggagcggcaatgg

SEQ ID NO: 47407 - DNA, 61 bp, Chlorella protothecoides
gcagcccgcggttgaaggcgcgggcggaagtgcgctcgtcccaggcggtgtacacgtcggc

SEQ ID NO: 47408 - DNA, 75 bp, Chlorella protothecoides
catggtgaggcccgtaaagcacagccccgggcagacaaaggattctctgcccccccccccccccccccccccccc

SEQ ID NO: 47409 - DNA, 7896 bp, Chlorella protothecoides
  modified_base (372)..(381): a, c, t, g, unknown or other
  modified_base (704)..(713): a, c, t, g, unknown or other
  modified_base (794)..(803): a, c, t, g, unknown or other
  modified_base (1121)..(1130): a, c, t, g, unknown or other
  modified_base (2013)..(2022): a, c, t, g, unknown or other
  modified_base (2085)..(2094): a, c, t, g, unknown or other
  modified_base (2166)..(2175): a, c, t, g, unknown or other
  modified_base (2512)..(2521): a, c, t, g, unknown or other
  modified_base (4033)..(4042): a, c, t, g, unknown or other
  modified_base (4622)..(4631): a, c, t, g, unknown or other
  modified_base (5366)..(5375): a, c, t, g, unknown or other
  modified_base (6830)..(6839): a, c, t, g, unknown or other
cgccacggccgccgcgcgcgcgcaggcctcgctggcctcccggggggtccccggcaccgccgccggggcccagcgcgcctgcgccgcctcgcccagcgtcgccaggtctgccagcaggcgcgccagggagacattggagggcggggatgggggagcgccgggtgcgccgggagcgccgggtgcgccgggagggccgggtgcgctgagtgcgccgggcccccccccacctacagacccctcggggcccggggcggcgacgtcgcggacccaggaggcgtagcgggccagggacatgagacccaggcggaagaagcggtctgccagccggggcagggacgagccggggtcggcgctggcagccagggcctgccnnnnnnnnnnccaggagacccaggcggaagaagcggtccgccagccggggcagggacgaggcggggtcggcgctggcagccagggcctgccaggtggcggcggtggcggccaggtggaaggcgggggaggagggggagggcggcgccgcctcgtccgccagccccgcctcccccagtcgtcgctccagggtcccggcaatgtcctacgatttagggggacaggaggatgagcaggtgcttgggtgggggtctgcgaggttccacactgcccggggcgagcgtggcggcccaccgactgagctcagggaccgccgctgcctgccatgctgtttnnnnnnnnnnactcggcaaacgaccccacacactccaatcacacagcaatgccgaggcgtgacctctgcaaaatcggcctcatgttgcccnnnnnnnnnnagtccacactgccccggtcgagcgtggcggcccaccgactgagcccagggaccgccgctgcctgccatgctgtttcagcctcacattcctccttggcaaacgaccccacacactcccatcacacagcaatgccgaggcaggacctctgcaaaatcggcctcatgttgcccacagcccatgcagtgctcaacccccacatgtcctgcgggctacacacagcgccaaggggtagcgggctggaacaccgcctcggcattgcccgcggcgtgagctccaagcccgacaaccctacccctccccacaggagtccctccatgnnnnnnnnnncacacacagcgcaaaggggtagcgggctggaacaccgcctctgcattgcccgcggcgcgagctccaagcccgacaatcctacccctccccacaggagtccctccatgtgtccagtcccagcacccacctggaactggagcgagaagtagacaggcaggttccagagcttcatgaaggccgagtagggctggcaggccctgaagcgcgccacctgggcctgggcggtggcgtgggactcaagggcctccaggaaggcgtctcccgcccgcgccccgacgtggaaggcgtgcgggacgcccgggctgaggtccgcgccgcaccgcgcctgcaccgcctccaggacctcggccaggacgccgttgcccaggaactcaaaggcatgcacgccggaggaggtggccatggcgtgcgcgaggaaggggcccagctcgtccgccatcccccgcgtcagggcctccaggaaggcgggcagggggacggcgggtggcacggcggccggggctgctcctgagccaggacgctgggcaggcgcagcggcgccggcagcgccaggggtggtctccctcagggccgccagcgtctgctccaccagtggccgggtgagggtgcttcgaaccacctgcggcacgtggagaaagcatgcgcttgttgagccttactgtccattgggcggcagctgttgggatttgggcggatgagcacagaaccggtactgcgagtgggcggtcacaacccccgctgcatgattgcgtgcgcaccctcctagggcaagcttttgcagcagcgttgcacgctcggcatgcatgctgggcaaccaccctgcagcagcgcaggggctcaagggcagcggcttgttcacacgcaagcacccgactgcccaagnnnnnnnnnncgggcggtaaaacccccggtgcatgattgcgcgcgcaccctcctagggcaagcttttgcagcnnnnnnnnnntccttgctttacgagatccccgagtcggcacctgctcagcggcctggggacggttgatgctcgcataggagnnnnnnnnnnaccttgctttaccagatccctgagtcggcacctgctcagccgcctggggacggttgatgctcgcataggagttgaggcaggcccccagtgcagtggggacctgctggcgaatggctgcctccagcgcgaggtccaggtatgtctgccagggaggtcgagggaggaggcgtgggaatgcaggcccccaatcattctgcctgatattgtccgagcgcactgagggccggcggctcctcgtgccatggcgcatacacgccagctcaatccctcgcgtcgtgcgtgcgtgctcaagtgtgcgccccacacccccccagcctgcgacaggatctgcaggccnnnnnnnnnngagggaggtcgagggaggagacgtgggaatgcaggcccccaatcattctgcttaatattgtccgagcgcactgagggccggcggctcctcgtgccatggcgcatacacgccagctcaatccctcgcatcgtgcgtgcgtgctgaagtgtgcgccccaaaccccccagcctgcgacaggatctgcaggccaggaaccatataaccccacagccgccctccccaggcacctgcagcctgtctgcggcggcaatgatgcgtggggccagggtctgaacaaaggccagatcctgccccttcttgacctggtactgcagacgggccacctctgccgttacccggttcagcacgtggcactgcccctccaccgcctcggggctgctatgcttgccgaggaaggcgtcgcccgggggtgggagctccgccagcagcttgtcgacctttgacagcacatgggtcaggtcctgcatcagctccagcaggcctctgctggcggccgcgtcggcgcgggcggccaggccccgagtgagggcgtgggactctgccagcagtgcatcgcgggtggcgctggcgcgcgcctgggatatggagtggggagggaaccggacgtaaagttccggtgttgcatgtcttggagggagggaaaactagaaggaaagcgcggcgttgggcaaccttcctttccaggaggctccaggggcagcaatagtggagcctaccatggcgccttgcccggtatccctgcgcccactgcgatgacccttttccccctgacagctcatggctcatgaggccgggctgtcggtgtatcttggtggatcaccacatacatgccaccaggtagggtcgagcaggcatcccctgcacaaacacctccctaacacgctgcccacctttaccacggccagaggcccctcgatgcgcttgaccgcgccctggacgctagtaagtcgcgaggtgaggtggaggaagccttcgtaatctttgttgatgacctctaccagatccccgtgtagcacggagaggtgggcctggagctcttggtgtagcacttcgagtgggacctgttggtggccagtgatccgcggagcatgatccaggcgtgtcgaggacgtattaaatacatactccaaacatacacaccgatccacgtacatattgctgcagatcagccacgtaagtcgccgcactgaaggctgggtcggcaaactcgccgggcttgaaccaggcgggcagggacctgaagcgtgtatcttgactcgcgacagtcatccttcccagtcaaacatgaagaaatttctaggactgggccatgtcatgagctcggtgcacgacagccggatcgggggcaattcatgagcgtgccacctcagccgcgggtgcccaccgaactgaggtgtagcatcccgccccgtccttttatctgggagggcatcgcaatgttccatgctatgtaccataagtcaatggcacgaattttggcgtgcaaatggggaggaagccttgcaggctcannnnnnnnnnctcccgccccgtcctttgatctgggagggaatcgcaatgttccatgctatgtaccataattcaatgtcacgaattttggcttgcaaatggggaggaagccttgcaggctcatccttgccactcgcagccacgctcctgagggcaggcgttgcaagccatgctaggcagccaccaccctcttccataaccaggtatggccgatgcgcgaaggggtatgcatcctactacttctctttggtcgaatgcctactggcatgggcacctttctgtgcagggtggaggtctgtccaggcagcaccctggacctggccttccctgggtcgccggtggacgtccaggttgggtgcggcgaacctgaggccatctccctctgcacaaaagatctgggaggggattcctgtgtgcagcatgtggtgctggacctgggacgcacccgcctcagtgtggccccggctggcagcggggccttacatggcagcgtcgctgccagcatccctgccaagtacaccagtgtttcgatcatcacgcgaggtgagcctgcgctcagtgacaccccgccggcatgcgaggaggtagggtnnnnnnnnnntgcattctgctcaggctgagctttccagcgacgcgtattccaccatccagcatcccaagtagtccattgcaaacccccaaatgcatccaggaaaagcaactttggagggtgtgagcgaggcagcactcagtgtgcagacccagggcggcgacatgtcactgggcaaggtgaaggccagctcgctgaccgcgcggagcgggggagggaggatcttcggatcgcttgtgggccacactgtgcggattgagagcgagggtgggaacgtgaccctgggaaatctgtccggcgaagacgtcagcgtggccacccggggagggagcgtgcaggcagcggctgcctacgctgcacagctgtcagtctcatcaggtgagggttgcagtgcatggttttgcggtatcggggcactgcagctcctggaatcatgcaagacgcaccctggctgcaatggctatggtaggcacgcaattgatatggcaaacacgcattggggctgtgcaggcagcctgttgaagttgcccacgtcctttatcacaggcggtggccccatcaccgtggactccatgcggtgcgggtcagcaagcctcgagtcgggcggtggtacaatcgaggtgtcgagcttggatggcgacgcagtcatacggtcaggaggaggagccattcaggtagggacttcggctcttcgggtgcgttcggtgacccctcgccccatccgtcgcaccatgccgaccatcccannnnnnnnnntcttcggctcttcgggtgcgtccgctgacccctcgcccatccgtcgcaccatgccgaccatcccatgccagcgccccaacgcaggtgcatgctcagccaaacgcgggtaatttgcgattgtacagcgaaggtgggcctgtacacctcgcctggagctcgacgctggtgggcaccgtgaccgtcgctgcctgcggaagcttgctccttcccctcggatgcgaggtggaggaggggcgcggcgggatgcgtgtgatatctccgaccggggtcaggtacttcgcgcctggggcaaaccccggatgttcctggacagactccgtcagtggtcccacacgtggctgcaccctcctggtagataccggtgggttctggtggtgtggaacaggggctagaggctgtctacgcgattctccagctttctcaatggtgtgaaacgtgccgcaggtggaggcggggacgtcaaaatcaacgttatgagctgggccgatgcgtttcgagagaaacttctgactcgtactcgtccgaccgagggtccgtaaagtacgcttggggcgcctcaagaaacctctatcggcattttgcccctcacatattgtcaaggtgtgagcattttggtcgtcctgcctgattgcacgcaaacaaccctactgtaaaccccagggaggcgatcgcaaatgaccccgataaggggctagaagctgtgggatcaacctattgtggtggggcgttctggtttagaccacgatatcgaccatcagaacccctcgtacacgccgcaaaatacaattaaagctagatttgacacgattggggacatttctccattcccggagatcctctcgaggcgctcctcctgcgcggctcaatacgcgggacccgagcagagattcgacatccatctgcgcaagagaggaggagaagtactccagatctaatatctcgtgtgaccctaggaaccgacaggtgggagtgtgagcccgggcctcttcgtgtcctggttcaccccggtctgacacacctaaagtgtcgctaagggcagagtccctctccgggcgtgcacggcgcggcattggctcgtttaccgtacgcagaggcttggaggtaacctaggccggcagtctcgaccaatcgcgcaggttgccggagctatggggcccgtgcgctcgtcagtatgaccttggctgttcccagtaacgtggccgaccacctgctagagaagattgtgggaggcgataccaaaatcgcgggaggctctcggcggtctcactccaccagccccgcggagacgacaggcgtgcctggcctggtgggacccgcaagtggcggagtccccagcccgaggaattcgggaggtgagcaagccgtgcgccacaagccccaagctgcatggagtgggcttggttcggacatggaggtcgtgaccattgctgaaacattacatttgatgagctgtannnnnnnnnntcaaaatcgcgggaggctcccggcgatctcactccaccagccccacggagacgacaggcgtgcctggcctggtgggacccgcaagtggcggagtccccagcccgaggaattcgggaggtgagctgcgccacatgccccaagctgcattgagtgggcttggttcgggcatggaggtcgtgaccgttgctgaaacattacatttgatgagctgtactggtcgcagtttgcgcggggagtgggcttcaccaagacacgaggctgaattcccctccccagtgtcgcgctgggccccctcagaatgctccatgggaggccttaccgccccctgctccggcctgccgacaataccacccaacaaacacatccccgctcgtgcccggcccgcagagatgaaggaagaggtgtccgaacgggacgcccgggcgggcatggacgacaagtccatcctggagtccccacaggagcacgagatagcggccgccctgttcgacctggccaacgttgccagcgcggggcagctggaggggcgcggcgagtccgacgcccccagccggcccgggagcgggagccccgccgccagcgccaagcgcggcgcagcgggcgagggcgtggcggcggagacgcagacgcgcaagcggccccgcaagcccaaccggaacctggacgcctaccacggctaccagggtgagacgccggggtgatctggccggtgtgccttgagtccatgggagggtggggttctcccgccctggtgactgttccggcggcggcatgcttggaggaggggtggacggggttgagctgcagcgctctgttgccaggggcgcgcagatatggggccccaatcgtggcttgggtgtcctctcgtgccatgtttaagtcatagccttctccttgacctcatgctcggcatacaccattcccaatccccctgaccccaccacatacacacagacaacgatccggacgacatggagccggaggtggcccccccgctgcgccacagcactgccaactgggcccgcggctcccagccccgccccgagacctccacggc

SEQ ID NO: 47410 - DNA, 61 bp, Chlorella protothecoides
gggcttgaaggggttcacagccaccagcactggcccggcagtggtgtagaccgcgtcgtgg

SEQ ID NO: 47411 - DNA, 61 bp, Chlorella protothecoides
gtggtgtagccacgggtgcgtcgggagggggggggccaccccaccaccagggctgtgctga

SEQ ID NO: 47412 - DNA, 61 bp, Chlorella protothecoides
agaagtacatctacgccctcatgtcggcggggggaatcttctgcctgggggctggggcggc

SEQ ID NO: 47413 - DNA, 61 bp, Chlorella protothecoides
aaagcaggggtgtcagtggtggcgggcttcaccagccagcagagctgcgcattgcaatcag

SEQ ID NO: 47414 - DNA, 430 bp, Chlorella protothecoides
  modified_base (123)..(260): a, c, t, g, unknown or other
gtgcgcccggccccgggcaggggcgcgacgaggccccatgcggggccggcgccggccccgagcccaggggcccgcacctcaacctcatgcgcggcgggctgctggccgcggatgcgctgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcctgcacgacatcctggccgcgcgcggcgtggccggcatcctcaacggcctggacacgcgggtgtgggacccagcgcgcgacgcgctgctgccccccggctgccgctacgccgcggcgggcgtgcgcgcgggcaaggcggcggccaaggcggcgctccaggcgcggc

SEQ ID NO: 47415 - DNA, 412 bp, Chlorella protothecoides
  modified_base (137)..(321): a, c, t, g, unknown or other
tggccgcaggcggcggcggcgtggccggcgtggccggccgctcccgcccgtctgttggaatggtggttggggtgggtgggtgtggcgcgaaggtgaggagagggaagttcagtgcctggtcctgagctgagacggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggcctctgcgtgctctcgccctgcccctcgccctgccctgtccccaccgccccgcccgcagcaagcggcacggagccggaggtggcggcg

SEQ ID NO: 47416 - DNA, 66 bp, Chlorella protothecoides
gggctgggtggcggtgatggcggagggtttagtggcgggggtgggggggggggtgggggggggggg

SEQ ID NO: 47417 - DNA, 61 bp, Chlorella protothecoides
taccgcgcgctgcgggcgagcatggcggggggcgcctccggggccctcctgctggccagcc

SEQ ID NO: 47418 - DNA, 111 bp, Chlorella protothecoides
gcggcgtcgccgggcgcgaggcggaccccgcggagcgcggggttgacgcgcgaggcgtggctccgccgcttccttcggcccggaccgcgcgtccttcctccaggggcacgc

SEQ ID NO: 47419 - DNA, 78 bp, Chlorella protothecoides
ccgccagccccttcgcctcgggcgaggggggtcaggaggccaggccatccctgcgcaccccctcgctggtgggggcca

SEQ ID NO: 47420 - DNA, 80 bp, Chlorella protothecoides
acaggattcacggctccctggtctgcaggctggcgcgcaggcctatgggcccctcgccacaccgccattggacgcgatca

SEQ ID NO: 47421 - DNA, 104 bp, Chlorella protothecoides
gccggcctcgccgcgcgcggcgcccctgccacggaaaggcggtgcggggccctggccgggggagctcgcggacgaccgaccggaggacgaccggcacaggtggg

SEQ ID NO: 47422 - DNA, 61 bp, Chlorella protothecoides
tgggagggggtcagtcatcctacggcagggggacaaatacgcagcacagagtatgtagaaa

SEQ ID NO: 47423 - DNA, 61 bp, Chlorella protothecoides
gcttgtgctgctgcagccttgcatggcagcaggttgataccacgacccagatgaagagacc

SEQ ID NO: 47424 - DNA, 61 bp, Chlorella protothecoides
ggagaatcctccgggctggggcttggggaggcctcagggctggggctgggagaatcctccg

SEQ ID NO: 47425 - DNA, 79 bp, Chlorella protothecoides
gataaccgagttgagcagcgggttgagctcccgcgcaaactcgcgcccacccgcgctgcggaactccagcaccacttgc

SEQ ID NO: 47426 - DNA, 6279 bp, Chlorella protothecoides
  modified_base (95)..(104): a, c, t, g, unknown or other
  modified_base (277)..(286): a, c, t, g, unknown or other
  modified_base (894)..(903): a, c, t, g, unknown or other
  modified_base (1429)..(1438): a, c, t, g, unknown or other
  modified_base (2123)..(2267): a, c, t, g, unknown or other
  modified_base (2513)..(2522): a, c, t, g, unknown or other
  modified_base (3491)..(3500): a, c, t, g, unknown or other
  modified_base (4163)..(4172): a, c, t, g, unknown or other
  modified_base (4568)..(4577): a, c, t, g, unknown or other
  modified_base (5155)..(5164): a, c, t, g, unknown or other
  modified_base (5561)..(5570): a, c, t, g, unknown or other
  modified_base (6144)..(6212): a, c, t, g, unknown or other
ctcgaggcaccacaggcgcgtgagcagcaccctgcggccctccctcgcgtcccgctcgcccgcgccggccccgccgctcggccccctcaccgccnnnnnnnnnngccgccgctgcgcagcgcctcggcgcaggcctgcacctccgtgcacggggtgacctgcgaggccgcgtacacccgcgcggccaggctccggacggcccagaccgggtgcgaggctagacccaggagtcgcccgctcgcggagcgcgcctgccgcgccacgccgtggtcgatgnnnnnnnnnnaacgcggccatgctccggaagggccagaccgggtgcgcggctagacccaggagccgcccgctcgcggaccgcgcctgccgcgccacgccgtggtcgatgtggccgtcgcagggggtgaggagtgccgccaggtcctccagcacgctcccggcggcggaggctgaccggggcgccgcgagcgccagggcccgcaggagcagggccgcggcctgggccctgagctccgcgagggggccgggggctggggccagttccagcgaccacgccaggtctgggggccggcggtcgcccccgcaccgggcctgccagccgtccgaccgcagggtcgcctggatgcggtcggtgcacggaagccactcatcagcctccacccccactcccttgtcgccgatctcgtgcagaccccgcgccgcaccggcctcctcgccggggccccccagcagcgagcccagcccccgcaggatgaggaccaggtcgttcagctgggccagggcgacggccgggtcggcggccaggtcacggaggcgcaggcgtgccagagtggccgccgccccggcccgcgcctcgtccacgatgtgcgcatccggagagccggccaggccgtgccnnnnnnnnnnggccagcgtggccgccgccccagcccgcgcctcgtccacgacgcgcgcatccggagagccggccaggccgtgccagatgggcagcatgcagcagagcaccaccagcgcggggcccgtgccgtcggggccgggccgccagcgcgcgtcgagcgccaggctggcgagcagcgaccgcgcccaggccaggtctgccagccagcagcggggggcgcggcgcagcagaaagaacagcctgagcctgtgtgtgtgtgttttgggtgggtggaggggtgggcggtggtgggcatgcaagtttgggagtgtgcggctgtgtaggggccttgctgtttcctttgccatagaacattgggggacggcctccccaccccaagccaccgcctcctgtcggtgctcctgagggcaccgggataagggcgatgcctcaactcaacgccccagcaggggtagctccttgcctgtcccccgcagagaggcaagcagcaactgagcccgcagcaaaatggctgaccctggctcttccaggccnnnnnnnnnntatgcctcgactcaatgccccggcagggttagctccttgcctcttgccagcagacaggcacgcagcgactgagcccgcatcaaaatggctgaccctggctcttccaggcctgcacttgcctgcacgccggcgggaaggaggggtccaggccccagcccagcagcaggtccaccatgttccggaagtcggcatgcagggcgggggggtgctccatggtctgcaggggcgacgtggggacggggtgtggcacgacatgccgcctttcttcgcacaagacatgcaacaaacgccacgcccgtctgcagcctgcatgctcggcggcgtgcttcgcccgtcgaccagccatcaactcgataggacggcggccgaagcggagcaggacggggggcgatgcatgcacagcacgtcgtttcttggtccacccaaggactgcacacgggccggcgtgctgctgcacctaggcacactgtaaccccaggagatccacaaacctggtacaagatttcgaggattgcagccatccagttcatgtcgaggtcgtctctctcgagcagggctatgcacatggcaaagcaaggggaggcatacctctttggcaccacgctgcgggctgcagggggggggacatgggggcctggtcgggagccgttgcgcggggcagccctgcagcatcagggagcaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcggctgcatggggatcggcgtgcgtcctcaggaggcgattggaagacggtaccctgccgctgggcagtctctgaaccgtctccatgtccccggggcgacagatgagtgaagtcgaggtgtacgagtgttgtctgcagcacagcctcccctcacaaagcctcaggatggtctggtgctccatgcgcccatcctccacagcctcatccccttccatgcacactcacccatgctgccgcccactggnnnnnnnnnnagggggtttggggacatgggggcccggtcgggagccggtgcgtggggcagccctgcagcatcagggagcaagacccccaccactcgcctgcgatgcctccgaggaggacttgcaggctgctctgaacctgcagcggcgtcagctcctccccacgcttggcccagcctctggtcaggaccggcacaaaccactggtacaggaggtcggctgcatggggattggcgtgcgtcctcaggaggcgatttgaagacgggaccctgccgctgggcagtctctcaaccgtctccatgtccccggggcaacagatgagtgaagttgaggtgtacgggtgttgtctgcagcacagcctcccctcacaaagcctcaggagggtctggcgctccatgcaccccatcctccacagcctcccccccttccctgcacactcacccatgctgccgcccactggcccaggatcgggcatgaggagccctgcaaggctggtcaggaaggtgcggagccccgtcgagaccctgacattggtggggggccccttccacatggcacaaaccaggtcattccagagcacccccatgtgctgagtcagcagcttctggccggcctgtgactccaacagcgcgcccaggaggcccagcgccgccagctgtgagtccacgccgaactcgtcgctgaccacgacgcgcaccagggtcagtgggtgcctgagatccagcttctgcattctgtgggcacccacggaggccgacagggcccgctggatgaccagaatgcgccggtctgtggcggctgggctggatgggggcttgggggtgtcggcggggctggatgggggcttggaggtgggggcagggcgaggcacgccctggggctgggggtggggtggcatggaggcggagcgctgccttcccgtcatctcctaccccactggcatggtattgctcatggattctgaagggcgcagggaggcgnnnnnnnnnncgcacgccctggggctggggctggggtggcatggaggcggaacgctgccttcctgtcatctcttaccccactggcatggtattactcatggattctgaagggcgcagggaggcggggatgtgtgtgtcaggactgcaagggggctccatgccggtattcgaatgcggaccactgtgggacacccaggtctccacgatgctcaccccgttcactgggatggacctcgcccttggccgcgatactcccatgctgtagcagcatgccatcgacgcgaggagtaagagtgcaagcctcatcagcacctcccatcagcgcggccgacatggagaacccgcaagcagatgccggcgacggtaaggtggtgcagtgtgggcgatgcaaatcaagttgttgcaatcgtgagctctccatggcgttgtcaaatatcgattgctccgggtatgggagcgccgcgcgctgatcgcccattgtcaactctctcggcgattccatccgcttgcaggtgccggtcatgctcatgccgagggtggagggggtatgcagattgaagatccaccaagcacatcaggacttgcagcttcaagatccgaagagaagctgctgaatacacagcatcgtgaaacatagtccctcgtattccctctacaaagtgaagtttctgtnnnnnnnnnntatcaggacttgcagcttcaagatcccaggagaagatgctgaatacacagcatcgtgaaccatagtccctcgtattccctctacaaaatgaagtttctgtactctgctgccaatacgtttacgcactacctgtgcttttgcagagcatttttttgtctgcttactgactatccctgcagttcaagaagcccatggcatgtctcatttgccatttgagacgtgtttccatgcatttggttgtcggaactttgcttgacgaggaaatcgttgcagtgcaccttgatcacttttccatgcctacagctcggcctggaaaaacgtcctagtatccttttcctgcactacggctgattgcggacgaaatacagatagtgtctagaaccactacatgtattnnnnnnnnnnaccatgcatttggttgtcacgtccttgcttgacgtggaaattgttgcagtacaccttgatcacatttccatgcctacagctcggactggaaaaacatcctagtatccttttcccgcactacggctgattgcagacgaaatgcagatagtgtctagaaccactacatgtatttgccccctccttagggctctttggcccggacggtcgacctgagatcactccgacccgaccgccaccggtatgggtttcctgtccaggcacaagggccagtcggcctcaaaggccgagttcatagtgaatatccaggagctcggtccctggccaacatctggtcccctggagatccgttggcagcgcggcggtaacatgggcaagacgcggccggtagaacccacaccccagcctgggcggagcagcgtggcaacctactccttcgctcaagccataagagtgccagtcacaatgtaccaggtgcatggtttgtgtgtctcggagtggtgtgctcttctctgggaggggttcttatgacattcgcaagcaatgtgaaaactgtctcagaaccggccttgtgcagctgnnnnnnnnnngttatgacattcacaagcaaggtgacaactgtctcagaaccggccttgtgcagctgtccggacacttgagatcggaatggccatccttctcccccacgtgcaggacaccagctctggcgcgtaccagcccaagcctctgaccctgtccatcgcgccgggcggtggcaaggccaagggcaaacccagcgcggggccccatgtctccctggacctggcggcatgggcaggcgcggaggccagggttcccactaccctgcctgtacagggggcgccctctcgccaggcagccggtggggtgccctccctcacattcacagtggagtgagtcattcagttggatctgtcgagtcgaggcatggtgcaggcgacccctgcctgaggggtccatggacacgcnnnnnnnnnntttctgttggatctgtcgagtcgaggcatggcgcgggagacccctgcctgaggggtccatggacacgctgcaagagcagtcggtgccgaccacattctgctcgagttctgaaatttgtattggaacgtatcgctccaaaagcttccaccattcctctcactgcgacaactcatcacaacatgctcaccccctcacccccgcctcaggcgagcgggccacggcgccgcggcgactcccaccaaccggtcaccgcgaatcgcggctcaggccggtgcacagttgacgctgcaggacggcagcgccagcgaggacctgtccctgatgggcagcacgctgagcggggagctcagcatgcgcagcgtggcagacgcgcccgtgtccgactcgagccccatggcccccgccggcggccagggttcgccgccccccgcctggcggccgcccgctctgaacctggccggcatctccccgggcacgggggcgagggtcgcgctcagcagccccagcatcgcgagctccgcctcgtccgacgtggcgctggcggccgcggcggccgccgtgccggacaggcccnnnnnnnnnnnnnnnnnnnnnnnnnnnnnnnnnnnnnnnnnnnnnnnnnnnnnnnnnnnnnnnnnnnnnagggcgcgccgcggcatccccggcatgccctccccgggccccccttccaccggcgtggcggcggcgc

SEQ ID NO: 47427 - DNA, 62 bp, Chlorella protothecoides
tttgccaccgccatctccgcctttgccacctttccccccccctccccccccccccccccccc

SEQ ID NO: 47428 - DNA, 61810 bp, Chlorella protothecoides
  modified_base (578)..(670): a, c, t, g, unknown or other
  modified_base (1070)..(1079): a, c, t, g, unknown or other
  modified_base (1159)..(1168): a, c, t, g, unknown or other
  modified_base (1862)..(1871): a, c, t, g, unknown or other
  modified_base (1940)..(1949): a, c, t, g, unknown or other
  modified_base (3034)..(3043): a, c, t, g, unknown or other
  modified_base (4425)..(4434): a, c, t, g, unknown or other
  modified_base (5040)..(5115): a, c, t, g, unknown or other
  modified_base (5349)..(5358): a, c, t, g, unknown or other
  modified_base (5507)..(5516): a, c, t, g, unknown or other
  modified_base (5766)..(5775): a, c, t, g, unknown or other
  modified_base (6687)..(6696): a, c, t, g, unknown or other
  modified_base (8071)..(8141): a, c, t, g, unknown or other
  modified_base (8515)..(8524): a, c, t, g, unknown or other
  modified_base (8986)..(8995): a, c, t, g, unknown or other
  modified_base (10346)..(10355): a, c, t, g, unknown or other
  modified_base (10801)..(10810): a, c, t, g, unknown or other
  modified_base (11145)..(11154): a, c, t, g, unknown or other
  modified_base (11587)..(11596): a, c, t, g, unknown or other
  modified_base (12569)..(12578): a, c, t, g, unknown or other
  modified_base (14502)..(14511): a, c, t, g, unknown or other
  modified_base (14773)..(14782): a, c, t, g, unknown or other
  modified_base (15060)..(15069): a, c, t, g, unknown or other
  modified_base (15300)..(15426): a, c, t, g, unknown or other
  modified_base (15662)..(15671): a, c, t, g, unknown or other
  modified_base (17513)..(17567): a, c, t, g, unknown or other
  modified_base (18324)..(18333): a, c, t, g, unknown or other
  modified_base (18747)..(18756): a, c, t, g, unknown or other
  modified_base (19238)..(19247): a, c, t, g, unknown or other
  modified_base (22208)..(22217): a, c, t, g, unknown or other
  modified_base (22582)..(22591): a, c, t, g, unknown or other
  modified_base (22902)..(22911): a, c, t, g, unknown or other
  modified_base (22978)..(22987): a, c, t, g, unknown or other
  modified_base (23041)..(23050): a, c, t, g, unknown or other
  modified_base (23509)..(23518): a, c, t, g, unknown or other
  modified_base (23791)..(23800): a, c, t, g, unknown or other
  modified_base (24643)..(24652): a, c, t, g, unknown or other
  modified_base (25895)..(25904): a, c, t, g, unknown or other
  modified_base (26641)..(26650): a, c, t, g, unknown or other
  modified_base (26867)..(26952): a, c, t, g, unknown or other
  modified_base (27401)..(27410): a, c, t, g, unknown or other
  modified_base (28322)..(28481): a, c, t, g, unknown or other
  modified_base (28809)..(28818): a, c, t, g, unknown or other
  modified_base (29077)..(29086): a, c, t, g, unknown or other
  modified_base (30040)..(30049): a, c, t, g, unknown or other
  modified_base (30252)..(30261): a, c, t, g, unknown or other
  modified_base (30922)..(30931): a, c, t, g, unknown or other
  modified_base (31104)..(31113): a, c, t, g, unknown or other
  modified_base (31987)..(31996): a, c, t, g, unknown or other
  modified_base (32826)..(32835): a, c, t, g, unknown or other
  modified_base (33302)..(33311): a, c, t, g, unknown or other
  modified_base (34222)..(34231): a, c, t, g, unknown or other
  modified_base (34714)..(34723): a, c, t, g, unknown or other
  modified_base (34806)..(34815): a, c, t, g, unknown or other
  modified_base (36647)..(36656): a, c, t, g, unknown or other
  modified_base (37014)..(37023): a, c, t, g, unknown or other
  modified_base (37430)..(37439): a, c, t, g, unknown or other
  modified_base (37770)..(37779): a, c, t, g, unknown or other
  modified_base (37978)..(37987): a, c, t, g, unknown or other
  modified_base (38265)..(38274): a, c, t, g, unknown or other
  modified_base (38549)..(38558): a, c, t, g, unknown or other
  modified_base (38760)..(38769): a, c, t, g, unknown or other
  modified_base (38909)..(38918): a, c, t, g, unknown or other
  modified_base (38985)..(38994): a, c, t, g, unknown or other
  modified_base (39648)..(39657): a, c, t, g, unknown or other
  modified_base (40298)..(40307): a, c, t, g, unknown or other
  modified_base (40911)..(40920): a, c, t, g, unknown or other
  modified_base (41259)..(41268): a, c, t, g, unknown or other
  modified_base (41481)..(41490): a, c, t, g, unknown or other
  modified_base (42305)..(42314): a, c, t, g, unknown or other
  modified_base (42764)..(42773): a, c, t, g, unknown or other
  modified_base (43135)..(43216): a, c, t, g, unknown or other
  modified_base (43316)..(43325): a, c, t, g, unknown or other
  modified_base (43425)..(43434): a, c, t, g, unknown or other
  modified_base (43621)..(43686): a, c, t, g, unknown or other
  modified_base (44199)..(44208): a, c, t, g, unknown or other
  modified_base (44663)..(44672): a, c, t, g, unknown or other
  modified_base (44914)..(44923): a, c, t, g, unknown or other
  modified_base (45468)..(45477): a, c, t, g, unknown or other
  modified_base (45669)..(45678): a, c, t, g, unknown or other
  modified_base (46113)..(46122): a, c, t, g, unknown or other
  modified_base (46829)..(46838): a, c, t, g, unknown or other
  modified_base (47206)..(47215): a, c, t, g, unknown or other
  modified_base (48391)..(48400): a, c, t, g, unknown or other
  modified_base (48867)..(48876): a, c, t, g, unknown or other
  modified_base (49297)..(49306): a, c, t, g, unknown or other
  modified_base (50182)..(50191): a, c, t, g, unknown or other
  modified_base (50498)..(50507): a, c, t, g, unknown or other
  modified_base (51109)..(51118): a, c, t, g, unknown or other
  modified_base (53146)..(53155): a, c, t, g, unknown or other
  modified_base (54196)..(54205): a, c, t, g, unknown or other
  modified_base (54728)..(54737): a, c, t, g, unknown or other
  modified_base (55102)..(55111): a, c, t, g, unknown or other
  modified_base (55605)..(55614): a, c, t, g, unknown or other
  modified_base (55789)..(55893): a, c, t, g, unknown or other
  modified_base (57358)..(57367): a, c, t, g, unknown or other
  modified_base (59012)..(59021): a, c, t, g, unknown or other
  modified_base (59702)..(59711): a, c, t, g, unknown or other
  modified_base (60085)..(60094): a, c, t, g, unknown or other
  modified_base (60389)..(60398): a, c, t, g, unknown or other
  modified_base (60483)..(60492): a, c, t, g, unknown or other
aattgcatatcacttcggtaattgggatgacgatcagtcgccgtactggaggggggacggcgtcagctgccctccggatgtggcctgggcgcgacaaggcatatgcccgaacgattccgatggccactacgatatcgtccttcggtctgtgcaccatggcgcaatagactgagctgtatatatatcagttgaattacatcgttgatcccttgtgcagggcactgtgctgccgttcagtcccccacggaactcaccccgtttgccgggcgggggagggatccgcgggcgcttctccgagggggctacaatggttcagacccgctccgtcgcggcgagaggcggcagccaggatgaagccgaggtcctggatcccagcacaaagttcctgtacagcccgcacaccctgaccgtgctcctagccggtgaggggcctgggaaatcttgtctatgcaatcaaaggaggtcggctggcaatgcacctcggctgatcacctgccacaagacgaatccctggcccttcgattccccatgcagccattgttggcctgatcgcatgggccaggcccttcaatcccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgggatctgggctgtggtgtacgcctttctgagtgcgccggttgcactggtgcctgacgcgggcatgagaggagcaagagtatctggcttgctgggtattcacttggtgcttctgtgcctggcaaacgcccccagcgcacactctctgccctgcggttgtcactccctcttttgagtctcctggaccccggtcccccaatgctgcagtcatttctacggtccaaggccccgacaccaagatgatccgcccccaccctgccttctggcgctttgtatttgggctcgtgacgtgctacaccctcttcatggtgtacctgctcttccagtctgctgatggggccaggcaaaccctcaaggtacagggaggatccttggagtgttgctctgtgcagcgccgnnnnnnnnnngaggtgcgcccagtgtgctgccatggtgggtgtggggcccagcttccggctgattcgagcccaccgagtgaaactggcgnnnnnnnnnncgtgggatctggacggtatgggtggcaacttctgcctgacgagtagaacctctgtctatttccactcctggcatcccaaaccctgatctgttcagcacctctaccccgagctgggggtagagctcgatgagagacactatggcaccgactgcgccctctataaaccaggccagggcattaactggaaggtgcgcctggtgtgctgccatggagggtgggtggggccggcttccgactgattcgagcccaccgagtgaaactggcgagagtccagtgtcatgcatgcttggcagcgtgagaagacaaggaaactgaacccaaggggccgccagtagacgctgtgcctgttttgatttgagtttagagctcacccgatggcgttcttcccctgcctacaaacgcctttcctcgatcgcaccctccttcctccaggtcattaacgacaccgtgtttgatgagtttgtcgtggcccacatccttggatggtggggcaagaccctcatgctccgtgaccgcacgatgctctggatcatcaggtaggcagggcaggatggaaatgtaggggaaagagtgatgtgctacgactccttgaccctgtcagaaatattgccacacatctcatggcaattgctgctctacccttgctgctgcagcattgggttcgagttgatggaggtcaccttccagcactggnnnnnnnnnnctttggacttgagtttagagctcacccgatagtgtttgtcccctgcctacaaacgcctttcctcgatcnnnnnnnnnnccagaagtattgccacacatctcatggcaatcgctgcactacccctgctgcggcagcattgggtttgagttgatggaggtcaccttccagcactggctcccaaacttcaacgagtgctggtgggacagctggattctggacgtagccatctgcaacaacctcggcattgctctgggtgggttcgggtgggggctagggggacttgctgtgtgtgcccggtagtggaagggccaatagaggatggaccactgtcaatgacgtgcactgcgccagggatttcgaaacaatcgcgaatgtttccaccgagcagttggcgcggcacagggactacccttacagatgttcatgggttctcactgggacagagctatgtcccagaaacagctcatggcaccgtggcatcaaattatgtgtgccgtgttgttcgccaaccacactttcaggcatgtggtccatcagctactttgacagcaaggagtatgactggagggggatgagccagcagccttccctcctggccaaggcccgccgatccctgctccagttcacgcccaagtccttttcaaacctgaagtggcaggcgtttgccagccccaagcgctgcctccaggtaggtgctttgggattccgcggaggggccgcaggcgggagggcatgcggcattgagcgggcaaccgctgcacttctgatgtatgtggtgtggctggcacacgctgctccaagtgctgtagcaccctgaacggatatgcactgctccacaccccttcatcctctctctccccaccccaacccccgcagtgcctcttccccattgccgtcttcctgctctttgaggtcaaccacttcttcctcaagtttgtgctgtgggtccccccctccaacccccttaaccccatccgcctgttcctgctcctgggtgtgggactccctggcatgcgggtgaggggtttgccgcacaggccgatgcgtgagggtttgagggggtggcggagggaggggggtgaaaggagcgcaaggtgtcatgaaggaaacatgcaggggtcatgccaggtcactgttctacagtcaccacattcgctcaccgnnnnnnnnnngggtgtcatgaaggaagcatgcaggggtcatgccagggccctgttctacagtcaccacattcgctcaccggccctacgttccatggatgcacaggagtgttatgagtacatcgaggcgtctggctctccccagggagccgacatgctgaagctgggagcctttgcgtggctgggtctcgccctggccctggtggaaaccctggtctccatcaagtttggcaaggggtgtgtgtggaggagaggagggaggggaagtgctgtgcggcggtggatgccgggctggcacgcctggtgcgggagcctgtgcaggggatgtctcggtcgggcgtttgcccccctccacatttgccctcctctccattcccacgacgcagcatgttcccggcaccctggcccacgcacatcctgatcgggtggggcctggcggccgcctgcggcctcaccctgttcacggtgtggtcgctgcggtactactcgaggcagcgcgcaggcacaaaggccaaggcggcctgaggagccttgagctgtcgtctgcctggggaaatgaagctgttacaggggtgtcagggtggcaagggaggtcgcaactctgtgagcatgctgtcatatcacagctcagcctgggcggctgtccaagatcaatgctgtcatgtggtgcggatcagcgtcagaagggcctggggtggcacatgctccaggagtgttgggggtggaaaagatgcaaggtgcatgtcctgctgccaaaagatccaagagacaacgtctaaaagccataccggggcacgccccagtactgccacgccttgccccactctgggtaccacaccgagtcggcgtcgctcctcagcggcggggcggggaagaggtcgaggggcggatcgactcgcccggccaagtgcttgctccgcagggtctggatgcctcccttgcgatccagcagcttgaggtatctgtgagtgtggtgggtcgaggtccgatgcttgatgcagggcagggaagtcggggtgctgatggtgcaactggcagcaaagtggtcatagaaaggcgttagggttgcaaacagcatgagacaaccaaccatccacatggccactgcatctggaagaccctcaaccatggctctccaacacgcgctggcgtcaccttcgcaggccgtagagggagaggctgagcactgcgagcaagatgcctgcctggacgtagccccccttgacgatgaacatggccgaggtgaagatgacctggatgagcaggcatgccaccagccttggggaggagaaaggaggagtgggttttgagaggtctgggtaggaactgggtgaggcgttggtgagcacacaatgcactgaatgtgcagcgaaacccagcaacatactgcaacnnnnnnnnnnagggaggagaaaggaggaatgggttttggaaggtctgggtaggaactgggtgaggtgttggtgaacacactatgcactgaacgtgcagcgaaacccagcaacatactgcaaccatcaagtctcccaccaacacaaagacgcccacctatgggcaaagtagggccagatgcggccctgggcatttgtcacgctctcgtacacatacagggcctggtacctccacacgatccacatcaggctgaagtagatcagcccaaacgggaggatgaagggggtgatgggggcgtacgcaaacaccgccacctgcgagggacgatgagcttggagatggggggaaagggaggtgggggagcacggtgcagcggcagaatatggggctggaagctctggtcacctgtcctcctgaacgagagacgaaaggggtgcaagccactcccttaagcccccccctctcacgtagatggccatgacaatgacgccgatgtcccggctgtagcgcaggttccgggctgggatttccatggccttgtcgatgggaaccttggcccctgcggcggcggggcaagcgatatccttggtcagcgcagcagaggcatgggattcacnnnnnnnnnnnnnnnnnnnnnnnnnnnnnnnnnnnnnnnnnnnnnnnnnnnnnnnnnnnnnnnnnnnnnnnnnnnnaaacaccgaggctgcaggccagaagagacgaaagggcaccagggcaaatccccggaacatcacatacaggacaaagaagctgcgatggatggtggagagaaaggggaggtgtggggacagggctggcatctgcacagttcagcaagaccgcggcaagggggatgtagacgttgcccaggcaacgaatgtgctgtgcaggtcaagcagcttgcagcaatcccctgcagccctgcnnnnnnnnnncggtgggcatgcctccataaccatctgagcccaggctcagtgatgaaatggcattaggtcgcagtgggcacccaggccaggagagagccagaggcatcacccgcagtaactcacatgagatgatgcggagccacttgaggatgaacacnnnnnnnnnngaagaagctgcgatggatggtggagagaatgggggggtgtggggagagggctggcatctgcacagtacagcaagaccgcggcaagggggatgtcgatgttgcccaggcgacgaatgtgctgtgcaggtcaggcagcttgcagcaatcccctgcagccctgccgccgccatccggccccttgccatgcacaccagcacacacaaacccccacatgaagcagggtgcagtcggctcccccatacccaggccnnnnnnnnnnaggccccttgccatgcacaccaacacacacgaagccccacatgaagcaggggtgcagtcggctcccccatacccaggcccagactctgtcgcacttggaggaggcggggatggcattgcccaggaggggccagatgttggatggccgctccagaaaggtctggatgctcgacaggacggacccccccagcagggctcccaggaacaggttgaagacgttcctgcagggtggagaagttatgaggggtgcaggagggcagttatcccaaaggcatgcaagcaaggcctttggagcaaggctccatgtctgggatgctcgctgcctcgctgctttcctatttcaggagcagttgcagtctctcagcagccgcgatccgtctctctgctgggtttgcgcatccttttcctggatgaaacaggcgcctccattcccctccaccccagcgcaccagtagaagaagagctcgccgcagcggtagtcgaggtcctccaggctgaagctggtggcctccgcctgcgccaccaggtagaacgcgaggggcagcaccagcacctggtacagcgacagcagcagggagggcaggaagccggtgagcaggttgcgcaggaagcgcgccaaccgttcgtcggagcagaaccaggaggtggcgtaggtggtggggtcggcgtcccctgcaggcacgccgcagatggccgtgctgagctgtgagaaggcgccggtgaaaatgccgatggggaacagcatgatgaccatgatgacggggaagaccagcagcgggcgcaccatgcgctgcttccacctgagaggtgggtggtcatgaggaataccagagtgctgagctgtattctgtccgtgtgtatgtgagaggcttcatggatgtacggagcgctaccatggtgcagagactcgtgnnnnnnnnnngcgtgtgtatgtgagaggggttcatggatgtgcggagcgctaccatggtgcagagactcgtgcacgtcccagactctgagctctcttccccccccgtcagcaccatgccctcagatgggccgagccaccgaacaagccagacgctggaacgcctgccccgccacgcacacaccccactcttcgctgcccgtcatttgccccccagccagccctcacccgcggaggagggccacccagttgatgtcggcggggtcgggcgagggcagcacgcgcatgaggtgctgatcgggcggattcacgttcacacccgcggcgaaggccgccgcctcctgcgtgcggaacacggcgaagaaggggcccgtgggcgggcgctccagcgtgcgctgtttcgcggtttccacctccagcagcacggcacgcagctcgtcctccagctgcgtggcggctgcggtcagctttgccagacgcgcgtcccggcgcttgcggcggcgcggggtgggcgccggcgctccgtccctgggctcgcccgcctcgtgcgcctgcagcgcggcgcggctgcgctccagccggcgcacgaggccgaagcggcggtgcagcagcttgtccacggcgcggcagtcgtagacgggcaccacggccacgaagtcgtcggcaaacacctcgccaaacacgcggcccgcggactgcatgcggcggttggcgtggcgccaggccagcccgtcctcggcttccttgtcctcgccgccctcgccgccctcgccgtgcgtggggctgccgtcctcccccccctcctcctcctcctcggtgcccaccacagcgtagctggcgggccagccgcggcgacgccgcgacagcaccgacacgcccggcagcacgccctcgccggagaagtggtaccgctcctccgcgtcgtccaggatcaggaccgcgtagcgccccacgcgtggcacgccgtacggctggccgtgcacggtcagcacgcactcgggcccgcccagggccacgggcggtgcgcccggcagcacgctgggcacgacgcgcgagtcgatgtggctggccgtgcgccggctcagcaggcccgcctcggggtccgccagggtcacgctcacgccgcccgccgacgcatcagagctggcgggggccggtgggggtgccgccgacccgttgcccacgggcgagtcgccggcctcctcctggctgctgtggcccttgaccacctccgactcggggtggaactcgtgccacatggccaggctcaggtgcgcctggggagtgtggtggaaagggggaatgaggcgtggactgggaggtgcatggcacacaccgccagggaggtggcgggccctggtccatgatatcagcatgtcatcaacannnnnnnnnnnnnnnnnnnnnnnnnnnnnnnnnnnnnnnnnnnnnnnnnnnnnnnnnnnnnnnnnnnnnnntgcaatgcgcccgatcctcaccttgtggtagcggacgaggaggaaggaggcccaggccacaaagaggatgacgtaaacaaagggcaccctgggacggggaacgcatggggcccgtcagccaggcagcaatggagtggccatgaggccgttggagtgtggacaggttccatcgactggatggcatccaccagcgggtcgcgggtgcactgcccacccattccatccatcctttcacaccactgccgtggggtggagactgtgcaccgggaatcaagcccttcttcccttcctcactcaccagagcctgccagaatccttggggatgttgctcatggtcatgcgcaggaaggcggagtccagccgcgaccctgacnnnnnnnnnntattggagtgtggacaggttccattgactggatggcattgaccagcgtgtcatgggtgcactgcccacccactccatccatcctttcacaccactgccgtggggtggagactgtgcaacgggaatcaagcccttcttcccttccttactcaccagagcctgccagaatccctggggatgttgctcatggtcatgcgtaggaaggcggagtccagccgcgaccctgacacgatctcgctagcagagttggtgtagttcacggggatcactgcgcagagtgggatgcatgctgtgtcaggggcttgtggggacaggtggcggtgtcttggcatgctgtggagcgaggggtcggcaaacagcaggcatcccagcgccttgcgtcggttgacccactcgaccctgcgtcccccacacctccacctccccctgcagctcacacactgccactcccagcacggtcagnnnnnnnnnncgcgttggttgacccactcgaccctgcgtcgcccacacctccacccccccctgcaactcacacactgccactcccagcacggtcaggggggccaggaccagaatgccgtactcaatgatgcgcagggaggcctgcgaggagcgttttggaaagggtgcagtggggggagggagtgacatggaggtacctctgtgtgtgcagcactccagtctcgcgcacggtgatctcacgctggcgacaagtcttacgctcctagacccacggcgccctctccacccaccacagcatccagtccggcctggcgcagcagctcgctatcactgactgtgaaaggaggaacgagccaagacctgcacggagagaggaccagcggcatgccagtggatgcacaggacagcccagcgggcattcgacacgacggcatgccaaggagtcggcgtgacatgcgtgcagaccaagcgctcctcggaagccgagcatggggcatagagtacctatgcagtccaggtctgccctctcaccagagccggcggtgccctttcagtggcatgagcgctgggcgccactgcttcttggcaatgtacatgcgggcctggtagatgggaaaggaccccctccacagcacgaaaccgatgaggaagagggcccccagtgccaggtccaggtagaggcccgtcacgatgttctggcctggggcaggcagggtgggtcggcggggcacctaagagccgaagcctggcctctttgggcatggagaggaccaccttgttcccctgcacccggaacatcgcgtattgaagggtcgtggtcatgcaatgggcatagctcaccagacttggacgtcgggtagcagaatatggccgtgcagttggtggtaatgttggcggtgccattccccagaatggagctgatcgacgccatgctgtcgcactcgtgacaccaaatgtggcctgtactctacaagtcagggtttcgaggaagcctgcatgactgcgagtagtctcaagctcggacaaacgcgtctctgctgggcgtaatgtcctgcatgtggttgactctgtcgcaccttcgtacgccgtggccgtcaaattttcatatgctccaggttcggggcaccttcgtggtctgaccatgcgccagcgtcagaaataccacaatcgtgactaccacagttgagggcttgattgtgccttgcacgctggattctgttgctttaatttcttgaaaaccctatcccatgtgcaattagtcagcccttcacaaagctaaagtactgtgtgacggtgtcctgcacttgtgtttacaacacagcaactaagagaccacagttgcaacattcccaacccaaacnnnnnnnnnncgacggtgtcctgcgcttgtctttacaacatagcaactaaacgaccacagttgcaacattcccaacccaaactccaaacaatgcacacgagtgctggtagatagaatcagtaatttaagagaaggtttcacacgtgagcactgatgaggtcgtctcgtcttaaggctgacaccacatgcgagattagcgcgcgccggcgccctcccctgcatgctgttttcacgcagggccacccttccaggattcctgacggtcggcgtagacgactcatatgaagaatcaacattagcataactcaaatcgctccttgggggactccagcgttgttcgtggggatgggtattcccaccttgtagcgtttccggccaccgcttcgccacccctggtgcccgccatggcgaagaagaaggggcctgtcaagaagaggtatggctccaaaaaggctnnnnnnnnnnatttccggccaccgctttgccacccctggtgcccaccatggcgaagaagaaggggcccgtcaagaagaggtatggctccaaaaaggctgagcctgtgcccaatctctttgagcgcctgagctcccacaagaagttcgacgtgctgggccggaaaaagctcaacggccctcaggagaagagcaggttacgcagcgcggctcatgaattggtgggtggagttcaaaacgggatgatggggagaagaactgcagagaagggggcgtgcgcctcgcagtctcctacctcgtagtccactgagcacaccgcctgcaccttggccccatcatcaattcccnnnnnnnnnncagaagggggcgtgcgcctcgcagtctcttacctcgtagtccactgagcacgctgcctgcaccttggccccatcatcaattccccataccagaggaaaaacacgcttctggtggagtacaagcagctccgaaagtcgaatgccttcatcgaccgacgctttggaggtgcgtgggccgcacggtagctttatgtttgggttgctgcgctggctgcagccaggcggcactgtctcagttgatacacttggtcagcaacaacatgaattccttgcgtcaattcacagaggacgatgagagcctgactgctgacgaaaaggcgttgctccgtttccagaagcagcggatgcaggagctcgcaggtgcggtatcagttttacggtggttgtaaaagatttgtacatcctgagcccagtgtcttgctttccagaggctnnnnnnnnnnaatgcaggagctcgcaggtgcggtatcatttttacggtggctgtgaaggacttgtacattctgagcccagtgtcttgctttccagaggctcaaatgccccattcagccccattgtgccttctatgtgaccaaacgcgtttgcacctatcagacaattaccccacctccctctcgccacccttcaggtggcaagtttgcactccctgacgacacccaggaggtggagctgacgcatctgggtcgcagcctggccgagtcccagggactgggcgaggtgtgacgggttgggtgggatatagagcggggactcaatcgatacaggggctggggcagggacaggggcatgtacaagagtgcggcctcagcagcaaatgccccgttcccaaggcatggtgctcattgcactggccacaacgcacaatgccggtatccttgggcacccagcatgcactctcgttcattgccccatcccaggactggcaaagggatgacgaggacgacggcctgcccgactacgacgtctccgcgcattttggcggcggggacggcgagggcggcgaccttttccagctcaagccccgcagcgagtccgccgaagtcgagggtggggatggcgacgacgcgcccgtcccacgccgcagcaaggcggaggtcatggaggaggtgatcgccaagtccaaggccttccgtgcggccaagcaacagcagcgcgaggaggacgtggaggaggtggaaaagctggactccgtcttccgggagctgggcgctgcaggggccctctcccgcctcgtgcggcccaagggcgccaaggggtgagagcgggcacggcgctctggtgcctggatttggaagaccgagtcgaccaaaggggcaatccaaatgaggctgccgagtgcgccctgcgacctgacggggtggagctggcagccagagggtggaggaaacagatggaccggcgtcgcctcagctttgnnnnnnnnnnactctggtgcctggatttggaagaccaagtcgaccaaaggggcaacctaaatgaggctgccaagtgcgccctgcgacctgatggggtggagctggcagccagagggtggagggaacagatggaccggcgtcgcctcagctttggctggatgtgcaccgagatccagaatgacagatggaggtgcatgaagatcttcacaatgccctcagcaaacccatttgattccacggacccctttcaggagcctggctgggttggagtctcgtgaggacgtggcttttgacatcgctgcccgggaactggtctatgaggctaagggtggccccgcggatcgcctgaagtcccaggcggagctggaagccgccgagaacgagcgtgccgccaaggcagaagccgcgctgcgccaccgactcaaggtgggaaacgggaacaggggtgtcgaatttggctgatcaggcagactcaattgcctgcactaagttgccaggaattgactccagtcccagcccttgcccctctcatcatgctcgcgtgactcaagctcgtaccttcaaaaccatctgcaggccaaggacctgggcgaggggtcggacaaggacggcgaggacgtcaccgtcatgctggagctgccctctggcggcttcgctgcccgccgcgccaaggccgccgctgtcgccgcggctcagggcaagaagcgcaagggtgggagcggggatgcactggaggacgaggacgagttcgacctgtcggccagcgccagcgaggagggcgaggacgacgaggaaggcgcgagcgggagcgaggacgaggagggcggccccctgacggctctggaggctcggcgccgggcgcgggcggccggctccgacccgctgcaggccgcctttcgcgaggccgccaagcgcctgcttaagcgacacaagggccaggcggagggggagagtgaggaggacagcgaggaggaggagagtggggctgatgaaggcgacagcggagatgacgagggagtggaggaggggagcggggaggaggaggaggaggaggaggttgaggctgaggaagaggctggtggcgtgtcggaggacgacagtgcctcagaggaggaggacgaggaggagcggacgattgacgtgggacggcgcctcaccacccagccagagccaagcatccaccctgaggcggcagtcagtggagagcagcaggcagcgccctccatgctgcagcgcttgccgaccacctacccggagtttgcacgcctggtggaggtgagtgtgtgttgagatggagtggggaggggaggcaagagctgtgtcaggattggcagcctgacattctgctgcagccctgctgctggctgctgggctggctgctgggggaatgcatgtactttccagcacattcagcctcacatcccctcttggtttgtccgcatggtgcacggagccaagcgctcgccctgtcctgccattgccagcatgacatccgctgcccacccccctgctcctcaccgccgggaactccctttccccccccttccatacacccagggcctctccgcagccgagctgcacgagacggtcggcgcactgcgcgtgacccacgccgccgcgctggctcgggacaaccgcgctggcatgcagaccttttacggccagctgacgcagcactttgccagcgtggcggcggctgggggccaagatgtaagcgccgcgctggacgcgttgctgccgcatctgctggagctgacggcggaggtgccgctgtacgccgcgacgctcgcgcgcgcgcggctctcaatgtggtcggcgcggctggggcggcggctggcggaccccgggcagcgcgccgacgcctggccggcgccgggcgtggtggccgtgctcctcctcttcctgaccctcttcccgccctcggaccggcgggnnnnnnnnnnctggcggggcgctgcctgaccttctgccccgtgctgacggggcgccacctggcaaccggcctgaccctggctggcctcctctcggccgcgcacacgcccgcgcaacgcttcagccccgaggcccttgagttttgcgcgcgcgcgctgcgcagcgtcacagcggggtgggtgggcgagggcgaggacggcgagggcgaggacggcaaggacggtcggatgagaaagaccgaaatgtggctgaggctcgacagcctggcgcccnnnnnnnnnnggaattttgcgcgcgcgcgctccgcagcgtcgcagcggggtgggtgggcgaggacgaggacggcgaggccgaggacggcaaggagggtcggatgagaaggaccgacatgtggctgaggctcgacagcctggcgcccctggccgagttccggccgcccagccttggcgagctgctggccgcagggcctgcagggtccccggaccagcggtgggagggcgctgacgcacggacgctgctggcgtgcgttgcggcgcgccaggccgcgcgctgcgcggagnnnnnnnnnnggctgctggccgcagggcctgcggggtcctcggaccagcggtgggagagcgctgacgcgcggacgctgctggcgtgcgtcgcggcgcgccaggccgcgcgctgcgcggagggcctggccggctgcgacgcggcgcctgaggcgctgcgcccagcgctggacgcgctggccgccatcctggcggaggacagcgcggcggtgcccgaggcgctacgggccgaggcgggggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcattgccgaggcgcggcagtacaacccgcgcttcgaggacggctacgtggccaccaaggactacgacccagacaggtgggggggtgggggtgggggggtattcttgggcgacagccggataggggtcccgggcgaggaggaaagggaaagtgggaggctccacccccctgacgccggcaaagctgaagcgggctctgaacaaccttgcgctcaccaatcacaacccgctcaggnnnnnnnnnnagggggttgggggtggggtggtattcttgggcgacagccggatagggggccgggcgaggaggaaaaggaaagtgggagcctccacccccctgacgccgtcaaagctggagcgggctctgaacaatcttgcgctcaccaatcacaacccgctcagggagaggtcggagcggcgcaagctgcagcgccaggtgaggaaggagcagcggggcgcggcgcgcgagctgcgcaaggacggggccttcatggccgcagtccgggacaaggagaaggccaccaagcaggcggccctggacaaatcggccaagcgggtgcgttgctggggatgggggacggtgcggcatcatggtactgtggctgccgctgcttgggccgcaagggtcgtctcccggctgacggcccgttggtcatccagacattcgctgcccgccaagccaccccgccccaccaccgcaccacacacacacaccctcctccatccacaggcgatgtccttcttgcaaaagcaagagtccgacttcaagagcggagggcagggcggcatgtggaagaagggcaagaagttttgagggcgtggtgcagatgtgccgggtcctatcagggcctgcctgctcagccctccttgctccttgcaatccctgtgacattctcggccggttcagcatctctcaaagcaatcagaacacgaggtggtcatgtagagggtggcattgcagggtcagaagcaccctacagtgcctgggttcacggtgccgagcatggcctgcccggatacgttttgggggttgggtcacggctcgcgagccgccgccgcccgcccgcctcccgatgcgaggactcccggcgcccctcccccgcctcccccgccgcggtggcgggcacggtgaaagcgatgcactccagccccagctcctgggtcagcacggccacgacggcgcgctgggcgtccgcgtccctgcacagcagctgggcggtgccgtcgccctgggaccccaccccctttccccccagcaggtgcggctggatggcagggaggcgcagcacccggtgcaggacgggggacccggcctcgcccagctgcgagggacacagtggccccgccgcagcgtcgaactcggcctgggcggcagtcatcagccggcccagctcggcgacgtcgccgcggaccatgctcgccgcggccgaggcggtgaggctctcgttcaggggccccaagcagcgcaccagggcatggtgtgctgaagtgctggggacggggtacgcttgcttcgcaaaagggggtggaggaaaggggtggggggggggaagggcgtggggcaggcttgggcgttggaaagtctcaagctgccagagccgaagaagcctgaatgagaaaggggacctgcaggccacccagggtccttgctttcccggaaggcgaggtctccttccgaggactttcacgctgtacagccccctccttttggtcctctgcctgctcaccccccccccccagcagatacccaacccaagcattgcccgccactccacctgcaggcaggacaggatctggacggtgtccttccccgccctcaggtcggcgaggacgaggtggaggggctccctcagggccacgctctccacctgcatcgcatccccatcaaaggtcatgagggctggggccctgcccagcgcaaccgcctggtccatgcgcccacagcggctgggcgtcaggcgctcgccctcgtacgccacccgcatctcgtcgcgcgtcgtcagacccaggtcgagaacgcggttggcggcgcgggccagcagcacgcagagcgccgcgctggaggacaggccgcgcttcagcggcagggnnnnnnnnnnnnnnnnnnnnnnnnnnnnnnnnnnnnnnnnnnnnnnnnnnnnnnnaggccggcgattctgtactccagggccagcttgtaggccatgcctgctgcgtaggaccagaagccgccggacctggcggtctaagcttgggtgagggaggggtaggggaggctgggaagggtggatctggggcccaggtgaacaggcatgtggtcttgaagagggctggctgtgcagtagccgactcgggagcaatacggcagcgaaaaggaatcacgcacctcgatgaggccgtccgggtcttgcaggtcatatgtctgactcaggcgccgcccgtcattggtggtggaggtgaggtggaggagggcatcgtcgcggcggcgcgcacgggcgtacaggccctgctcggttgtcaccacgatggtcctgcctggcacgatgtcgggattggacctgggagggggtgatgtgaaggtactggaaaagattgagaataatcacagggccaaaaatctggcagtggcaacttcatcttcccaatcgccacagaggaccgcgcagcagcccgggctcacgcgcgcatggatcctgcccagtcagagtgctccccaaagaggcaaagtcgcccagggacgaagatctcaatggcttgcggaacattgcaagcgtctgcctccattccagccaacggcagggccgccgcgcccgaacctgcgctgcttggatgcggtggcccgcgcaacgccgcaactgtacaaatcagcgatgttgcatttgttgatatcgatagcaggctgcgctgtgtggcattggtatnnnnnnnnnngcgcgcccgaacctgcgctgcctggttgcggtggcccgcgcaacgccgcaagtgtacaaatcagcaatgctacatttgttgatatcaatagcaggctgcgctgtgtggcattggtatgaagctaggcatcgaggcgtaggcccttggcacccccatcgagcgccgtccccgtcaccacccttccggtgatctcggaccgcatcgcgggttcggagatgccgggacgctttgaagacctccatgccgggtaaccctgatcactgggcaccatgtttccctcaataatgatctgagcagatacgcgaagatcttgcgggcatggcaacatcggagtatggggaagagggtggcgacgaggaatccgtcgtgttgccgagtatggattcaggatcctggctgacacccctccgcatnnnnnnnnnnctcggagtatggggaggagggtggcgatgaggaatccgtcgtgttgccgagtacggtttcaggatcctggctgacacccctccgcatgctggtgctcttctgcaccctcaatatcctaatctacatggacaggcaagcttggcgaggggcccgcgcagcccccacaccatgttttgaccgtgtgatttgctgcacctgcggcaccccagcggaacttatctcgtggtcactcccccgccgcagaggggtgatcagcagcaacggcgtgagtggaacggctggaacccccggggagcccggtagcggcatcatgggcgccttcggcctgaccctcttccaggcagggctcctccctgcggccttcatggtgggcctgctggtcgccagcccggcgtttgcggaggccagcaagcagtggcacgccctgcgtctcattgccctgggcctcaccgtctggctcctggctgccgcggccagtgggnnnnnnnnnncctcatcgccctaggcctcactgtctggctcctggctgccgcggccagtggggcggcctggggcttctactccctgctcgccgcccgcatggtcgtgggagtgggggaggcgtcctttgtggcccttgccgcccccttcatcggtgcgccgggcggggattctgggggtcgtatgtgcttctttcgtgcacactgccctgctgcacggaggctgcttggcgctggcgacgacggctgacatgcacaccgtggcctgctggcccagcatgcgcttgccatgctcaggcaccggacgtcccccctttcccaccccaccccctcccctcctccagacgacgtggcgccccccgcccgcaagtcctcctggctcgccgccttctacctctgcatccccgccggcgtggccctgggctacatcttcggcggcctcctggcggcgggcctgggctggcgcgcccctttcctcctggaggcggccctggccctgccgctggtggcgctgctagcctcgctgcccccgctggacctgcgcggctcgcactccgccgccggccagcccggcgccgactccctgctttcctctttgaaggccgacgccctggccctcgccagactgcccgtctacgtgctggtggtggcgggcatgacctgcttcaccgccctgctgggcgcgctttcttactatggcccgcgggcggggcgggaggtcttcgacatccccgcccccaccgccgacgtgacctttggcggggtcaccgtgttcacaggtgcgatgccaaaggcgtcgggggggctgggggggggttccagaccgtgggcgcagcagggatgatgttggcatcgcaagtgaggacggtggatttgggcgttgtccttgcgccccgtcactggccagaagtactctgcagcgaaacaaaacgcaaactattctatgggcactgagcagggggctgccagcaagtccccacctgacctggttccacaaccccatgcatgcaggcatcgtgggcacgctgatcggaggcgtggcgctggatggcatgggcagcagcatccacaatgccctgctgctctgcgcggccgggctggcagcggggtgcctgctgctcatcggcgctttcgctctcgcctccaattttgtggccttcatggctgtgctggtgaggcgggcatgtggagagggttgtaggggcatgtgtggttgaagcgtgggtaacctagagttgttactggtaggagctcaccatgagtatgtgggttgcccaggtctcacatcaggctcaaagcctgcgatgcaccacgcccctcctgagagtctcaacaaaatgcctagtacccctgcaccaccttgagatacccactctccacccgcaacacaggccctgggccagatgtgcctgtttgcgaccatggcccccagcaacgccgtggtcctgtggaccgtgccccccggcctccgggccccagccatgagtttctcggtggtggcgctgcacgtgctgggggacgtgcccagtccccccgccctgggcttcctgcagggccgcctgcgcgactggcggctgtccctcagcctggcctccctcctgctcgcggcgggggcggcctgctacgccctggccaccgcccccgcccggtcagcgacagactaccgggctcaggacgcggccacccggccaccgctggaggtccaggacctgcgggacgcctccctcgcggactcgacggcgggggctggggtggggggggtggagggcatgcgcctgcgcctcctggcggggcagtccacgcccaacctggccatgctgcgggagctggaggagaacagggagtgagcatgcagctgattctgtactattcttttcgttgtgtatcacttgtaataaatcgcattggcatgagtgcggggtatcggtgcgccggtgccacgacaagccgggatccggagcccgcggatcatttgctccgacagttgtaatttggggaaatgtaaacaaggtgcaggcggggagctttgctgggaccatctctcaatacggactgctcagactagccgtgcagagagccctacctctatgctggcactgggccagactcggactgcgctccacctctgcgctctacgagccaacttcagggcctgcaaccttgggcaggtgcgtgctggtaccaaagattcgagggatgggtggatgactgttcattgatgtgcatcgatgggagttgtagctcggagcattacgatctggaccccctcgactgtgcagagagcatactcaggaccaacttctcgaggcgtggcccgtcatcctcctcaccgtagcatcacacatcactcaagcaagcgtgtatctcccacattgattgccgacgcctccagaatgagcgctcaaggctcggacgtccccgacattgtgtctgcccagtggctcaaggacaggtctgtggtgatgtgttcgagggcgttggcatgcagagatcgtgttctttggtacatattgctgcaggattatgactatccttgagttccatttccagaatgagggctgagtcttatcaaccctctctcacaggctggcggatgtcaaggtgctggatgcgagctggtccctgccggtgcacaagcgtgatgctgtcgaagagttcaaagcctcccgtctccccggtgcccaattctttgacctggatgccatttcggacacctctgtgggtgagccaggaaggggttgtccaggtggtgagactgtcacctgagcacgccgctcatcagagttcttgctgatgccaatatcacatgtgggctgctccaggatcctacgtcctgatatgcgcacccacctccgccttcgaccccctattcccgcgcatctgcatccctgctgcccccatacccctgcacagacctgccccacatgctgcccaacgaggcagcatttgctgccgcagccgatgcgctttgcnnnnnnnnnncctgcatccctgctgcccccacacccctgaacagacctgccccacatgctgcccagcgaggcggcatttgctgccgcagccgatgcgctttgcatcaaccctgacgataccatcgtcgtgtacgaccgcctgggcgccttttcgagccccagggcctggtggacctggcacgtctttggccacaagaggtatagggagaagggagaagggattgggcggtgtggaatggtgtttggtcctaggctctgggtggtcctcctgtgacagggcgcgccccatcgtgggtcctccccttcccgctcggacgcagtattcttgaaaggagctcaccgatccccctccatcccccgccccgcacagggtgnnnnnnnnnngtcgtgggtcctccccttcccgctcagacgcagtattctcaaaaggagctcgccgacccccctccatcccccgccccgcacagggtggcggtgctggacggcggcctgcctgcctgggtggaggcgggcggcgagctggagagcacgcccgtgtcggacagcgtgctcaccgcccccggcgccgcggcagcggccgcccaggggccggacgccggcgtgcggcccgactcccgctaccccgcgcatctggacttgtcccaggtcgcctcctggcgcgacgtgctggccgccgtggaggcgggcacgacggnnnnnnnnnntggtgagctggagagcacccccgtgtcggacggcgcgctcaccgcccccggcgccgcggcagcggcnnnnnnnnnngcaacctggtggatgcgaggcccgcggggcgctggcgcggcgaggcgccggagnnnnnnnnnnacaacttagtggatgcgaggcctgcggggcgctggcgcggcgaggcgccggaggtgcgcccgggcctggcctcggggcacatcccggggtccaaaaacctgccctgggacgctgtgcagaatgggggcaggttcaagccggcggagcagctgcgcgccgccttccagggcgcgggcgccgacctcggccggccgctgacgctgtcctgtggcagtgggacgacagcgtgcgtgctgctgctagcggcgcgtcgcgccgcaccaggggcgcgggcaacggtctacgacggcagctggagcgagtggggcggcctgcctggcgtgccggtggccaagggggcggcctgacccggtggcgggtagctgtgatgaatgacggcgtcgtttccacagtaaatgatggcgaactgttcagtgactgcccagggttaccacacaccccaggcacagggtggcggtnnnnnnnnnnatgcagaggaggctgtgatgaatgacggtgtcgtctccagagtaaatgatgtcgaactgttcagtgactgcccaggggtaccacacaccccaggcacagggtggcggtcatgatgggaacatgttttgtaaatggaggttgccttgccggcacatccggtggtagaccttgttcgcgcttgatctgaccacgcatgtagtgcgatctccacgcgcgagcaaaggccccgcctgccttccattcagtgatccagactttcaaagctttcgatannnnnnnnnnacaacggccctgcctgcctcccatccagtgatccagactttcaaagctttcgatatcactgggtgatcgccactggccagtacgcttgcgctgcggcacacagcatgctgaaggttcatgcgcggaccacaccgctcctcctggtgcgcatggacatgggcgccgcgcacgcctgtctatctggtgcgatgttccagtgccatgccatgaccacgccctatcattcctcctcctgcagaatcccctgacacgcccggtctaccgccaccccatgggcaacaggggagccagcctgaccagcacagcagctgcgtcgcctgcctccaccagcacctcctcacaggaggaagacacgctgagcgacttccatgcgcaccagtccaaggctccacgcctctccatcgccgtccaggcccggaccctggtggctagcagcacgtgaggcggagcatgctgaagggggctggtaatgatgcaacccacattcctttggtgtgccatttccatcagcagcctttgcactcctggagaggcattaattcactgcaaccctcacactgacccctcctccatgtcgcctcgccaggtggggggtgctgtccaccatctccagcggccccgacagcgagggcttcccctccggcagcgtggtggagtatgccgtggacgaccgcgggctgccccacttcgcgctgagcaccctcagcccccacacgcgagacgttcagcgcgacggccgtgtcagcctcaccgtgcctgtccaggggtccaaggtgaggctcgggaggggggcttcagagagtgagaaggagcatctccgcaggagtggtgggaccccaccannnnnnnnnntgcgctgagcaccctcagcccccacacacgagacgtccagcgcgacgaccgtgtcagcctcaccgtgcctgtccaggggtccaaggtaaggcccgggagggggatttcagagagtgagaaggatcatctccgcaggagtggtgggaccccaccactcagtgtcacttcctttacacctcgtgggaacagtcgcatcgcttttcccacatgacgctggtttatttgacaactgggtgtgacaagagtgacactgcacacccacaatgcacaaccccagggcctgccggacgcgcgggcgacgttgacgggcagcatggagcgcctggccggcggcgaggcggcggcggccgaggcgctgtaccgtgcgcgccacccgggcagctactgggtgggatttggggactttgccatgtaccgcatggccagcttgcgcggtgtgcggctggtgggcggcttcgcgcgtgcggggcgggcgggcgctgaggagtacctggccacagcacctgacccggtggccgccttctcggcgcccatcgcgcggcacatgaatgccgaccacggggaggcttgcgtcgccatggtgcggcactgcgcgcgcctgccggcgcgcgccgccctcctgctggccgtggacgagctgggcatggacctggaggcggagctggagagcggggagcagctgccggtgcggttgggcttcctggcgcccgccccagaccggaaggccgtcaaggaccggatagtggagttgacgcgggccgcgagccggggtggttgaggggctggagcatatgcgtcaggaggtccagaggtctgttcaggccttggaggcttggctgtcttccttccaggctttggaagccgaatcctgagcctctgccaagccagcagttgtgatgtagcatcgaccaaccctgaggcaatgcctccacggagcacatgctccgcctgcagcgagcacggcgcgcgcattccagccctgcctggcgcagtccaaggctccactacccccaggctccgatatctcagtccgagaagtagcggtcctctgcatcctgggcctgcaggcgcgcccagtgctcgtccagctcggcatcgccgtcgatggcggggtagtctatgcccgggtcgtggcccgccaggaagctttgctgcatcaggtccagcagcgcgccctccctgcgtggttgagggtgtgtgatcgggggggtggtggtggcatggtgcctgatgaaactcacannnnnnnnnnggagggtgtgtggccggggtgggttgtggtggcatggtgcctgatgaaactcacagagaacacagagtggcgtgcagtgcggctcgccacgacaacctcggacggcattggggcctcggtgacatccagctctcaccgctccggtaaaggctcgacaggtgccggactctgctggtccctcccgtcctcgtccacctcctcgtgcccgtcctccccgtcctcctcctcggtggcagcgtcgtatgcgagctgctcctcctctcgcgcctctgccagcgtcgcctcacgcgcatggtccagcagccggtcggcgtaggcgaggcctggagaaacaccggtcgatgcctggtcagaagcgtctgcactcggcctgtactggccaatgtactggtggtatagccagggctggcgctgctccatggcactctcagaaaaatactgtccctccgccatgagccgctgcatgtgcgccagtcgccggttgcggatgagggctgagctcttggagtcacctctcgcatctcccagggctttaagatagaaatctacctcgtgatcgctccgaagggactcaaagtgcatcagctcgtctgccgacaggtgtaccccatgcctctcgaggaacacgccagggtccctttgtagcagggccgcaacgtactcccggcgctttgcggacccgacttcgccattgcgcgtcagctgaccggggaggcggagatcaggcaggtccgccnnnnnnnnnncagcagggccgcaacatactcccggcgctttgcgaccccgacttcgccattgcgcgtcagctggccggggaggcggagatcaggcaggtccgccagtcgacccgagatggaggtgacagtctccccagatataccgctccgatcctggcccatgccagcgttttggtatagggctgaggacaatagtttgtgtggatgttcaccagaggtttgcagnnnnnnnnnnnnnnnnnnnnnnnnnnnnnnnnnnnnnnnnnnnnnnnnnnnnnnnnnnnnnnnnnnnnnnnnnnnnnnnnnnnnnncatggctggtctgtcagggcgcgaaactcagtcccgttcatgttccaaaagcttaatattcgtgcgagcctcgccacattaacatatgccatggactgtttttgattctacgagggatatatcgcagataaagtggtgctccattgccatggccactgccgcccggcagtgccgggcgctggccagcctcgcgtcgcagtcctgtgacgggctgctaggcgcccgttgcatggccaccctacccgctgccctggcctcacaagtggcaacacgcagccctgggtccatcgacctccccgccgacgtcaacgacgccctccttgctgctgccaagggtgaggaggattggtgagggtgggctggcaatctcgtctccgcttacctagagaatcaactgcttcagcgcctgtccccccaatgctttcctcaatctctccctaccccccccnnnnnnnnnngtacccagagaatcaactgctttagcgcctgtccccccaatgctttccttaatctctcccaaccccctcccccttcctcccaacaaaaggtgcaagaaagaagcacctgcgcgggcagggtgccgcgctgacggacgagctgaagcatatgtcccgcagccggcaccgtggaggcgtgcaccccaacctgcatggggttccagaggcccaggcgcagcgccccacgcgtgggaaagcacggcagcagcgacgcaccctgctggccgagctggccggcgaggtgccgggcctgcctatggtgggaactctgacaggcaaccgggggccggcgcgcatgtcccgccgcgcccgcgccgcggcggaggcggcccaggagtgggaggacctggaggaggcagacgagggcggtggaatgatggacagcacggccgcagcgcggccatctgagttggctgacgccgggccggcggaactctcggacaccgtggatacacaaggagcttccggtgttgctgctctggaccagcctgtcatcggaccccccgccgccaagtcagaatccgcatcccagtgggccgcgccgccccccctcccgctggaccgccccgcgcgctcctcggcggtggcggcggggaggcggtatggcgacgaggccacggcgctggcctacgctgcgacgcgcatgccggcatgctacgccgcgctgcgccgcgctctgggcgaggtggcggcgcggcagggcgccgcctgggccccggccaccatgctggactttggggcggggccggggaccgcggcctgggcggcgcgcgacgcctggcctgcggccgcgctccgcgtgacggccgtggacgcctcgggcgccatggcctggctggggcgggctgtgcaggcggcgcggacgagaagcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgtgctgggcgagctggacggcgacggggagcggcgccggctggtggccgacctctgggccagggtggcgccgggcggcgtgctgctgctggtggaacccggcacgccggccggcagccgcgccgtcgcagcggcccgcacccaggtcctggaggcggcagcggacggggagggtagcggggcggggcaagggaggcgcgcgcatgtgctggcgccctgcccgcacgacggcgcctgcccgctggagggcgccgcgacctggtgccactttgtgcagcgcttccagcgtgggcccctgcaggtgcgaggggtgtggaaggaaggaannnnnnnnnnctcatccccctgcccgatgatgtcatggaggcgtaccgtgccctgcccccccacgaggtcccccggcgagccaggccgcaggtgtgggggtgaatggggctatttttttgggggggggggaagggaggcgtagtacgcagagaaccgctactcgtacagaaggtctcagcgcggggcgctggtctgcccggttgagcccttgagtggaagtacggatgccggcacatcccgccaacgagcttagctccctgaccagccnnnnnnnnnnaggggggtgtggggggattggacacttactcgaatgccgaacattgcaccctcctctctttgacacctcccccccacgaaaacggaaccccaacctggcagagggcggccaaggactttgcgccggggaaggtgacggtgcggtcctacgccgacgagcgcttcagctacgtggccatctgcaagcggccccggccgcacgggccgccgcagcccgccatcgacgccgtcatccccttgcccaatgatgtcatggaggcataccgtgcccttcccccccacgaggtccctcggcgagccaggccgcaggtgtgggggggtatggggctattttggggggagggggggaaagggaggcgtagtacgcagagaaccccaacccgtacagaaggtctcagcacggggtgctggtctgcccggttgagcccttgagtgaaagtacgcataccggcacatgccgccaacgagcttagctccctgaccagcctcctgctcaccatgccagctcgggcttccggaggacattgaaggcccagagattgttgagaatccagcagcaccggcggggcccagcgggggcgccgctgggagaatggcgtgggcggatgacgacgctttcctcctgcggctggccgagggccggggcctgctcagcgacctggatgaggacacgctgcagctcatcagggacagcatcggcgaggatgcggagctggggaccgaggatatggagctgcggcggattgggaagggggagcttgggaacgaggtgacaggtgggcagtgggtttggggggtgcagttgtggagtggcggcggtaacgctgggtgcggcagtttggcgcggggcgctctggggggcgcacaaaaccgaaagacggtgctgaggaagcagggggagagggtagtgcatccctcaccttgagccatgaggtttgtgacttggttctcctcnnnnnnnnnngtctggggggcgcacaaaaccgaaagacgatgctgaggaagcagggggagagggtagcgcatccctcacctcaagccatgaggtttgtgacttggttctcctcgatgaccatgcctcagagccggcctgcatccaaaaacccttctccctcttttggattctagcagcagcagatgcgccacactcacctgctgacatcagannnnnnnnnntcctgctccctcttttggatttttgcagcagccgatgcgccacactcacctgctgacatcagagggagccagaggcaaactgcagactctctgcccacctcccgacctgcccccactgtgccggcgtcatctagcaacgggcacgaccccgacctcgacctggagaccctggcgcaggcctccgcctccacctggtcgcgggtgctgcgcccacccctgaagcgaggcgggcacgtggtgctggacctgtgctctgccgtagaaagcgggacgcggggcgaggccgtgcgccagaccgtgtcgcgcctgggcagcgagcgggcgctggggggacggggggcctaccgcctggcgcgggggctgggctggggcgacctctggcccgcagactaccaggacaggctgccgctgcagagagggggggcttggaagaagggcgagtgaagaatgatgtgtgagagtgctatttgtggagtggccccatcagaaatgcgagtctgcagcgtgaggcttggagcaggtgctggcgggcatgaagggtcctcagagctctgaatcgcaaacttttctgtgataaccccacattgtcccagcagagaactagagccaggtttcttattgggatgtgctagtccttggacgtgcggtccagcacggggtnnnnnnnnnngtggggggccagtgaggaacagagcaggtttcaacatacgcaagactggagcaggccggcagggatgaggggcactgcgccgccacagtatccagtgcgttcggggctcacaggcacagggggtgtcagcgccgggagtgtaccgcgccgctaccaggcgtggcggcggaagnnnnnnnnnnggttctgaatcgcaaacttttctgtgattaccccacattgtcccagcagagaaatagagccaggtatcgtattgggatgtgcaagtccttggacgtgcggtccagcacggggtgcaagtttcttggggggtcagtgaggacccgagcaggtttcaacacacgcaacactggagcaggccggcagggatgaggggcagtgcgctgccacagcatccagtgcgttcagggctcacgggcacagggggtgtcggcgccgggagtgtgccgcgccgctaccaggcgtggcggcggaagagccaggcgatgctgcgcgcccacccggccacgcccatcacggtcaggagcagcaggagcggggcctggcggtggcgcagcatggcgcccaggggcggcaggcccgccaggttgcaggccaggtgcgccgccacgggcccggccacgctgcgccccgccgtccagagcgcggcggcgtgcaggccgaaggcggcggtgtaggcggcctgcagcgcagcggcgcgcagcgcgacgcgcacgctgtgcccgccgtgccagacccggtccaccaagtggtgaacgtgtgcggcggcaaagagggccagggaggcagccaccgccgcggcggcgcccaggccccgctggcgcaggaaggccagcaggctggcgcggaagacgagctcctcgctgaggggggcgaggcagaggtcgcgcaggacctgcagcgcactgcgccggctgacgtggcgggggggcccatgcgccggcacagcgcccagcgcccggtacgcaaggggcccagcaaagaggagggcggtcaacccaaggccctgggcgacgctgctccaaaagccgtgggccgtcaggcccagcagggcannnnnnnnnnaggtcaacccaaggccctgggcgacgctgcgccagaagccgtgggccgtcaggcccagcagggcagcggcctcagacgcccgggggagctgcggtgaagggagggaggagtgtgggtcactcacgggagtggcttgtgattgcgatgtccgctttccaattttggtgggggatcaacccacaaaggcaggccagccgcatcccggctcgcactgcaccgtgcgcctgaagcaaacaacggctcacccgcccgttcgactgcgaaaaagcgaggataatcggcacccatgtcagcaaggccgatgttatcgcagtggcagccaggcgagctttgatcacgggaggcgagtccctgggaccccgcacgacatacagggggagcacgtacaccaccaggtatgcacatccagcaagagcggtgtgcaaccccggcgatgtcatgacatagcggattggtgtgagggaaaatggcacttgatcgcctcctgtcccaaggtacgattgccgggatgggaggtgtcgtccatgacagagggtattccaccgtggcactcccgaatcatgcgccgactctgcatcgatgaaagaatccctgaagctgtcaaacgagcatttgcaagattttagtggcgcttgagatcgccacttgctgatttttcgcggcacagtgttgcctgcatacacctcgggagcaaggggtttcgattcgcggaccactggctggcgcacagacacaccacgatccgccattaatggagcgcattacaagctgaagtagctgtgcatggtaaatgatgatgcctccatgcggttgagggcgcatcggctgtnnnnnnnnnncatagctgtgcatggtaaccgatgatacctccatgcggttgagggcgcatcggctgtcaagtgcacccaagatcacttccgtagcctggtgaaattcagagctggacggtctaccagctcctcagcgcaatctagactccatgagtgacgggtgagtatccgatgtattgtacccgaccatgtgatggcatggtcatcaggcttttgcttgcctcattgccgagcacattcccactccctgcaggcaggatgtgctccgcatcctcatctccaccgacaaccatctgggggtctgggagaaagatgaggtcaggggggacgactcgttcaacaccatggacgaggtcatgtgcatcgccaagcgcgaggtggggctttgtggggaatatcccgacgtcattggacattgagagcccgagctgcacttccccgcgcgtgaagtgttggtggggaccagggttcaatgnnnnnnnnnngttggacattgagagctagagctgcacttccccgcgtttgaagtgttggtggggaccagggttcaatgcttatttgaaaatcacctggctcaacattacttgaaagagaagagtttgagcgtgctgtgttgctcccatgcacaattctctctcagatcccagatccatgccttgacacagaaagtggactttgtcttgctgggcggtgacctgttccacgacaacaagcccagccggcagactgtggtgaaggccatggagatatttgcgcgacactgcatgtcggacgaccccgtcggcttccgcgtcatctcggaccagcgccagaattttgccagcgggtgagcgaattccagcggtgtatgtggtggcgcggtgtcacgccttggggctgactcgtgaccatttaggcatgggggtgcaacaatgggcgcggggaacctcctgatggttgctccactactcgtttgattccagtgcttgttgagagaatgggctgcattgaaagtacattctcaggaaggattgcccactacggtgtcccacacgtcccttgccctgccactccactctcagccgggtcaattttgagaactcaaattacaacattggtctgcctgtcttcaccatccatggcaaccacgacgatcccgggggcaccgaaaacctgtctgcggttgacatactttccactggcgcactcctcaactattttggcaaggtgtgaagtggtgtttcacagggttgtttccgggtgacgacagggttggggcgggagtattgcaagctgagggccctgtgacaaggctggatacagcggaaaggtggtaggagcagggtgagagcagtcggcatgctgagcattggccgctccctccacgacccatgcaggtcgccatcgcaggggaggnnnnnnnnnngggtgattcacagggttgtttccgggtgatgacagggttggggcgggagtattgcaaactgagggccctgtgacaatgctggatacagcggaaaagtggtaggagcaggatgagagcactcggcatgctgagcatcggccactccctccatgacccatgcaggtcgccatcgcaggggagggggtgggcaaggtccgcatcgcccccgtcctgatccaaaagggtgctaccaagctggccctcttcgggctggggaatctgcgcgatgagcgcctgtgccgcctcttccaaactccagcctgtgtagagtggtgagggagagcactgcagtgttgcaatggcgtgcacaggatgcgatgcccaggcctgcagcactgagaaaggacattgtacagctagactgatgcaaagccagagtctcacgctttccatcacgttccacgtgcccctctctcatcgccttgccatttggatgcacaggannnnnnnnnnccagaatcggacccctcactcccaggtgtggaggtgcccaatcatgcaacagtgtgactataggaaacagggcacattcttcnnnnnnnnnnatgcagcattgagaaaggacactgtacagctaggctgatgcaaagccagagtctcacgcttttcatcacgttccacgtgccccaccctcatcgccttgccatttggatgcacaggatccgtccggccgacacgccagactaccccagggacgagtggttcaatctctttgtcctgcatcagaatcggacccctcactcacaggtgtggaggtgccgaggcatgcaataatgtgactataggaaacagggcacattcttccctgtgtgcagctgcatgtgtcctggctgtgcatgtgtagtcacagcatttgccagggcttcgtgcgacacgcatccggccggttgccctcaaaccattgctctcaccaagccccacttgctcgtgtcagggcgccaaaaattacgtgaaggagagccacttggcgcgattcctggacctggtcatttggggccatgagcacgagtgcctggcagatccttgggtgtgtggactggtggtggcctggcggggagtggagggcaggaggtttgtgtcctctgtctcacctcatgttggtgatgtgaccgacctgtggccaaatgaacaagcaggcctaataccaccacccccatactcggtggggcggcacccagcagccacaccatcccctcaccgcatcgatccgctgccgagcgcaggactcggtggagacggggggtgccttcagcgtcctgcagcccgggtccagcgtggccaccgcgctctcagagggcgaggccaaaagaaagcatgttgtggtgctcgagatcatggggcaccatgtgaggaggcgtgggatggggcaggcttctgagtacaaagtgcttggtgatgactggggggcccgaggtctggaagcattggaagctggctgagcggtctgcctcctggcgaccttgatgtctaccgcactctccactgagtcccatcagctgcaccccctcctcacgcacatgcagtggcggacaataaagcacccgctggagacggtgcggcggtttgaatttgagactgtggtcctggcggagcacaccaagaagctggacccggaagatccagaggtgcgaagcatgatgtgctcattgtgaaagggtcctgggctgatgaagattctgatcaaactctgtcttggtagctctcaagggaagaagtgggtgatcagcagaacgctccagaactgtctgatttcctgccttcctgtggcacattgaccagccacctgcgccgcacctgtgccaaagcccttttggtggcttgcccggctcagatgtatagcagcttgaaatcgaacaccatcgccctcccaccgcagacggtgactgccttcctggatgcccgggtgtcggccatgatcgcccgagcagtgcgcgggcggccgccagcttccccgaagcttccgctggtgcgcctgcgcgtggattacaccggcttctccaccatcaacacccagcgttttgggaccaggtttgtggggcaggtcgccaacccacatgacatcgtcctgtggcagaagccgcctgccagacgtgccagggtgggtgaggggaatggtggaggaaggaggaaggggtggtgtaggccaggtctgggcttgcatgcccggtgcaggtttctgaatggagcatgggatgatcatgtggcctaccaagaattgctctgtaaggactgccaatggttgattccgtgacaccccaaaactccacaccgaccctcacccatatgcgctctgtgcaggaggaaagcgccacccgagccggcaatgcccctgtcgtgcccattcgtcccgaggcgttggacgaggcccacatcgagnnnnnnnnnntaatggagcatgggacaatcatgtagcctgccaaaagttgctctgtaaggactgccaatggttgattctgtgacactccaaatctccacactgaccctcacccacatgcgctctgtgcaggaggaaaacgccacccgagccgacaatgcccctgtcatgcccattcgccccgaggcgttggacgaggcccacatcgaggacctggtgtcccagcacctgcagcatgacctggagctgctccctgaagtggtgggcagagggtgtggtgctggaggagttgggaggacgacaggtccaccaagggggtgcttgtggctcccagctgtggtcattgctgcagacacttgccaaacgcctnnnnnnnnnntaggaggcgacaggagttgggaggacgacaggtccacggaaggggtgattgtggctcccagctgtagtcattgctgcagacacttgccaaacgcctgcttcttagatcctggcgtgctcttccagatgaacgcccccaccatccctccccatgcacaggagctggcagaggcgctgcacgagttcgtggacaaggagaacagaaacgcactgtcggaggcggtcagtcgcgtgctggaggagacccaggcggctgcggctgcccgcggcggcgaggagaccgggacctcggcggccggagagggccgcggcggcgcacgaggcggtgccgacgccgcagtcccctccggccccacatccccatcccggcagggcgtcaagcctgccaagccggaggagggcgaggtnnnnnnnnnntggcggccggagagggccgcggcggcgctcgaggcggtgccgacgccgcagtcccctgcggccccacacccccatcccggcagggcggcaagcctgccaagccggaggagggcgaggtgctggagtccatcgcccgggccacggcccggcgccgcctgtcccacggcctgggcagtgctctgaggggagggagcccggccagtctgccagccctgtcggggctggagagcggggggcgagggagagggcaccaggccgcgcccactcccgtcccatccacggcgggtgggtcgtgggtggcgaggccgccagtccattgcgacaccaggcnnnnnnnnnngctggcgcaggccatccaaacgtacaaatccaggcactctctgacgcgcccatcgggaaaaactcctccacccgattcaggtgcgcgccgccctccgaggggaggggacgccgctggggaggcgccggcgacacgcacgacgccacagcgggcgcatggcgatgccgtgggcacccactctcgcccggcggccggaggnnnnnnnnnntgtggacgccgctggggaggcgcgggcgacacgaacgacgccacagcgggcgtatggcgatgccgggggcacccactctcgcccggcggccggaggcaggttgaggcagggcgcgctcaggctacagccagccagttccccgaacttgtgagcctgctgtgcggtataagtccatcagtatgggcacatgtgtatagtgattcacactgtacatacagggtctcgcctgccttgcaggggcactttgcagggtgccctgatcagtggtacttgacgcnnnnnnnnnntgctacagccggccgattccccgaacctgtgagcctgctgtgcggtatgagtgaatcagtgcgggcacatgtgtgtagtgattcacactgtgcacacagggtctcgcctgccttgcagggcaccctgcacttttcagggtgccctgatcagtggtacttgacgcggttacaactgcgagtcttcacccctgccatagggcatcgcggtcacagcctgcctccaacagagaccttgagcttgcatctggccactcggagctgcaggacgcagacannnnnnnnnncacaactgcgagtcttcacccctgtcacagggcatcgcggtcgcaccctgcccccaacagagaccttgagcttgcagctggccactcggagctgcaggacgcagacatgtctgaagccatctttacagattcaggtgtgtctagttttgttttgtgtgtgtatgtgtgtgtggggggggggggtccttttctctgatagagnnnnnnnnnncacagattcaggtgtgtctggctttgttttgtgtgtgtatgtgtgtggtggtggggggggctttttctctgatagagatgggacatacctttacaagcagaggctccgagcacttgagcatatctactggtacaaatctnnnnnnnnnnccgagctcgggacaaggctggcagctctgaagcccgtcaccaggagcgcatggtcactggcagcttnnnnnnnnnnatgggacagacctttacaagcagaggctccgtgcacttgagcatatctactggtacaaatctccttgcgtgctgactgggcaaagctccactatactcattctcccccgtacctccactgtgcagatggcgatgggggggtattgacaggaaccagatccctggctggcgccaggcaacagcccactcccaccaggaagaggggcaggaccccaggcccaccgtctcgagcccgggacaaggctggcagctctgatgcccttcaccaggagcgcatggtcactggcagctttgtggagtctgatgcggacgaggtggcagttcccactgctcccaggcgaaggaaggctgggtctatgggcacctgagacccctcgaacaagaatgacgccctgtcgagggaacacccttcatacttgaaggacgtgtggaattttatcatagaatccgagcgtcggatgcactgttttacatctcagagtgcctcccagaggcttccgtacaccagaaaatcttaatcagcgagacacaaagcctaaagcatgagcgctccccgtggcgctgctagaggcggaatcctgcagttccggcaacatttttaccccatcgatgtcaaaacggttttgctcctggcaagggtcccgtaaacatctcnnnnnnnnnnggagttcgagcgtcggatccactcgtttacatctcagagtgccgccgagaggcttccgtacaccagaaaatcttaaccagcgagacataaagcctaaagcatgagcgctccccgtggtgctgctagaggcggaatcctgcacttccggcaacattttaccccatcgatgtaaaaacggttgtgctcctggcaagggtcccgtaaacatctccctcccatgcgagatctgtctcggcgcatggtaacgtaactttgacgccatggtgtgacgggctggcgaatacatgtttcatctcacctccatgcccacgatgtacagcctcacgatgaatcagctagtgggttcacagccctacaagcgcgtcaatcagatggtctcgttgttgagcggcgccgtcttgtgattcaccatggcctcgacctgggagagcgcccaccctctatcgcacggtccgagctgggatgcggcacccagccttgacatcgctgctgcgccgccccagtctggagtgtcagggttgtatgctctggccctccaggtaggctgctgaagggatcggggcgaggggggagctatgggcgaaccctgtctccactggctggtgctaactataggacccgaggcaggagagccccgtgcnnnnnnnnnnaatcggggcgaggggggagctgtgggcgaaccctgtgtccactggctggttctaagtataggacccgaggcaggagagccccgtgcgcaggcctctgacactgcagcgtggctctgaccaccagactcgaagcgctggtctcatgcttctgcacctctcgtcccgcagggccagtggcgtcaggtcattgggaggtgcaaggaactccgcccggcgagtagagccgattcgctcaccattgctaccttccatgtccttgcgctcgcccagctgaaccagaccatggacgccctccaggagctggagagggttgggaacctggacggaagtggatcccacgcggcccgcaggaggcatgcaggtgtgtgtgcatgtgtacccgcatcgtggtttggtgctgcttggtgccttgtgtgtggaacgttcaattgccggcagtagtctcacggccccaagacgttggttgggacaaagggaacgcactgagtgcatgttttgcaaggactgaccacctgttccctcgcatgctttacagcatgtttcccctcacccatacgctttcctcggcaggtgagcacagcgcacccgacgccagcgaggtgcnnnnnnnnnnacctcgcatgctctacagcatgttttccctcacccatacgcttccttcggcaggtaagcacagcgcacccgacgccagcgaggtgccctttgcgctgcggtggctcgcggcggagctgcccggccgggcggggcgctggatggaggccgtctcggcgtttcaggcccttctgggcctgtgcgtcacgcagagcgggatcgcggagcgggagggcgacgccgaggcgtcgcgcatgtggggtgggcgccgggcccgggcggcggctgccctcgctaatgtgcacgcccagtaagtgcccgcgggtgtcagagcggggatgttgtgtcctcggagttgggnnnnnnnnnncgtgcacgcccagtgagtgcccgcgggtatttgagcggggatgttgtgtcctcggagttgggtgtgtccatgcccagacaggatcttgggtgactcgtatgggctctttcaactcagggaatccatgccaacatatcaaaatcccggatgacgacctcttccctgcatcctgccctgcctcgatttcaggcccaacccgcccctcgccacccnnnnnnnnnnctatcacaatcccggatgacgacctcctccctgcatcctgccctgcctcaatttcaggcccaacccgcccctcgccaccctctttcaccagacagcagcagtaccccgccgcgctggcggtgctggacgcgcagctgggcgccgatccgcggcgcatcgacacctggctgcatgcggcccaggtccagctgcgggtcggggacctgcccggcgcggaggccagcgtcgcctcggccgccttcctggccggggaggccgagggacctgccgccgcgtacagcgcgcgcgccgtgcgtcacgcgcggggcctgctggccgtcgcgcggcaggactggccggcggcggctgccgccttctcctcctgcctgcgggaggacgcgcgtgacgccgaggcggtgggcgacctggccgtctgccagctgttcaaccgcaacgtggagtcgggcgtggcggtgctggaggccgggttccaggcccagccctgggctatgctcaaggtgtgcgcgtgggtggtggaaagaaggaaaggacgagcggggggagggagcattcgaggacggtggcgcagaagaggggtccttgcagagcacggtgactcttgcttgggatcctgcccctgccgaggagcatgtcggtgctgtgcaataattcctggggtttgggccttcagggccgaggagtcaccagggcagcctgctgtcagagggtgtgtgcaaaggatgacgcaagtgtttgttctgtcactgaggtgccccatgaaggcatgaccaatgcagtgaccccccctcaccagcaccatcagcaagaacttcctnnnnnnnnnngcgtcagtgctgcgcagtagttcctggggtttgggccttcagggtcgaggagtcaccagggcagcctgtcgtcagagggtgtgttcaaaggatgacgcaagtgattgttctgtcactgaggtaccccatcaaggcatgaccaatgcagtgaccccacctcaccagcaccatcagcaagaacttcctaccaccatctcatccaggcgccgctggtcagcagcctggcgctcatgtacgacctggcacgccccgactccggcgccaaggagcgattcggcgcctgggtggcccgcatggcgcccgatgacctggacatgagctgcctgagccccggctgaaatgcctgcatctcgatccccacactcgagcagtgcagcgtcctgtcactctgaagctggggccgatactccccaagaaggtggtctgccaacctcactccccccacattgnnnnnnnnnnaatctccatcccaacacttgagtagtgcagcgtcccgtcattctgaagctggggccgatactccccaagaacatggtctgccaacctcactccccccacattgcctttgatcagtcccatgcacccttcttctgtccttctctgcgaggcagcaggccactgattccgaactggtcctggtgccctcgccgacccctgccttcgcctccttgctcccaccgcgcagtgctgatgcactaccccctctgcaccttctcttttgcacccagggctctgatatgcaccaccagaaggagggattcgtacagtacaagcccagcaggaaagtcccaggttcacaaagtgtgctgaccagagcaacnnnnnnnnnnnnnnnnnnnnnnnnnnnnnnnnnnnnnnnnnnnnnnnnnnnnnnnnnnnnnnnnnnnnnnnnnnnnnnnnnncttggccccttctcggccggcgtcctgcgcggcacccgcttctcctcgaccattgcttcgcccagggcggcccccagccccggccgctccatgtccttgnnnnnnnnnntttggccccttctcggcctgcgtcctgcgctgcacccgcttctcctcgaccatcgcttcgcccagggcagcccccagccccggccgctccatgtccttgnnnnnnnnnngcccctctgcaccttctcctttgcacccagggctctgatatacaccaccagaagtagggattcgtacagtacaagcccagcaggacagtcctaggttcacaaagtgtgctgaccagagcaacagccagacaatgaaactagaccccacccccttgctccttggcagctggcatggtctgccccttcnnnnnnnnnnnnnnnnnnnnnnnnnnnnnnnnnnnnnnnnnnnnnnnnnnnnnnnnnnnnnnnnnngccaggctgcgcgccaggggctcccgcaccgacaccttgaccccggggggggtccacacggtgagctcggcggcgccgctcactccgacacccacccaacccaggccggcgatggcgacgtcgcgggtgctgcggatccactccgacccctgcaggtgcagtgtcgtggggaccagctccgggaaagtgggaccggactttgccgtgggaggggacagccgcttgcccaggtgcttttggcgcctggtgggagtgtgaattcgtgggaggtggggctgaggcagtgggcaggcctgcatggcgcttgagatggtatcgaggagggcatgggtgagctgcaccctgtcgtctccccatcctccaccactcgtgccagtggggactggatataaaggatgaagcacgggaatgccaccaggatagtgggcgcacccgaggtacctgccggccgacacccctgtcccactgcaaccgcatcaaatggcatgttccctcccacctacctctccgccnnnnnnnnnngggtacctgccggccgacacccccatcccactgcaaccgcatcaaacggcatgttccctcccacctacctctccgccacgccctcggtcttgcccatgtagcaggccacctcgtcgctgatccatggggtcaagtacagggtggcccccctctcctggctcacgacgtcgatgcgggccaggccgcccagcagcaccgacttgccgggcgagatgcgaaaggtgcgccccttcagcgccctccgcggctgcagcatcttcagctgcggggcggagtggtgtgccagtgggtgaagggaatttgcagggttgcctttggacccacaggatgaaggctttgggatcccagaacccccccctgtggctgccgtcagctcatacaatgctcaagcagcacctgccatgcactggcgttggccccaggaccgggcatgccctgcatgcacatcagacctnnnnnnnnnntgcacctgccacggactgacattggccccaggtccgggcatgccctgcatgcacatcagacctcctgcccccctcgcaccctccctgtgacctgtcggcacgcttggacataccccttcctcccacttgacaccagggcagcccttccctcacctcatcggccggcaggtacttagccagggagtgtatctgatccatgcccggcgtgtcaatcagcttgcagccggcggggaggagccccnnnnnnnnnntggccggcaggtacttggccagggagtgtacctgatccatgcccggcgtgtcgatcagcttgcagccggcggggaggagccccggcacagccagggcgcccagggtcgtccccggcacatgcgtggcggtgacgtcgcggcgggagcccagccccgccgcgccgcgcatggcgttgatcagcgagctcttgcccgcgttctgggtgcccaccacccagacgtcgccgcggccgcccacaccgcgctgcaggcggttgagcaggtccttgacgccccagccgcgcagggaggaaaccacggcgatggtggaggggcgggggaggcccgcggcggccaggcgctgccgcgcccaggcctccaggtggtgtcggtgcagcgactcgggcagcaggtcggccttgttgatgaccagcaggaaggagaagtcgggggagaagcgggaggtggtggggttggagtcggcacgcgtcagctggaagtccaggattgttctttgagggatggaggggggggggggggggggaggggaaattggcaaagtatgnnnnnnnnnncgttctttgagggatggaaggggggggtggggaggggggaggggaaattgaagggggcactgcgtgggggtgcaggtgcttgggaacattgcatggaaggacgcagggtacatgcatgatggccagcccccaaggccttgagaaggcacccccacgaccctcaacaacgcagtggagcatctggaattcccnnnnnnnnnntttgcatggaaggacgcggggtacatgcatgattgccagcccccaaggcctttgagaaggcacccccacgacgcccaacaacgcagtggagcatctggaattcccacgtccccacgatcagcccgcactcacttgagggttgtggtggggagggagccgtcaaagtccacggcatccaccacgaccaccagcatctgcttccggaacttggtcagcgcgatcttgcgccccacctgcttgccaaagtcaaagctgggcaggatggcctcggcctcctcattcttaacgcgcctgatcatgtgggtgggtgggtagggttttgcatgcaaccttatgacttaggggagctattgcagacagcagcatgctatgtatccctgctccacgcagcaaacatctgtcaacagaagcactgcttatttcctgttgaaagcnnnnnnnnnncccttatgactcaagggagctattgcagacagcagcatgctatgcatccctgctccacgcagcaaacatctgtcagcagaagcactgcttatttcctgttgaaagctacccacccattgtgctgcagagaatggcagcgtgcacagcgtatggctgcctcctcgctctcctcctcttgctccccatactgcctgatctccaggggggtcctcttcctgggctgcaggttggtggcgggggtaggtcccgtgatttccctccatacaccgcacaagcagtgcaccttgccatggagtgattaactcagcgctatcctgtttgacagatcctcggcaacctctcgaatgcctgtgcaacagtataacaccacccatcccacatcaggtctctcacactcaccacccactcatcaataatttggtcaaacaagtccatctgggagtccctcttgggcgcagggggtgcatcatctggagcctcaggcgatgatgagcttgctgccagctcagggtgtgccaccaactcctcctcctccaaaacctcagcattgtcaaaccggggcgaagactgttccaagagtcgcttcggcacttgaaagaacctgaattcagcagaggaaagttattaaaattaaagactgggagggagagaggcaggtatcaatgccatgctaccccatgcggagccgtccttccaaacattcccannnnnnnnnngttagaatcaaagactgggagggagagtgccaggtatcaatgccatgcaaccacatgcggagccgtccttccaaacattcccatgcttaccctggggcggcagggtcgttctgttgtagcttgacaccacatccgatacagtgggacggtaggttgatgacggggggggagctagggctggctgttgcttgttgctgcttctgtgccaccgctgcaaccactttccttcctggctgcaagctgaaagcggggctgctcagcctcctgacgccgacatcgttcagcaggcagaatggcctgatgcatactagttggggctggagcttgacccctgtgtgtttcgcaaagagtctccagggcactcttgnnnnnnnnnnaaggcagaaatgcctcatgcatactatttggggctggagcgtgacccctgtgggtttcgcaaagagtctccagggcactcttgccaggattcgtcgagtgaacatcccctcggacggaagccgtataccacgaaggatccactacgactatagctcttccatatataatattgcagcagctttataatgaagctgtctcttgctcctatattcgctgggagccttgtgcatgcaatagactccacacgggagtgactaggggtgctctgagccacgaaacgagttcacgcgcagcacgatccaccatacgtccattaccacccatgcgaatggccagatgcatgctacacgcctctcccacgttgcacatttgtacacaataggtaactcaaaatcgtgatcaccatgtttgaagcacgcctggtgcagggagagctgttgaagaaggtgcgctcggggtccgggaccccggtaggaatactgggcattcggtctggcccgctctgttttgaccatacaacagctcaatctcctggaatttaccacagcaaggttcttgggtcttcacccgtcatggtcgctgtgccgggcacatcggcatgtaacaggagggaggtcgggcgagactccccagcaccccccctcctgacacgccctgtcgcagatcctggaggccaccagggagctggtgacggaggccaacctggagatcggcgccaccggcgtcagtttgcaggccatggactccagccacgtctccctggtggctctgtccctgaggtcagacggattcgagcactaccgtgccgatcgtgccttttccatgggtatgaatctgaacaatgtgagcaagatgctgcggtgtgccggcaaggatgacatcatcactatcaaggcggacgatggagacgatacagtgtatttcacttttgagagtccaagtaaggatggtggtgatgcacagcgggtatggttggaagcatccgctgcctgggtcagaatgttttgcacatcatctgcgtgcaagcattgttcctcaatgtcacgcagtcagctgtgctcccggattcctgttgcaaacagaacacctcagcaccaatccccccttcccacacgcgccagctcaagacaaggtctctgagttcgagctcaagctcatggacatcagtagcgagnnnnnnnnnnctttgagagcccaagtaaggatggtggtgatgcaaagcgggtatggttggaagcatcccctgcctgggtcagaatattttgcacatcatcttcatgcaagcatcgttcctcaatatcacgcagtcagctgtgctcccagattcctgttccgaccagaacacctcagcaccaatcgccccttcccacatgcgccagctcaagacaaggtctctgagtttgagctcaagctcatggacatcagtagcgagaaccttggcatccccgagacagagtacgccgcctccgtgcgcatgccctctgctgagttccagcgcatctgtcgagatctcagctccatcggcgacacaggtgggggtattctgtaacggagaggagcttgggcaacagttaaaatggggaagagtgcattcttgcagaggacgtcaaggaagaggtttgtgcaagcagacttgccttgccgctgatgnnnnnnnnnnttgtgacggagaggggcttgtgcaacacttgaaatgggggggagtgctttcttgcagaggatgtcaaggaagaggtgtgtgcaagcagacttgccttgccgctgatggttgtaaggagctgcaggaataatgatctgtgaccacatgggctatcgatcttcaggtcttgtcaccagggtgtgattgcttgagacacgaatacagaatgatgttctcatcgccggcccaatctacccattgtctaattgcagtggagatgagcgtgacaaaggacggcatcaagttctcgaccacgggtgacatcggcaatgccagcgtcatttgcaggcagaacactgcgattgataaggtggggaagctactaggacgtggtggcgaggacctggaaccttgcgccatatcttggctggatgggctgtgnnnnnnnnnncatctacccattgtctgatcgcagtggagatgagcgtgaccaaggacggcatcaagttctcgaccacaggtgacatcggcaatgccagtgtcatttgcaggcagaacactgcgattgataaggtgggcaagctactaggtcgtggtggcgaggacctggagctttgcgccatatcttggctggatgggctgtgaggtgatcttcactgcgtcagaagcgatttttcgaatgctctgctttatgaatgagcgccttgatgatgcgtctatgtccctccagatggtcgatttattggtgcagacatatcttgtatggcccacagacctctccacctcctccccaccatgttctctcccccagcaatccgaggagcagacggtgatcgacatgaacgagccagtggtgctcacctttgcattgcggtatctcaacagcttcaccagggccacaggattgagccctatggtggtgcgctggcctgatgagactgtgggaaggctgtgccgccccacggcacacgtgcaaagctcgtggtggccgctccgttgtctcaggggacccaggaccatcttcagacacacaggcactgtctatcccccaacactgcagcaaataaagctgagcaaggatctcccggtcgtggtcgaataccgcatcgcagacatgggctttgtgcggtactacctggcgcccaagatagaggatgaagagatggagggctgaggaccagccactgcagctccacatgcacacaagcaagcctctgctggaagtttctgctggggcggcagtcggtggctactatttgctgacccagaagacccaaaagtttggccagcagggctggagaataccactgactctgactgccatacnnnnnnnnnnacacaagcgagcctctgctgcaggtttctgctggggcggcagccggtggctactatttgctgacccaaaagacccaaaagtttggccagcagggccggagaataccactgactctgactgccataccatgcacgtccactgaccctgtcaagacagaaagcctgccctgaattttggaacaggttggaagcccagcaaagttggaacaaggtagagtctctcattctcaaggggtagaatatgtagcgtcggaaaacgacacatcatatcaaatcgcgattgatagctgcaggtcaacggttcgagnnnnnnnnnntaaggtagagtcaatcattctcatgaggtaggatatgtagcgtcggaaaacgccatataatatcaaatcccgattgatagctgcaggtcaacggttcgagcccgtttggggccatactgtcctggccccatagctcagttggttagagcggcagtctaatacctcatattttttggaatcaatgaatcacattaggagcgagaaagtattccagcgctgcgggccccccgcagcgctccaactccaacacccgtcccctgctctcctcgcgctgcctctgcaccgatgcacacacttcgaggggtcctgcggcgccctcatcggcaacctggtgcttaagacctccaggaggtgccccgcgtaacggacatacgatgaggaactgaccatgttgaagttgccgtcgaaagggcggcggtcgatgccgcggtcaacgagtcacccaggctgaccgagtggctcgaggtcgacgagtcacccaggcagaccgagtggaggtcaccgagccggcgggcataggacatatgacgggaggcagagaggaactacagtatcacctccctcaaaccccttgcaaacgccttccgtgacctccagaagannnnnnnnnnaacgagtcacccaggcagaccgagtggctcaccgagccggccggcataggacatatgacgggaggcagagaagaactacggtatcaccttcctcaaaacctttgcaaacgccttccgtgacctccagaagaagaggccaccacattgggtggcccactgtggccatcgctggaggacattgtcatcaccatcacatagtattgtctgtgtaccctgaccgggccctgctaccccacttccacctgttcccgctctgcaccgagtccagtgcacgccgccttgccgcgtctaatgaggcccgacccccacactgcattccgggtctgaactgtaacactcccaattcgggtcacatacatcggtccaccgttgtggaggctggcctggccccacaaggcatcggcagttttcttgggcggactgcttgctgatctccacgccattcccatattggaggagtttgaagggtggcagcatacattatttgtccatccagcagacctcacaagcaaacccgggaggccccctttctcgttcaaccaatgatggcacgatatctggtgctgctataccccattatcatgacacaaaagtcacgtgtagaagaaggtatggtcgagtggttgcagcaccgcatctgcgtccgcctgggcgagtctacttcagcagctcaaactccaccaccaggtggatcgcgtaaaaagtgcgagaaagcccacccagaatgatcgctcggtaacgatcaggacgatgtagtaaggtgtcggccgcagcggttccccaacgagcttgcaagttcccccacttcgttttccggaagccagcaaagatgatcttgcggcaggtggtggggaaatttcctctcggcttcttgtgtagtctccttctccccaccagcccacttaccctgggcactggttgagcgtggctttcatatatgcccattcggcagcgatctcagccgccattggctcagctcgccgccagaggccggttccgctggacacggttgagagtcctacggtatcaaatcagagagggatgtacgggggagtatcataagcaagacccaatcacgactgcagattctgtaaccagccgctaaagtggagctggcaccccagggcagacagtctatcatctacaaggttgacaaataatgtcactttcaccttccaccaccacatccgcctgggactacataggcaagaggtatcgaggcagaagagttacactcggcatcatccctcggcactcctgcgacaccggcagtgcgcgccccgtgctgcatactgcagcctggctgtgctgcttcgccagcatagctgcacggtgtgtggtgaggtgtatggtgaggatgttgtaggggctggcaagcccccacaacggtggactgctgcatgtgcccgagctgggaatcttacggttggaatcctgtatgcagtgcataagtcgggttccgtaggcgttacaaggcagcgtggactcgaagcagagcgggaaacaggtggtaggggggaaacgcgcccgaccaggggactcaacaacaatagatcatctaaacctactcggtaacatgaaagtattccagcgctgtgaaggttgcacgcatgtcgagggctggcttcaacaccaggtagccagagacccaaaaatccacagtgcaacctctctccaccccgtggacagtgacaatgcattgccgacgccaatggacatcccaaatgggctggtcatgccatcaaagggcagccccatgatctcctaggcactccagtggctggcgccaggcatctcccttatcatgggtatgggagtgcatggcgggcacaacgaactctacaagaccctggcgaaagctgtgtcgcctgtgctacccacatggccagaggttgctgccctgtatgagctcaacacaaggacagagcactctgcctcaaaccccttgcaagagggacgataccaaggggcggcagaccaatgcaactggacgttacaagatgggatggcggtgaacctgctgtaaannnnnnnnnntaccccttgcaagagggacaatactaaggggcggcagaccaattcaactggacgttaaaagatgggatggcggtgaacctgctgtaaatttcacacttcgtcagcatctagacagcatccaggcaggcagcgtgtgtgggtgggtggggggtggagctccatctgggcccaaagaagcgcgagggagaatcttttggctcctaatagccgatagggggcagtgcgcatgatcgatatgtgcagactgcgctccatgcccttgcactggaagtttcaccgtatcaatgacgaacagacggggtaatctgccctgtgcggtgcgcgttcacacccccgtgagccgggacagggtcacgcggagtggccggaatgggtcctgtgttcgctcgaacccttgggccccggtcaatcgattgacgattagttttcgagacttagccatgggtaaggtttaaatggcggttttttgggttttgtgacttgccccgaaaaggtctcaggccaaatcgcactcaggttaaaacccccagcacaggtcgtctcgagcacccgaagaggccttatccccatcgggactgggtcttctgattgagatcaaggtggtctctattgtttgtagcaacctgactcaccactatacctcacagtgaattgtattagcgtctggtacggacgaatgctttaatgaagtggtgtggatgagcgaatcgagactcgctaccaaccgctcttgctccaatgccactgattacttacaatgcaggcaagcctggaaacacgatcaggcaatactttaggaggaatgcagggacaggtgggtaagtaagcctgcgcaagggcatggatggctctggaccaggaacagaacgcatggcaaatgtaccacaggagttcccctttgatcaaattgcagacgttcgtgatgtttggagaggcagaggctaccttgggtgtgatataagcagcaaattaggcctaccaattcagggttagagcatccgaagtgccaccccctagcttgtacgccactacttgggcatnnnnnnnnnngttatcaaattgcagacgttcgtgatgttctaaggggcagaggctaccttgggtgtgatttcagcagcatatcaggcctaccatttcagggttagagcatccgaagcgccaacccctagcttgtacgccactacttgggcataggatgcaagaactatctcactggattccagcgtgatggtccaagtcatcggcgtgctctcataagctttctggacaactcgcaaaggaacaccatctgcagtgagaaaagcgcagttgacaccggtgggtgtgaagcctacgatgtttaccttaatgagaagtcattcccgtcgttggtaacactcccgctgatggacccaaatattggtggtggtggagagggtcccagaggggggggtgaaggattcaacagagtatgcggtagaacttccttgagctcagatgtatagatacttgcggagccaatggaatactttgttgctatcccctgaggttgtcccttcagagtgatggtggtaacagcggaagtactcacccnnnnnnnnnngaatgagaagtcattcccgtcgttggaaacactcccggtgatggccccgaatattggtggtggtggagagggtcccggagggggggtggaaggattcaacagagtaagcggtagaacttccttgagctcagaagtaaaggtacttgcggagccaatggaatactgtgttgctatctcctgaggttgttccttcagaatgatggtggtaacagcggaagtactcaccctactatcaccgccaagataggataaggctgatgtgtacagtccccacttcatgaagttgggtacataacccactgtggtgacagcacaagtgatgtccaccgagtcactcgaggcagcactgaattcgactgtggctnnnnnnnnnnccaccgacaagataggataaggctgatgtgtacagttcccatttaatgaggttgggtacataacccactgtggtgacaacacaagtgatgtccaccatacccctcgaggcagcactgaattcgactgtggctgacgtacgtggcggtgagggtggaggagagggacttggtgggggtggtggaagtgatgatggaggggggctgggtggaggaggggggctgggtggaggagaggggctgggaggaggagaggggctgggaggtggagggctcgggcttgaaggtggggaaggagacgtcttggcaggtgggggaggagacgacttggcaggtgggggaggagacgtcctggcaggaggcggtggagacttcttggcgggaggcggtggagacttcttggcggggggtggtggagacttcgtggcgggaggcggtggagacttcttggccgggggcggtggaaatccaaggacccatgcatacttccggaactnnnnnnnnnngggctgggacgtggagaggggctgggaggaggaggggtgctgggtggaggaggggtgctgggtggagatagggatggaggagtacgggggtgggatgctgaaggaggggagctgggtggaggaggggggctaggggttggttgtggcggtggtgacttcttggcaggaggcggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggcttttttgcgggtgggggtggagacttcttggtggggggcggcggcggcttcttggtgagcggaggaggtgactttctgacgggtggaggtggagagttcctcttggcgggcggcggcgacatcttcttgggggggtccggtggagacttcttggcgggggtcgatggagacttcttcacgggtggaggtggagacttcttcttggcgggcagcggcgacttgttctttggggggggcggtggagacttcttggccgggggcgagggagacttcttgggtggatgaggtggaaagtgcatggcgggaaatggtgggaacttcttggctggaggggacggtggagaaatggcgggagggggtggtggagacatgtcgggaggcggcgagttggcaggagccgggaagtagagcctgaattgattcctgctcaccacacgcaagctgcacttgttgatataactggtgtctcctaccctgccaaaacagcggttattattgcctctgttgccatctccccagttggcgttgccctcattggagttccctgcaaaggcagcatcatcgcatgaatgagtgggtgtgtcctggggccgcagcggctgtgaacatcatgcatgcctcctcagtcttctccactggctcacctctattgtcatcccaaacgttatcattgccaaaattgcgcttgcccttgttgccggaaccgatgttgccgttgctgtctgccgtgcagggcttctggcccgactcgaggcactccacggccccgatgatctgtgcggtcgtgtaaaacacgacctcgaaggtatgtgcactgatggcggtgtgaaagttcgtgttgcccatgaactcgaaattggctgtgcgaactgacccagccttgctaaagccgaagtgcctgcaaattttgaaaggtgggcgtccaaagattgaggcgtgaccgtcatggtacatgtcagatgccatgcctacctgatggtgatattaattgggccaggtccagtgatatgcaagcacaagctccgatgttcacccccctcatgctgaacttacttgcaaacgacatctgcactgtcatccctcagcaggtaaagattacgtccgatactgtgaagaacgaagcacgtctggaatgatgacagaatatcaagcagtagtgtctgatcaagaggtagactcgagtacagtatctatgtgcatggccaaggaagcagatttgccaactccccagaaaggtgagaaggggtacggatactggggcccggcaggagccgagtgcgcaagggctttgtgcggacaggaacgtccccggtgccgcgcgcagcccttcccaagataaggaacaaaacacacgccttacattgcactgggaattgctttgaatgtggagctgcatgtgtcctgcggtgggcgaggaagctggggaagtaagtggagaagcggcaagcgcggtgcggctgnnnnnnnnnnccgatggttgtttcacctgagcaagcccactgatgtacaagcacatgctctggtacaaacaaccaaccatgcgttacttgcttgcagatggcatctgcactgtcgaccattgtcagatacacattggctcccaggctgcaagggaaccgtatgtatgcgcgaattgttgatgaagggttgggaagagacatgcgctagtggccatctcattcacaatttgtacgtgcgtgacaagaggagcaggtctgtcggccctggagagagctgcatagggacccgggctcgaccggaacgatgtgcgcgagggctttgtgtgaacagtgacggcaagggtgacgcacctaacccccccgctctctcctccccccaacgaacaaagcagaagcctcacattgcactgggaagcgccacgaaagtggagctgcatgtggtctgcggtggtcgaggaagctggggaagtgagtggagaagcggcaagcgcggtgcggctgacgcgggatcgatatcgaccagcgagatctcccacgcaccgcgagggcgcatctggtgagtagcagagtaagtccagtcaggaagatagggttcctgacggccggcgacatcccggaccccggggcgctgttactgttccgccctgctggctttacttatcggggtagggtgtgctgcctttgtatgagtacacctttactttgctatgcctcgttcgactgatggactgcaagggttgtggtcaacctactttgccctagactctcctcatttagtttgcaagggcatcaggggcgacgtaggagatgctgctcgcggaaatccggaaggaccccggccggtccccgtggtcaaacaatgcagcaggtttttcgaaattcgcgaaatctaaaaagtttaccgaaccgattcgcgaattttagcattccccaatatcaccccgaaaatttgggctgtcgtcaggtggaacatccagcacagacccgtcgcatgctgtggtgccgagatcatatcacgacgctttgaggatggcgattttggcactgaggctcttggagcaaaccctgcagctcatctccgtgtgagagaaatggagccagtaccagtagatccatggcaaagtgcgcaacaagttggccgtcgatcgaacaatggacttgatgttcatcgatgccaaatcccgttttattaaagccgttcagaatgtaggcccccctgtgcgctaccttcgaggatgatgactccataccaacacgttggcctgatgtgcaccccactctgcgatcatttgatgcagagaaaggcttgctcaccccctccacaaactcttgcaatgcacttgtgcaatctggcaaaaagatccgaatcttcactaccttgaactattggaaatcccagagatcatcatcgaaatctttcataacttcgttttttaacaatccagcgatgcggggtgagcacggcgtcggctcccaagaaacgaaatcacaagggacatacaccccactatcaattattttctgagatctagcagccttaagtctctttttgtacccagacaagtcattcgatgacaatgacagctttggacctcctcaccgccgcctcagcatcagcatctccgcatccggaagaccctccggcatccccgtgnnnnnnnnnncagaaggagcacaagcccagtcaggaagagaggcttcccgacggtcggcgacagcccgcacctcgccgcgctatcactgttccgaatggttgatgtcattgccatcagggtgaatgacgttgcctttgcgtcagcatacccttcgcttgctgcacatcggtcgagtactatgacgcaagggtggagatcagcccatcatgctcctgcactttgatcattcatgttgcaagggtatcgcgggcggcgcgggagatgctcaccgtgggaatccggagaggcccagctggtagccatggtcaaacggaggcagtgtgaacgcggcgttgaatacaagtacacatctcgcatgggatgcaaacccaaccacacattacacattcttctcgcaggcctcggcatctcttggacaccaaacaagtcactcggtgaggatggtcgcttttttactcctgatcgccgccctcagaaacggcacctccgcatccggatgacccggccggtaaccttgtacaacgtcatgcgtcagaaactgcggagcattatggttcataggaaactccatcaaacgcctcgaatcaaagtgtaatatatgtgaattgctgcaaccacgagccggaggaattgaagtatgctcggtgcagtagttccatggcgatttccctgccgtagagcaactacgtnnnnnnnnnnttgcgtcaggaactgcggagcatgatggtacataggaaactccatcaaacgtctcgaatcaaagtgtaatatatgagaatcgctacaaccacgagccgaaggaattgaagtatgctccgtgcagtagttccacggcgatttccctgccgtagagcaactacgtagacatccactcatgagcctagaagtggcgttgcgcttgccttacctgatggataggccaggcagtgaatgccatgctgtgaatcgatggcccctcaagatatgaagtatggggggcagtccgaccccgcgccagaccctcactcacagcgcttcgcagggctgcaggttcacgaccagcttggccgtggaacccgccaccaagccgcacnnnnnnnnnngccagttctgcatataccagctgcctaaaccccgttagcttgtgtggatgcatcacatggcgactttcatgatcagggtatgagctatggcaccccagggaaaacagctaccccgcccaaaaggccaggccccaggaggtgccaggatgggctcagggctggccggcacacgaccaccgcgccgccagccgtcgcggcgttcaaccaagtaagatttgtgtacccgtattacatgcaaacctgagtacaaggattcgaattaggcccacggttgcgagggatggatgtgtcatgnnnnnnnnnntgccttaaccccgttagattgtgtggatgcagcacatggcgactttcatgatctgggtatgagctatggcaccccagggaaaacnnnnnnnnnngatctcgtgggatcctgcggagaatgagcgtacatcagaacttccattgaaagggtaaatcctcctataacgcatggaaatcgtcgccaccaggcgctggcaatgagtgctccactttaagattgttttgctcctccagcgctaaacgggtgggggcataccgacctcgcgccagaccgtcactcacagcgcttctcagggctgcacgttcacgaccagtttggccgtggaacccgccaccaagccgcaccgcacctagcccagttctgcatataccagccccccgatccccacacgcatgtggaaatggatcacagggcgacattcgtaatcatgcttgcaacgggacgttgcgtctcatgcacagcagactctgggccgcgggcctctgccctggctaaatagaaatccatggccccgaggctctgttgtaacacctcaacctcgccatttcaacaaaatgcttattgtcggaccacgtgaaggtcacactctggttctgagagagagaacagtcagggcagagagcctcgtacgccactcggcctacccgcacttctgttacatctcaggccaatacatggtgagcctatttgaggtgccaaccccagatttgtaaaccactacttgagtataggatgcaagagctacttcatcggaggtcagcgtgtccgaccagaccgctccaaagctaccgacgcccttgctgccgtagtggatcaggccatcagctgcagtgaaaaaagcgtacctaagaccgtccggatggtagcctgcaaagttcacgtcaaatgagaacacatttccattttttttacggttccaatgatgtttccaaatactggtggtggtggagcgacatagggcccaggagggggcgaatgaggactgaccagagtcagccttataacttccttgatatgattgggtgtgtcatagattactgcggcacctatatgaaattcagcttctagcgcctcagtgatgtctggaagatagatagtgatggaagtagagtacccatcaaatccctgaccgccaagatggataaggtctgctgagtaaatgtcgcaaacaacgcgggcgggtatataacccggtgtgttgacaacacatgcggtgttcacaagacctctaaaggtataggtaaatatgattgtgccagatgccggttctggtggaggtggaggagagggactcggtggaggtggaggagagggcgatggagggggactgggtgaaggagggctaggtggaggagggggactgggcggaaggggcgggctgggtggtggaggggggctgggtggtagagggg

SEQ ID NO: 47429 - DNA, 61 bp, Chlorella protothecoides
gcgagctcggggcaggagccaaagtggaggtggatgtaggaggccagggtattgcgcacgc

SEQ ID NO: 47430 - DNA, 28546 bp, Chlorella protothecoides
  modified_base (1227)..(1236): a, c, t, g, unknown or other
  modified_base (5736)..(5745): a, c, t, g, unknown or other
  modified_base (6212)..(6221): a, c, t, g, unknown or other
  modified_base (6797)..(6806): a, c, t, g, unknown or other
  modified_base (7664)..(7673): a, c, t, g, unknown or other
  modified_base (8067)..(8278): a, c, t, g, unknown or other
  modified_base (8346)..(8355): a, c, t, g, unknown or other
  modified_base (8708)..(8717): a, c, t, g, unknown or other
  modified_base (12686)..(12695): a, c, t, g, unknown or other
  modified_base (16656)..(16665): a, c, t, g, unknown or other
  modified_base (17330)..(17339): a, c, t, g, unknown or other
  modified_base (17865)..(17924): a, c, t, g, unknown or other
  modified_base (19651)..(19660): a, c, t, g, unknown or other
  modified_base (20011)..(20071): a, c, t, g, unknown or other
  modified_base (20228)..(20237): a, c, t, g, unknown or other
  modified_base (27054)..(27063): a, c, t, g, unknown or other
cctcccctttcaccccccaccccaccccacccccctggtcacgccccaggttcctggagtggcagtttggggactccctccgcacccagttccccctcgccgtgcggcgcagcgcccacgtggccgctggggacgcagcgctcctgctcatcaacacccacaccgccctggagtttgaacggccggcgctgccgccccacgtccgactggtgggcccgctcctggccgagcccgcctcgccgctgccgccgcatctgcaccgcctggttcacgggcccaaggaggacagcgatgctgaggtttgcggcgggtgtttgtgattttttggacgagaggagatctggtaccatctgcccagcagcaatcctgcggtcagactggaattttcccggcaggcacacctcattcatgccctcattcaaacttgtatctcccccttgccccaccttgatcacattcacaggcgccccccatcctgccctcactgtacgtgagctttggctccctcttcacgctgaccatgaccctggaccagctgcggggcctgcacgccgtgcttgcctccctccccgcacgcgtgctgtggaagttggaggccggggacgtgcccggcccggacggcgctgcgttcctggccggcctgcccccgctgccgcacggcggcgcactgctgggctgggtgccccaaaacgacgtgctggggtcgggcggcgtgcgcgccttcctcacccatggcggcatcaacggcgtgacccagtccctctaccacggcgtgcccatgctgatcctgcccttcgccggcgaccagctggacaacgcgcggcgcgtggaggcgctgggcgctggggtcaagctgggccgcacggggttcgtgaagaggcaggccgagctgcatgcggcgctgatgcgggtgctgacggaggatgggttcaagcaggcagcggtgcgagtctccagggagctgcgaggcggccccaccccgggcagggtcctggccgccgacgccgtgctggaggcgctggggtccctggcgctggctgcagctgcgtgaacgggtggcatcagggggttgaggctctggacgctgcctcgttgtaacaccgactgactgatccaggacaggaatgaggcttcaagatatcgagtgtatgcctgtgggatggttgacggctgtacacaggctccgcacaggagggggcctggcaaccatgctactgccccactggnnnnnnnnnnatatgcctgtgggatggttgtcggctgtacacaggctccgcacaggaggagtcctggcaaccatgctactgccccactggtctgtgtcaaagcctgcccctgtagtagcaatgtcaccgcactagctctctggacggcatcatcaagagtaggacaagtcagcagtgccggcgctgttgcagggggtgagcgtcacgccagggtcaagtgactcctcacccagttttcctgctgatgcccatgttcagcttcttgccgaatgccatcaggaagctttgctttgtagctgtgccactgcaggggtggaggcagctcgcttagttggcacacaacagacacatgcactttcagaagccctgcattggagctatgggcagtgcgcagcaccctggtgcgctacggggcaggtccagcctgtcgtccctgaggtttgtgccgtgtggctgtgcatcctgtttcaccgaccactcccgccttcaccgggtgtgtccccaggccaggcaccctgcagcattcctcacctggcggtgttcaccatggcgatgctggacctcggctccgcccggacctccctcccagccttgcagcaaccagacagcttcttccgcagggcctgcagcggcttgcccggcccctccgcagcaatcccagcccgcaccttggtgcccgcaggagccaggatgactgtggcgccaccgggccgccgagcggcagggatgaggtcggccccgtcctccctgccctccaggggaacgcatgccggcgcggctgtgctcggcgcctcggagcttggcggcgtgggcgaggccgctgcgaccgctccgtcgtctggttgtgaccttgattggtcttgcgctggggcaggggctggcgtcgcggccccggcacgagccaggtgcccctcctgcaggcctgtgatccaggggtctcgcagcatggcgctcgggctggggcgctggctgggttcacgctggagggcggcgccgaggaaggccttggcggcgtgggacaggtgacgggggaggaagggctccgccttctggatccgcgtgtaggttgcctccctgcttgggcagaggcggggcagagggggggcttgcattggctacacagacacattgcaagggagagctgcgcgagccaggtaggctaccccctcccaatgcccagcccacagccgccgctcactttgacggcgcttcaaagggcgggccgccaatcagcagctcatacgccagaactccgacgcaccagcagtccaccgccagggtgtagttggcccctgtaggcatgactggtgtgctggacaccgtgagcttcactatctgatcataaggggaggtaagaggaagcaggtttgaaaagcaaggcccagcagttgacacagtggagtaatatgatcagacacgcgcagtgatgcagagtgatggggagcggcaagtatcttgtacgattggaatgctgtgtacacctgtggtggaccactgtgccctgcaactcttggacatggtgtcagaacggtgtcagaacagtgtcagcccttcaccctccaatgtaaccccatccccctcttgcctctggagccaggtagtccagggtgccgactcgagacatgggaggttccaggttagtgttgatggccaggccaaaatcaccaagcatgatacctgagcttccggcgcccctcaccaggatgttctctggcttgatgtcccgatgcatcaccccctgaggatgggaagcaggggttttggggagggatgggatgctagataccactcggttcaaaacaaggagttctggttgtttgtctcttgcactggtggggacatgtgtacttcccaagctcagggcgctccagcattcattgcttgaagggtactccctccaagttcagaccctggcttcaccttctcgtgaaggtactgcagcgcgttgagcaaaggcacaaggacctgctgcacgacttccttctcatgcatgaagccccctcgggctgccagttccccatacaggtcacctgagcccggagtgggaggtggaggggagcgtgaaacctttgtttcagcgtgcagctggaaccggcacagaggaccagcagcccaacacatggctacatggagcctccgacgtggcaggatgggccaagctgcgctcatttcaggcgatgggctgcacatcaacctgccccacagggggcagcttagaattcaaagcaatccctcgactcccatggccaatgtccgcggtggtcacccatccctgcaccttgcgcggccagctcttggaccaggtagatgccatcagcgtcctcaaacgtagcgtacagggggacgatggaagggtggttgagggcagcgtgtatgctgatctccctcgccacctgtcgtccaaacacgccgatgagcctgtccttgtggtacgtcttgattgccacacgctggttgctggtgcggcacgtcgcagaaatgacggtggacaggctgccctcgccgagcaacttgtccactttgaagttggagatggccctgtgcggtggcagagtggccaggaggcagtctgatgcagagatccaggcatgctctcgatgcctaccagctggatgtatgctagtatagttgcattgactccctcctcaccagttggagcgccggaggcccggcggacaccatggagtttctgcgagcttcatgaagtcgatacttggtgtcggccttctgctccacaaagccgcggtcccagaggtctagactcccgtcgcggggttacatcaaggacctctggtgtcgtagtgaaactgtatgaccgtcttcagaattattcctgcaactgtagctcctcataagaccacactcggaaacgacatgttcacatgggcctaccgggagcccactgtcgggcacgatggactgtaggcaagagtactctacgagctatactggttggatgaaaatataatccgaatgggataggccacgtacttttgtttgttgctctgtaacattctgattttggcggtcccggcggagattcggctccggtgtcctccagacccccggccccgccaagttcaaagcgagtgaatgagccaaaacgtgcaagagaatgcctcaacaggaaacagggacaaaggaaaataagcacaacaggcatcgaaagctgcagggacccacgcaggggctgccatgtgcctgagcacgcgacggcctcagagaggatggggactggcatgggatgcgatcctgggatgggaggagcctgagaaagcctggctaatgatgcgactggatattcataggcactaatgtgccatggattcgtacattggttcaaaagggagcccgagggggtgggtcgggtgggtgggtgggtggggtcgatccccctccccctcatccttcggccagcatgccccagcgccgcgcgccacgcgcgctgtcccgccgctccagctcgccgagcacctgggcgaagacctggtcgtagagctgacgctccttctgcgccatgtcgctggcggcgtccagggcccactgctgcgcctgcggcgcccctgccaggccctttccctccaggtcggcggtgacggcggcggtgtgccgcgccagccggaacagggagtccgccgcgccggaggccagaccctgcaggtcccgccacttggcgtccagcggcttggcggcgtcgatcagcgtagcgtgcagcggccgcagctgctcggacaccaccgacgggttgaggggcggcagagcggtgggcaccgccgggcccgaggtcgcgccatcctcctcgtcgtcgctgcgctgctgggctggggtggggttcggggcgtgtgggcccttggccccgggctgcctcaggtgccgcaggaacaccaccaggccctgcggggggagcgggcaggtatgagtggggtttccaggccattctcgatcctttgggcgacgaaagatgcatgcacggtagattttcaacagtatcgggcagggcaggtgccggtctccaggggtcccacaccatacctggaccatggtggtcagatgccggagcagcaggcgcagcgacagcatcgtgatctgccgcgtctgggcccggatgccctctaccaggcgtgtaccctgcagtgagttccatgtgaggggaatgtcagataatgcgaatgagccgggccagccctgcagccttccccgcaatgtgtggcccgcctcacccacgggagggctgacacacgcgcccgtagcaccaggcgagctgcagtctgcgtggtgccagagggcactcgcacgccatgatggcggtagtttgggatcatcggcctcttaaacgcgctgccgcccggcagcagtcccatgtgcgagcagcagcattccattgggcgtcgaagctcagccatggtttgcagggactgtcggtgacagtttgcccgtggaagccagcactcgcgcttcaaacgataattttatgccagagtttcaatttcatggcacatgcatgatgcannnnnnnnnnggccagcgctcgcgcttcaaacgatatttttatgccagcgtttcaatttcatggcacatgcatgatgcactcttcacttcaggctcgctgctccctgaccagagtgccgcatatcttcgtcctttccagaccctaggaaacctgtccttgattgatctcgtacttctccaaggagactgggtatccacagcaggcggggttgaacgatccaaggagctgaacgtctcgcaaggtgcacaggcatgccagatttgggcaagcagcatgctgcgtgtagcctccgccagccttgcaacgcggaggaacggtgggtgcgaggggcctcgatgcaggctttggagccgcgctactccatgcgaggcctggcgatgacacaaaattatcactgcgggccctacatcccgtgatcagcacgtgaagcgaccttgtgctccttccacaggaagcgctcagaacctggcaacagnnnnnnnnnncgccctagatcccgtgatcagcgcgtgaggcgaccttgtgctcctcccacaggaagcgctcagaacctggcaacagcccatacagcccccagccggaacagccgagcccggggcgcgggctcagccaaccccacatggtcctgcctcatctcctcccactggaggcagtacctgttcatcctggttgccttcttcactgtgcagtacacagaccacgtcaggccgttccggcgctccatttaccacctcagcgatgccgaactctggagggtgggtggtgcccttggtcacatggtctgagggcaaggccagacgtgtgcatgaaaggactttattgattgggtgatcgctccaccatgccagcattcgcgggcgatgttctcatcgtgtgctgctgcggctgctgctgctcctgtccatgccccctccccgctgtcacccttccccggctccacgacccgcccctgcagtatagttaccccctactccccaaccacgtgccggcgtgggcggtcccactgctgagcctgtccacgccctttgtgatcatcctcggtttccacctggccggccgcnnnnnnnnnntggtcccactgctgagcctgtctacgcccttcgtcatcatcctcggtttccacctggccggccgcctgccgcgcctggcggcccaccacggcgtcgtgcagggctgggccgcggtggtgatcaccggcctcatcaccaacctcatcaagctcaacgtgagcggcgaggggccggtgatgtatgattcgcccctgtgcgcgccggccattcgtggcgcagtcagctgccgcttggacaccacacacgctcatcacggcctcggcctggtgcctgtgaggaactcctcacttctctgatgcaaatgacgcaccactcacaaacacaccaacccgcccacacatctgcaggtggcgcgcccccggccggacttcgtcgcgcggtgctggcctggcggggcgacccccgccttcacctcgctgggcgtccccctctgctccgccgcggccctcgactgggaggagggcctgaaatccttcccctcggggcacaccgcctggagtagcgcggggctgggctacgccagcctctggctgctgggcgcgttgcgctgctttgacggcgccgcgcgcccagcgcgcctggccgtcgcccttctccccctggccctggccggctgggtggggatgacccggctccaagactgctggcaccacaccgaggacgtgctggccgggctggggctgggcctggccgtggcctgggcctgctaccgcggctgccactgccccgtgaccgggcagcaggcgggctgcctcaccctgctcgccgaggagggggtgtgggcggactccggcctggctccagcaggcttggctggaccgggcggcggcatcggcgttcccgtcaccagtgcctccnnnnnnnnnntggcttggctccagcgggcctggctggcccgggcggtggcatcggcgttcccgtcaccagtgcctccaacctgcctggtctcatgggcgcacgctacaactcccttgcggtgcccatgcccgaagaggatgtctgatgtggttgtggtaacagaatatgtgggcagtaactctgtgagctgtaaatgttccatgattgcgtaaggtgtatttccacagtacatggaagcacctcaactgatggtcactggggtttgtaggcatcgacatttccactatatagttattgatactatttcagtttatatatgtgaaatacacacatcctcatcctaccaacctaagtttcgatatagaactaaaatttatcagattacaatcgacattgtgaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcagcagaatccttgttctggtcgaacagggaaaaagtgccgataccaccaacaaagttgaggatgnnnnnnnnnnttaacagaatatgtggacagtaatcctgtgagctgtaaatgttccatgattgcggaaggtatattttcccagtacatggaggaatctcaactaatggtcactaggttttgtaggcatcgacatttctattatgtatttattgatactattctagtttatatatgtgaaataaaacatacatacttatcctaccaacctaagttttgataaggattaaactttatcagattacaatcgacattgtgaattgtaaaaatggtgatgtagtgatgagtataggggagggcgagggtgggggagaggtgtgaatcagggcctgtgagcactcagatgacaaactctccaacatcacnnnnnnnnnngatgtgggggagggcgagggtgggggaggggtgtgaatcagggccagtgggcactcagatgacaaactctccaacatcacaaaagaattctgagatgaggcaagctacttgcaaacacatcattgcctggtgggatgagatgggaagggtacggaaacaatccaatcagtacgcggcagagtccttgttctggtcgaacagggaaaaggtgccgataccaccaacaaagttgaggatggtgagggcgatcagccagatgggagcctggctgaaaggcacgcccgtgggaatgatgcctgcctgacccaggggggacatgccaccgttggcaaactccaggatggcggtggtgaggaacaccagcatggcggtacggccctgggcaagctccaggcgcaggaagaactggccagggtccttggtggggtcaatcacacggtccacatcaggctcaatctgggtaatgccagtcaggcccttgctacgcttggcgacatcacgctggttgtcgtcgctgtaggtgggagtgcctataggggaaggaggcatacagtccaggtaaataattgtttggagatgacacggcatgtacaccaatttcccccccccacactgctctgcattctacctaccagaattgaggccgaagaacagctggatggcgattagggttagggtgacaccatagccccacacaacgggcacaccagtctcgttggagagctgggtgatgggaccataccccgtcagagtctgcgtgccgggcgaatgtagaagggtttcggtaagtcgaccaacctcacttcggagcaacaacgatcaagcatgtatcgcgcaaacttgcaagcgagcgatgtgcaatgcatgtatatacaaacctcaaagccagctagaacatgcaccacgcacctcgccaacccaggagaaggccaggcccagcgtggcgaggcggccgacagccctctcgcgctcacgagtaaactggggaatcagcgactgggcagggtccttggtgcggaaaggctgatcttgctgcaaaaatagaggattgagatgggggtttggtgagccatgacgaaatcaacggaagggaagctgtcaactacccaccatgaacaggcaggaacggcttcaggcacatgcgtgacccgcatcctcgacgtacgctggcgagtgacatgcacctcgtaagtcacaccaggtctgccaaaagtgctcaccttggcggcgaacaccctcatggagcgacgggactgaagggtggagcagggagccctgacctggagggcagtgccagacctggacagcgacctgggcatgcatgatggaccgcagacggtcatcgaggtggcaagggtttgcatcattgtgaatgtgtgtgtgatgtgaattggtgggagttggggaaattaatgcggtgtttgatggtttggcagatgttatgtcccttttgaacccctcccattgattggttgaaacggctggacagtccggagtctgatctcgcgtacccttcgccgtcaccgcggggtagctctacggaagtcgctccccgtcaaaccccggtctgcggcagggacaccacctcatcgagctccgacgaaactgtgccgaaaggcacaccttattgcaggcacagagatgtggtgaggaaggggtgaggaagatgcaagaattccagggcatggacgccctccctcagccaactcgacttgttgaggactcctggtcgagggatgcgccaagataattcatgccaatgatccgcattgtgcgggtcgcgcatcgagacctttgcgggtccaggtcgtctctggtttcacccatcagtggggagccgttgtcatcgcggttggccgcctggttccgcaataatactcatgacgggcgggaggtcgatcagacggacctgtaaagcgatcgctcaccgccttctgcgattaggtctcaacacaccatttgcttctttgcgtgtaaccatgtggcaggcctctgaagccgtgatccagctgcagatcaaagggtctgatgcatggagtaacaagtggcgctggggaaatcggggacctggacctgctgttcaggtttggcacctggatttgcataaccagcccagcacgtcctaaaggacggcacgcagcactctcaagaacgtctccacctcgtccagcgtgttgtaggagtgcacggaggctcggaccacactgtccaaccccctgtcttccatgtcaatgcgcgtggagggtgctcgggaggtccagacgttaatgccctgctccagcagcctggcctggatgacctcggcgggtgtgtcagcctgtggtttgggttaagtgcacaggcaagtgagctgacaccactctgatggtaaggaggtgagggcatgatgcgatgggttcccagtttggtttttgtgagcagtttaggcagtcagcaaaaatcttcagatccgggtactaacaacatcatccccctgttcaatactgctgcgcaacaacccctccccctgccagccccgtttgcgcaccgctgtgaagctgacgatgccgcccaggcgccgcccccggtcctgcacggtgatgccggggacgccctgcaaacccttcctcagcgccgtggcaaccttggcaattgcggtgctgatcgtatccatgcccacatccaccgcctcctgggccgccacgccaaagcccaccttgacagcgggtgtggagatgggaagaatggtgagcaggcaaggtgttgcagacagccggcactggctcgcagtgcagcgagctgggatacagggagcctccaatgcctgacagcctgtcgacctgctaggtttgtgtgctgacttgccagcacacatagactgaggcatgagtgggtccaatctccaggaggcctacagcaagacgcagtgcaagacgtcctcaacccacccctctccccccgtcacaaattcaccttgcttgcaaagctgatctcgtaggactcgaagcgcttggcagtggggtgcagggcgtaggcccctctcgccacccactccgcgccatgcagatcgatgcaggccggctccagcaggtcccacgccgacctgcagtgggcagagggaggtgggctcctggtcttcagggcgggagtcactgggttgcagcaagacgttgggggccaggggggaccccccccagcttctgcattgacaccacgtcatggacacaagcatccagaggccattgggtgcaccttttgcacctctaccatctcacccctgccccctcctcctctcttccacgtacctcttcccccaatccacccaccccacaaacacacacacctggctgcgtagaggaagcccacccccctgggccctcgcaggtactttcggctggtggaggaaaggaagtcgcagccgatggcctggacgtccaccggcacctggcccaccgactggcaggcgtccaggaggaaggggacggcgtgggcgcgggccaccgcgcccgcccccgccgcgtcgtagatccggcccgagttggtggggctgtgtgtgagggcgaggagcacggggcggcgcggcgcggcggcgatctcgcgcgccagcgccgtcaggtccagctcggcctgggcggtctcggggacgaccacgatgcgcgcgccggtgcggcgtgccagctgcaggtaggccaggtagttgctggcgtactcgttgaccccggtgagcaccgtgtcccccggtcgccatgtccaggccaggccatagaccacggcctgccaggcaagcgtggcgctgcccatcaccgcgatctcgtcgggggaggcgtggagcagggaggccaaggcggtgtaaggcagctgcagggcagctgcgttgagcgccgccgcctcgtacctgacgtgggggacagggtcagtgggtgtgggtgtggggggaatctcatgagagaaactggcctccatgatgcggcggataaattcccactgaannnnnnnnnngggcggtgtagggcagctgcagggcagctgcgttgagctccgccgcctcgtacctggcgtgggggacagggtcagtgggggtgggggtggggggaatctcatgagagaaactggcccccatgatgcggcggataaattcccactgaaaggaaggcgcaggtcaagagaaagtgaagcagctgtgcacgctcactgcgcatgggatctcgggcgcaccgctgcatcttccatggctgcatgtaggcccactcgtgcctgagacacatcaacaatcatcatcgagccccagcctcacccgccgtgtctctcctcaagatcgaggtggtgccgcactgcctgcagcgttttggggctttgcagactggccccggcattattgaagtgaatcaggtgccgttgccgggccggggaaggggggtgacactgggagacatcgggaatgtgaggagcagccttcatgcaaacattcaatcctcggtgcattgtgccgcgggcgtgtttatgttgtcgcatgccagtctgcgcatagcatgactcgcgcccggggacgctgttgcgccgtatcaccagtcacatgatccacgaccaccagatgaaggcatccctgccacaggggcgaagggaaccccccatgatttactcctacccatctggtattcttaaatgctctgtgggagcgagggacagtgtcgtggggtcggccttaatgcttgaaggggaaatctcgcgctgaggctcgttgtttgccagtaccaacaaaccctagctcggcaacttctgctttccggcacctgacttctatgttgagagatgtttgcagagcattgggcattacaaatgttcatcttctcgtagattcgtctcgtcagtctcctccagagagcaaaaggagctcttggaagagggccactacaagcaagggtggtatggatggctcgaaaggtgtaggagacaaaaggatcatagtacaaatttatcgctggagaagagggaggatcaccatcatgtcgaaatgctttaggagaaagactggtatcatatgcagacatcatcacgcagtaagaggggtttcatgtgaactaccttgttggagcacgagctatgcactcaagatctgcgcacagaagtgagcagccgctatggtgccatggaaaaggtacagattgtcgtacaagttgatatgagctagaatgttccttcagccagcctccatgtcctggaggcatgccagtgcaccattgggtgccgcccgccgccttgccctccctcaccctgtcccctgcaggctggtctcccccccaagcagaggcgctgaagggggcgtgaagggcacggcattggagctgagggtcgccgagcctgcgccatgcgtcggcatgtatgccgtgtcgctgcagctcccatgcagaccgtgcggcagtgggtgaggcagcaaagcgacggcgatcggccccgcaccgatgcgatgagcatccaggatcacgaaccggcttgtgaggctttctgtgggttttggtaccacatggagtctgggagagagcctcgttgattcgccatccacgatggccacggcatgccaggacactgcagtgcgccgcaactctcgctctgggtccaggcaccctacccctgcgacgctcaccggactcaaacacacaggccagcagccagccatcgtcctctgcgccagcgtcgggcctgggcacaaactggggctccccgacaaactggtggcgaccagggaaccacgtctcagcctccaagctcgccatgtccagctggaggagcgatgttaagcgggtcggtggagttgagatgcgtgctgggatgcatgcgcacagagcccctgccagcccagaaggattgacatttctgtccagagacacaaggatttgatgcaggggtcgtcgagctgcacaccaggtctcagcacaggacatttatgagacgctatccctatcctagctcacagccagctccccaccttgatcagtccagactttgagccttcaaagtcggcagtttccgcaaaaacgaactcgtgcgctctgccaaagcacgtctcgttcaccgaggggaattccaggtagcctgggtgcagcagcttccgtgcctgtgatgtggagcaaagcattagctcggcaaactaatgggagcatgcattgcctgctcgatccccccttccctggctggcagggcgccagcgagagaaggttcggatggtcgtgcacccagagccacagctgcaaggtcagcatgccctggagccgaagaagccgtgctgtcgcatctcatcgcacgcataccccacccaaaccctgcacacctccccatccataaccgctcactgcgacgcccgtcctgaggttcagggtggccctgcgcagccgcgccgagtaggagacctggggatccacctggtgcgtgagcgtgggaggggaccaggggtgagcgaaggatggcctggtgatggatgctgcttgtgctcatgtccccacggattctccctgccgctgcgccttctgtgcctgtttcttgccgagggcaggggtccccacgcccgggagggagtcgtagtgaacggagtctatgatcacgtgctccccctgctcatacgcattggcgtggtggaagacaaaggaaggtggcagctcaaagcggcgcggccgagcgccaggaggggcacccggcctgggaatcaggtgcaccaccgtcggcctgcccacatcccacctggttttgagagtgagagaaaggcggtggagtgggaaccgaagctgagcgacaggcattgatgaagtggttctcgcctccccagacgcctggctcgcaggctgagggactggtgcgcagcagcacggtggcccctcctcccggctaccgctgcgtgtctcaactgcaattgcatggtgggcacccttgccctctcaccccttgcaccctcaacaccccccatctccttccctccctttttcccccacctgatgctggccgcggcgggggccaggcccagcatgtaggcgtggtagtccacggagacggggttctcaaacaccacgtaccaggcgcgcgtgagcgcaaaatcgtgcacaaaggcgtagccggggagggcccagggcacgcgctccaccacgatgcctgccccgtccagctccatgaacgtgaagtgggtgtgcagtctgcgggtggcgtggccggccgggtcgcggggggagacgctgtacttgaagctcaccaggcgccgcaccgccgggtccacatgggggtgtgcggtaaccgcctccccgcctgtggagagggggtggtgtggtgggtgggagggggtggtagacgggcatgagatgcagcggggtcggtgtgtgcaaagggaggctggcgcggggccggcggtggtccacggggcggggcggcggaggcctgcagccaggcgcagtcctcctttcccccctccccccttccccccagaccccgcaccgacggccatctggcgcgggtgcaggtgcgcccaggagcccacgctgcgctgcaccaggcggtgcagcgcgttgaaggccgcgttcagagtcgggccgcccaggtcgatgggcaggccctcgcgcaccgcgccgcccagtgtggcgacgcccagcgtgcgcagcgtgccggcgtgcagcgcgtagggctgcccgccctcgaagaaggagaggaggaggccgccccagtccaccacgctggtgttggaggtgttggcgacgtgcaggtccagcaggttgctcagcgggccgccggcgcgctgggtgccaaaggtgccccgaaactggccgcgcttcaggaccttgccggccacgtgcctggcgggttgggtccagggagtgtgttaatggaaaggggacaggcgtgcaggggtgagggaccaggggtttcagggaggaagatggggtgattgaccgccggcgatgcgccggtgctggctgggagcagnnnnnnnnnntcttgccggccacgtgcctgacgggttgggttcagggattgtgttgatggaaaggggacaggcgtgcaggggtgagggcccaggggtttcagggaggaagacgggttgattgatcgacggcgatgcgccggtgctggctgggagcaggctgggagcaggctggttcgctcctcaggggcttgtcatgcgccctatggcgctcaggatatgcgcgtgcatgggctctggggcgctcaaagggaaccaaacaccaccatacccttgccagctcccgagcaccctgtcgcgccctgcccaggccacgcactctggggtctgcacgaagtcggagcggtaaaaggccttgccgccctggacagagatggatgagatgaagccgtcgccgtccagcgggtgtccgatagcctggccgccgacctggaacttgcctggcccgttgctgtggatgtatatcaggcagagggggcggggatgcagaaaattagagttcgcggttgtaattcaattgtgcaggatccctctgggccataccatccagcttgtcatccggctttgcatcttcaggttcgactgtaggatctctaatttggaagcctggcaggtcagtgacatggtccatgatccccttgatgagttgcagctccatagcctgcttcccgcgcctnnnnnnnnnnggagttcgcggtgtaattcgattgtgcaggatccctctgggccatgccatccagcttgtcatccggctttgcatcttcaggttccactgtcgaatctctcatttagaagccaggcaggtcagtgacatggtccatgatccccgtgatgacttgcagctccatagcctgcttcccgcgcctacctgaagtaggtgcacaccaagccctctggtatgctcccatgtgttagctccaggaactgtccctgggggcatggcgtggcctccaggtaccccttgtcgaaggcgacctgaaactccctgcgaggtgcgggatggcagtgtgtcaggggggatgcgactgcgatccgtcatggtaagagggcacaactgaagccggcatgatcttgactcacgcctgtccgggggtgagacccgcagggtgaggccatcgacccgcctgcgccgtcatggacctgcgagggttgttatggtgcccatgtacatctgcaaacgtcggggttgatgcgacctggcgccaacaagtnnnnnnnnnnnnnnnnnnnnnnnnnnnnnnnnnnnnnnnnnnnnnnnnnnnnnnnnnnnngatcctttgcggaacgttgcatgtgccccacctggagctcttctgcgcacgagccatgcgactgcacgacctagcggaggtaggtctcgaaggccccgagcacctagaaatgcgtgccgccaaggcatggaagctactcgtactccccagagaatggatgtgcgctctggccttgccatcggcggtattcgaatgcctccgggaccgactcgtcggcccggcgccggtcctgtacaccatgaccatgtcagcgtccgctggtctacaaagtgttcacgatgccaggaattatatgtttatgagcgatcagttcgagtttcggtgttcaatgcgtcaagaggagatgtaggttttattggtagatttgagctcgggcgtgtcccgagcagctggttcaaggcctgggcgcgagtatcctggccggactcacagcgcacaactgcattccatcattgacctcccaatgaagcacgaactcatttgaccataattaggaacatgtctaaactcacgcctgctctcgtgggccagttgcatcctggggagagcttgggaacagtgcagcggctcgatgtcgccggccgtggcatcacaacggtgagcatggggagagggacggggggatgtggacccctgttcttatgcggtaatacttttaatcctgttttgcttccccttgtaatccatgcaggtcgtgggcatggagtcctgcaccggcctcacccggctggacgcctccgacaatggccttacgtccgccgacggcatagctgcgctgcctgccctgcgctggctttccctagccgggaaccaggtggagagcatcgaacccttgcggtcctgcgattctctggaggtcctcaacatcgccaacaaccgtttatctgggaaggtggctttaggcaggctcagccggctgaaggccctggtggccaacaacaacgccatcaccctggtgggggcgctggaccgttgcaaggagctcaacacgctcatcctgtcccacaacgcggtcgcgagtgtgtcgggctggttggcaggggcgggtcccctgcagaagctgcaactgtcccacaacatgataaccgacctcggaaacgctcttaggtcagtcgtgggggggtgggggggtgggaaacaggcatgacatctgcttggggaactggacgtgcagagagccaactggaagacccctgatcctggagcatctgaacaatgtctgcagagtctttgtatgtgggccgaagggcggcgctaagcacaccgtgcttgtgcaccattgtgccgcggtaccaaacccagcaccaggcacatgtacaaatatccgcgtgctctttgcatactgacacgtgcagccacctcaccaaactcaaggagctgcgcctgaatcacaacaagctcaccagcttccctgctgacctcagcgccttggccagcctgaggaccttggaagcagggtccaatccgattgcctccctggatgccttgcagcccctggccggccttcctgccctgcgccagctcagcttaaagggctgcccagttgcggccctggagaagtacaggtcccatgtgcaaggcctcctgccaaggctgcaggtactgcagaggactctgtggggccactgagagtcaataaggggtgtggggaaattaaggagagtgcatgcagccctggcacctgtgggaatacaattatgtgcaactcttgctgccagcagaagagnnnnnnnnnnttctgtggagccactgagagtcaacaaggggtgtggggagattaagaagagtgcatgcagccctggcacctgcgggaatacaactatgtgcaactcttgctgccagcagaagagcagtggctgaatagtctcgaaggccactggactcgcaaggtctactgttgtgcaggacgactcaaaacctcattcttacatctgcaggttctggatgggcagcggctctctgcaaaatccagcgtggaacggcgagcggttgaggcagcgacagaggcacgaaaaggcacagagtcaaggtgggtgagaatttgttgcttggctgcatatgctgtacattgacgtgaggtctggggnnnnnnnnnnnnnnnnnnnnnnnnnnnnnnnnnnnnnnnnnnnnnnnnnnnnnnnnnnnnntaatcacgccagcatgtacaactaggcctgttggcttcctcatcagacctttggcccaaaccaggaaacattctcaacttcttctcctgcagcgcccggagctcagctacagccaaagtggagaaggagaaagccaagaagaggaagggtgaggccnnnnnnnnnnagctcggagctcagctacagccaaagtggagaaagagaaagccaagaagaggaagggtgaggccgtccaggaggctgcaggggctgagctggaccaacaggaggttgacgcgtcagtgaaagcaaagaggaaaaaagtgaaagagccttcaggaaacgcagcaccaagccctggagacaagggtgctgctgtagccagcctcagcaagccgttgaagaaagcagcccatgcccgccctccacccaagatgcctgctcaaacagagggcaatgagagcgaaggcgatgatgcggtggcgtttgtcgagccaaagaagaaaggaggagcggtggcgcccgacaaggaggagaggctacaggctgtagcccgtactggtacgtcaagtggaacttttcggtgcacgcttgcaaggatcaggcctaggcaatgcacaagccaagcatgcgcccatgagtcccctgcaccaagcatcttacctcatcccatcttgacttttggcaggtgtggtgaaagtagtggatgtggcacgcctcgagaccagcaaagccggtaagaaggcgtccaaggtgtcagctggcaagcctgcaaagcctgtagtcaccgggagtgctgtcttcaaagcattgttgaagccggacgacttcaccagtcctggctggggttcgtaaaaggagtgagcagtgcatgagattcctgcagtatgcacgccccaatgctcctgttgtccagcagatatagtagtgatccagcaatgtcacctggtcgaccattgtctgtgccctgtgcatcgatctccttgcaattgatgcagatggcatcagcattcactttttgggcgcgccagcattcacgcaagcagaagtgttgaccgggtgataacccccgatcaacattatatccagtccactcgatgttcattctatcaaatgaatattcaagtagtatcgtgcacctgaggatccgggagggatgatggaggtgtccccggccctcttcccggatcacttgcgggcgtccctggcttcctgcgacgtggccacctcccagacacttgtcgccatcgacgcatgtctcaaacgcctctcagatctcgataatgtcctgaagcctgtgacgtccgccatcagtcctgtcctgggacgcaccccatccggccccctgctcacaggaccccaggacattcccaaacacctcgccacgatcagagcggtgaggcgtggtcttgctgcgtgtggtaatgcgagtgtagttgagacattggtgagggatcctgcgtctggccctcacacatcatctgcacttcccacggcagcaccggaccagcatcggcaagggccctgcggcaggagaggctttcctggcatccctgcaagctgtccatgttgcggccagttccctgcgggcagcgctggacagcggtgcgcctggtctttcggcgagcgaggtgaaggcagcggcagccctccggcaggagggcctgacggccgcccgagccggcctggcagcagctttcaggactggcggcagcggtgccgaggctgcagccctcgtgcaggccctggtccgtgctggggacgagcagggcccttccacgctgtatgccgaagcgagacggggcccggtggccgctggtctggaagctgctgggaaagctgaggccgggccacctggccagaggtatgcgggaatgacacccaggcaggggggccgtgtgatggtgtttgctcggagacgcacggccagggctgatgggattgcatgggcaggctttggcggtgcctgtcgtgcatgttttcgtcccaacagcgagggactgcaaagggagggtccctcaggcagcttggttttcatgaagggagcagtgtctgctgcgtgactggcatgatcaggcacgcagcagctactttaactctgccacccacgcttgcgccgcagggtggctgcgacgctgcgtgccctgggggagatcgcacaggaagagagccagaacgccagcgacaccctgggcgccgccggcgcctgccaggccctgagtgcgcttgtgggccccctgatcgtcggggtcaagggccaggtgcgcgacctgctgggcgtacaggcttccctctccaaggttgcggacctggcagaggtggcggcggctgcgcgggccgtcatccctcccctgttgaccctgttccagcgtgagctggggtgttggaggcgcatgccgttcgccatgcagggagaaggggggtgtacacagatgccctgtaggtttgggactggccgaggctagtgtccttgacatctgccgaagctccggtgcttgaccctgtgctcaagctcctttcacccacagcgtgtccacctcagccctgcccccaaaaacccccaacccacccacagtacctggccagcagtctccttcccctggtcccggccctgccaacaatggcggctcggcatcctccccctccccctccctggcggcgctgcagcaggaggtgctcggcggcgcctcccgaacctggacgttcctgcagcagaagggagggacgggctccctgccctccccacccccggccacggctgcctgccacccggcggtgggcgaggcggtgcaagcgctgcgccgcctcgcctcgctgcctgaactggggggcctgctgctggcccagggcaagacggccagcctgtcggccacggtctctgccgtcctcggtgatgcctgtgtttgtgtgacctgaaggactgggagtcaggacgctggtgctcttcgagactggacatggtggcacgctccccgcagtgctcctgccgtgcaaagccttcgaccgtgggtgcacctgcgaggtgaatgtgcgggtgtgcaccatgccaggcatgcattaaaaagaccccaccaaacccctgttctcccccgcagacggcctggttgacagcctggagagcacagccaaagcagcataccctgcggcctctggactgacggaggtgcacctcctcaattgcaccgtggccctgacaactcagctgcagcgcaccgagggcacagcccagctcgccgcggcgtggctcgcagatcgcaaggtggggctgcaggccatggcaaagtctgcgttgggatggggcttatcggtagaacaatcggttcctgcgctgtccaccgcgccggggcacctgtctgctctgagaagtggatctcttgtgctcccatgaaccaaccccacaaccccccttgcatccattgtgccccctgtcaccccctgccaggacctggcggcgcggtatgctgagcggtacgtgtcggtggcctggcagccagccctgcgcgccctgagctcggactccagccagcagctccgtggggcggccgccctgcctgatgcgcagagggctgccgtgaagacggtctggactgcagtgaacgccgcgcttgacaccttcaccagccacccagtgagttgtgggaagctatggcttgacgccagatgaccctcgcgcatgcatttaccattcctgtatttgcatggtgtcccccgtacgatcccagtttcaggcgcaagcccctgatcgcccttccatcccgccccaaccccccatcacacaacagtccctcctcctgcatctgcagggcatcgtggagtccatcgtctggcagaagcgagtccgggagcaggtgggggccgctttcctcccggcctaccgcgccttcttcacaaagtacgagggggtgcctttcaccaagggtcgccggtccaagtacgagcgctattccctggccgaggccgaggcggccgtgcagggcatgctgagtggggccgctcgggcccccctggagggctcgccgcagaggagcggtgccagcatgagcaatcgcctggctcgtttcaggtccaagctgatggactgagggatatggcgactgcacttgtactgtcgcgctgctagccactacccctggccacaaggcttgaataacacagtggccggcccagtgctcgagtcaaacctgagccaagcaagctttgcaatcgcagccgtccatacttctcgggaagggagttagtggtgatgtgtctcacaagaccgctatgtggtgacagctgtttgggggacatgaatattcccacgagaagagctgagtaggagaaaccctgttaatttctgctggtttccgggagtgtcggaaagaagtgagtacgatttagatcatgtggtgaaatcaatcgatatcaaaagcagaaaaatcacggtcgtaagcagttatccatggtcagaagccttcttctggcgttcctgttggcggcaggatcggccatcttgatcaagggtgagaggaagccgggccactaccgagacccgaggcagacagaccattgcagtgtcgatcggcgcacaccctctcatccttgatgaaatgcaggtgtcgatttcaccaagctcccgctgccatgcctgctccccatcgtcgacgtggaccctgccaagtacccggtgccggctccatggaccggcgagtttgccaagaacacgaggctgcgtcggtccaagcgcttgtttgagggccaaatcaagggatcaggtgggtgatggagaggctgaagatggtgcctcgtcagattatgttattttgcgtacctatttgcatatcgaaacgctggggaagcttgaatcggtaataggaaggcacccattgtgggtctgcagccccgacgctccctgcggtcgttgagtgccacatggggcttcctgattcccaacgtgcatctgtagataaatatccccactgggactctggaacccaaacgctagtgacatcaggttgttgggctcctgtcagacatgcccatgagctgacttcccaaccctgcttgccacagaatcgatcgctgtatccaggaacggcacggtctacctgctggacggcagcggctacctcaaggtcgcacatgggagcacgcggcaacccctggatatcacaatcgacgcccagccccaggcctacctgggtcctgggcgcccgctggggttccacctggacggtgacgatgacctgtacatctgcaacagcctcctggtgtggtggaaagggggttttagagggatggcattgctcccacatccagacctgtcgcagaggctggggtggggtggtggcggggctctttttgccaggtgctactcagcttgcctgttcacatggccacttgcccagactttgatccactctctccctaacttacccccatctccccctactttcctgtgccagggcctgacgcggctgccagatggcgcccgggcccagcagctcctggccaacagcgtgccgggcgccgcccccggttccttctcccccattgcctacgccgacgacctggacattctcctcggcggcgacgtggtgttctccgacgcctcggccatcccacccgcgcttgggcgggccggacgctatgacaccatgcgctcctacgtgctcaccgtgctgcagggcgcgcccagcgggcgtctgctgcgctggcacgccgggtcgggggagaccagtacgctggcagacggcctctggttccccaacggcgtggccctggcggcggacggcagcttcgttgtggtggcggagacggtcacggcccgcatcctgaagcactggctggcggggcccaaggtgctcgaggagggggggatttggatcgcatggggtgcctgcaacgggtgaaagttgggtcaagaagcatggcggcatgcaagtggggcaggctgcttgccccaagtgtcgtgaaggggacagtatcctgggaggtgcaatgctggtgataatagcagactgtcatattgccacgggactccgatcctgcccccaattccaagcaaaggcctgactcatgaccctagctctgaggcggcctgagggtccactgtcttccaacgcctggagccttgccaccccactcaacccttgcccttgagacaccccccccctgaccaccctttgccccgaaaaaactcacccccacctcctcctcatgccaggccggcaccactgagatcctggtgcacagcttgcccgggtatccagacggtgtgagccgggcgcccgacggcaatttctgggtggccctcatcaccgatcacctccccgtcatcaactggagtgtgcgctcgcgctctgtgcgctgggccctggcctggctctcccacttcctccccgtccccatcaagcacatgggcgcggctctcaaggtgggaggcccgtcggtaccagggcaacgatctggggaactcacaacgccctgtgttggtgctactgggtgatgtctagtacagtgccatggggcccttgggtttgaatatatccgtgtccttgaagctgtctgatctgtaggtgtccacccaccctccctccctgtgctccacagatctccccagaaggcaaggtgctggatctgctggtggaccctgaggcccacgtcattggcagcatcacctcggtggtggagcgcgatggctggctgtacatgggctccttgaccaacgattttattggtgtgctggatctcagcaaggcttcctgagctgttatccatgtgtaacactcatacacagaagttggcaagtgtcagcacagactctgggacttagcaatgtgcccgtgggacaaggttgaccctgcttgtcaccaacaggagaccaggccagaggcagggaagtgaggtgccagcctcctcatcagcccaccccggagtccggccagtacgactctggaatagtgggagattgtcctggactgatgcaatgcttatgggccgacgtaccagcatcagggagccannnnnnnnnnatgggagattgtcctggagtgatacaatgctcatgggccgacgtaccagcatcagggagccactgaccgctgacctactgtcgctggcctttgtgtgccgtgtccaccgctcaaaagcgttgaaaatcattcgtttgcaataccactggcagtctgacaccagggcatgttctaccagcagctagggagcaggcaggcataccggctccaatcacagggtcttccacggcgcgagatcccccagggacaccaaaatgtctcctgtcttgcagctgagggtgatgttgcttgccaggcgtgagctgtggcaaggatttagaaaggggacggtggtgggtctcatgagctggacagaagatgggcctgcacatgttaggtagagtttcaacacttcccgatgctccctcttccctccagctggccacagtgtaggtccaagtaaacgagcccagcatattccagactcagactcactggatatcaatagatgcaggggcagccacctgggtcaactgacgagcaacctcgtcagatggggcagggaatgtgtcaaacagctcagtggggatctgtgccagttgggagtgttgttatagtctacacggcgacctccacatgacggctggggactgacgcgcaccccagcgcgagcccgggtcgtgcactgccgaggcaacaaggaatgccattcgggttgagagactactacccgcgtccctacacgcaaacacacgtgaaatcgcgtgtgggacaaagagcttgacctgtatctggtcgggtccagaccgcagcaccgcttttagaccattttggtaacaaccttccccggttaccttgatgtgtgcctccagctggtccggtacactaggagacagtgccagcactgtgcgtgggggatggggcgcagagagatgagttggtgtttccagcgtgtaccccatccaatgtacccagtgtgtgctggactccaagacatctctggagggaacggaatcttgactcaccatcctctccaagaatatctgtgtgaccttgcaggacgtctgccaccgtctggccctcaaggccccggagaacgtggcgatggccctccttatccactacggtaagctgaacactgtgcaaatgatagagtacagggtcggcgagggtccaggagccaagggtgcagcaagggtcagtgtcccttgcccctctgcacatgcgggcccagttctagctgctcacatcttgtcgaagacggagggcgcggcgctgccataccggcaggaccgagcgccagaaagccttcgccccatggcagagctggccatttgccgcagcatgatgcaggtggcacttcaagggtgtcgccagggaggggctccgtccaggaggggcagtccgtgtccagtgatacaaaccgagctcaatagacggggaggaagcgtatttgtagatctcctgttagttcgatctatgggtgggggggtgggggtggggt

SEQ ID NO: 47431 - DNA, 61 bp, Chlorella protothecoides
ccgccccgccaaggacctggagcagagcaataatgtacgtgctggggctcgtgtgtggctg

SEQ ID NO: 47432 - DNA, 62 bp, Chlorella protothecoides
tgccggcgccgtgcacggcacaccacctcgatgctcgacgcctgcgcaggcagcggagcgca

SEQ ID NO: 47433 - DNA, 441 bp, Chlorella protothecoides
  modified_base (101)..(333): a, c, t, g, unknown or other
ccacccgccctcccatgcctgatgaagatggtgttgaggccccgggtgccagggaagacctcccgcgcccgccaggactcagtgtccaccgtccacaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagaggggggcaggaatgaagagggccgggcagccagcatcaggaagacggagctgcaattgtggaatcccacatctccggaagtaaagcgtccaaaccaaaggcag

SEQ ID NO: 47434 - DNA, 67 bp, Chlorella protothecoides
ctggccacctgcgccaggccagggcccgccatacgtgtgggtgccgggggcggccaggggcacgcaa

SEQ ID NO: 47435 - DNA, 75 bp, Chlorella protothecoides
cgccccttcctgcgcctggcgctgagcaacgtgctgctggatttcggcagcatgtgcgacggcgacaagttcctc

SEQ ID NO: 47436 - DNA, 61 bp, Chlorella protothecoides
tgaccagggaggccggcgtggcctggctcagaatggccgacgcctccctgcggggtgattg

SEQ ID NO: 47437 - DNA, 61 bp, Chlorella protothecoides
gccgcagcctgccctgggactgcggtggaaaggggggggggggggggggggggggcccggg

SEQ ID NO: 47438 - DNA, 20422 bp, Chlorella protothecoides
  modified_base (103)..(225): a, c, t, g, unknown or other
  modified_base (315)..(324): a, c, t, g, unknown or other
  modified_base (397)..(406): a, c, t, g, unknown or other
  modified_base (1213)..(1222): a, c, t, g, unknown or other
  modified_base (2691)..(2700): a, c, t, g, unknown or other
  modified_base (3410)..(3419): a, c, t, g, unknown or other
  modified_base (4082)..(4091): a, c, t, g, unknown or other
  modified_base (5134)..(5143): a, c, t, g, unknown or other
  modified_base (6041)..(6050): a, c, t, g, unknown or other
  modified_base (6113)..(6122): a, c, t, g, unknown or other
  modified_base (6418)..(6427): a, c, t, g, unknown or other
  modified_base (6784)..(6793): a, c, t, g, unknown or other
  modified_base (8228)..(8237): a, c, t, g, unknown or other
  modified_base (8807)..(8816): a, c, t, g, unknown or other
  modified_base (9924)..(9933): a, c, t, g, unknown or other
  modified_base (10010)..(10019): a, c, t, g, unknown or other
  modified_base (13828)..(13837): a, c, t, g, unknown or other
  modified_base (14353)..(14362): a, c, t, g, unknown or other
  modified_base (14849)..(14858): a, c, t, g, unknown or other
  modified_base (15180)..(15189): a, c, t, g, unknown or other
  modified_base (15561)..(15570): a, c, t, g, unknown or other
  modified_base (16217)..(16226): a, c, t, g, unknown or other
  modified_base (16667)..(16676): a, c, t, g, unknown or other
  modified_base (17071)..(17080): a, c, t, g, unknown or other
  modified_base (17183)..(17235): a, c, t, g, unknown or other
  modified_base (17751)..(17760): a, c, t, g, unknown or other
  modified_base (18854)..(18863): a, c, t, g, unknown or other
  modified_base (20299)..(20353): a, c, t, g, unknown or other
cctcccaggcccccggtccccaccttggactgctgcaggtcagcgagacgggacgggacggccagcacggcctccacgtcgcccagcaggcgcagcgtctcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgccaggcggatgtcgaactgctgcagggatgtgcacagggtctggcgcagcgtgctcagctggggggggggggggggggggggggggnnnnnnnnnnaacacagcgagcatggagaggcacggcggtgtggtgcatggcagtgagcgccgcaccccctcgatgcctgccnnnnnnnnnngacgcagtgagcatggagaggcacggcgctgtggtgcatggtagtgagcgccgcaccccctcgatgcctgccggactagccccgccaccgcaggggcacgcccgctctccaaaggtacctggactcgggcatcgctgaagagcttcaggatgtgggagtaattctggatggcacggttgaagccggcgtagtaggtgtccaccacgtccgtcaccagcgcatccactgcagcactttgggcccgcagctgatcgtggcggaggtagagggggtgttgtgggatgaaagccctgcatgtactacaccttgactgcgcatctcgaggccagtcgtgtcatgccgaggaacacgcctgtcacgcagtgccccacagagcaaaatcacctccacactcaccctggcgagctcctgctcggcccgctcatcgctgaggagggagaggacgtgcttcacagagtcgaacctgggctccttgaaggatgaagggatgccctggagctcggcatccaccgcgtcccaatccacgacagcacggcggatcacatctccacgtcccaccatcctcgggaccctcacttcatcccccgatccctataatataaaaacataggatttgagtgagttacgtcgttttatgtccgtgatagggaaggattgctgtgatcactttccgcacattgagggccgacaagagcacgacgggaagtggttcccgagcgcaatttcggtttggagacagatgtggacaggcacggagaagtcggcatcaaacgaacggtgataagtaacatatactagacacgtatnnnnnnnnnnaatccctagaatataaaaacataggatttgtaggagttactttgttttatgtccgtgacaaggaaggatcgctgtgatcactttccgcacatcgagggccgacgagagcacaacgggaagtgattcccgagcgcaatttcggtttggggacagatgtgaacaggcacggagaagtcggcatcaaacgaatggtgataagtaacatatactagacacgtatcttcaacgatggacaccagtgtcactcccgagcccgaacgccctccccccttggaagactaccaaacacccagggggacgcctgccacactcagctccatagattcagagcgtttgcgcactgtactcacaagtgtacggctcaagcatggcctcgactaccggttatccgaggaaacaggtaggagcaagagaatgggggatgcagcaagaaacatgcgcccactggcaggcacagcagctcgtgtgtagggaagtattcagtcctttcactccgtctaaaacctatcgaggcccaggacacagcaagcggaccccccctgaggttattcgcttggacttgtctgacgatggagccgacagtcccgagcactggctcatttccgtccccaggaaggggccgaccaggtgtgtgatttcccagcctggtggttcatcagccaccagttcggcaagcatgcctggtatgcaagaccttgttggtttctccttatacctatctcgtggtgctcgagctgcccaccatgacttctctcaacgctcgctgcgactcccaggcggctgattgacagcgggagcgacgaggacacaccggcaaaggcgagtccttcgtcatccatcccaggcgccaccgtcagcgacactccttctaacgttgactctgaacagacggtggatgaggatgagggagtgtcagaagatgactggacacccagcagcccggaaagcctcccgccaggagaaagctgcagcccttcgacatcaaaacctgagcagcagagcccagcctggggcccagaccgggcagtgccccattcatctgtgttcagcactcctcgggggccctgccccgtcatcccctcaggagcgttcaaacgccgtcgtgcagagctggcggtgaccctgtaccaggagtacaatgcattgatatttgacaaccgcctcccggcggacctggcgatcacctggaatccacggctgtccacaacggccgggctcacccactacagccaatcccccgacgggttggggggacgaacgtgcgccagagtgattggggtttggggctgagggcgtccagcggggtgagtggtctactcaagatattgtggcacgcatcatgacagatgatggagtagctccagagctgctttacagagcttatcactcaggatgctactccactgctgcagcttcctcttttgctatttgcagaggtcctgcaactggccaggcgtctccccttgctnnnnnnnnnngtgatggagtagctccagagctgcttcacagagcttaccactcaggatgctacttcactgctgcagcttcctcttttgctatttggagagggcctgcaactggccaggcgtctccccttgctgtgcagtgtcgctccaggatctggaaacctacactcctcctgcatgactgcaagacgcccaaacacttgcccaggaactccgcttcaatacccaatgacaggtacacggcgcgcgtagagctcagcatcaaggtggtggacggcctgcccaaactgaagcgcacgctctgccacgagctctgccacgtcgccgcctggctgctggatcactgtgccaggccgccgcacggcaacgtgtggcgagggtgggctgaccgcgcccagcgagcctacccggagctggagatcaccacctgccactcttacgacatcttcttcccccaccgctggcagtgcacgaacgcagagtgcgcagttgattgtggtggtggtggccatggggcagagtagatgaggcttgttgggcgtggtgcacaggttgcctcagcttcgtgcgccctctccctggcgttcaacagtgcgaagaccagcatggatccatgccccttccctccattcccccccatctttgcgactccccctgctgcctccagcaccccaccccggcccctccccttcaggtgtggagccaccctggggcgccacagnnnnnnnnnnatgcgatgaccagcatggacccatgccccttccctccatttcccccctttgcaactccacctgctgcctccagcacacccccccggcccctcccctccaggtgtggagccaccctggggcgccacagtaacagcatcgacgtcaaccgaaaggtctgtgggcgttgcagggcaccactggagtatctgggcaggttccaggctgacaacacgcctgccaagcccagggaagcgacaggcttcagcctcttcgtcaagcagcactttgcagcaggtgggtggagctggactgggcgcgcaggacatgccatgaacccagtccacctatgctcattcgcatttatacctctcaacacagagaggaagcagcttccgccaggaacacctcatggggaggtcatgaagcagctctcgctgcggtggggagagcagcagagggccactgcggctgcgtctactgatgcggcagtgcctgccaccgatgctgcctgcgatgcattgaggaggctcttgttgtgattgtggagagcaccagagatatgcatggcgcacttgctgtgtgccaaggtcacgctgtgcagcaatgcatcaagctcctgaaggggggaaatgaagacaaattcgtgatcacacacacgggcgacttcctgggcgcgctctcaannnnnnnnnnactcctaaaggggggaatgaagacaaattcgtgatcgcatacacgggcgacttcctgggcgcgctctcaaaatatacaactcaccatgcctctcccttgatcccttcaagtgccacctgccctgatcgaagagtacgagtgggtatcgtggccattcgaggggcatcttcggcatcttccggcgtttcggaagcacaggcactggtgccgcgaccggggaatgaccacgaattccaagggcattctgtatgccctggtggcccgtggccccgtcatcctctgcgagtacaatcttgtgagaggcaatgcccctcttgttgccttgaacctgcttgaaaagtgggtgcctcgcccagacgccaaggcctcctatgtggccgacaagcatgtcttccacctcctcagcgatggggagctcacctacctctgcatgtctgatgaggtcagtatgaggttcatgcagtcgatcctggtgtgattggctgtggcatggtgagagctcaggcagggatcttcatcggccatgccgccatctgctcctcctctcgatagagcttggggcggcgagtggcctttgccttccttgctgacgtccagtctaccttcctggcggcacacggagcctccacacggtctgccctcgcgtacgagctgaacacggccttcgagccggagctgcgcagccggatgctgcgcctgaacgccgacccccgggctgatgccctcaccaggatacatggtgatgtggcggagctcaagtccatcatggtagacaacattgacaaggtgggtttggctcatcatggggttgtttggggaggccggaagaggaggggatcaggagtggtggtgaggctctacctcctgggttgtgaaaaaatccagtggttggatgatgactcgggaggggctgccctgcccctgtgcgatcgcagccctgccagctcttcaatcagacctacaacaagactggggtgcaggccttgcgacaccccctgcaccacaagccctgtctcaccaccattcatcctacaggcggctgnnnnnnnnnnttacgtcctggggtgtgaaaaattccagtggttggatgatgactcgggatggctgctgtgcccctgtgcgatcgcaaccctgcaagctcttcaattagacctccaaaaagactgggttgcaggccttgcgacaacccctgcaccacaagccctatctcaccaccattcatcctacaggcggctgcccactcccctcctgccccctcctgcccccgctcagatcctggatcggggcgagcggctggacctgctcgtggagcgcacagacgacctcgcctcctccaccttcaccttcaagcgggaggcgaggagggtgcatggcgcgctgtggtggcgcagcgtgcgcctgcgcgtctgcatcctcgctctctgcgcactgtgcctctacgtcctgctggccgtggtgtgcagcccgaccctgcactgctgacggccgcggacaccctcgcgcgtgatcctgtgcacgaactctcctcctcactccccctcgctgtcctgttgcgctcattgggtgttcatcaagctttacagtgtgttgggtgggggaagtgagagggggcagcgactgggcatacgggggtctgcgccatgcggcgcacgcccgttgaggcaggggtcggaagcagctctggggtatttcagcaatacacaaaactgatgagcgatggtgggagaggacccgggggtcaagcgggtagggtacagcaggggccttgacagcggacaagggggggtggggggtggggggtgtctgatgtgacgcgggcaagataagctggtcacaccaccgtgacgatggggatgtggacgggcccgcgggcgaggctgcctgctcccgctgcatgggcctccgccagccgctgcattgctgcaaagtgctggcggtacatgaggcgcnnnnnnnnnngggcaggggtcggaagcagctctggggcgttgcagcaatacacaaaactgatgagcgatggtnnnnnnnnnntctgatgtgacgcgggcatgctaagctggtcacaccaccgtgacgatgggaatgtggacgggtccgcgggcgaggctgcctgctcccgccgcatgggcctccgccagccgctgcatcgctgcaaagtgctggcggtacatgaggcgcaccatgaaggaatacgcgaggccggcgaccaggccggtccacagcgccgacgccaggttcatctgcaggatgccagggggggaggggttgtgtggcaaacgactgggagaacgtatctggtgcaccacgaaaggagagacgtccaagcnnnnnnnnnnacaggaggggagaggttgtatggcaaacgactgggagaacgtatccggtgcaccacgaaaggagagacgtccaagcgcagagcaagcgccagataggtcgtgcgcttctcagagccaaatgttcactacccgagccctttgaggactccacctcccctcccctgcgcctcacgtcaaagaagaggatagagacgatcatggccacccatgtgacacgtacgcagtcgaacaccaggtctgcatggctcggcgccagctccaccatctgctgcgaggctgtggcgggacaaggggaaatggcgatcagacagggcatgctccagtactagggaccaggctttgaccatgctcacacgnnnnnnnnnnaggacaagggggaagggcgatcagacagggcatgctccagtattagggaccaggctttgaccatgctcacacgtgagaaaggtgcagcataatgcggcactggcaaggtgaatgcggcagcttagacatcagcgtctcttcatccccacttcctcaggcacctgcaggtcttgaacccacccccgcccccccaccccatcataaacaaaccacaaaacatcatgaaatgccatactcacagtagacgtcctccatgccggcattgccttcttcctgcggcggcctggggggcagcgccggcaggttcttcacctcgtgcttgcacagctcgcagatgcagtcgcccttcacctgggcccacttgatggcacactcgcggtgccgcagcgccaggtcgccgcggcactggcagtccaaagtcatggcttcaccgttctgatgaaaggagggagagagagagcggttgaagcagcgcttcagacaaccttgccatgcgataaggcacccttcaggtggcaccagcacctgcagggagtgtgcatgtggcatcccaatccctccacacatgattgggcaacccggcagctgcagaaacactcaccctgaattcctcggaggtcagggtttccaggcagatgaggcagacggggtcggatcttcgacccatgctgccctgggacccggtccgatgaacccccttgtcgcccttgctgcgctcgccgcccggccgggacaccgacagccttgcgatatcccctgtgctgctgctgcactgctcctccaccaccgtcaaggtggctggagctgtatcgctggaggagggggggccgccctccggaacggggggcgggacggagggcgagacctcctcgcgcctcagcacgcgacgccaccatgacgacagactgcttgcaaccccgggcttggctccggcagtctcttccaccggggcctgccgctccgcgtctgcgcgccggaggagcctcacgggagagtgagcacgaggcgtcacccccacgttgtcctccaccccatgcgaaccgtgtctccccaagctcccacgggaatgtgctcacccaggagaggctgttcatctccgacttgagtccgtgactgggcagggctgtccgacgcagcagcgatttccggcattatgcgcctgtgacctcagtgaacccccacctgtcaacgccgggtggaggagactgggcgaggcaagaagcttcggagcgtcaccgttgaggtcgctggataattaggaatggtgaatgtcgggcggggcgcgtcgcaatggtggcatggggaaggttccgcgcttcggggacgtacgggggaggaccccttcaaccgggtcgaatcgcgttgttacaaaatgggggagggttgctcagtgaacaggggatagggcaatcaggcagtcttcaaccatccggannnnnnnnnnatgtgggagggttgctcagtgaagaggggatagggggcaatcaggcagtcttcaaccatccggaatacatggggtgtcaaaaactatggcctctacaatactattggatcggaagggagcggagcacccgacagcagcttccctgggcgtggtgagggctcctgatgcgcggggctggccacctacccctcgacatcaaagtggcaagggcggcgaccccctgcatggacggcccacatcctcagcagcatacgctcgaaatctgacacccagcgccgcgtgtcaaacagggggctggacccccgagcccggcacaccgcggctcgcagggccaggcgcttgggcgcatccagcgccagctccagcgcctgaatgggtgaggcgggcgggtgtgtgcttgggtgggggagtgggggctggcgtcattgcatgtactcctggagggtggtcttgtgctggggcaatcgcaggcttgtgtcgccgggatcctttttcggtgcccctgctccccatcccccccgcccgctgcgctcacccgtgcctcgtactctgccatggacccgacgaccnnnnnnnnnnagtgcccctgctcccccgtccccccgcccgctgcgctcacccgcgcctcgtactctgccatggacccgacgaccatgtccccccccaggcccgaggcgcaggccaggctggcggccacgcgggacgccatcctctccagcggcagcgtcagcagcgggcaccccgcccagagcacgtcgcaggcggtggtgtgcgcgttgcaggcgggggtgtccaggaccaggtccgccagcgcgcagcgcgcgacgtgggcgggctttggcgccacgtcggagaagacgaggcgggcggggtgcacgccgcgggccgccgcctgcgcgcgcagccgcggctcgcctgaggcggggaagcgcaggagccagaggacggtgcgaggcgcggcgcgcagcacgcggcaccacgcgtccagcacgcccgggtcgatcttgtacagctgattggcgcaagccagcaccacgccgtcctcgggcaggcccagcgcggtgcgggtgggcgtcggggcggcgccgcgcagcacgtcgccgtgcgcccggcggtggtcgttcacaaagtaggagtggggcatgcgggccacggcctcgccatagcagccgagcaggtggtcgggcgtgacgacctgcgtgtgtgtggtgggggaagatgagggtgtgggtggaggggtactcactggtgtgtgcagcagcgggcaggggggcagtgatgcatgcaatggtgtattgcacgggcatccagagggggctgaacagcccagtgcaggcagcagcctgccatcgcgggggcgacgctgccttgtgcgcctgcacgagtcagaatcccagattcactcccccgcacagcaaccaccttgtcggtgacgatgtagtccatcagcccccggcccgtggtggcggggaagcccatgtaggagacgccgatgggagcggggcggagcgcgaagacctcgctgcgggcaccgcgcgtgtacccattgaggttcactgggaagaaaggagggagtgcgggacggtggcaggagggacgggggtgctgcggccggcgtgctgggatgcaggggatggctgtgctctgcttgaaggaatgcatcgggagggagcccagtgacgctccnnnnnnnnnnccgcctgtacgagtcagaatcccagattcacgctcccgcacagcatccaccttgtcggtgacgatgtagtccatcannnnnnnnnntggccggtgtgctgggatggctgtgctctgcttgaaggcatgcatcgggagggagcccagtgacgctccgccttgcacaccccatccacccacccacccaccggcgatgtggatgccgtcctcggagatgcggcgcgcgatgctcggcgacggccactttgcgacgtccaggaagtggtcggcgtccgcgcggatgcgagcgcgccatggcgaaccgtcgtcggcagacagggcgtagcagaagacctccaccagcctggcttgcatggggaggaggccatggctgggggcggtgcaaggtggagggccggaggccgggggcaatcatccacagtgatcccagcctgcctgacagacagcaccccaacaagtcaccacatatcaaatcaaccaccttcggtcgtgcatcccaaacacggagcccatgaggtgactcagcggatggttgcccaggtccgacgacacgtaggcgatgcgtagccgccggccaggcgccaggggctcccgcgccgggtggggcaggggcccgacattgagggctgccgcggccctcaagcagtgcccggcgtaggcggaggagatgcggagggcgaggtcgggggaaagcgggtacgccatggcgtggaaaggctgcacagagggcaggcacccggcggccagctcctcttctgtgatggcgatcaatctgcatgcagaggttgtaagatcaaaatctcagtgctacatttgtgtttgtggtagctttggtagcatgcagggcagtgggagagataccatgcattgcaaatactctaacgagtccgccaagctcagcatgctcgtggcccctgcaggcacatcaaaggagacagcactttgctcgtcacctctggaagaggctgggtcggtcttgccagtcgcacacacactgcatggagtgcacgaggttggcaaaggcgtctgggaagtcgggccgcagcgccagcgcctggcggtaggctgcgatggcctcctcatgctgatctggtgcatgcaagacagcatgggataggagtgggtggggggttgtagggtttagaactgtgatagtcgcctccatcatctgttgtgaacgttatgtgatcaaacatagcaagcataacaacacatccatgtacagtccaacaccatctgtcccttgtcagggaacccgctccacgcactgttgtccttcagggctgcagcgaggttggcatggccctcagcctcccccggctgcaaggccacggcgttttgatagcacatgatgccctccctggccctgcccaccagcttcagcatgctcgccaggttgctgtacaccacgctctggggatcgtggatggggagaggtcaagacaaaccctgaggcatcacccggtggggtggattggacacggtgcaaccgagcaatgcgcggtttgccacccgcactggtgccacagcgagcccgccatgcacacaacggggaggccacacgacacaacaccacaaccactgctgacctgacgtcgcgcgtgggtgcgggtgcccagaccctgggcctcggcctgggcggcctccgagatgaggagatggaggcaggccacatactgtgccacggcctcctccccgcgccccgcctccctcagggcgttgcccaggtcgttccgctcctctgaggacagaggccgctggctggcacccaagtgatacgcctgcaccgcacccgcctccacttcgctgtcctgctggcagcggcgtgctgcaacggctggcgccagggaagaagagggtgggaaggccgcggcacccggggctgtggcaagtgatgggtcccccaggtgccggtttccggaggcccactggctgagctgccgggaatgcaaggtcccatcagatacacccgactcgggaagcatggcagcctcgtgaactcgaccagcttctcggcgattccgacgctgcagcacggtggccagactggtctggacggcgacggtggtgggcctcaggcgcagggcagactgcagtacccggggcgaggggaccacggatgcgtttgttacagggtttgtgaatttcaacaggcacgcaatcaagggcacataagaagtcagaatcgcaccacccaccttggccgaccaaaaccttcacaacccatgctcgatgggccctccacccagagtgcgccccagtacgctcccgttcaccagacctggccacgcccacctggtagtacatgattgcgaggtccagctggcccagccgactcagcccactggcgaggttggcctgagcctccgggagcgaggggtccagtaccacagccgcgtcgttgtaggccaccgacttggcatactggccgagctcaaagtacgccacggcggtgagcagcaggaggtcgatctggtagcgcctgtggtgcgactggggcgccgacacgcaaaggagagactggccgatcatgcagtgctccaggcaggcctcatagttgccgcttgtgtatgcctggctggccttgagcaccatatcctggagggaagcatcttggccagtcgatttcccctggcacctgggggcctgccaggctgtgaccatcctgcctcccgaccgcgctccgtgctctcccggtccggccgaaaccccgttggcgtcgttaacgccgggagctacggcgcccaccgattgcgggtcgatcctgtaatgctatttatattctagcggtgtgatatcgaggcaactggcatggccagcatagctccttaccgtgtcgggagggaaccgtcctcagtgaggtcctcggggtgccgagggcaatcgagagactaccagcgagaccatactggtgaaaggcagagctgaaaaagggtgtactgttcgatgttggaccgtccttcgaatcggcatggaggcgcaagaagtcacaggtcgctttgaggaaggtgtggaatctcgacgatgggctctgtccttcgtgaacgtgatgggcgcaggcaggtctgtcctatttgacaatcatcatattacattttcataccccggatgacattgcaagcatgcagtttggggcacgacttccgaggttcattgaatacactgagtgcggtcttaccacaacaccgctcaagttcagtcaccaaaaatcgaggcggtgaatcaccttcaaataccgcaatggcaagattggaagtagatagcaggtacacagtgctccttcacgttacatggtgcccagcagcttcggcaccgacagactttgagcgcgggaagggaaccgaatgaagatccgctgtagatcaatcgcgtgctgcacgcacttaacgctgcacagagtacggggctggatcagacaactcggtcccaatcaatatgtcgctgaccgtaccctttgcagcctgcagccctcgggctgcaccatcgctccggtccacattccgtgaaggggccgcactccaggttcggactgcaccgccccggacccggcccgcagcacgcacaggcctgaaaatctatcagtttggatttttgaagaaattgggtctggaaaagcccgagttcctccctgatttcggggctcccaagcggaagttgctgctggaggggttcttcagcagcatcaaccaggatgtgctcgccaacaccctctcggatgacttcaagttctccgacagggacagggtgtacaccaaggatggtgaggtggggagtgggagtgcctgctgttgtaccaaaagcaatgtcgtcatggcaccaagcgcaacccaggaatgcccgttcaaccccttctcatcacacaccttgctccatccccgctccagagttcgcccagnnnnnnnnnncgcaatgccgtcatggcaccaagcgccacccaggaacgcccgttcaacctcttctcatcacacaccgtgctccatccccgctccagagttcgcccaggtgctaaaaagcgtgaaggctgccatccccgactttcagtggcatgccagcacggacggcctggcagacaagaaggacaagaaggcgcgggtggaggtgcgcatcaccgggacgcacacaggcgcgcccctctccttccccggcctcaaggaagtcccctccagtgggaagaaggtggacctgcccagtgcaaagtacctcgtctccgtggaggagggcagaatcacgagcatcgaggtgcgctgagctgcctggataggctcggctgggcgcacatggcttttgcaccgtcttgcagggtctgcgtttaaggacatgcggggttggtgtttggtctggagcattatagagtgctattttgcactgcttgagtcctgggcttcactctaactgcaggctgacagggagtctggctcctnnnnnnnnnnatttaaggtcatgcagggttggtgtttggtgtggagcatcatagagtgctattttgtactgcttgagtcctgggcttcactccaactgcaggctgacagggagtctggctcctccctcctgagtctgtatgctgccgtgggtggtgtggcccaagtggcctcgtgatcatgttgagagcttgaggagtagccttcagcatggggcagtagcagacctggggatctgggccggtggttgagtcctatcagaggcatgctgtcatgctcgattttgagcagcttgctgcgaaactccctcatgtgaagccccagagttatttcagacagtgtggtctgtcgagaatgatgaagagtccgtgctgtatcaataatgctcttgttcttgagttgtaaatattaataggttctgagtgtggtaggagtttagaagtactgtcaggtcaatggccatgagtcacagaatgcagaccgtatggatgctaggggnnnnnnnnnnctatttcagacggtgtggtctgttgagaatgatgaagagtccgtgctgttacaataatgttcttgttcttgagttgtaattattaatagcttctgagatgtggtaggagtttagagaaactgtaaggtcactagccatgagtcacagaatacagaccgtatggatgctaggggtattcaatctaccttgaagtggtgaacgagggtgtgcagactgatcatcggatgcaaccctcccgctgctgtactgtttgggaaggtgccagggtatatgttgcgcggtactgcaagtgcggtacctcccgaaccccgcgcagccacannnnnnnnnnccggatgcaaccctcccgctgctgcactgtttgggaaggtgccagggtatgtgttgcgtggtactgcaagggcggtacctcccgaaccccgcgcagccacagtctctggcgagttttgatggccgaggcaaacaggcgctcccctttccggcgcagaccgcttagaggatacagctgcggtcaagatggtgagccctcagggcggggacctcggagggcaacaggggaggatgcccgtggcgccccgtcaccagcgttgcgcccctgacgaacaggcgcaccgcctgtgacgatcagagggtgcatgaccttctaaattacaggaattgaatgggctccatgtctcgccaggagctcacatgcctctggctnnnnnnnnnngtaacggagtcgaatgggctccaagtctcgccaggagctcacatgcctctggctacccccccgaccatcggagcaggtgaacgtgccgaagaccaagaaggcctactgcaagggcaaggagtgcaagaagcacaccctgcacaaggtcacccagtacaagactggaaaggccagcctgtacgcacagggtgagcgaggcgtcctgcttgggagattgccggatcctgggctcgatgccgtgctcgacgagtagcctctgaaccactccctgccgagcccttgcaggaaagaggcgttacgaccgcaagcagtccggttacggtggtcagaccaagcctgtcttccacaagaaggtatgttggatgatcctgtggtgacatttttggcgaggactgccctgggatattctatgcatgcagaggtccaaccttgtctgggagctgatactgctgtcgtgtgtctacccctcaacccacaggccaagaccacgaggaagattgtgctgcgcctgcagtgccagcagtgcaagacccagcacatgcacgccatcaaggtaaacagttggttgcatgcggatgtgggacatggagcgaccatgtgaattgcaacctaggtcatgagattgctcggctgcgatgccacagccnnnnnnnnnntacagttggttgcatgcggaggtgggacatggagcgacaatgtgaattgcaacctaggttatgagattgctcggctgcgatgccacagccggcatactccaccgagccactcactgcaaacaatccccccctgtatccttctgtcgcttgcagcgctgcaaacacttcgagatcggcggagagaagaagaccaagggcggtctgtactgatcgtcttggagcctcctgctctgtttgcctggttggctgcggctgtggtgtaaaggacatcatacacttgctgctgacacggatgtggtggcgtaggagtggacaggggtgggcagcccgggaggggaaatgcgtggtgggcccgatctggagcctgtattggtttcttcaagcatgcaacaccaaatctcacaggactgtatgtctataggccttttacaggactgagannnnnnnnnngtgcgtggtgggcccgatctggagcctgtactggtttcttcaagcatgcagcaccaaatctcacaggactttatgtctataggccttttacaggactgagactgtgggctgtcggtctgctttgccctgccatgcaaccactcaagtggaaatgtgcgcccagggagtgcgatcgcactctgccagccttacactcatggttacatcaagggtgaaatttctcccctcggtgtgcgcaaggggtgacattgagtccagcccccctgcgcacgacgtgccacccatgcgtcaggccctgtccatgagacagggctgttcagaacactcaaaaactcagactagagaattcatgtgcatgagttgcaaaaggatgacgagcatgactcgcgtggcgnnnnnnnnnnacccagggagtgcgattgcactctgcgagccttacactcatggttgcatcaagggtgggatttctcccctcagtgtgcgcaaggggtgacattgagtccagcnnnnnnnnnnnnnnnnnnnnnnnnnnnnnnnnnnnnnnnnnnnnnnnnnnnnncccgccatcacccagccttctgcccctccagacccggacacccctgcgcatcagacatagaacatggccttctggaggcgggggttgatggacatgaactcgacggtgccgcccccgcccgaggcggagctggcggtgtcggagccgccctccccgcgcagcatgagcctgcccctgaaggcggccaggtgcgcatactgcgcaggcgggcagacactgatggagcgggtgcagcggcagaagaggtagcagaggtggtaggtgagcagctgcatgccgtccgcgccaaacttgttctcgtccaccagcaccgagtagtgagctggcttggaggtcccctggatgccagagtgggagttgaggtagaaggagaagtcgtgggggtgggcgatgtcgttgtccaccaccgtgcctgatggagtggtgacgggatgggggtgggatagggggaaggtgagtcgagtcatttcagggaaagagggagggaggacgtggtgatgacggggcctgcaaccnnnnnnnnnnggggggtgggatgggggggaggtgagtcgagtcatatcagggaaagaggaaaagaggacgtggtgatgacggggcctgcaaccgtgtacctcgtgctctcaatgcccccatacggcctggcctgagtttcacgcgggcatcaggtgtggtctgcacccccattaccccttccggtcccccagctcaacatcaacggaccccctcccccccctccacccctcccccgcccgcacacacacacctggcaggacgtttccggaccggtcgcggttgctctggtcggtggactttgggaagaagcgtgtgtggtgccgcttctgcacgatgacaaaggtgatggggggccggtattcagcccccgcatcgcccatctccgcgcaggcctccagcagcgcgctgtactccttgtagtacacctcctgaaactggctctccgacacgccatcgcggtagaagagcagcgactcggggcgcatgccgcgcgtcgcgccgtaaaactccagcaacaggctcttgaccatggccttgagctcggccacgatctcctggccgccgcgctgcatggtcacgcgcgccgcgtagcgcgtggcggtggcgtccatgctgcccaccaccgcggcgatggaggggccgccctcgccggggcgcgggtgcgtcacgtcggcgcccaggatcatgaagggccggcgcgcgcccaggacggggaggcgctccacgtcgcccaggcgcgtgttgcagccacccagcttggcgttcaccttcatggccacgttggcgcagtactgggggcgcccgcgcgcggggcagccaatgcccgccttgcgcgacacaatgcactgcgtgggcaggcccagcatgctgtcgctggcctgcttcacctcgcggtacagcgcagcacctaggtggatgaatgggtgggtgggcgtatacatgcgggtcatgtgaggagtggggagttgcttcaagcacagttctgagcatatcctggcggagtttcaggaccccacgctgcgtttgcagagttctcccccccttccctccccccggcatttacccacttcataacaccctctagcagcaaacccgcagagcgnnnnnnnnnnccccctcccccccacctggcatttaccccccttcaaaacaccctctagcagcaaacccgcagagcgcatcctcccccttttcccccccaaataacacctgtgtccggcaggacaaccaggaccagcgaggcgggggcgccaaaggcggcctgggccttggccttggcctccgccaccgccgagtagacggtcgcgttgcggtcggggtagacgacgggggggaactcgcggggcgtggtcacgccgcacttgttcagcatgtccacgaactcggccatgaaggtgggcccgtgctggccgcgcgccgcctccagatcttcggccgcgaagcgctggttggcgaagcagactacggcccaggagggcaggctggagccgttgaggaatcgcacgtcgcgcaggttccaggagccgccgcccttggggtcgtagcggccgggcgagccataggcgagcatggggttgggcagcacgcgtgcgcccacctcgacggtacgcgaggagatggacaggccgaaggcgcgggcagtggggtcgtccgggaaggcggcctggcggttgacggcgtggtcgatggcggccaggcggtcgcccgggcgctgggccgcaatcttgatgatctccgacgtctgcgtctcgtccaggcgaatcaggcgctggcgcggtgccacgcggcacagctccatgggcagcagcacggtgccgttgccgacggcgacgcagggcatgtcgcggttggtcaggcgcacgccgtattgggcctccaggtagtcggcgacgctgacctggcgtccctcccgctcaaaggtctcctggaaggggctgccccgggacaggtggcggatggccttggtcatgcctgtgtggctggtcaccaccttgacgccccgcaggtcgcggttcaggcggcgccgcgcggcgtcgggcagcggccccgccacgtgccccaccttgtcggccaccagctccagcagcggcttctcctccagcactgcggtggcggccatgtccacgttcagggccagcccggtctggcagggacgcagggactgctggtagcccagccagacctccgcgccgccgcccagcgagcgcgtgccggggccgcggaagaacacgccgcgcgccacgggcagcgaccgatcggccatggccatgcggtgcttcagcacgatgtccaggcactgcagcgcgtggtaggcgtactcctcctcgtcgcgctggccggagatgaagcggtgcagcgccgcgacagacacaatggccgcgcggcggatgaccaccgccaggcgccgcggcttgtcctcgcccgccggcgcggcctccacctccaggcgcaggccctctgcggggacgaggctggtcacgggcgcgtacatgaccttgcgcccgtcgaaggcccaggagccggcgggccaggcccgggcggccgccannnnnnnnnnnnnnnnnnnnnnnnnnnnnnnnnnnnnnnnnnnnnnnnnnnnnnngcccatggccgcgcggcacacgttggccggcagcggcttgccgtcctcgcccgcgccgccgcgtggcgg

SEQ ID NO: 47439 - DNA, 76 bp, Chlorella protothecoides
cgaagctggcagtgctgctgctgaacgcccagcactagcacacaccccacaccccgctctcaacctgtgaagtcga

SEQ ID NO: 47440 - DNA, 70 bp, Chlorella protothecoides
cacaagcacatgtacacaagggaagcagggatgtggatgcgcagcatgccggccgggggcctggagtggt

SEQ ID NO: 47441 - DNA, 67 bp, Chlorella protothecoides
atctcaccctggcccctcatccttctcctcaccccccccgaccccacacctgagctgagccccccgc

SEQ ID NO: 47442 - DNA, 61 bp, Chlorella protothecoides
cccactccctgacgcactgtttcccgctcagggccgcagcccagccgtgcccttccgcggc

SEQ ID NO: 47443 - DNA, 1665 bp, Chlorella protothecoides
  modified_base (545)..(554): a, c, t, g, unknown or other
  modified_base (705)..(783): a, c, t, g, unknown or other
  modified_base (1007)..(1016): a, c, t, g, unknown or other
  modified_base (1068)..(1077): a, c, t, g, unknown or other
gcagccagcgcgtgacgtggcgccccgtcagctccgccagcagcgccacgcagcgcagcgccgtcaccgcgtcctcgccccgcgacgatgccggggcagcgtcgggcccggcgcgtggcgggcacggtgacgtgcaaacattggtatcgatgggaaaattggcactacccccgccactgttgctgccgccgccacggccaccgccgcctctcgtctggccggcccgggcatgcacgccttccagggcactcggtcccggcagcgccgcgtccaggcggtcgcccagctccttcagcgtgcgcgtcacgtggtcgccctccgccaggaagtcggtggcgctggcggggacctcgctgcggcggtgcgccgccagccgccccaactccaacaccacacgcgagacgcgctccacgacggcgggcggcggcgcgtcggggtgggagggggaggggcaggggcccgaggtcggcggcggcgctgatgcgctgtcgccgctgccgcccggcccagccgccacccccccggcctcccagtccgccagcccnnnnnnnnnngtgtgctggcgccgccgccgcccggcccagccgccacccccctggcctcccagtccgccagcccgccgccgcgccagatcacctcgcccagagtgcgtggcatggcggcgcgcaggaactccaggaaggtcatgcccgtcagctcctcacnnnnnnnnnnnnnnnnnnnnnnnnnnnnnnnnnnnnnnnnnnnnnnnnnnnnnnnnnnnnnnnnnnnnnnnnnnnnnnncaaaggcgccggagccgcgcaggagctgggaggcgagcacgtgatgcccctgctccagcatgacctccttggggctggagccagtctggcggggaggggagtgggatgctgggtggggtgagtggtaggctgggtgggggagggaggctctgggtgggggagggggaggagtacaaggaatctggcgggggccgtgcgggggtccctgctgcggctggcagcgnnnnnnnnnngccccctccacccccataaatccaatcacaaacctcaccgctgcgatgaggnnnnnnnnnngggagggggaggagtacaaggagtctggaggtggctgtgcgggggtccctgctgcggctggcagcgggcacaggcacggaccccatggcagccatccttcagcccagtccctggcgcaaggagggacacgcgctccgctaccgtccccagtcgcagcacatatgctcatgccagcaaagaggccgccacagctttgcaatacctatgctctacgactcttgggaaggccatgtgtctgaccgacatcgtcctgaagaacacccaccctcttccacacccactcccaccccgtaccagaccatgcatccccctccacctccataaaaccaatcacaaacctcaccgctgcgatgagggcgtccaggtcctggcgctccccactctccatcagcgggggcagggcgtggggcagggtggcctgcgccagggccgcaggggccaggcccaccgcggccgccacgcccggcagcagcgccgcctcccgtcccgcccggcaccccagcagcgccagcagcgcgggctggagcaggaggaaagcgcggccgccggcgccctgggccgcggccagggccaggaagccgcgctccg

SEQ ID NO: 47444 - DNA, 29065 bp, Chlorella protothecoides
  modified_base (111)..(243): a, c, t, g, unknown or other
  modified_base (1029)..(1174): a, c, t, g, unknown or other
  modified_base (1262)..(1271): a, c, t, g, unknown or other
  modified_base (2113)..(2122): a, c, t, g, unknown or other
  modified_base (2555)..(2564): a, c, t, g, unknown or other
  modified_base (3969)..(3978): a, c, t, g, unknown or other
  modified_base (4084)..(4093): a, c, t, g, unknown or other
  modified_base (5037)..(5046): a, c, t, g, unknown or other
  modified_base (5590)..(5599): a, c, t, g, unknown or other
  modified_base (6216)..(6225): a, c, t, g, unknown or other
  modified_base (6444)..(6453): a, c, t, g, unknown or other
  modified_base (7231)..(7240): a, c, t, g, unknown or other
  modified_base (7978)..(8035): a, c, t, g, unknown or other
  modified_base (8221)..(8230): a, c, t, g, unknown or other
  modified_base (9170)..(9179): a, c, t, g, unknown or other
  modified_base (9346)..(9585): a, c, t, g, unknown or other
  modified_base (9882)..(9891): a, c, t, g, unknown or other
  modified_base (11329)..(11338): a, c, t, g, unknown or other
  modified_base (12002)..(12011): a, c, t, g, unknown or other
  modified_base (12572)..(12581): a, c, t, g, unknown or other
  modified_base (12799)..(12920): a, c, t, g, unknown or other
  modified_base (13093)..(13102): a, c, t, g, unknown or other
  modified_base (14070)..(14127): a, c, t, g, unknown or other
  modified_base (14208)..(14217): a, c, t, g, unknown or other
  modified_base (14600)..(14609): a, c, t, g, unknown or other
  modified_base (15145)..(15154): a, c, t, g, unknown or other
  modified_base (16052)..(16061): a, c, t, g, unknown or other
  modified_base (17309)..(17318): a, c, t, g, unknown or other
  modified_base (17551)..(17560): a, c, t, g, unknown or other
  modified_base (18220)..(18229): a, c, t, g, unknown or other
  modified_base (19241)..(19250): a, c, t, g, unknown or other
  modified_base (19549)..(19558): a, c, t, g, unknown or other
  modified_base (19883)..(19892): a, c, t, g, unknown or other
  modified_base (20489)..(20586): a, c, t, g, unknown or other
  modified_base (20834)..(20843): a, c, t, g, unknown or other
  modified_base (21448)..(21457): a, c, t, g, unknown or other
  modified_base (21873)..(21882): a, c, t, g, unknown or other
  modified_base (22978)..(22987): a, c, t, g, unknown or other
  modified_base (23090)..(23122): a, c, t, g, unknown or other
  modified_base (23182)..(23414): a, c, t, g, unknown or other
  modified_base (23552)..(23561): a, c, t, g, unknown or other
  modified_base (23918)..(23927): a, c, t, g, unknown or other
  modified_base (24391)..(24400): a, c, t, g, unknown or other
  modified_base (25177)..(25186): a, c, t, g, unknown or other
  modified_base (26166)..(26175): a, c, t, g, unknown or other
  modified_base (26634)..(26643): a, c, t, g, unknown or other
  modified_base (26835)..(26844): a, c, t, g, unknown or other
  modified_base (27288)..(27297): a, c, t, g, unknown or other
  modified_base (27726)..(27735): a, c, t, g, unknown or other
  modified_base (27791)..(27800): a, c, t, g, unknown or other
  modified_base (27882)..(27891): a, c, t, g, unknown or other
  modified_base (28347)..(28356): a, c, t, g, unknown or other
cccccctccctccctccttctgcctctccctcacaccaggtcatctaccaggtggtgccggatgaggccttccagaagctgagcaccaccgggttcaagggcgccatggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgccccgcccagctcaagcgcatgttccaggacctgcgcccgcacctggcacagctcctgcgcgcgcgccgcggcggcgtggtggccgccctcctcgccggcgcccggcggctgggcacgctggaggccgacgcagccgccgcgacctgggccgccgccggcgcactgggcggcgaacacgccgggcccgtcccggccttgctctcgctggacaggcccgtccccctggcgcggctgggcccctccgcaggcacgcgcggcaagtcggggctgtcgccgctgggcacggcgctgctgatccagctgctgcagctgcctgtggaggccagcggccagtgggccgacgcgcttgcggcactgccgccagcgcagctgaggcttgtcgcgggggacgcggggggatgtcgcgtggtggagacctacctccgcgctgtgcagaagtcgggcaagaaggtgaaggccatgctggcggcgctgaggggggggtgggccttcgccgcccagggggggtcgggcgccaagtttgtccagacctgtttcgacctggcggtgaggcgaggggaggagaggcgagggggaggttgggttgaaactgatgcagaggggggagtcgggtgtggtgtatcgattccacattgctagtgcagtgaacaacatgatgaggattcgcagcactcccaacactgccacaatgtaccagaccatgcacttggcgccactgtgtcgctcatccccctcctgaccatggctgggaaaactgacagcaccatagcacaacacaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagtaggggtggcggggtgcgatttggcaaggtagtccagggcagggacaccaaaacgcatgcacgaagttggggtagccacatttgnnnnnnnnnntgaccatgcacttggcgccactgtgtcgcttatccccctcttgaccatggccggaaaaactgacagcaccatagcacaacacaatactccaggacatggacgagaagctggccattgccgaggagctgctcaaagggaggcaggccctggtgtccacgcatcatggacctcggctgcttgcatcgtaagtaggggtggcggggtacgatttggcaagagagtccagggcagggacaccaaaatgcatgcacgaagttggggtagccacatttgtcaaggtgagccatggatgtgtgccatcccatcagcagaaacctgcccctacgtgcacccatgcacaggtgccacgtggacaccctgcgcagagggagggaggcatggatgcaaagggttgccaccgccagcgtggcacggcagcagtttgcagacatatttgcatgacaccctgtattgtaagcactgtggagcagtggctgtacactgggtattcagaaccagacgggctggagtagtatgtttcactcgcagcatgcatagcatttcgaatgacccccgcatcttgaattcgggaatgcagcttgcggtgcgaggcctgcgatcgctcgtttggacaatagtgactgcgtctcaaaggatgtagatgaccgacctcatgtgatagtctccttcatcgcggtgataatcgctcctgcactcctatcccagacgtatgcctcggctgtcctcgccaaatctcctggcctaaccagacgagatctgagggtttatagacgcgcacgcgtgtccacaggagctccgatcgatactcaccgccatggtgaactcgtctgccgccgatgcannnnnnnnnngcaggagcttcgatcgatacttactgccatggtgaactcgtctgccgccgatgcagagctcaaggcccggttcccatgccgggaacgcagcatcgatgccctggctacggcagtgcagaccgggcaagcgggcgcctgtaccctgctcctgcatggccccccaagcaccggcaagaccgccatcgtcaggtcagttgctgcatacggtttcatggctggaatagcggggccttcggaagcatgccaagaccactgggggaactacaccatgcgaggactgtgggttctgtgccatgcaggacggcgaaaatgcaccagcgaccggactgtatgcttcccaacccatcccgcatatactgcacggcatgcctgagttcctgttgttaaccgagtacccatggctcccgccccacagggcgtgcatgtcggcatnnnnnnnnnntaacgacgaaaatgcaccagcgaccggactgtatggttcccaacccatcccgcgcattctgcacggcatgcctgagttcctgttggtaaccgagtacccatggttcccgccccacagggcgtgcatgtcggcatggggcatgcgccacgcgttcatcgactgcgtggcgtgcagcaccccccgccccctgctccagtcgctgctgcaccaactcaagggcggcgcaagaaagcgcggcacgggctacgcccaggaccaggactgcgactcgctggcggagctcctggtcctcctgccggccctgttccggggtcatggccgggcacccccccagcgcggtgcctgggtggtgctggacaacgcgcagcgactggccggcagcgacctgctgacggggctgacgcgcgcgggggctgccgcggacgtcccgctgtccgtcctgctcctggccaggcagccctggtccagcacggcgttcgccacctccacgcaggccctggcgccgccggccacgctggagtgggctgcctactccagcgaccagatgatccaggtgggctggatgaggactggggctgggtgcaggtggcatggacaggggttggcatgtgggagccaagtcgagacccaatgtcggggcaaggcaagcctcttgtgcaccagagggcggcgatgtccgacggcaatggggtggtgctgtgctgccccggcccacgcctctgcgcacccccccagccttggtcggcggcgtcctcaccgacccctacatccaacaacctgccgacagatcctggagcaccgaagacgcgcgacgctccccgccggcgccgccccctccggcgacgcggccaccttccgcgccttcctcaccgcgttcgtgcccacctaccgccgcgcgaccacggacctgctggaggtggaggcggcggtggcggcgctgtaccccgcattcagagcgccgctggatgcagggcgcgagcttcggcctgcgcagctccacgcgcgcgtcaaccccctggtccagcgcgtggtcgcggagcgcagccacactgcggcgccggcggccaaggaagtcgggagcggcgtgccctgcacgggggccgcacatgatgcgaccccgggctcgtcgagtggggcgccaccggcgctggcctcccagctgcccttcgtgtccaagtacctcatcctggcggcctacgtggcgtcgcgcaacaagcccaccgccgaccgcgccgtgttcgacccggggttcaggaagaaggcgcggcgcggcgcccaggcgcacgaccgcatggtgaggctcatgtgcaggagtgcgagacttggggcccgggtgtgtgatcgacggggcgtgcatgagcgcagaggatgggaccattgggaggcttcgtgtgtgtaccacagnnnnnnnnnnttcgggagcggcgtgccctgcatgggggccgcgcatgatgcgaccccaggctcgtcgagtggggcgccaccggcactggcctcccagctgcccttcgtgtccaagnnnnnnnnnngggggtgcgagactcggggcctgggtgtgtgatcgacggggcgcgcatgagcgcagaggatggggccattgggaggcttcgtgtgtgtaccacagggagtagggacactgtcaagcagagagggcgactgtgagaccgccgtgcttggaatcacaaacccatgatcgagcacccgcgcccgacccacccgcccaggtcgaggccgcagaggaggcttggctgcgggggccgcaccccttccccctggagcgctgcctgcacatattctacgcgttgtactcgagccacgagggggaggaggtgggggagggcggggcctggcacgaccccggcgcggagggaggggtcgaggactggagcgacgccaatgtgacccgggactgcttgggccaagggcgacgctcgcctggaagccagccgcggggcggcgactgcggcggggtggaccgagcggcgacctacccgcccgaggtgctgcatgccgacgtgctgatggccctgtccagcctggtcatgctgcgcatgctcagcatgagtggcggggacccgctggagccgggcacgctgtaccgatgcggggtggaggagggggtggtgcgggccatcgccgccaacctcaaggtgcagctctccgactacctgaagctggcctgaaggtggctacaagagttcagggcaccaaacctccttttcctgctgatcccctggacggccacacattgccagccgctaccctgacaactgtcagccctgtacgttcctcactccccgcattcctgaatttacatgtgtgtacaaccaaagcagcagggctgcatctgcaagaattcttcgatcgatcggaggaccaaggtggacaaagaagagcctgagcttggaggcatagacctcgcaaccatcacctcagcatatcaaaaaaattgcccaaacatagtaaaaaccannnnnnnnnntgcttggaggcatagacctcgcatccatcacctcggcatataaaaaaaattgcccaaacatagtaaaaaccatgcaccgcacaccagaccagacatgcacgtcggggaagaacaatggtttcaaggtttgggatcactccggaccagggtccagccggtacttgcttcccactccggcctcctgagccatggccctgaaggacgaggtgccacgcgacatgaggtgggccacagtgtcatactctgccaccttgccgtcctccatcaccaacacctgttggtttgagagggggggcagaagcacgcgatcagggacagcgcgaggcagcatgctgtgacgaaagaagtggatgtgccataaagaagctgtccagggcaccaatctccagttcaccagatgcacctctgaatgaaagtcaaaggtctggtacaaccaccatcagacagaaactttccccccatccgaaaggaaaaacaccaacttattcatggtacaacaaacctcatagcccacagcccaccttggtggcatccaggatggtgnnnnnnnnnntcatgaagaagctgtccaaggcaccaatctccaggtgcacctctgaatgagagtcaaaggtctgctacaaccaccatcagacagaaactttcccgccatccaaaaggaaaaacaccaactcattcatggtacaacaaacctcatagcccccagcccaccttggtggcatccaggatggtgttgatgcggtgcgcgatggtgagcacggtgcagtgccggaattcgcggcggatggtctgctggatgagtgtgtctgtctcggagtccactgaggccgtcgcctcgtccgccaccagcacctgaggctcgcgcagcaaagcgcgggccacacagaagagctggcgctggccgacggagaaattgtcgccgccctcggcaacgcgtgccgacaagccctcgggcagtgccgccacaggaccgcgcatcgccacatgggtcagggcctcccacacctcagcatcggtgtagcggtcgtacgggtccaggttggcacgcacgctgccgctgaacagcaccgggtcctggggcggtgagatgggggaggtgcgggacggggtaaacaactgcgcggcaggagtcaagcacgcaaagaatcgtgcattgcaggtgacatgggnnnnnnnnnncgggatgggggaggtgcgggatggagtgcgtaaatgcgcggcgagagtcaagcacacaaagaatcgtgcattgcaggtgacatgggatatcagcgatgcaggttaccagaaaagctccccccgatccatctggcaaactccaagcctcccaaccaagatttaatggtcctaatcacttctcgacgaaaagcacacctgagggatgacagcgatgcgggnnnnnnnnnncaccagaaaggctcccccctgatccatctggcaaaatccaagcctcccaaccaagaccttaaggtcccaatcacttctcgaagaagagcacacctgagggatgacagcgatgcgggagcggacatcattcagtcccagggacagaagatcgatgccgtccagcgcaattgagccctggtacggctcccccagcctgaagagggagacaatcaggctggacttgccgctgccggtacggccgacaatgcccaccttctcgccgggcgccacgaagaacgtcacacctggaagggggtatgcagcgggatggtgaggaggggcatcatcagtgtccagctctgggagtggatgcagcagtatggaagaggaacgggcccctcacacactcattgtgcaagtgtgggctgtaactgcccaccaaaggtgctcactacaaccgacacctctcactacgaccgacacctctcactcacccttgagcacggggcccagctctgcgcggtaccgcatccacacatcggtatactgcagcgcgcccttgtccggccaggcatcaggggccctgagcggaagcgagcatggagaggggtgagacatggcgatgcatggcatgcgattgattgctgaatcccatagatcttccccaacaccgactgtgagtcgtttcaaggactcagcaagagattgaatcgccattcatcaactgacacccccctctccctccccagcttgacatgcatggccctgatgccacttcaatgatactttatcaaccccnnnnnnnnnnagggtgagacatggcgatgcatgccctgcgattgattgctgaatcccatagatctttccctaacatcgactgtgagtcgttccaaggactcagcaagagattgaatcgccattcaccaactgacaacccccctctccctccccagcttgaaatgcatggccctaatgccacttcaatgatactttatcaaccccagcccgaccctccaccacgaaaacgcactctttcccaggcaggtaggcaggcgcctcctggggcaggtcccagtacgcaaacaggcgctccacggagttgaacctgctctcgaactgggcggcggtggtgaccaccaccttcaggaactgggtgacgctgagcgcctggctcagcgtcagcgctgcaggggtgcagggacggggtaggggctaggatgcgggagctgaggagtggaagtgagaaggagcttggacattgggacaaggagcaggggcctgcagccaggaatcattgtgaacacaggagccccaacgcgcccatcacactgggtgtggagcatcacgtcaccctgaatagctcacccatgagggccacattgatggaatttcggttgacaatggacagaatggccaccaggaagacaatgatggcgcccatgaagtccaaacgcagactgagccactcgttggccatgctgaggcaccagtatgccctatgattcgcatccacccgcccctggctgtcggctgcaaaggcgtcgcnnnnnnnnnnnnnnnnnnnnnnnnnnnnnnnnnnnnnnnnnnnnnnnnnnnnnnnnnntgagcgggaggtggcgtcctgcctctgaaattcgatgtacgagcgcctggatgagggaatggagtggcgggtgtcaacgatggtggatcgcgaggttgcagatcagggatgtggaatttctcacctcaccactagtaatgtcatgggctgcatggagtacaccagaccttttctcagatgaggtcnnnnnnnnnnatgaagatcagggatgtggaatttctcacctcgccactattaatgacattggctgcatgaagtacaccagaccttttctcagatgaggtcattcctccagggtaaactcaaactctgtcatcaatccaaacctctctatgaatctcctcaaaccctttgaacaaccccacctgtaaaacttctggatgaagtagtagacaatggtcaggggcgctatgcccaccaggatccagggctggatgaccgcgatgaagatgattgtgcccagcaggttcatcacacacgtccccagctgtgacagggacatggacagcatgaagtccatgtctcccgtatcctgcgcagcgcagaatatggacaggaggttggtatgaggaaggaaggcggagatgtctgagggaagcttgaactcggcatcaatgctcactggtaggtaggccttggacattgcagggtgaattgcatactgtgtggaggtgcgccatgtggcaaccccatgcgacgattcctcatcggtgcacctcgggcattgccctcgcaatgccgacgacctcccagccccgctcaccttggaaaaccgattcaggatgcggccaatgggggtggtgtcgaagaatgtgacgggggacctgtccagtgacaacagactccgctcatggatgagtcgggaggcggtcagggagctagccaggttggcaatggtgcgcagggtgaccaggatgacataagcaaaggcgaagcccaggtagccgccaatgtagctgatgcggctgaagtcggagggaatgcctgcaacaaggggaatgaggggttgggatgaaactctgtaatatcgcaaggagagtgaggagtttgccttgggccatgcgattgaggacgagtggggtgaactgggggtcaagatggtatcttgttcatgtttgcctggccataccgggannnnnnnnnnttatcgcaaggagggtgaggagtttgccttggccatgcgattgaggacgagtggggtggaactgggggtcaatatggtaccttgttcatgtttgcctggccataccgggacacgaaagagcagcccccaccccctgccagcaaggacaaagcagcagcaggcattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcccctcctccttgtcctccaccaccatcagcgcgccaggcatgggggcctgcgcgcattttgggagagggtgaagacatgtcatgagcgatcgcggaccagggtgacgaagggaacagagcagggaatggggagggtctgaggggcgttgggattattctgagtaggatgcgccgcggcaaacagacagactctcgccagggcagcagcatgtacggcaacgtcatccttgcgcccataccaaaacctgctccaggccctgaccggcaggcagctcacgcccccctacgtccgtnnnnnnnnnnccatccttgcacccataccaaaacccgctccaggccctgacgggcaggcagctcacgcccccctacgtccgtcccacccagcaaccatcaccttgacgtcgtgcttcttcgtggcagaggagctggagcccttggagggccggaccagcatgctgccggtgacggcaggcttggtggcctggccatgcggagggccgtcgatagcgtcctccggcgtcccctccacctcctccaacacctcctgcagcgccacctcactgcgagagacagcgcgcatcacaagctccccacttcccttcttggcaaagggggcgggctcgggggcctcctcatcagcccccgcctcagcagcgtgctcccgcaccagcccagcaaaagtggggtgcgccatgcaggtctcgtaggtgccctgcaccaccacctggccctcgtccaccacaatgatctggtcggcatggtggcagtactgcagttggttggtcaccagcagccgcgtcttgccctgtatagtgtgcggtgtgggtgcgtgcgtgtgagtgggtggggggtggggggtggggggttgattgagtattggcattgagatttgcgatgcaacctgaagatcttccacaagggaggagcagacgaggcatgcagcccaggcgtcgcagggtcctgcatgccagatagcttttcggtatccccgagcacaagtgtcgagattctgctcaaggcaaggccacgagggaggggcaagtcccaggacaaagcggtgaccatcccaagagctacaccgcacaccttgagggctcccgtgataaggttctcaaagatgtggcggcccacatggacgtccaccgccgacagggggtcatccatgatgtagacatcagcgtcctggggtgacaaagggcgggaagaggtcaggtgaagggcaacctcacgggagtgaaccagggttgaagtctttgagacagcaggcggatcatgccgggggagcggattggcctcgcacataatccccaccctgccctcacctgatacatggcccttgccagcgagacacgctgcttctgcccgcctgaaagattgatccccttctccccgatctccgtgtctgcgcctcctggcagcgtctccaggtcttgggacaggcagcatgcctgattgcgatagagtggagtggcaaggaggttggtgtcaagtcctgtgccaggctgcaacaggctagtcaaaatcattctcagcggagggcacgctactgacctgatcaagaacatagcatgctatgcagagaaacgatgataaaaactaaagccccattttcacctccattccatccccatcatccgccttggatggccggcagccaacctcccccagcacaagcatgcctccgtccagaatgtcaacctcacctccacggtagcattccacttggcctcgtcccactccnnnnnnnnnnacattctcagcagagggcacgccactgacctgatcaagaacatcgcatgctatgcagagaagcaataataaaaactaaagccccattttcatctccattccatccccatcatccgccttggatggccagcagccaacctcccccagcacacacatgcctccgtacagaatgtcaacctcacctccacagtagcattccacttggcctcgtcccactcctttccaaaagacacattctccttgacagaggcgttaatgatccaggcctgctgcgcaacatatgccatcgagccacccacctattaggtagtggggggtgttggtttgacagaccagccctgagcatctaatataaacttgtgacattgcacactcctaaggaacaacttttgtgtgagctgaaatgccagaggctgacatcacccctcaccagacccatcacgcccatcaccatcctcaccctgacatgccctgtctccttgtccatctccccaaggatggcctgcaccagggacgacttgcccatgcccacgcgtccaacgcagcagaccaactccccaggcttgatctgaattgggttggtggcataaagggtaaaaagggttaaacagccattggcacaaacatgccaaggctggctgatattctacccacaggctctcaannnnnnnnnnggatctgagtcaggtgggttggagagcatcagggtgtgtaattgagccatcaactccactaggcttggacaagttgggactcttcctcaggggaccgtcatgtatgaactcgtcagcagtgacaaggagcagacggccatcatgctcctcacatcacattccagtactattcctcttctttccccctacccctgctaactcctgctccctggcctccccaaccaacccccagccaaagcacccaggtacctggagggagatgtcccgcagccagaacagagcgtccttctggcccctgttggctgcctcttccccatcggcaggcttggagggcaccactatgccgtccaccatgacatcagtggcaggcagaggctggcctttagtaatcacgggcgtgatcttccctaagtcggcggcagaggatatgctgctggcgtccagcccgccatcagcagaatgtgcagaatcttgggcaagcccttccgcgcccttcatcggcgcgtcgcccagcttctcgtcctcgtccctcctccccttcttcttcttcttgccctgctnnnnnnnnnnatgccatccacaaccaggtcggtggcgggcagaggctgacctttggccaccacgggcgtggctgcccccgagtcgggggcggaggattcgctgctagcgcccaacccgccgtcagcggattgtgcagactccttggccaagccattggcgccctttactggtgcattgcccttcccgttcttgtccttcctccccttcttcttcttcttgccctgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcaagaagatgagggggaagcgcatgagcccgaacctgttttggagggagtaatgaagggggttggtgattgagagaattcttggggacctgagcgctgttcacaatcatgtgattgacctaggagccatgcaaagcagagtcaacagcaacagcatctccacggcaatannnnnnnnnngttggtgattgagagaagtcttggggacctgagcgctgttcatattcagtgattgacctaggagccatgcaaagcagggtcaacagcaacagcatctccacggcaataatatacccttgccatccccatgcccttacagtgcaatgctggtaaagatggccgcgggcgtgaagccgtcgggcgatgtggcgccatacgcagagaagcaggcgaccatggcaagggcgggggcggagaagagcagacactgcatggccgcgcggtaggggatggccttgcgcagctgccaaagctcgtccttcctcacctccatgatctacgcaaatgtcaggggtagaaccgggaagggacaggggtgaagggctggagagacataggggaacatggccaaggcgaggaaacgcttattcagacacccatgcctgacagcaagtcattacatatgccagcagggcatgcaaaacccctaattcaccccagcccatctcaccgcagcctcctgagccgcctcccaggcatacatcttgagcaccctgatgccgacgagcagctgattcatcagcttcactctctgaagaggggaagggggtgggaaggaggacgtgagtcgctgagcaagcagagcatgcacagggggaggtgcaattggggggcatgcaatgcagaccctggtgtccatgcccacactgacagagtgaatcacctcagcttgacttgcccattccgagatgacctcccgggagcacagggtagtctggccacatcccaaggcctgaggcttaatgctcctgactggccttgtacccatggccagcatgaacaacaatctggtgcccccccacacacacaacaattcagctgaccttgtcagtgtacttgagcatctcgcggcggtaggcagacagcttggccacaaagatgccagtgagcggggtggaaaccaggaggatggcaagaccgatgaaggnnnnnnnnnnnnnnnnnnnnnnnnnnnnnnnnnnnnnnnnnnnnnnnnnnnnnnnnnnataggtgaagatgggggtttggcaaggggggtggatatgaaaggagggaataggatgctgaagggtgacgggcgacggtgnnnnnnnnnncatctgcagctggttcacatcagccgacatcagattgacgatgcgcccagtgtcagactgctggcgggctctgcaatagtcgtgcaggaggtgaagatgggggtttggcaaggagggtggatatgaaaggaggagtaggatgctgaagggtgacgggcgacggtgatgatctgcttttgccatgcatatcttgccctttgaagggcctgcactgtcgattttgagccagcgcacattactctgacaattccatcaagcaacagccatcagcacttcccttcacggggttccgagctcacacatccctccaaccatcaagtccctccccatcgattttgtcacaccctcaatccataagcaagcacctgttgctcaggcgcagnnnnnnnnnncattttgagctagcgcacattactctgacaattgcatcaagcaacagccatcagcacttccattcacgaggttccgagctcacacaatcctcccaactatcaactccctcccccttgattttgtcacaccctcaattcataagcaagcacctgttgctcaggcgcagggccttggcgtagatggcagcattcagctccgcgcggatgatgacctgggtgccgatactgactcgattggccatgccattgatgagcgtgccgacgacaggcgccaggaacatgcccatggcgtacaggtatgcctgcttcaggccctctgcatcctgcagcgcctcgggcgtctgcaggaagcgcacgatcttgttcagcagcagcgggccagcgaatgtggtagcagaatagagcagctggatgctgagcgcgacgctgacccgcacccagtgcaggcggatgaagttggtgagcatgaaggccgtgctgcgccccagccgtgagtcctcgagccggcgctgacccttgggcccgccgtctcgtgnnnnnnnnnnggcctgcttcaggccctctgcatcctgctgcgcctcgggcgtctgcaggaagaccacgatcctgttcagcagcagtgggccagcgaatgtggtagcggaatagagcagctggatgctgagtgcggcgctgacccgcacccagtgcaggcggataaagttgatcatcatgaaggctgagctgcgccccagccgcgagtcctcgagcaggcgctgacccttgggcccgccgtctcgtgcctcgcggaccagccgattccagccggcggtgtagggcgggaagacggccgccgtggtgagctcctcggggatgacgaacaggtcctcgaactggagggggcgccgccagccctgtgcaataggagcaatatggccacaggtcagggagggggtccaggcggaagctgcttgcactccaccccacacatggccccgaaccctccccacatgcacgcccatgcgagaggcgcaccagcaagaggaggggtgtgaaccatgagaacagcagatagctcagcggattcttgcgcagtgggacaggcactcggggtgggggaggggggcccccgtcatgaaccgcagcctccttgtccaccgccgcatcgttgccatcagacttccgcttgtggaaccaagattttattcccatggtatgatgattctgttaattgcccgtgtcgccctggtctagaggaagatgtgtccccgggtgacgtgcgtgggggtgtctctgggtgacgaactacttcgccgatacatgctcgtagtgtgggatcggcagacacatccccgccaattgtaaatgtgtgatattaaaatgtctaaatggagccaagaaggaatagccattttctggaatcatcgttcatcattgtccacacacctgtggccgggggggggnnnnnnnnnnacgtaggtgggatgcggcaacgggtcaaagggaggtgactccctgggcgaggtgattgcaatcaacaagtactccggtcaccggtcaccggccccaaccctgggcctcacttcggaccatgaaaccctaacctatagacgtaccagcactaggaggggcgtgaaccatgagtacaatacgtaactcagcgggttcttgcgcaacggaacgggctctcgtggtgcaggaggggggcccttgtcctgcacctcagtcttctcatcttccgccgcatcgtcgccgccagacgtccgcttgtggaaccaaagatttttcttcatggatttaggactgggtatgtgccctcgtcgcccttttctagaggagaatgtgtctcggcgtaacgtactagcagggtgcgtgtctggatgagagtctaccgggccgatgcatgttcctgctgaagaatcagcaagcacatcctcgccactcgtaaatgtccgacatgcggaagaacaacggcgccaaaaaggtatggtcctgtctgaagtatcttcgttcacaatggggcggccggagctcgaccgctagcctgcggccggagttgcacgaaggtgtgtgctactgaacgtcgcgcgtcatgcacaacactcatccccagggtcgaagttcccagtctctaatggcccagctgcttgagcacctccctctgtgtgtgcatcgtggccgcctccggcaccgcctccagtgtcaccagcggacattcatcatcccccccccgccatgggtcgcaatacctctggctggttgtgtatacatgcgccacttactgcactgtaagaccttatcctctccagtagtatgatcagtgactgaccaggtcaattccctcgggatctgatggacaaactgaaagccttgtgccgccacggcatctctatcctgctgtcacagggatcagatatgaccattcctttacgaagattatgagcgattcatacatcaggtggcgcatcctgacaatacaattcagagagtctcatcaaggtatgttctcaccacttcatctccaaggacaaaatgtggcgacgacgatgaccttgcaagcttgcatagttttactctgggccacatatcaagcattctcgacagggatgcctgggaccgttttgccatgtacaggagcgcagtgcccttccgatgccctggtgagagtggggggcgcgacacaaaacaaaaccgccagcaccttgcctgaggacacagcannnnnnnnnnggtgtagatatgtgtagatatgtgaatgtgagagtggggggcgcgacacagaacaataccgccagcaccttgcctgaggacacagcacggtccttgtcacccgccgttgcaagtagtagaaggatgatgtacctgtcttgagcctgaggatggctgcctcctaggccgttgcggctgttcccgagaatgccatgggtgtttcggagcagaccaagggcttgatcctggcaatnnnnnnnnnncgcggctgttcccgagtatgccatggagcagaccaagggcttgatcctggcaataagctcctctgtgttcatcggttccagtttcatcgtgaaaaagaagggactgcgtcgtgctggggcctcgggcctccgggcaggtgtgtgacggggccagagtgatctcgacagcagcctcagacgcccgcactgccccaccctccaccatcgcggtgcgacgaccggtacgccctcctacaacagggagtgggggttactcctacctctacgaaccgctatggtgggccggattcctgagtatggtggttggggagctggccaactttgcagcatatgcctttgccccagccatcctcgtcacccctctgggagcgctgagcatcctcgtcaggtgtgtggggggattcgggggcttgctcgtggacgggcaggccgcaggggaaggtgctgggtgctggggacctgggcggcaggcacagctgtttcaaggccagggtctagcgagctaggggccagtccctgcaggagtggagtcatgttgcacgctgaagcaacgacagtggcaccctgctgacgcccctgcccaaccccaccctcaacacatcccccctaacagcgccgtcctggcacattttctgctgaacgagcgactgaacgggtttnnnnnnnnnngtccccactgacagcgccgtcctggcacactttctgctgaacgagcgactgaacgggtttggggcgatgggctgcatactctgcgtcacaggatctctggccatcatcctgcatgcccccgaggagcaggtctttgagtccattcctcaggtctgggcgctcgtggtccagccaggtagggtatgttgctttgaggggaagggggggggggcacatagtaggggggttggagtgggaggggagggggttgtgagagtatgggatggtgagtccaaaattgggatcctgaccagccccacccccccttcccaaatccctccacccacccacacccatgccaacctcctcccaggcttcctgctgtatgccgcaagtgcggtggcggcgactctgctcctcatcttccgcgtgccgcccgacgtggctgccagcaacccgctggtccccatcgccatctgctccgcggtgggcagcctgtcggtgatggcctgcaaggcgctgggcctggcggtgcgcctgaccctggccggctccagccagctgggccaccccgccacctgggcctttgccgccacggtggtggtcgcggtgctgacgcagatggcgtacctgaaccgcgcgctggacctgcacagcaccgccctggtcacgccgctgtactacgcgggcttcacctcgctgaccctcctcgcctccgccgtgctcttcggccaggcggcgggcggcgtggccgccgccagccaggcctcgggcttcctcaccatcctgtgcgggacgacgctgctgcacgccacgcgcgacgccgacctggccgcgctggcgccgctgctgggcctcgcccgccgcgcgggggaggaccagcccgccgtggagctggccaaggacgcgcgggtgtgaggcggggggcggggccaggggccgaggcgacggcggcagcgcccttggctggcatgcgaggggtccccatgttaccccaccccgcccgcccgccggcggcataccttccaggcgnnnnnnnnnntgacggcggcagcgccctcggctggcccgcgaggggtccccatgtcaccccaccccaccccgcccgccggcggcataccttccaggcgactgcctcgcgatctaccaccccacgatgcgctgggcagggccacgcccgaggtggcttgcaaagcctgccccactccacctcccagaatccattgcccacactcccatccaactccttcccccccttgtcatcaccattgaatcgccttgccgcatcctctatcagcccctccctcgctgccctgtcaacagagggattctcacaatagnnnnnnnnnnactgggcagggccacgcccgagttggcttgcaaagcctgctccactccacctcccagaatccattgcccaaactcccatccaactccttctcccccttgttatcaccattgaagcgccttgccgcatcctctatcagccccttcctcgcggccctgtcaacagagggattctcacaatagtgtacaggaagaaattcggtgtctggaggaagaccgcgggctgcagccctggtcctgaggatgtgcaagggccgcagaccggcgccctcatcaagccctctggcgacgcgtggtcgggcccgagcccgacaccgccgcccagccnnnnnnnnnnaaagaccgcgggctgcagccctggtccagaggatgtgaaagggccgcagaccaccgccctcatcaagccctctgacgatgcgtggccgggcccgagcccgacaccgccgcccagcctgcatcccgctctgcgagggagtcgggtgtgagacttgagaggttgagggcctgcccactgggccccggcatctgctttttggagcggcaggagtgggcatgactgcgaaaccagggcgacagaggggcagcacctcaccagcggcaacctgagccccccacccaccatgcgcggcgatggcggcccgcaggctgccgctgccgtgcgagagatagtacagcgcggtgaagcgatccacgcgcagactgcgctccagcatgcccaccagcttctcgctggcccccgcgcgcggtgcgggggcgccggcggggcgtgcggagcgcgcgtccggcgcaaaggccacgacaaagcggcggccaacgtgctggcagcgcacgaaggcggcggtacagcctcgtaccgccgccacgtcctccactgcaggggttgcgggggttgtgtgtgtgggggggtttggggggggggggaaattgggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggaagatgttgatatcaggagccgcttgccaggcagctcctcaaaacccttcccgctcgctaagaaagctttctccccccccacaaacaatatacctgggatgaagaggtgagtacggcacgcagcacctgcatcatccatcaggttgttgcagcgccgcagcacggcggcctcgcagtcgtagcgcagcgccacggaggccagggtctcgtgggggcccagctcgtggcgccaggcgaagtggcgnnnnnnnnnnttgctcagggagtccgcggccgccttcagccggcgctgggtggcctgggggagtgggagggggggggagggggcatgtcatcgccccagagcattgtttgtgtgggtggaatgaggaccacaggaggctgcagcgcaccctccaccgctgccggcgctgcagccatgtgggcgcagacatggcacgagatgctcgcgcgcacgccgcacaggaccccccagagaggcccggctcttctcaccctgacgttcagcaggtcggtgtcggacaggttgtgtaggatggagcctaccagaggatcaggcaggccgtccagactctcccgcattatgcgggcgagagcccctgactcgagtcaaggggtctgacgggacctctgctagtcaatcctagaattgactcaacaacagactgatgtcaggaccggggcaggggtcccggagatatctgtggcttgagccaagctccgacagcaattcatgagcccttcacaggaccctcatgcagtggtccagattatccatcagagagttcgtgaatggctcttactccacatgcgatgtgacctggcggtatgcaggcgatgtttgcgattgcgagcatgnnnnnnnnnnacccctcatgcagtggtccaaattatccatcacagagttcgtgaatggctctcactccacatgcgatgtgacctggcgggatgcaggcgatgtttgcgattgcgagcatgtcgggagtcctccgccattgccggagcgcgcgatttccaggtcgagcaggggagtgtgatctcaaatcttcatcgcctttaaaaacaggcatacataggagacagtgatgcttcagtcatgaggatgttgcatggcgtgtattggctgccagcatatccattggcgcactgtatgccctcccactgacgcccatgtcgccgtcttacaatcggctcttctcactcctgtcgtcacttgcttgcatagaatacatgtatcatggtggatagaagtcgaacatcaagtctgtcactctgatatgcaannnnnnnnnngatagaatacatgtatcatggtagatagaattggaacatcaagtctgtcactctgatatgcaaggaactcgctgggcggtgggcaaccctcatgcgtgccgcccagccctaactgccacaccgcgtagttggcacagggaaagggtgtgctgccatgctgagcgcccacttcaagagggcttgcaggctctgcacagagagatgagcttgctgcaggccgccagtgggcggtgaggtggggttgtgggcatgttggcctcatgggtggaactggtgcatgggtatgctgtatcacccaccttcgactgacaccaaacaaattgctgatgacccctgcttccctccgtatggcaggcatggcctgacaacacactcctccaacctacttcccatcgacccactccctgcgacgcgcctgctcttgcaagaagcgcagtcccacttccaaagccacaagtcttcctccgggataccgcatgggccagacactttggcgctgtgcacattttggtgctacgccgcgctgtgcctgcgcaacgtcgcggctttggcagcgcgatctcccgaggccgacgagctggcggccgcatgctgcgccctgctgcgccgccgctgcgccgaccgcgctcaggcgcccgacgccgccggcttgaaggaggcggcggagatcctggacgcgctggccgcctacctgggcggcaggccgcgtgccgggtggggtagggttctggctgccgagctggcccccgcactcgacgccgtggcggggctcgcctgccgccaggccagggaacgcgccctcgaccccagccacgccgcggtcatcgttgcagcgctggcccgcctgcggcacgactccgtggcggtgccgcccctgctcggcgcggcggggagggcgctggtgcgggtcggcgacgggccgcgccccagcgtgcgcagcgtgctcctcgtcctgcggggccacctggcgatgggctatgcgccctcgcccatactgctctatgcactgcagcccatggtctcggatgcactggttgcgagagagggggcggggcggggcggggacggcgagatggagacagaggaggagggcggnnnnnnnnnngctgctctatgcactacagcccatgctctcggatgcgctggttgcgagagagggggcgcggcggggcggaagcggcgagatggagacagaggaggagggcggnnnnnnnnnnnnnnnnnnnnnnnnnnnnnnnnncagctgaggatgacgacaaggggcgcggcgggcgaggtcgagtgacgcgcgagggggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactgaccaagcacatatcacactgatcgttgctcttcgcgccgtcctaccccttgatcacggcgatgggcctcagcttgaccgtcttcttggagatgcctgcctgatggcacgtctcgatcacgtcgtccacatccnnnnnnnnnnaggggagggaacggatgaggaggcgaggagcgctgcggcactggtggagctgctcgccgagctggacgtcctcgtggggcggcagggcaggggccttgctgcgtagctgaggatgacgacaaggggcgaggtcgagtgacgcgcgagggggcgagtatgcatgctgaccaatgcccatcgacgactacatgcggcaattgcaccgcgcctcacaggtggatcacgggcagggcacccggtctgcatggttcctgggtgcctctttgagagtacacaaacaatctggcatgctgtttcttcctgccagagtgagcgggcggcatgcgggtgccctggtaaaagcgcgacgcaagcagnnnnnnnnnncacaaaaacaatctggcatgccgtgtcatcctgccagagtgagcgggcggcatgcaggtgccctggtaaaagcgcgacgcaagcagaatcttccactgaccaagcacatatcacactgctcattactcctcgcgccgtcctaccccttgatcacggcaatgggcctcaacttgaccgtcttcttggagatgcctgcctggtggcacgtctcgatcacgtcgtccacatccttgtaggactccggcgcctcctccatcaccagctttgggctgccgggagggtttgaagggggggggtgagggctgttgaagaggatgacaggggatgagggcaagatgccctccgtgacatgttaatgggatcttgccgtcaccctgtcctgattatgcgggggggaggggccctcaagcaccaggtgcctgaccacccttagagcctacagtgccacacaagtcaccccattnnnnnnnnnngtatgggatcttactgtcaccccgtcctgatcatccggggggggtgccctgtagcaccaggtgcctgaccatccctacagcctacagtgccacacaagtcaccccatttccccccaaacccactcaaccccccaccccacaccgcccacctcgccacgcggatggcaatgcccttggtcttcagcgaatccagaacctgctggtagtccagcttgttgcgcgcggcgttccggctgcgcgcgcgacccgcgccgtggcaggtgctgccccaggtctcggccatgcccttgtccgtccccgtcagcacgtagctggcggtgcccatggtgccgccgatgagcacgggctgccccgtcagctggtagtccacggggatgagcgggtggtggggcgggaaggcgcgcgtcgcccccttgcgatgcaccagcaggctcttcatccgcccgtccaccatgtgctcctccacctgcggggatggggtgtggagttcatagttttggagatgcagaggtgcatggagaggagggtggagagcagcgaatcagcgactggatggccaatccaggtagattacagaagctgcagctaccaattctggcagctgcagcgagaaagagagagggaggcagaaccttcgggagcccctggctcgatatgaatccgtcgccgtcccgcttttccgctttccccccctccccccaataaccacccacccaatcaccttggcgatgttgtgggagacgtcatagacgacgtgcatgtccaggtcgtcgggcnnnnnnnnnngggagctgcagccaccagttctggcggctgcagcgagaaagagagagggaggcagaagtttcgggagcccctggctcggtaccgatccgacgccgccccgctttcccgcttcccccccctgcccccaataaccacccacccgatcaccttggcgatgttgtgggagacgtcgtagacgacgtgcatgtccaggtcgtcgggcgtggcgtcaaacatcttggcaaaggcctggcggcacaggaaggtcatggaggagcggttgacccaggcgaagttggcggcgcaggccatggcggccaggtagtcctggccctcctgggaggcgatgcgcgcgcaggccagctggcggtcgttgaccgggatgccgtcgcgcgccatggcgcgctccatggccaccagcgcgtcggtggccacctggtggcccagcccgcgagacccggagtggatcatgacgcagacctggcccacggcgtcgatgcccatcttgcgcgccgccgcgcggtcgaacacggcgtccaccacctggatctccgcgtagtggttgcccgcgcccagcgtgcccatctggggcaggccgcgcttcttggcgcggggggatacccgggacgggtccgcgcccagcatgcgccctgcctcctcgcagtgctccttgtcctccgcccatgcgtacccctctcgcaggctccagtccatgcccagctccagcgcccccgccaggtcgcgggaggtggtggggatgatgccctgggaacccacgcccacggggatgtggtcgaacagggcctgcgccagctgctccttcacgcccagcacgtcctcctcgcgcaggttggtgcgcagcaggcgcactccgcagctggattcaggggttttggtgggggctgatgttgtgtgcgatactgagatgaggcagggagggtgttgatgatgccattgcttccatgaatcccgcactcgcagtccaattccatctccagcannnnnnnnnngccgcagctggatttagggtttttggtgggggctgatgttgtgtgtgatactgagatgaggcagggagggtgttaatgatgccatcgcttccatgaatcacgcactcgcagtccaattccatctccagcagtccccagaaccttccttcctccaccgacaacacaactcacttgatgtcaaagccgacgccgccaggggagacgacggcctccgggtccgacatgtcaaacgcggccacattgccgatgctgaagccatagccggaatgcacatcgggcatggcgatggagtgctgcagggggcgagggatgagagagggtggtgaggatgggtggagggacttggttttccagcaaggtcaaggcagttgggcgatcatacaagctgctgcggtcccaacgcatcccattcgcgcccggcctccacattccattgaaacaggcatggcaaaaatgcannnnnnnnnnaatcatacaagctgctgcggtcccaacgcaccccattcgcgcccggcctccccgttccattgaaacaggcatggcaaaaatgcagaactgaaaccaaagtcccgcaggacggggcatgcaattgagaaccacccctcctcaccctgacaatgccggggagcgctgccacgttggcaatctgcttgacggccnnnnnnnnnnaacggggcatgcagttgagaaccgcccctccgcaccctgacaatgccggggagggctgccacgttggcaatctgcttgacggccggcaggaagccgccggcggggccacgatcgcagtaggcccgcagctcgtcgtccaggatgctgcgcagtgcgccgttcacataaaagatgccgggaaccctcatgttgggcacgaaccccgtctcgatgcggtgatggtaggggctgagcttggtgatgaaggccgactcctggtagtggggaggggagagagggcagtgggtgtgcagccgctcagggtccaaccaggggatcgagtgcgcccccctgacttgcatggtgcacattttcatagcttgacatcacacagtggtgctattcagtgcaacccaggatctgcacaccattcgtcggccccacctcctcatatgtccggcgggnnnnnnnnnngtcgagtgcggcaccctgacgtgcatggcgcacattctcatagcttgacatcacacagtggtgttattcagtgcaacccaggatgtacacaccatccctcggccccacctcctcatatgtccggcgggtaggggagggcgcgccctcattcaccatgacgacgaaggcaaaaggctctcaaccagggatatgagttgggagaatccaaagtctacatgcgccagagaccgacaagcatctgcagtgcgcgagactccctgctgtagtttccgaggtcccggggcaggttccgcactacgagcttttacgcgtgtcagcagggctccctcccagcggcgcctcacgatgtaatgtatcgtgtaaatatatttattttatcctctaatctggccagtatagttttcgtggttgcgaagggtcaccgtgcannnnnnnnnncttatcctcttatcgggccagtattgttttcgtggttgcgaagggtcaccgtgcannnnnnnnnnacaccaagctcaaatgtcaaatcgaacgatgcgtatctacctgacgtcgactctgcacccctaagccggtgctgttggcgtnnnnnnnnnntgcgcacgatcctctgtgctggcgcgcgcgctcaaacgacctgaagggcagggagccttcaaaaaatgccggaagccctgcgcttcccactgttgcccaggataactcgtcgtgactacctgcaccaagctcaaatgtcaaatcgtacgatgcgtgtctacctatcatcgaatctgcacccctaagccggtgctgttggcgtgtagctccgctccgctcctcctcctcgagcaggccccccgtgacatacgctgggggagtgcggtttccagctgtcataatctacacggcacctacttcagcatgcgcgtcgaccctccaccccccggactgtttcatctggcccataccgcagacgggtgagttggggggaacgggcttttcggcagtacagctagggtccaatccgagagcgtgggactgcaactcgggttctcacttccttttgagacatgnnnnnnnnnnggaccctccacccccgggactgtttcatctggcccatactgcggacgggtgggttgggggggacgggcttttcggcagtacagcaagggtccaatccgagagcgtgggactgcgactcgggttctcacttccttttgagacatggagacggtgctcgcaagggcatgctacccattcgaatgcaaacctctcctccaacgaatgtgatgcatcggccacctcacaacaacacctgtcctgcaccttgccgtgcttcaatattcactccctccgcacaccctccccctccctcacccccctgtcaggctggagatcagtaccgacccgcgcggcttccccgcccccctgcgcagcctgcaggccggggcggaggccatgcgccgcgcccgggagctgtggggcatgtggcgccggcccgcggcagcgcgcggggaggaggactgggtggacatccccctgccccgcctcatccggcggaccacgctggagcgccggctggtccccgcccgccccgaggccctgcccggcgaggccgctgccgctgccgcgcatgccaaggcgctggccaaggtccgcagcgcggcgcagcgtgccgccaagctggcggccgccgcggggctggacttcgagcccccgcccggcctggggcagggcgagatgccgggcgccttccccaagctcgacgtgtgtgcggtggaggcggcggccg

SEQ ID NO: 47445 - DNA, 61 bp, Chlorella protothecoides
aaggtgggcggccccagccgcgtcacgacgtcctggggggagtcccctagctccacgcagg

SEQ ID NO: 47446 - DNA, 61 bp, Chlorella protothecoides
gacctcacggcggctgagaccgtggcgggggacaggccgttccccggctctcagccagtga

SEQ ID NO: 47447 - DNA, 61 bp, Chlorella protothecoides
agcgcctcgtcaggaagaggcggcggcgggggcgggacgctggaggtcattcctgaccttg

SEQ ID NO: 47448 - DNA, 61 bp, Chlorella protothecoides
agctgagtacgccgcctagggagcggctggggggccgccgcgatgcgatccacggcctggt

SEQ ID NO: 47449 - DNA, 9563 bp, Chlorella protothecoides
  modified_base (301)..(310): a, c, t, g, unknown or other
  modified_base (843)..(852): a, c, t, g, unknown or other
  modified_base (1264)..(1273): a, c, t, g, unknown or other
  modified_base (1349)..(1358): a, c, t, g, unknown or other
  modified_base (1507)..(1561): a, c, t, g, unknown or other
  modified_base (1706)..(1715): a, c, t, g, unknown or other
  modified_base (2606)..(2648): a, c, t, g, unknown or other
  modified_base (3466)..(3475): a, c, t, g, unknown or other
  modified_base (3551)..(3560): a, c, t, g, unknown or other
  modified_base (3612)..(3621): a, c, t, g, unknown or other
  modified_base (3688)..(3697): a, c, t, g, unknown or other
  modified_base (4388)..(4397): a, c, t, g, unknown or other
  modified_base (4682)..(4735): a, c, t, g, unknown or other
  modified_base (5566)..(5575): a, c, t, g, unknown or other
  modified_base (6945)..(6954): a, c, t, g, unknown or other
  modified_base (7319)..(7328): a, c, t, g, unknown or other
  modified_base (7679)..(7688): a, c, t, g, unknown or other
  modified_base (8419)..(8428): a, c, t, g, unknown or other
  modified_base (9255)..(9264): a, c, t, g, unknown or other
  modified_base (9362)..(9373): a, c, t, g, unknown or other
cgacgccgagcgcgagcgcgacgccgcgcgcgccgaggcggcggccgcggcggcgcgcgtggacgacctgtcccgcaagttcgcgctggccaagaagaagatcgcggtgggggccggcgccgcgcgcaccgcgcaggaccgcatcgccgagctggaggcggagctcgcggcggcgcaggcggggggggagcgtttcgaccccgccgaagtccgggccaggtgggcgtgttcagggttggggtgtgggcagggcgacactggaatgggtcaagcctggcacggtggcagggcctgagccggnnnnnnnnnngagcgtgtcgaccccgccgaactccgggccaggtgggcgaggttcagggttggggtgtggggagggcgacactggaatgggtcgagcctggcacggtggcagggcctgagccggacccccccgggaaaaccgaatggggttttcgggggctggggctgccatgtcggcaggacgccccacccgtccttaccctcccgcgcacacctttccccctcttccacagggatgcggagctggagtcgctgcgggggcagctccaggacgcgcaggcgatgctggtgggtggaaaacaagggatcaagggggggttggggacgggggagaagggaggcactgcgcagcctggccaatcgatgggcgcggcgtgtgcgtggagcaggctgcagagggttgccgaggctcgtgtgtgtgtgcggaggcttgcatgggcgcgccagggcagcgctgcacgccgatgagtttgtgtgaagacggcatgggcccccctgcccccccgacgggaggggggggtcctctggcgcatcgcctttgcnnnnnnnnnnacggcgctgcacgccgatgagcttgtgtgaagacggcatgggcccattcccccaccgacgggaggggggggggtcctctggcgcatcgcctttgccccgccggccatccttgcgtggtcaggcccccgggtgcatgcacacaagcaagcaaacccacgcatgccccacccccaccatgcagagccagctgggccagggtcagacggcgatggaggaggagctggcccgcctgcggcagcagcatgcccaggtgcggtgccgtgagagtgtcgatgcaggctggtgtctggcagccggcccggccgaaggcatgtacctgctgggcgtacagccggcggcccgtgacacctctggttgacagctcctgagtgtccctcggcgtcccaaccctctttccaggaactggaggatnnnnnnnnnntggtgcatacacacaaacaaacacacccacgcatgccccacccctccatgcagagccagctgggccagggtcagannnnnnnnnntgtgagagtgttaatgcaggctggtgcctggcggccgggccggaggcatgtacctgctgggcgtacagccggcggcccgtgacacgtctggtgcacagctcccgagtgtccctcaacatcccaaccctctttccaggaactggaggatnnnnnnnnnnnnnnnnnnnnnnnnnnnnnnnnnnnnnnnnnnnnnnnnnnnnnnnccggggggcggggtggcccaggtcggactcttggagctgaccccggccctgtcggtggctccccagacacagctgtcatggtccgacggggtgttgggcacgctcatccccgaggctcatggcctcgaaatcaagctcaggcccnnnnnnnnnnctggacgccgagaacctgaagctgatggacctgctggagagcaagacggtgggccgagtgggggggcggggtggcccaggttggactcttggagctgacccggccctgtcggtcgttccccaaacacagctgtcatggtcctacagggtcttgggcacgagcatctccgacgctcatggcctcgaaatcaagctcaggcccaccggcatctgccccacttgctccacaggaggccgcggccgaggcggccgccgaggccgaggcggcgcgcgccgagctggcgggggtccaggcagccgccgaagcgcggctggcgcaggcccaggccgagatggaggcctggcgtgtggccgcggaggccacttctcgtgaagagatcacggggctgcgcgaggaagcggagagcctgcgcgcggaggaggcgagcctgcgcgcggaggccgaggcgctgcgtgaggaagcgcagggcctgcagtcccacctgatcgcgacggaggccgagctgcgggccctggagacggagcgcgaggagctgcgttctcggctcgaggaggccgagcgcgcgctgggggaggcgcggcgcgagctggaggagcggggcggggcggcggatccagaaaccgtgcgcgagctggaaagcgcgcgcgcgcaggtgcacgggctgggcgcgcagctgctggagatgcagggcgcgctggaggcggccgaggtgggggtggcggggcctgcaggggagcgcgtggcggcgctggaggccgaggtggaggcccagcgtgcggagcgcgccgacctgcacgccatgctggaatcgctgcgtgcggagctggccgcggcagaggaggcggccgcgacggcggcggcggatgcggcggggggcggccccgcggcggnnnnnnnnnnnnnnnnnnnnnnnnnnnnnnnnnnnnnnnnnnncggcggccgacgacctcaagcgccacaagctgcagctgatcaaggccaaaaaggcgcgcgccgccgacgcggagcgcatcgccgagctgacgcggcgctgcgaggtggccgaggccgccgctcttggtgcggcggcaggaggcccagaggccgccctggagctggaaggcgtccggcaccagctcgccgaggcgcgggaggaggcgctggaggccatgtcggtggcggaacgcgccatcgccgacctagacgccgcggccggggagaaggccggggccgaggcacgggtggcaggggccgaggcgaagacgagagaggcggaggccagggctgcggaggcagaggccagggcgagagaggcggaggccagggctgctgaagccgaggccgcgcttgcgagggccgcgggccaagcggcagccaccacccctgcggctgccccggccgacgacgtcgccgctcagatcgcggaggccgaggagcagcttgcagactgtctgacctccctcggccaggaggaggccaaggtgagagaagggttggagcccggggctgccgtgcacgaggacctcacatgctcgtgggatggtgtgttgactgtgaggttgccttgcaaccttcctcaccgtgcccaaccctttcactctgcctccgcaggtgcaagccctggtccaggccttggtagaccggggagcggatccggcgtgggtcgaggccacgctggcggccgtggaggaggaggcaggctggggcggcgacgaggccacgcagggcgaggacgcgccgagcgcgccccaggaggcgtggtcgcccgatgnnnnnnnnnngagggttggaccccggggctgctgtgcgcaaggacctcacatgcccgtgggatggtgtgttgactgtggggttgcnnnnnnnnnncagccgcagccttacgaggcgcaaggctgcgatccgcaggcctaccaggcgnnnnnnnnnnaggcagccgcgctgcggtcgggatctggagctgcagccccctggcacggagagagtgtgccagacgnnnnnnnnnncggcagccgcgctgcagtcggaatctggagctgcacccccctggcacggagagagtgtgccagacgagccggagccgctggcttgtgaggcacaaggctttgagcgccagccttacgaggcacaaggctgcgatccgcaggcctaccaggcgccgcaggtccacgagccagagccggagggctctcctgtggatgcacaagcctccgaggctgtgctcccagagcaacatgcacccgtgttccactatggagcaggggaggaggctgagcagccagtttatgttgcccaggatgctgagacggcgtggaccgcctccaacagtttctgcggctgggacggtgacgaggacgtgaccgcagacgagggcctgcccccacccctgcccttccacaacaacgcccagcctgagagcgactggggcgcagcatcctcgtcaaccgctgtcggcgagatggcggcgggcggcatgggctgtccccctcaggaggacgccgccttcttcgaggacattgcactcgacggcaaccctggctggcagcagggcggctggaacgacgacgacgacgtctttgcttgaccaaggagggttgccaggcctgcaccctgcgatgcatctcctattgtgcttcaacaccatctcttcccgtccatttcctcaatattgtgacatgatcttgcagctgcagaacnnnnnnnnnnacatctcctattctggttcaacaccatctcttcccgtccatgtcctcattattgtgacatgatcttgcagctgcagaacacgagtggtctggagggtgccgagagagcggatggaagggaacccctggctggtctgtgggaggggacgaggccaaaaactgacacacagctcatgtgctgtcgatctgtgcacccacacagctggtgcacggcccttggtgcaactgaggggcggcatggtgtggccgttgctgggcttcaggcgcagcaatggcgcgctgctcnnnnnnnnnnnnnnnnnnnnnnnnnnnnnnnnnnnnnnnnnnnnnnnnnnnnnnagatgccatggaatgagagacaatgaacctgggtggctcagaagagggaggtctttttcatgatgcggaagaactcctcctcgttcacctcgccatctccatcccgatcggcctcgtcaatcatctcttgcaactcctcatctgcgcagaaagggggcccaagggtttggcatgggactggtgcatgccattggtcgagccacatgcatgcttgccaggtgcaggtgcaattcagcaagggttgacttcctgctcgatgcccctgattcgttatcccttgcatccagacgatccccaccctcaccggtgatgttctcgccgagttccttggcaacccgcttgaggttcttgaaggagatcttgcccgtctcatcgtcgtcaaacagacggaacgccttgatgatctcctccttgccgtcgcgctcgcccatctttgtggtcatgacctggaggaactcctcgtagtcgatcagcccagagccatccttgtcaaagtcagccaccagcttcttcacctcctcctttttcggctcgaagcccagggcgcgcatggccacctgtattgggaaaacaggagttcgatttgagtgacaaagatttggtggttgctggctgacttgcgcgctggtcgtgccaggagtgattgctgggacagcaatcagagaagcccagggtaagagccaagtgcttcgtgaaaccgcgtcgcaaaatgcaccttcagctcccgggtgtcgatggtgccagagccatcggtgtcgaagagatcaaatgcctccctgtggtgatgggagggctcgtcatcagcacgtcacatcggggcagacggtccgnnnnnnnnnngaatgcctccctgtggtgatggaagggctcgtcgtcagcacgtcacatcggggcagacggtccgcggcgacagacccctacacgtccgcatcggggtttgcagccacgctcctgcacgccttccccgcacacacctgatctcctgcctctgttcctctgtcaggccgacgcggggtccggccttgcgatcccggcgggacgtcgtcaccgcccgacggtaggtctgtgcggtgagcccggtggcctgtggtgcaggcggaaggcaaatgtgacacgccaggctgaacaaatggtggaaacaatcacccagagacgtttcaggagtcaaacggagtgcactatgcgtcacgaatccgcaggctgtctctccatgccgagttggcttcgcgaaggcctgcactcccagcttccctgctcaccatggcgctcaagactctaggatatgtccaagagctaaacttcaagatccgtctcgagggacaccgggcgctcgttttgacggacttggtgccagagggtggactttgaacggcttgttcaaacgtcaggggaaggcgtgccggcctttcctcctggatgttgttcaaacacctagccaaaaatcgggccgatgacgactgcttcgtgagacgagatgcggtttcagcacattaatccccaatcactgccttctgtagtgagatccaagcatcctttacattcacggatgcagctgcaggtgcaggaagtcggtggcaagttccaaacatcagcatggattctagattcgccaacattgattgtttcattctacttcagggcatccaaaggcaatgccgatggagtttgctttgtcactgtattttactcagtaattccgggcccacaactgccgacagtgcagccatcgccctcattcttccggtagcatctcctcgtcactgctgctgctctcctcctcaatgatcagccgggtgggagcccccttccaccgccgcaccgcgccggactcgtgccctgaaaagagcacatcgccatcgccccatacgacggcggtgaccgcgtcccctttgcagtcaccgatagccagcggactgcagtagtctggctttccgggtgtcgctgtctggaggtcgtagacgatcacctcgccgtcgtcgccgcccgtcgccacgaggccacccacgggctgccaggccagggcgttgatggtcttgctgtgcccgacaagcagggtggggctgctgtcctcagggccaccctcaaagtccaggactgggtgggaggggggatggttgggagagggtgcggctcaggtgcttgccgcatctggcaggggttggtggagggtttgacacagggtgcagtcgtgtgcaagtctgggacgccannnnnnnnnnagatggttgggggagggtgcggctcaggtgcttgccgcatcaggcaggggttggtggagggtttgactcatggtgcagtcgtgtgcaagtctgggacgccacagagtattgttgcccaccctgcctgtctcacctatgccgacgttgccgcccacggatcccatcttgtgcccctgggcatcaaatgtcacatgggtgacctttccatgatagccgccgcccgcaaactcctgagtgtggaagtttgcaggagtggtaaaagccgtcagtttatacctcactttacctcgctgtgaaagtcgagcaagacaggcatcagcgaaatgacaatcacgtcaaagatcaccatcctacgcccccgttcnnnnnnnnnngttatacctcactccacctcgctgtgaaaatcgagcacgacaggcatcagcgaaatgacaatcaagtcaaagatcaccatcctacgcccccgttcagcacccacttccacttcagcccccttggctgtccgcttcagctggtagatgcgcacggcctgatcctggcaccccacgatgacatgcttgccgctggcatccacatccacgctcaagcaggctccctgcagggatgagggcaagattggatgtagaggagggggagcaccatgggtgttcttggcagccaccgggcctgaatttatctggcagctttgtgatgtatccttcaagatactgggttgaaccacatgnnnnnnnnnnggcaggctccctgcagagatgagggcaagattagatgtagaggagggtgagcaccataagtgttcttggcagccaccgggcctgaacttatctggcagctttgtgatgaatccttcaagatactgggttgaaccacatgctcccgcccacctacctctacgggcatgtctagtgggttgggctgcttggaggtgatctccatctcctcaagcagcgctaccgacttgctggtggccacaacgagtgagccatcaaccggaagccgcacatccagcacagtgcccttggttgggggctggggataggccttgacctccgccgtctcgggttcgacggtgaagtaggtggcctgatgccctgctgcgcacgcaaacgcattgcccctcactgccaggtgccggacgcaggggccaacgggtgtcctggaatggagttgttgtcgtggtgtattggtactctgacaactcagggacatacacgcattccaatggtgatgctattggctggggccttgagcacaaaggagctccagctggagctccaatgaaggagtatccctccctgccctcataagtaagcctcaacacaaatcctcacacacctgtcggcatcgacatgtggcacaggaatagcctgcaccttgggctccagttctcccaccgggagtgtccagatacgggcatgtccgtcctcgccaatagacaccagtctcctgagacccaggtgggcannnnnnnnnnggcctgcaccttgggctccagttcccccaccgggagtgtccagatccgggcatgtccgtcctctccaatggacaccagtctcctgagacccaggtgggcaacagcattggtgccccaatcgtgccccgccagctctatccccgtttggccagaggcagccgacaggagggaaatgggtccctccgccgtgcccacggcgatgtaggtgccgctggggtccatggataggcatgtgatggactcatcgagcaccgcctcccagtcccgggccatcaagggcacgtccacatcggggtagctctgctcatcgtcagactcctcctccccggagtcctcctccgactcctcctcgtctcccgactcctccccctcggtctcctccttcttggtctttggaaaattcaggtgatcgtcgtgacaggctcccatggtgagatccggtcgccaggggcaggggtgcaaggcagagggaggcagcgcgagaatgatcccccaccgccgactcccggggacttgacgcagtcccctgggattgggcgtgggccgatggcaatcgaccctggctgtgcacggaaacgtgacctccctcctgggtgctgcacgggtctgtcagcccagactgaggcacacagctcaatacacgacttaaacacccattcaccagaggcacaccctgtcactcttgtgttacactgtgttttcatctgcaatgccatgtgggccaggtcgggggcaatcgcttcacgcacacgcaccgcccacccagggagcatcaggccctgaggccctccagcgcggcactcagggcccccgcctccccgccctcnnnnnnnnnnccaatacacgactcaaacacccattcaccagagacacaccctgtcactcatgtgttacacggtgttgtcatctgcaatgccatgtgggccaggtcggnnnnnnnnnnnntgcctcggccagcgcggcacgcgctggctcccaggcggcgcgcgcggccgcgagctgcggcgccacctccggggcccccccttccccgtcgccgccgatcctgagctcgcctgcgcggcggcacagcgcgcccagcacgccgcccagccagggcgtctctggcgcgggcacgggggcggccagcacgccc

SEQ ID NO: 47450 - DNA, 61 bp, Chlorella protothecoides
gccgagcctgtacacctcagtcatggtgtcgtcgaggaggaacttctccaggatctcaagg

SEQ ID NO: 47451 - DNA, 75 bp, Chlorella protothecoides
cctgcaggcaaggctcccaaaatggctgggttgcaaggggaggaagcggtgcaggcaggattcctggcacttggc

SEQ ID NO: 47452 - DNA, 89 bp, Chlorella protothecoides
tatccgccaccgccatatccgccaccgccaccgctgccgtagccaccgccgctgccgccatagccaccgccgccgccatagctggccct

SEQ ID NO: 47453 - DNA, 210 bp, Chlorella protothecoides
aatgcagaactgaaaggatttgggatgggtcaaaggaagtgctcgagaatcacgcgccgctcgtcgctgcctgctttcagaccatgcgtctatgcaaacagctctcaatctctttgcggatcatgaccacagcccaccccccccagcctccctcccacacacacacacactcttggtatccaggacggccactttgtgtttgcgtccgag

SEQ ID NO: 47454 - DNA, 96 bp, Chlorella protothecoides
tgcctggcaggggggaggagaaggagggaggtgggggggggccgaggattggggtcagactgtgtccggcggggcagagtgggtgggaggggtggg

SEQ ID NO: 47455 - DNA, 61 bp, Chlorella protothecoides
aaggggtgctgggggggagaagagggaagggcgacaagacaaaccctcctcctccctccag

SEQ ID NO: 47456 - DNA, 64 bp, Chlorella protothecoides
gggccacagatcatcggctgagggtgacgcagccacaccacgaacggattgatacactgaagct

SEQ ID NO: 47457 - DNA, 61 bp, Chlorella protothecoides
gtgtgccctctgtgcgtgacggccaggccaagccaggtggtgtggcctggacagccaggca

SEQ ID NO: 47458 - DNA, 79 bp, Chlorella protothecoides
tctgccggcagcagcctccccctgtcccgcaccaccccccccgcccgcatgggagctggagggccctgcgtagtccttg

SEQ ID NO: 47459 - DNA, 61 bp, Chlorella protothecoides
aatgcggaatgtgctatcaaagcaacagtcggaccggggccaaggccctccatcgggtgcc

SEQ ID NO: 47460 - DNA, 74 bp, Chlorella protothecoides
tcgccctgctcaccggcgtgcggccgtcggtgggcatgcccccggcccacgcagtggccgccggcgctgcggtg

SEQ ID NO: 47461 - DNA, 61 bp, Chlorella protothecoides
gcgccaggaagcgctccgcgctgcgggttgggtttgcgtggaaggcggtcgggtgggggtt

SEQ ID NO: 47462 - DNA, 25823 bp, Chlorella protothecoides
  modified_base (83)..(92): a, c, t, g, unknown or other
  modified_base (327)..(336): a, c, t, g, unknown or other
  modified_base (487)..(496): a, c, t, g, unknown or other
  modified_base (862)..(871): a, c, t, g, unknown or other
  modified_base (1456)..(1465): a, c, t, g, unknown or other
  modified_base (1676)..(1685): a, c, t, g, unknown or other
  modified_base (2298)..(2307): a, c, t, g, unknown or other
  modified_base (2818)..(2827): a, c, t, g, unknown or other
  modified_base (2977)..(2986): a, c, t, g, unknown or other
  modified_base (3191)..(3200): a, c, t, g, unknown or other
  modified_base (3265)..(3274): a, c, t, g, unknown or other
  modified_base (3511)..(3520): a, c, t, g, unknown or other
  modified_base (3673)..(3682): a, c, t, g, unknown or other
  modified_base (3754)..(3763): a, c, t, g, unknown or other
  modified_base (4793)..(4802): a, c, t, g, unknown or other
  modified_base (5233)..(5242): a, c, t, g, unknown or other
  modified_base (5509)..(5518): a, c, t, g, unknown or other
  modified_base (5930)..(5939): a, c, t, g, unknown or other
  modified_base (6247)..(6256): a, c, t, g, unknown or other
  modified_base (6801)..(6810): a, c, t, g, unknown or other
  modified_base (7171)..(7180): a, c, t, g, unknown or other
  modified_base (7649)..(7849): a, c, t, g, unknown or other
  modified_base (8078)..(8087): a, c, t, g, unknown or other
  modified_base (11395)..(11404): a, c, t, g, unknown or other
  modified_base (12427)..(12436): a, c, t, g, unknown or other
  modified_base (12506)..(12515): a, c, t, g, unknown or other
  modified_base (12582)..(12591): a, c, t, g, unknown or other
  modified_base (13126)..(13135): a, c, t, g, unknown or other
  modified_base (14099)..(14108): a, c, t, g, unknown or other
  modified_base (14207)..(14216): a, c, t, g, unknown or other
  modified_base (14463)..(14472): a, c, t, g, unknown or other
  modified_base (14716)..(14725): a, c, t, g, unknown or other
  modified_base (15324)..(15333): a, c, t, g, unknown or other
  modified_base (16965)..(16974): a, c, t, g, unknown or other
  modified_base (17836)..(17845): a, c, t, g, unknown or other
  modified_base (18765)..(18774): a, c, t, g, unknown or other
  modified_base (20137)..(20146): a, c, t, g, unknown or other
  modified_base (20268)..(20277): a, c, t, g, unknown or other
  modified_base (20366)..(20375): a, c, t, g, unknown or other
  modified_base (20782)..(20791): a, c, t, g, unknown or other
  modified_base (21371)..(21380): a, c, t, g, unknown or other
  modified_base (24844)..(24853): a, c, t, g, unknown or other
cgggtctcgaaagtcgacctcgcgattcataaaaagcccgacctgcgctccctccacatcactccgcacaggctgctggacannnnnnnnnntccctgtcctcctgccgcaggctgaccggctgccccctcccaggtacacacgacgatgctcggctgcaagcatcaagcctactccccacccccacccgacatccccgctcacccgcagctgctccttcagcacggggccctcctcgccacgccagagcctgccctcgtcaaaggggatggggcacacctgctgcagcgccgcgttgtccagcagcctgtgcggagtgatgtggannnnnnnnnnagtggttggtcagcctgcggcaggaggacaggggattgctcgctgggccgccactcagggcacccacctgagcccttgaatcgctgcggtggtggcatgatcgccgtgccggcccatgcctgccgccttcctccacagcgatcaggctcgnnnnnnnnnnaagagcgcaggtggggcttttcatgaatcgcgaggtcgactttcgagacccgagcaacagtaggacaggaacggtctgcatgactgtccgttcccaaatcccttgagcgtgtcgcaccctgccttgccagccaataaaccagggctcctggacagtacctcctcacaaacccagctgcccctgcttccattcctgaccaatccccccccccccaacatcaaaaccccagccatgacgcccacttgtgcatgaagtgctgcgtggccgcgtcctcctccggtaggcccgtggaatattccacgccgcgcaggaggggcgctgccttctgcaccgcgcgcagcacgaagaggtaggcgaagtagaggnnnnnnnnnncaggcccgtggagtattccacgccgcgcagaaggggcgctgccttctgcaccgcacgcagcacgaagaggtaggcgaagtagaggttctccacgcggtcccgcagctccggggagcccaggcggcgcttgaactcggccaggtccgggccccaggcgtagacctcgcgcgtgtcgtcgcgcagcggcgattccgcaactagatgagcggagatggaggcatgcaggccggagatgaggcggtagaagacccggagctccggcgcggcagaggcccctgcctccagccccggctggccgtagatggcctgccacacgcgtgcggcgtgctcccccgcgtaccccgtgaagcgctcggggttgcgcaggaggttgatgtaggcgtactccacgccggcgtcgtccgcctccggcatccaggggttgcgatacccgcgccagtctggtactgccagcagcgcgcgtcggatgtctggctgcagcgtgcggtccagcgctgactcctgcgccgccgctgctcgtggggtggttgatggagtgggggttgagggggggggtgctggggcagcggagcgatctgttggtgnnnnnnnnnnggatagagtgggggttgaagggagggagtgctggggcagcggagcgatctgttggtggtctgcccgagaggccccagccggccgtcaaatctgcaagataccactggccaggagtgaacgaccccggcttccgtgctcccaagtgcagcgaccaacaaacactacgtcatgcatcctcgccgcccctgaactcccaccctccaacacacgnnnnnnnnnngagccccagccggccgtcaaacctgcaagaaaccactggccaggagggaacaaccccggcttccgtgctcccaagtgcagtgaccaacgaacaccgtgccatgcatcctcgtcgcccctgaactcccaccctccaacacacgcacctgcgcaggcggcggcgggagagtcggcggaggcgagtcgcccctcggccgcgcgccagatctttggcacctcgtcctcctcacactcgcagacgctgcaatcgcgcatggcgcacatgccgtcgtccggccagaaggggcagtcgcagtagaggtccaccttgaagtagcggaagaaggccgactggaccagcttgtccaggatggggccgatctcgtcgcgattcacctgctccaccgccgagtagctgcagcctgcagggcggagggatcggcaagcagggcagggcgttggtgcaggggttaagattggtgggggaaagaggggatgccagagcaaatcggcctacgccggaaaattaccgcccttgtcattggagcacccccgatgacagccccccgaaacaccagaccctgcaacccatgagtactcacaacagtccaccacggtcccagacatatggcagnnnnnnnnnntggcaagtaggttagggctttggtgcaggggttaagctaggtgggggaaagaggggatgccacagcaaatcggcctacgccgaaaaatcaccgcccttgtcattggagcacccccaatgacgacccccggaaacaccagatcctgcaacccatgaatactcacagcagtccaccacggtcccagacatatggcaggagttgggctcattcaaacccgcgaggtcctggtataggagcacgggaagggagggtgtcactcctctagcacgtgcatagagcacattgtccagcatagagcaatgttgagcgtactgcacggtgatcacccttgatcgggatacacccggaatctcagctcaccccacagtgacaaggcgtgtcgaacagctccaccgccggccgtgccaccccgagggtggaggccaatcccggcggcaagtgactcgatacccatgacggtaatctgagctgcagccctggcgtccctgcctgtctctggaagacagcaatnnnnnnnnnncataggagcaagggaagggagggtgtcactcctctagcacgcgcatagcgcccattgtccagcatagagcgatattgagtgtactgcacagtgatcacccttgatcgggatacacccgaaatctcagctcaccccacagtgacaaggcgnnnnnnnnnngcctagggagagtaagaccaccagggcgcccactcgggacagcttggtcatgggcctggctcgctagggcgggtgtcgtcgacgtcgaaacccacaccttctatgtccttccacgaatgtgccacacgtagtggagcaggcgcaatgttcctcggccacgaccttaaaaaccaaaatgggtatcgatgccgctgtgttgcgtcgnnnnnnnnnnccacccatgccggtaatctgagctgcagccctgacgtccctgcctgtctctggaatacagcaatnnnnnnnnnnacgacgtccgtggtgtccttgcagagcagctggctgaattcgcggcgtgttgaagaaagaaagccagcagaaaccgtccagcgacgtgtccctgacgtagaaagcatggtgtactgcaaccagaggtcaaatggtgcagcatggcattggagcacatacagcttgttgccgcactgcagaaacaatgggaaaggtatcttgtggaccagcgatcaacttggccgctccataaagaannnnnnnnnngtccgtggtgtcctgagcagctggctgatttcgcggcgtgttgaagaaagaaagccagtcgaaaatcgtccagcgacgtgtccccgacgtagtgtactgcaaccagaggtcaaatggtgctccatggcattggagcacatacagcttgttgcnnnnnnnnnncataatgctgttgagaagaacatccattctactcggtctttgccgcaaagaatctggtgatggactgcctcnnnnnnnnnntataatgctgttgagaagaacatctattctactcggtcttcgccgcaaagaatctggtgatggactgcctcttctccttggccgcactcttgtacagcttcaggactttttgcacactgctgctgaggcccttggcgtccagggcttcctgctccagccactggcactccgggcactcgctggatcggcccgagccacgcttccagtcctccagctgggcggcagaggcctgcacttggttgagggccaatggcgatctgagtggtcaggcatgcccgtcccactgttgttctggtaagggctccaaggcgagacttgaaacatacagcccttcatctctcgcccggcataaccgccggacggcagccccctgatcactgtagtaatgcacagcacccccaatgcgggcaggcctgacgacacccagagctcagaaagaaagcacgacgcaccgcaacgaggacgtgctcggctcggatggtcatgcggatgtgggagaagatgtggacgacctcgcccagcgcccgccgcgacacgaccttcggcgcggtgctttccttggactcatcaaacaggccgggcaggaggcccgccagcagggagtccacggcgcgctgctgattggccgcgctttcctccccgccgccctcaagctcggcgagcgggaattgccagagcccggccagcagtcccttctccggccgcttgaccaggaggtaagcggggctgaaggcctgcatgccaggtcccgtgccgcagcaaggcctgacctccagcacggccaccgccacctccacctccctcctcgccgccttttccacctatgtagacatgttggggagactggagggagtggtgcgacagagaaatgcccgagcgttgtgttgatagtcgggcatggcacgggcagcatgcattttgcgcgctggcacagtggcattgctcgaatcctttgagatttgatggtcagtttcaacactgctgggcccgctggaccctgtgtcgcttctgtggagagctgatttcagtnnnnnnnnnncgtgtcgtgttgatagtcgggcatggcacggccagcatgcgttttgcgcgctggcacagtggcattgctcgaatccttcgagattgaatggtcagtttcaacgctgcggggcccgctggaccccgtgtcgcttctgtggagagctgatttcagttctgcaggaggcatggagcccccctccccacgcaaaaccggggtcaatcacccacatgcgccgccgcaccttggtggggtagtcggtgacccgtggccccggcccccccggcgtgggccccgcctcgccccagtgctctcgctggcggcgcagcgcggcgcagcggcccgccagcgggcacgcgtcgcagcgcggggcggtgccggggacgcagaccgtcgcccccagctccatcatggcctggttgaagtcgcccgggcggtcggggtcgagcagnnnnnnnnnnactgaatcgctgcggcggtggcgtgatcgccgtgccggcctatgcgtgccgccttcctccacagcgatcaggctcgcgttcgcctggcactcgatctcggcgccctgggaacccttggtgcgcgccaaccctcaagagagcctcgatgttgagccgcccaccgtatcatcccaccctccccttccctcccctccccttccctcccctcccccttccaggcgacgttccagaacattacgcgggtgatggactgtgtggggtgcgagnnnnnnnnnncaaaataaagcctcgatgttgagccgcccaccgtgtcatcccaccctccccttccctcccctcccctcccacttccaggcgacgttccagaacatcacgcgggtgatggactgtgtggggtgcgagaagtgcaagatgtggggcaagctgcagttcctgggggtggccaccagtctcaagatcctgttctccgccgaggactgcagcggcgccccagtccccgagcaaggtgcgtgctgtgggagggttggggcgacgcagggccagctcaggatctggcctgtcccctgcctctacaaccccagggtgtgtcagctcgggcatgcaggaagtccatgcgccccatgcgccaaccatcccattctctgcccctccaaatattcccccccaggcctgcagctggagaggaacnnnnnnnnnnttgctcgggcatgcaggacctccatgcgccccatgggccaaccctcccattctctgtccctccaaataatcccccccaggcctgcagctggagaggaacgaggtcatcgcactcgtgaaccttctggagaggctgagcaactcggtggaaaccgtgcgcacgctgagcgtgcagctggcgggcggcagcgttgcgcacccccagggcctgggagccatccaggacgtggtgcagcacggcctcgcgccgcagctgcgcaccggggggggatgatgacggccaggggtgtcgtcaggggactggagctnnnnnnnnnntgcgccgcagctgcgcaccgggggagcatgatgaaggccaggggtgtcgtcaggggactggagcttcaggcgccctccattctaccgcagttgggcacctcatgcattgttgtgccaatgtgcaaggatgcatgttccaggtggaccattcatacagcaccctggagttaaaggcattgcagcacagggaatggtgaaggcatcttgatttctgaggatcagtctcgtacttaaccaaggaagtcgatgggcagctgcccgacacctcccggtgaaatgaggtgtatcccttacagttcgccgaggaagtgaaaccggtcgacactccaagcactatacaattcagataacgcatcaaggctccatccacatcctcacatccacttgccaccccatagccctcaggttcgctttgggaatggtcagccggtgacctccccgacaccggtgtcggagcattgctgccgcgatgccgggcatgatgcctcgatgcttcactgcgccccgcgcttctccaaatcatctcacccccccgccatctcatnnnnnnnnnnacacgcccagccacgagaagcgatgtgggagttgatcgctgccgctgctgccgggctcaatgccgggtcggggctctacattgccgcggcggagcaccccgccggcctcgaggcgggcgtcgccacctattggtccttctttcccaaggtctccaccaaggccgtgaccctgtccaccaccctgtccgtcctgactgccgccggtgctgccgcagcctacttcacaggtgaggggctggaatctggaccgtatgggggtgttgcagtactacgtatgtctcttaccagcttggtcgcgtctctctcacatgcttgccccttcccccccttcaccctgcaggtgaccctgatcgggacccannnnnnnnnngatctggaccgtatgggggtgttgcagtgctacgtatgtcactttgatgcttggtcacgtttctctcacatgcttgccccccacctccaccctgcaggtgaccctgatcgggacccagcctggctgacgtgcgcggcaggcgccctgaccgtccccgtgttcgacttccttttcgtcgccccgaccaaggccgtcattgacagccgggtgatgatcgaccagccagtcgcagagcgcgagtcgtggctcaggtcctggggccgcaagcagatcgtggatgtggcgctgaaggtggccacttttggtgccctgctcctggttctgggtgccaagggcgaggacggcgcgctcgctcgcctgacgcgcccccgctgaagtgccgctgaacggagatttgactggtgatgtggcgcacatattaatagcaaggtcttcaccacccctcgcaaacattcggcgctgcatctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttgaggggacaatggtggattcaacaaggattaccatacatgacttatcgattggacatctcctcagaagaggaaatgacagcctgatgccgatcaggcaccccactgactccttggagaggaccattggaaactgtatgaaacccgccttcccgcctcttatccctgtgaacacatctattaacctgagctgctaggacggcctgaagagagaaggctgttgaggnnnnnnnnnntgttagacgttgcagggaagatctgatcactaggcaggtggttgtacgatcaattgagcagcttccacttgatcggacggcaatagcttgaggaatgtgcgcagtttctcctgcaggtttgaggggacaatggtggattcaacagggattaccatacatgacttatcaattggacgtctcctcagatgaggaaatgacagcctgatgccgatcaggcaccccactgattccttggaaagaaccattggaaactgtctgaaacccgccttctcgcctcttatccctgtaaacacatctattaacctgagctgcttggacggcctgaagagagaaggctgttgaggcattcatgtcgatgtttatggacccccgggctggggccgcatatgtaaggtagtactcatcgtagtcgatgctgcgcagatattcgtacacctctcgcgccaggatgcccgccctctccgcttccccccgcccctccagtgctgcagaaatgtgaggactgaagtgagcaggacgtaaatggagcgcaacttcgtgccctcgaatcattctcacgatccaaatccccacaagagtgtttcaagatacctgctgctgcagcgcgtaggttgctctgggcattgtttgggctgtccaggatgcttgcgaggagctccttcaagcgctgggtgtcgcctgccttcactgcctccacagtggatggcaatagagcctaggatggtggttgggggaaccgaagctgcccttggacctagaggcatggtgagtgacaggcacccagtgtgccagcccgcacccactcggcgacgattctaacccatctaccccaacaatgggctggtgcacacctggatcctcagcaagggtgcaatgtaaaagaagagcggcttgctgggagtggacgccatgtattgggttggtacgagggcgaatgcaagggcacctgccgcagccagtcccccaaagagcactcgccgctgcgaggggcatcagttgtacaggttctgatggtgtgcaggacaacaacagcaccctcctggccacattcaatttcctcctcctctgaatacgctcgtttcacccgcacaagctcaccgttacaactccagaggccgcctcagctgcgtctggatcatcgccagtcacaaagctgacgtcagcctcactcagccagctccgatccccagtatctggtatgcaggaggcaccaaagtgactgtgcaaaactggaaagcatgcaggcaggcaaggtggggaagcacattaacaaaaacaacctgacatttgcctccagcaactatcaacagtgcagtcacaagcatgctcttgtacctcccgtgaatagcgtctcgcgacgaagtcctggtccatctatgcgtcgaatggggggctgcagcttcccaccgccccctcctgctttctgtagaggagatgggaggggaaggatgcatggctgtgggctccgtggaggtccttaccctgcaaaagaaacaacctccatcatcaaaccaacattgcgcacctgagtttccagctctttgcgcaacttggctgcctacgaggtgcaggtgggcttgatgctggtcagtcctggatctcttcgacatgagaacattgactgtgccaccagcaccaccaagacatcagcgtacctcgccctccgcgagtctcagcttctccaggagctctttgtccctctcatcggacggagccgcgccattggagctggtggatggctcttgggctctcactcgcgttccatgctgagaatggacccgggcacggctgagccttatagctgagaatgtgtaagctgcaggcgtctgagcgccgacgccccatgcaagccggtgatgcattgttcttggcctttctgggcagtgtgttggtggtttggggccatgcctgtcgacgactgttaatgatggcggacaacggagcttccccatctcgcgccctggcattgtgattggcgtcgagcggtgcggtccattacgtccgacaccaccatcccacgaccgattccatgccatggcatatccctgcccggcaaaatcaccatgcatgacacatgcctccgaataagctgctgacagcgctgtcgcacatgggaccccgcaatgtgcgacaggtggccgaggcatatgtgtgggcggtgctcctggtgcttcgatggtgccagatgcagctcctggagcccattgtcacatggtgaggctcattgatttgtctgaggaaccccatgcatgtccttggcgctcgaccgggcctcgcactggttcgacacccatacgaggctgttcgcataactgagatcgcactttgtggatcccagccaaaccctcgcacttactgtaacccctccccatcatccccgctcgcaaccgcaacaccaaggtggttggacacggtgatggccaactgggaggagacgttgaaggcctgcttgcgggaggtgctggcgtacgccacccgcctgctcaacggcgcctccaacgccgtggtggccctgctgtttgggcgctccgcctcgtcgcgcatgcgtgccacccgagcccgtccctccccctgggtcgattggtgggcgagccgaggccggggccggacaggcaccttcaatgccatcctggctcgggatggcctggtgccgggtggggagagagcgggagcggatgggtctattgcgccggggttgcacccacccggccgcgcccagcgccagggatgcgatgatggtctcacacgactgccgccgaagtcgggcgctggcacgccgtggcgctggcggtgggggtggtggcgcggccggcgggggcgcggggcctcggcaagccaaagcggccctcgtgcagtgcgcaccagagtgcaaggcggcgagcgcgccccgcgccccgcgcacagcagcgggagcgagctcttccggcggccggggggctcgggacagtcgcagggcgccccccggcgcggtttcatggaggaggggcgcctgaatgccgagctggcgctgaccaacacctttgcctggctgcgcaccgccacccggcaggcgctgatgctgccggaccccagcgtcactggcagcggcgatcccggctgggggcccagcttcaacgtgagaggggtttgagtggctgggtggaatcggtatcgcggggccgtacaattggagccaccctcatgggtgcggttctgtggggtgcagagcagatgtgtgcgggcgtgttgccatgtgattactattcaaggacagcactctccttccattccatgtgccaggtgcctgggaagggggatgggcgaccgannnnnnnnnnagttattatcattcgaggacagcactctccttccattccatgggctaggtgcctgggaagggggatgggcgaccgatgcctcggtccagctccttctcccacaacctgcgtggcttgtcccggaagccgtccttcaactcagccgaggatctgcagcactggacggtggccgatgccatactacgagtgagtcacagagggggggggagtgaggttctttggcatggcaccggggcgaggtcgcataatacgagcagttgctcatcattcctgtggctggtcgcttgtgcagcttgcaacaaagggtccaggctagtttttaccacccttcatttattagtttcatttctctcataattcacaggcagggtacccgctggagagtcacattgtcaccacagaggatggatacatcctcaccatgcagcgcatacctcgcaagggtgaggggcctgtggctggagtggggagtggaccggtagtgtgcctcctctgcgctgggggattggtgacggcctcaacgtgaccatgggtgttgcacaggattcccggcgctgcaagtcatggggttggaggctggcaattgcttcccatcctcaacaacccctgcccacagactccaaggaggtggtcttcttccagcatggggtcatggacacctccctcagttgggtcagcaatggggtggaggggagccaggcgtttgcagcccatgatgctgggtttgacgtctggctcggcaactcccgcagcaaccccccacgagctcatattggtgaggacagggggggtgcaggtacatttcctgggtgacgcgcgccatgagatacaggcgcatgctagccactggtcgccggcgaagggatgctgtgaccctgtgatccccggacccgctctccatgcagatccagccaagtctgggctgcggtactggtactacagcatcaatgaacttggcatccaggacatggatgcgcaggtcggtgtggactcgtgcctgtgggtctgctgactgagccgggnnnnnnnnnngagggggtgtgcagggacacttcctgggtgactcgcgctatgagatacaggcgcatgctagccactggtnnnnnnnnnngaggttcgctggaccctctctacacctggactctgtgatcctgttcaggaacattgcacagccattnnnnnnnnnntgggtccggtgggccctctctgcacctggactctgagatcctgttcaggaacattgcacagccatttcccagccgcagtttcctgtattgccccatgcccatccctcgcagctggactttgtgcaccgcgccaagacagcggagctggccagagctgggcgcctgggacatgtgctcgggggcatgggcgtgtctgggctggagcagcgtgaggaggagcaggagcagggggggccgactgagggaaagcagcaccgacacgggacgctgggcctacccaggtgagcgcctgcctggggtatagggcttgccggcccctcaaccaggctccagtgttgttgcagtgtgcctgctgttttccgagcctccccggcgttggtaatcctcacgcatgaggatcctcgctgtccccagggtggttgggatgacagaagctgggtggatgtggccctattcctcctctcctcccatcacgctttggacgctgcgtcccatgagggcacaccctccacccggattcaccctcttggcactnnnnnnnnnnaagtggttgggatgacagaagctgggtggacgtggccctattcctcctctcctcccatcaccctttggacgctgcgtcccgtgaggggcaccccctccacccggattcaccctcttggcactcgcagatccgcacgctcctccggccccggcgctcgacgcggccaccgccgcagcggctccgactccgtgcttgcagccaggcggaacctggagcaggggggtgcggagagcttggagaatggcccagagggcggaccggggcctggcaccacagaggcgcaggcagaggccgccagcatggcgccggacgagggctggggcccggctgcgtcctgcgcgggtggccgtggtcaggagggcgggctggcacaggctgccgacagcgcagccgctccgctggcaggcggtcgggagggaggggcaggtgtccgtgcacatcatgcgcaaacgcctgggacggaggcgctggaggggtgcagcggcaagcacgcgtctgcattcgccgcaagccaagctgcgactccagctccggggcagcccaggggcagcaccggggcctcagcgcacccgccgagcggtgtcggcggcgccatgaaacgccaggtgtcgcacgacgacggcgtcgcaagcgtgcagtaccgcctgcaggcggtgggccactccctggggggctgcagcctgctcatctatgcggtgcaccgcgcgatggcggggcgggcccaccacctcaagaggctggtgctgctctccccggccggctaccactcgcactatcccagggtgaaaggaagggggcatggagggctggctgtgcgtgacaagcatgcttcacacttggcatgctgcacccaaaggcatgggcacgaagacccacatttattggtagcgggacggcatgttggtagtccagggtgcactcgcccagcatgcgccccccccccccccccccccccctcccgggnnnnnnnnnnaaaggcatgggcacgaagacccacactgattggtagcggaacggcatgttgatagtccagggtgcactcgcccagcatgcccccccccccccccccccnnnnnnnnnnctcacaggcggcctggatcttcctgtgggtgctgcccaccttcatgcgtgtgctggagtggctgcggccggggttgagtgctcccgtctacatcccctcctccctcctgcgctacatcaccttcaagctcagcctggacgtccagcagctgccggctttgaatgagctgctcaggtgcagagagtgggagggaggggtttggccgcggaggtgcgggcgggggccccatgcggaagaatgcttccgnnnnnnnnnnaagtgggagggaggggttggtccgcggagttgcgagcgggggccccatgcggaagaatgcttccggctgatcgtgtggctgcgatccgaggctccattgtcccaccagacgccgatgcaggcctgcaagcaacctcttcgcacccgattgcaagagcctgcttcgggccaacctcttctccccccgaaagacccatcaggtcgagcccggtcacccccatcccctcctcccaaacctcagggcnnnnnnnnnntttcgcacccgattgcaagaacctgctttgggccaacctcttctccccccgagagacccatcaggtcgagcccggtcccccccatcccctcctcccaaacctcagggccgccttccgcctgctgctgtccggggacggcagcgagtgggaccgggcggtgcagatgccacactacaaccagtacagcatgcccgccctgagcctgcacaccggcgcccacctggtgcagctcataaatgagcgccgcttccggctgtacgaccgcgggtcgcggcgcgccaaccgcgccgcctacggcgtggcccggcccccggacctggcggcgcagtaccacctcctggccgggctgccggtggacatggtggcggggcggcaggacggcatcgtggccgcggcggacgtgcacacccactacaccatgctgcgcgacgcgggggtgcgggtgagactgaggaagtatgggcgtgggaggagggggatcgaggcggacacccagcccttgggtggtgaggtggggggccgctggccaagggtgggccgacaggccgcgtgctccccgccactccataccctgacccccacaccttcccaccgcaggnnnnnnnnnngcaggccgcgtgctccacgcccctccgcaccctgacccccacaccttcccaccgcaggcgaccttcaaggagtttgacgtgggccacctggacgttgtgtttgcgatgaaggacgaggtacagcattatgtactgcatcgcctgctgctgccccccgccccccttgggcccctggcgtgagacgcgcggcgcctgtctcgctgttgcctgccgcacctcttgaattcccccccccccgctcgcccccaattctcactggtatcgctgctgctgcaacatggctgaatgctggcaggggtgggaggcagtctcagctccacaactgccgtcacaagacaagcccccgggcagcacactgtgtgcaaggcctgcatgccatcctggcacgtgagctcatgggggttggggcccactcccacacccaccgggccagcaccgtcccagcatgcacagcagcagattcatgatctgcattgcgaaccaaaccgagctggaatgcgacttcgggaccctggccctccaccctcagcagggcaccgtgttgcagcgttttccgttgcatcacatgtttgtctgagccattgggatccgtgcagggccgatcgagccaggggcccccctgtcccggtgtatggagggccggcacaccccgcccatgccccgataacccacgcgagtcacgcactgaacctgcgctccccgcattgccgcgccccgctccgatgacagagacgtccgggtcccagcccccggggtgggacatgcggcgcaccgtgagctcccgtgccgtgcagggtcgcctggcagccgaggtgctgcgcaagctctccctggccgccagcgccgacaggaaggaggaccgggacatcatctgcagcgaggtgtttgccgacatcaccggcgacctgaacagcgctgctcagggtgcgttaggaggatggacttggctggctggtcgggggggcctgcgtccactcttcacgcaggggtgtctgacgccatccactccgtttcctccttcgccatcttccccttcccgatctcaaaaacctgcaggcagcacgggcacgctgtacacccggtggtacgaggtgctggccccctacttctgcgccgacgagggtgcgagcgaggcgctgctttccgcctgccgccggctgtggggccagcccttcaccacccccacctttgccctgctcctgcaccagtggctgctggtgcaccccggcgcgggcggcgcggaccagcgcctcaagtacctcaacgtcctggtctccggcgcgcgccagctgttcgtgggggacgccgagacggggagcgccgccttcgcgcccatgttcagcttcctggccgagcgtgtggtgctgtcgcccggtggcgcgcgcctggccgccctccccgagaccgggcgggaggcggtgatggccctggccgcctccttcgcgccctactacctggggccctcgggggtgagcgcttggggggggaggggcgggttttgagtttggagatggatcgtttgtataagggatcttggatcggtgccgatgcaagcacctgcgcggtggtcggcgctgttattggtggcgccccaccattctccgccacccaggactatgtgaccttccttgnnnnnnnnnntgctgggggggcggggggcgggttttgagtttggagatgaatggtttgtatgagggagcttggatcggtgccgatgcaagcgcctgcgcggtggtcggcgctgtgatcggtggcgacccaccattccccgccacccaggactatgtgaccttccttgactcgttcccggcgccatcggcggtgtcggcggggcgcccgcccccccgcgaccccgggcgtgacggcgggcggcgcgagggcgtggactttgcgctggaccgggcggtggaggcgctggcccgcgaggtgaccgccgagccgggcgtgctggccttcctggccgcgctgcgcgcgctgggtggcacgggcctgctgggcgcgctgcgcacctccacccgcatccggctccaggccgagctctacgcgctgacgcagccgggggggccgcgctacgcctcgcgcgccgtcaaccgcgccgccttccgcgcgctggacgcgctgttcccgcgcgggcggcgcgcgcggcgcctggtcaacgccgccttccgcgtgctgcacccgggggagtggccttggctctggtgggacgcgctgtgggacggcgcccgggccgtgagggcctgggcgcggctggcgggccgggccgcgagggggctctgggcacggctcgccgcccgactacggtggcggccggggacggggcgcggtatcctgtgcggttgaccgaggagggagggtgcgtggcagggagcacacccgtgtcgctgctgtaccctgttggtgagcgcgtccagaaactagggtttacgtacagatgtgagagtgcctggaacaagagggtttgctgggcgtggcgcgcaggatcgggtgggagccggcctgnnnnnnnnnnagaaactagggtttacatacagatgtgagagtgcctggaacaagaggatttgctgggtggggcgcgcaggatcgggtgggagccggcctgacatgacggcggccatgcctcgacggtacaaccataaaagcgcaaaaagagcggtgctttctggtgtttatctatgaaacctacgctacttccaactgagctaaggaggcttgccaaggttgaacctggcccggtagcggatgccccctgccagtctcgatctggcgacctcaggctattccaggtgtgaaaccgcttgatggaaatctgttttttcgccggactatgagcgacgctcacgaggcatgggaatggtgcgagatgtgcacgaggttccttgctccaattgaagttcaccagacagtgtgcttgtcactgggagactggatgctggtgtgactgccaaggcgacacatccgtctggcgacccctgctacccttgaatcatggcttgggcaggagtctgctgacaaacagggctctgctccagaggttcgcgccctccaataccaaagacgcaacatcttgagaataagaacccgaaaatgtgttgacttgagacaccctcagagcatgaaccggtggagggtcccgttgcctcgtgacatgatgccaacctcatcttgcccctcatgatgggcagagtgtcagcatatgagccacggcactgaactatttaggctgatagatgcatgcgtgtgaggttcgggctgtttatcgtgtcttagatctgagtcggtattgggcaatgtcacgtccgacgaccaggtctacatcaagtcaatccgaccccatcttcttctctttctgcacgagcaactgttattgtttggaccagatatgattgtgatttcctgatcacagagtacctcgccgatgctatggccagnnnnnnnnnngttctgcacgagtaaatggtattgtttggaccaaatatgattgtgatttcctgagcacagagtacctcgccgatgctatggccagtccaagcggaacccgaacgggatgcaccttgccacctccgccgtccccccaagaggcacataccgatcaaattcggatggcgaggatgcccgcgacctattaggctgtgtttaagaatccaaaaaaattcaaaagagtaaatgttcctgccgcttaaaccaatgaaagtcaggaggtaagatccttttgcgtacacctatatgctcaaatatccaaaatccttgcgggatatgccgcgtcgctggtgtggggtacctgcctggcaagctctcgaaacagcattatccaatgggtaccgagtttcatccctgtggagcctcctctgccagaaagccccctcttgtattgaataagtgcagaggagcagcgcatcatgtgatcgtgaccaaggcagagaaggccgccacatttctgggagagtggctcagaaaacgacgactaggcataagaaaatcaggtggtacagccctccgactcaagatggcttgatgtgaagttagatatgaaaatcatgcctgatttgagtcccggggcatgggtacgggctgagctctattggcatctcatgaagcattggcagacgttctgttccatcggaccaaaccctcgagcaagtgggacggcttgcttgctgtcatccgcccgcttataaaacagcagccagacccacaaccaagtgcttgagcaaacgcacaaccaaagggtcgaacatacgtcaggacaaccggtcctcgagcttcaagtatgggctgtcacagctccatcggcaacgattttatcagcacaccacaaggtcggcagttcgagcctgtctggcggagtcatccgcaaccttccgctatagctcagccggtagagcgtgtggctgttagcttacacttttggcacttggctgcatggtcatgtcctcgccgaggacaccaatgaccagcggtggtatgtttgtgccactcttgtggtatggaggaaagatgggagtgaagctgcctgcctcctcatttcatagcaggtgttctctctgtcaagcccaactagccctcgtgggccagccaaagcaggcacgattgttgccatgggtgctcccccatttccaattgtctcatacaggagacatcacctcatcccagcgagtcgtcttggtggccggaaattggagattgaacttcatgacatgcacagccccccaaccagctccgtcattgccatctgctgccgggctgtgtgctgattccctcctcaattgcagactcctgaaagcatctgccatcaccgcacagnnnnnnnnnngtgccatgggtgctcccctatttccaattgtctcatacaggagccatcacctcatcccaacaagtcgtcttggtggccggaaactggagactgaacttcatgacatgcacagccccccaacnnnnnnnnnntttacatcgcactctggattccaaagggggaagccgccaccgcggcatttgcaggcaagtttcacacattgcagctatcttaatacgtnnnnnnnnnngttacgtcgcactctggagtccaaaggggtaagccgccactgcggcatttgcaggcatgtttcacacattgcagctatcttaatacgtaacaaggcgataactcggtcccatgggaggagtcatagagttatgcatcggatattccgatattgaaaggcagagaggcggcgttgaacgctccacccgctctctgaagcaatccccacgctgtcattgtgatcctctcgcactacacattttcacccggccacccgacgctgcagcgataccatgtatacaccattcctatgtcaacaaagaccgtcagggtgagcaataatctcctcgcattcccagcccctgggctcggtgatataacaccaattttactcgcaatcggtcagcggtctgtctcccgacagagtannnnnnnnnngctgggctcggtgatataatgccaattttactcgcagtcggtcagcggtctgtctcccgacagagtacgattcagcgaaaggtcgtgtgttcgatccacacatcaggcactcaccctgatacccgcctgtttagcttagtggtagagcgttcgcttcgtatgaaaactagcttttgcatttttggccacggaatgcactcaataaattagaagactccggtccctgcctgtttcgcagtcgagtccctgcggaaaagcgggtgagggatgcaatgtgtgctggctgagaacgtgcaatacacatcacattgggggagatcaacgcgagaggttcacagccccgcatctggggtaggctctgccttgcacctctgccctggtctcaggccagtgtcctacaccacctgttttcctttggcatgtctacagatacctacaattcatcgaaaatgcacagaggatactgtgtctcgtacacgcctctaaagctcacatctgggatactgtagaatatccataattatatgtgctcgaggccaggcgtgtatcactggaatcccacctcccacaatgcaagatnnnnnnnnnnttgtagagtatccataaatatatgcatgctcaaggccaggcgtgtattactggaatcccacctcccacaatgcaagattgccatgcatgatgttcaacggaccgtctttgccaaacatgatgggtgcaccttcataccaagcacttccatgtcatgaattgaccgcgccattgtcgtatttcgttgccaacccacttcctggaaggtgttgcaaagggttccccaaacgccacgtcatcaagcccaccgacgctgagtcatgaatcggtagtaaccgtgcttgctccccacgctcgagcgcgcatgaatgtgccaacatacgcaagtaccgaaacctatcgtgcctgacatcgtacgacctcgcatcaacccctgctcgggcaccactggtacaccatggcaccctccgtcgacctcgccgaggtgaccaccgagcagctcatccatgaggtgcagcgtcggatagagtgcctgaacaagcccgagaagcgcctcatcctcataggtgggtggatgcatggtgggatcgcgggggcccgacatcccatccggctgcctggccagggggggccccctgtgcaccaaatttccattctcacccccctcccatacacatacccagggcctcccggctgcggcaagggcacccagtcccccgccatcaagaacgagaactgcctgtgccacctggccaccggtgacatgctgcgcgccgccgttgccgccaagacccccctgggcctggaagcgaagaaggccatggagtctggggccctggtcagcgacgacatcgtggtcggcctgatcgaggagaacatcaagtccccggagtgccgcgtcggcttcgtgcttgatggcttcccccgcacggttactcaggtgaggggtttgcgtcatggggagaagggttaggggggtccccgatgctgcagtgcacttgaatcgtatgccacgacgccacgtgctgctgcctagtgaggcacttcaggaatccctcctccccttccaaccactccaccaccccacccaactattccccttcctacaggccgagaagctggactccatgctctccagcaagggcgccgcgattgaccgcgtgctcaacttcaacgtgcccgacagcctcctggtggagcgcgtgaccgggcggctggtgcaccccgcctccggccgctcctaccacaccaagtttgcgcccccgcgcaaggagggcgtggacgacgtgaccggcgagcccctgatccgacgaaaggacgacaacgcggagacgctcaaggcgcggctggaggccttccgcaagcagaccgcgcccgtgatcgagcactaccgcagccgggtggtgaacatcaagggcgaccagtcggccgatgcggtggcagcggaggtccgggccgcgctcaacgcctccacatgagtgatgcggtgtgtgtgtgtgtttaggagggggcgttcgggggcggtgctcggagcgtgaacccaaccgggaaggacctcgaggcggcactgtcccaagcttgggtgacctctgtgcctctcaactctacagcctgtcaacaaggactttccagtcggttccactttggtgacggtggcgggccagaggcatcagcgggcagtgatcagcaagaatagatacaacggctgggtttcaaaggattccggggggcagaacgagcgaatggaggaaagcaggaagttgccagcaggtgttctggacccagatgtgcatgcctctgagcgctgtgtgggctctggcgagctgcacagagccaccagggcatggtgcaggaggcggcgccatgggacacaccggtcccgccaccacgccgcccactcctcgtgactgcccatccttcagcactcgcatcctcgtcacagcgggcgcagcaggcggcgcagcacatggtccctcagctccggcttcactgcaaaggtcaggtccatgtggccgacatcaaactcgcgcaggtggatgggctgccccgagcgcgccagccacctggcgtgcatctgtggggtcggagggcgggcaagagtggtgggtgggtggggtgagctgttaggtatggcaggagaagaggcggcatgcatggccaagcgaggatgtgctgtccctcaacctgttgatactgggcgcacacccccctcgcccgacgatctctggagctgagccagatgtggtttgaggtgaagcatcgtactgttcacccacaagggggcagcggaaaagggcatgtgcgactgtttacaaaatattttgaatggcaagactgggacgccctcttccgctggacagccaccccacccctctcgaaggccttccccaccctccccaccccggcccctgaccttgacgtcctccacgccgacgacgcggtcggaggtgccggccaccaagtccacgggcacgtccaggaggcggtagttgtgcgcgatgctgggcgggcgcggcgcggcgtagacggcgcggttggcggcggccgagccgtggtcgaagaggcggaaggcggggtcccgcgcccactgcccaaagtgggctcccgtgtgcaggctgacggcgggcatggaggtggagttgtagtgcggcatctgcatggccaggtcccactcgctgccgtcgccggacatgagggcttgcatgctgcgccgcaccagggactgcagggcggggagctcgctcaggtcgagcgtcagcttgaaggtgacgtagcgcaggaaggggctgggcaggcgcaggcccaggccgcgcccgggcagcaccaggtccatcagccgcgcggcccagggcatgagccacttgcatgccgcgatggtctgcgcatgttgtgagggggggggtgatgcctggtatgccgcgggggctggggggtggggggttgggctatcgccgggcggtgtgcacaagaatggccgtggcctggcgtggcagcactgaaacctgagtgcctggcacggccaggggcccacaggcaacggtttgttcgggaagaagctgttgattgggcaatctgtggctggaccattgcaagccccggcctaggccccctcaccagggcccctccacaccgccgacatcccatcatcccaaatccctgctgaacactcctcccagcctcacgagtccctcccctcctcgatcatccccccaccaccaggcccccgctcaccctgggcacgtgggagtggaagccggcggggctcatgagcaccaggcgccgcaggcgatgtggccggccctgcatgcggcacaccgtgacgtacatgagcaggcaggccgcgcccagggagtgccccacgccctgaagattgtagggcaggtgctcgggggcggggtcgcggcgctcctcggggatcctgaaactcaggcccttgtagcgggtggtcggaagcggggtggcgtcgtcccgcgccggcggcgctggccgtcgcttctcgccctcatcatccccttgaagctcgtnnnnnnnnnncagtgggtggtcggaagcggtgtggcgtcgtcccgcgccggcggcgctggctgtcgactctcgccctcatcatccccttgaagctcgtcggccgggggcgcccgccgtggcgccgccccgttggagccggatgtcctcctccgacggctgctggagcgtgtcgccggtgcgtcctcgcggaatcgccctgctgcgtgtgaggttgcagtcccctcccccgccgccccgccgcgctccctctcgttgccaccgccgttgctcccgcccagctccgccatcttgacggcgtggatgtgctccacctgcgccccgacgtcgcccatggcctgctcgttggcgctgtagtgccagtaccgcaggccctggcatgcgcggtcggcgtgcatgcgcggcgcgttgctgcgcgagttgcccagccagacgtcgaagccggcgtcgtaggccgcaaaggcctggctgcccaccgaaccgttggccacccagcccagcgaggtgtccagcacgccgtgctggaagagcgtgacttcctttccacctgaaggggaggggaggaggggtggtggtctgtggtggtgggggtggggaggtgtgttttgcgggtatgcgagactggcaactccccaggtacaggtgctggactctcgtggctgccctcaacccccacacgcttccccaccccgcccccatcaaccctccctttcttatcaacctgtgcgtgggatgcggtgcatggtgaggatgtagccatccgacgtggtcacggtgtgctcctccagggggtaccccgcgcgcaggacaaagtcggaggcggtccagacgtggccgtcctcccacttggcggcaaaggcgccggtgggcagcggctggaaaaggcccccggcgcccgagtcgcgccgcagggctgggttgcgcccccggccggcggccggcgggcggccgggggccaggagccgcgccgcgccggcgcgca

SEQ ID NO: 47463 - DNA, 61 bp, Chlorella protothecoides
ctcgccgtcgacgactgcctcgccactcttcgctgcatcggcagccccgccgccgtcggca

SEQ ID NO: 47464 - DNA, 61 bp, Chlorella protothecoides
gatggcggagctgcagggccgcctgcccgtccgcgtggagctcaagggcctcacgtgagtg

SEQ ID NO: 47465 - DNA, 61 bp, Chlorella protothecoides
gtaggagcagaagctgaagggcccgtcggcaccgggggcgtgggcgggcgtgtcgtgcgtc

SEQ ID NO: 47466 - DNA, 65 bp, Chlorella protothecoides
agtctgcacccccacccgccaagcagtctacacccccacccgccaagaagtcaccaccctcccca

SEQ ID NO: 47467 - DNA, 61 bp, Chlorella protothecoides
tgcttgcggtgcaccatgcctgggggggggggagtttggggtaatgtggtctgtaccagca

SEQ ID NO: 47468 - DNA, 73 bp, Chlorella protothecoides
tcaggctccaatcccactgatctgcctgctatccacccccccaccacacaccacacacacacacacattgctc

SEQ ID NO: 47469 - DNA, 79 bp, Chlorella protothecoides
tgcacccagcgatgccttccctcgctgtgctcgcagcagtgggcacgagcggatgccgtggtcccagcgctcgactccc

SEQ ID NO: 47470 - DNA, 11807 bp, Chlorella protothecoides
  modified_base (307)..(316): a, c, t, g, unknown or other
  modified_base (821)..(830): a, c, t, g, unknown or other
  modified_base (1182)..(1191): a, c, t, g, unknown or other
  modified_base (1647)..(1656): a, c, t, g, unknown or other
  modified_base (1959)..(1968): a, c, t, g, unknown or other
  modified_base (2233)..(2242): a, c, t, g, unknown or other
  modified_base (3099)..(3156): a, c, t, g, unknown or other
  modified_base (3385)..(3394): a, c, t, g, unknown or other
  modified_base (4577)..(4586): a, c, t, g, unknown or other
  modified_base (4915)..(4924): a, c, t, g, unknown or other
  modified_base (5335)..(5344): a, c, t, g, unknown or other
  modified_base (5881)..(5890): a, c, t, g, unknown or other
  modified_base (6642)..(6651): a, c, t, g, unknown or other
  modified_base (6962)..(6971): a, c, t, g, unknown or other
  modified_base (7750)..(7759): a, c, t, g, unknown or other
  modified_base (8017)..(8081): a, c, t, g, unknown or other
  modified_base (8257)..(8266): a, c, t, g, unknown or other
  modified_base (8462)..(8471): a, c, t, g, unknown or other
  modified_base (8538)..(8640): a, c, t, g, unknown or other
  modified_base (8735)..(8744): a, c, t, g, unknown or other
  modified_base (9070)..(9079): a, c, t, g, unknown or other
  modified_base (9159)..(9168): a, c, t, g, unknown or other
  modified_base (9256)..(9265): a, c, t, g, unknown or other
  modified_base (9539)..(9548): a, c, t, g, unknown or other
  modified_base (10011)..(10020): a, c, t, g, unknown or other
  modified_base (10533)..(10542): a, c, t, g, unknown or other
  modified_base (11393)..(11402): a, c, t, g, unknown or other
  modified_base (11470)..(11713): a, c, t, g, unknown or other
gcgctgctgggcgccccagcgcccagcgacggcgcatggctggccccggggtccggcgccagggcccagcggggcgtgctgggcgcgctggtcgaggtgccggcgcccagcctggccctgggcccggagcggggcaggcgcctggcggccgccaactccgcggtcctgcgccggcacttccaggagctgacgcgcaccctcctcttccccctgctcccctgcatcactcccgcgccgcgcccaggccaaggtgggaggctttgatgattttggtagcggggctgctgcctgagtgcgttgccgggannnnnnnnnnaccgcgcccaggccaaggtggcaggctttgatgcgtttggtaccggggctgctgcctgagtgcgttgccgggagccttgcattccctggggcaccttgccatagccgggcgtcctggttgccactgtgcaaacatggctcgacaccctgttgaagcccattgtgtgaagccctttccaacaaccactgcaaagcacggccgcccatcaatgccactccacattacacacaggctcgcccggtcctggagacagaggcccaccagaatttgaccctggcagggtactcgccgacctggcagaccccagcggcaccatcccagaccccctcgtccaggtttttggcacgcgggccagggtggtggcgttctatgcccgcttcctggcaagccgcaactgcagggcctgggtggaacagcgccaggcggacgccagggcgtggcagctgaggcgcatgcttgggggtgagttctggatgacagcgaggaggcgacgtgggggtggcgnnnnnnnnnngcagcgccaggcagacgccagggcgtggcaggtgaggcgcatgcctgggggtgagttctgagtgacagcgaggaggcgacgtgggggtggcggtggctgcagcctgagcattcggccctatacaacaaccacacgtcaccgggcctcccctgcgacacccaggagacatcgctgcccgaggaggcgacgagctggagccacgtcagcggcgtatgagtgtgaaaagttggagggacctcacccttccctgggcgcggtagcaccttgcggcctggcgatggggacgcacagaggctcggcccatgctccactgaatacccaatttcctcgcacccatgcaacaggctgggcnnnnnnnnnnagaaaacttggagggacctcacccctccctgggcgccgtagcaccttgcggccgggcgatggggatgcacagaggctcggcccatgctccatagaataccccatttcctcgcacccatgcaacaggctgggcacgcatataaccatgttacagtgagtcagtcagtggggtgcagcacatcgctgcacagaacaatcccacgccggcctggagtgggcatccgcgctgtctgcctccagccagggctttgctagcgtgctcgtgcacgcccgggggtgtgcaccccaggcaggatggttggtgtgcacgagtgcgagcggcgaggaggagtggccatactggtatgggcgtcacgttttagcctcacgccgatgttcggatgcagatagctgaaaagtcacgggcagtggccctccccacccgcaagacctctggcatgaggacccgcagaggggnnnnnnnnnntgcccgggcgtgtgcaccacaggcacgatggttggtgtgcacaagtgcgagcggcgaggaacagtggccatactcttatgggcgtcacgttttagcctcataccgatgttcggatgcagatagctaaaaagtcatgggcagtggccctccccacccgcgagacctctggcatgaggacccgcagagggggcgtcacaagatcaggaggatggaagctgccgccgccgcccccgcggccagaccccaggcgccagcctgcaaggttggcgattctgagagtgagagtccagcatcagagaggannnnnnnnnnggcccccgcggccagaccccaggcgccggcctgcaaggtcggcgatcctgagagtgagagtccagcatcagagaggagtttcaatgacagtcccagccctatccatggcccacccaccttctggctggaggaggggggaggcgggctggccgccggctccccaaatgcggaggccgcggtaggggctgccccagtacccggactccggccggcggcgggtgacacagtagaggtcgccccgatgacagtgggcgaggcaccactnnnnnnnnnntgaggccgcggtaggggctgccccagtacttggactccggccggtggcgggtgacacagtagaggccgccccgatgacagtgggcgaggcaccacttgtcacggcggcaggtggagcgacactggctgcgccagatggcgacgctgcgggtggaggggggctgccggccgcctgctttgagggggagctgggcgtggcacaggcacatgagtggctcagggccccggacctcgagtcgcactcaaagtcgactgcaaggggggagagggggatgcaggttgtgagcgctggactggtacgctggaccgtgcccagagcttatacggggggcggaagatcatggagacaccctggcacccacattccttctgtttccattcatttcccacatcccatcctcactcttggagtcggccggacattgctcctcacagaggcttctcagctcagtgcattgggcggactcactggaggtggtgaggaggggaggcgggggggacaccgaagggactgacgcaggaggtggagggctggggggactggggctgggcgaggtggaggtagcgcaagcacatgactgggagatggagccgctttcctcctggcacttgaagtccgacacgcttcccgccggacagctagccgcgcactgcagacaacgttggtgggcagggcatgagtggacatgcatccattccattgatcagtgcatgccattagaaggtgcatcgaggggctgtccggtgcaacgcacctgttgcttggcctgcgcacaggtcagtgccatggcggaagggatgagcagggcgagtgctgccaccagggcggcaatgcaggtcctccgcattttgtaaaannnnnnnnnnnnnnnnnnnnnnnnnnnnnnnnnnnnnnnnnnnnnnnnnnnnnnnnnngtatcagtaatgtctttctctcgtgcgaagccttgtgtaccgggctatatgcgaaacacgactttcccctacacgctttcggctggtctccatgccttcctcatgtcccgaacgcggttgagcttgcccatattttctgattgttcgcatgcctgccttgttgtccacacttaatcatagtatttttaaatcttgctttaagaacatctctaccttgcgaagtgtgagnnnnnnnnnnctcatagtatttttaagagcttgccctaagaacatctctaccttgcgaagtgtgagttgaggacacactcgcagcgccacctgtgcgtcctacactcttccggcatgtcgaaacttcgctgtgcttcaccaggcatgcagccagggaacacggcatgcgcgctgccgtgaaatcacagtttctttatagctgctgcacacccctttcccaaggtgctcggaccaattttcgcaccgctcacggcttgttgtagcaggcatgcgcatttcaaagtacattcccttcgtatccggacggggcaccaactgcgcggtgtcgcttatatcctgtgtctgaagaggaacttgactggctacaagggctatgatcttgcctagagtcagcccggaaacgtctgcttcggaggtttgcattcgcgatgacgtagaagtcgagggaagaggtatgaacccgagggaagcatgataagagcccggcgcgtggcatcttcgactacatgcagcctctttcgagaacagtatccgaaacgttaacctcccaacgacatttatacctgtcacagaatctttcctcattgcggcattcccgatgacgtctgctaagcagctctgccgggccggcctgctcgtatgcctcgtcctcctgctggctcagcaggcatctgcggcctacgagtcccccttctgcgctgcccagaacgccacatgctatgagggctgccctgttggagaggtggacttccagtgcgatgacagtggccccggatcgcagtccatctcctgcacatgccagaacggttccgggcgcggttcctcgtctgcctctgcaacatcatcgtcgtcgtcgccctccccatcgagcacgacgtcgacttccggtagaagctatgcgtggtggaatgaggagagagagaacgctggaggtcgtcgctaatgtaggttgctgttttcgaatttgggggtcgggcggtgcatgcagcttcggctttgggctgattccgttccacacattcgattctgcctcttgcagggtgaggaggccacggcaaaatcagggccagagcgcttggacccttaagagcacactttcgaccaagactgatgatgtaagcacaccctccatcctgaattttctccattttgtgaatatttgatgtaactgccgaacagccgatcaaattcgnnnnnnnnnncttcgattctgcctcttgcagggtgaggtggccacggcaaaatcagggccagatcgcttggaccctcaaagagcacactttcgaccaagactgatgatgtaagcactccctccatcctgaatcttctccattttatgaatatttcatgtaactgccgaacagccgatcaaattcgaggcatgggctggatgtctttgcagtatgctgtatccttgaccgcaaatgagtgccaatgaatagaatttatgatggtgatattaccagtggctttgaacagacctcattatgttgctgcactttcattccatccgtttccaccctctatcccnnnnnnnnnnattatgatggggatattgccagtggatatgaacagacctcattatgttgctgcacgttcattccatccgtttccaccctctatccccccagacttgtcctaggggaccaacacagatactcaaagaatttctccccgttccttcgctcagatgaatgctcgaatgaaactcgtatgatctgaattgcagcatgtcagcaatgtgtagcggttggtgacgcccaatgccaaggtctgggtgacggagtcttggggtgtacgggtgtcgagaccgccacaagatacgcgcgcgattagcagcatgcgcgacccacagggccagactttaaagtacttcaagaatacaccccagcaacggtcgacatataaatattgacggtgaactatccggatcaaatgctgtgggagactnnnnnnnnnnatgcgcgccccacagggccagactgtgaagtactccaagaatgcaccccagcaggggtcgacatataaatattgacggtgaaactatccggatcaaatgctgtgggagactccggggtgtagtggcagtagtagggtttcaccggcccctgatacccacttccaggacctccaaggcgatcatagtgcctcctatgaatccatcgttccaccgcgcgaatagtgtttcacgctgacgggtggtgaatggcaccttcctccaccttgtgggcgtcgcaacgcagccagacagggtcacagcgggtgggggactacctcctggggcgcaccatcggcgaggtgcgctggtgtcgcacgcgccgacaccctttcaggcataccgagcaacgaggggcattatctcttgcgaagaaagcgtgcgcattgccccagtcgggtgtgtaactcccaaagtccccacccaccctccatcgcctgcatcagggcgccgactccagggtggtctacgcccagcacgtggacacgggcctcaaggtgnnnnnnnnnncgccccactcgggtgtgtgactcccagagtccccacccaccctccatcgcctgcaccagggcgccgactccagggtggtctatgcccagcacgtggacacgggcctcaaggtggccatcaaggtgctggacaaggaggcgctgctgacgcgcggcggcgctgcccgcttcccgcgtgaggtggccgcgctgcgccgcctgcgccacccccacgccgtgaccctgctgggcgtcctttcctccccctccacgctctacatggtcatggagctggtggcggggggcgacctgtacgaccgcatcgcgggggagggacccctgaaggtgggttggggaaccagggggttgagagggagaggcattgcccgagaagatgcgcccgggggcgcacatacatgtgctgactcggatgtcattacctggtgcccctgctcctcacacgcaggaggcggaggcgcggcgtctcttctgccagctgctcagcgctctgggtgcctgccatgcggcgggtgtcttccaccgcgacatcaagcccgagaacgtgctgctgacggagggcggggacgccaagctggcagactttgggctggggtgcgtcgccggggcgcaggacctcctcaggacggcctgcgggaccatgcagtacaccgccccggaggtactgcgggacaaagggtaccacggcgggccatcggacctctggtcccttggtgagttggggattgggtgggggcagagtggactggggcctgnnnnnnnnnntgggaccatgcagtacaccgccccagaggtactgcggggcaaagggtaccacggcgggccatcggacctttggtcccttggtgagttgggggttgggtgggggcagagtggactggggcctgtgcaaggtcccaagcatggtggtaggaatggattaggaatgcgtgccagggagcttcctcccatgtggcaaggcgccatgccggatgccgccgcttggtgggccgctccacctcctgtaagccccctccccccatataacaatgaatccaatcaaggcgtggtgctgttcgtgatgctgacgggggagnnnnnnnnnnacccaagcatggtggtagggatggatcaggaatgcgtgccagggagcttcctcccatatggcaagggcccatgccggatgccgccgctaggtgggccgctccacctcctgtaagccccccctcccaaataacaatgaacccactcaaggtgtggtgctgttcgtgatgctgacgggggagctgccgttcgacgccgacacgcccctggctctgatgcagtgcatcgccgccgccgactactccctgccgccgacggtgagcgcggcggcggcggccacgctgcgcgccatgctgtgccccgacccggcggctcgggcggggatcgaagaggtgtgggacatggactgggtcgccgcatggcagggcgatgcgccaggcgaggcggcgcgggcgcgcgggggagccgacctgtgtcccgagactcaggcggccgaggccttgctggagccggggtctgactcggcatcgggcatcgaggaagtgtccgagcctggcagccccgtggtgggtcggtgatgctggggaagaccgggcggtggaccaaggggcttcagggggataagaggtcgcacggcaggattgctcagtgatcgccgagccacacagggatcactattgtcgaccagccatgagcatgcgcatggcaacgcctgcccacagaaccagatcaacttcacagcccggcacctcccggcatgacacccaacctacgcaagcctgttcttcctcctcacccccaatcccatcaccatccacgcagatgggtggcagccaccccnnnnnnnnnncgagcatgcacatggcaatgcctgcccacagaaccagatccacttcacagcccggcagctcccggaatgacacccaacctacgcaagcctaatcttcaccctcacccccaatcgcatcgccatccacgcagatgggtggcagccaccccttgctggccgggcccttccatatgaatgccttccagctgctgcgcgccaacctggacatctccgccatcttcgagggcaggcaggacgtggtcaagcgccgcacccgcnnnnnnnnnnnnnnnnnnnnnnnnnnnnnnnnnnnnnnnnnnnnnnnnnnnnnnnnnnnnnnnnncagtcccaactggtgaggcggcgggggggtggagttgttgccagcgcagacttcaggctgggtcgggcctgcacctccacgtaagcccacctcagcccacgtcctggctttctccaagacagaaaggatgcggcaaacaccagtctctgtcctgccaacaagcaatcacccccccnnnnnnnnnnttcacctgtgggcccgacctggagggcatcctccatcgcatccaagccgccgtggagggagtgggcggccatgtggcacgccgtagtcccaactggtgaggcagcgggggggtgggggtgttgccagcggagacttcaggctgggccgggcctgcacctccacgcaagcccacctcagcccacgtcctggctttcnnnnnnnnnnctcacctgcgggcccgacctggggggcatcctccaccgcatccaagccgccgtggagggagtgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaaccactgtgcagcctcagcatgtcggtacccatcccagctggcatcctcactgtgcggctggatgcccacatgctggtgccgggcaaacatnnnnnnnnnnaaacccctgtgcagcctcagcatgtcggtgcccatcccagctggcatcctcaccgtgcggttagatgcccacatgctggtgccgggcaaacatctgctggacatctcccgtgtctctgggcccgcccccgccttttacaaatggcaagtcgggaagggtgttggtgcgcctgcagtggggacaatgcagagccatggggggtggcggggcatggggtcgacaccggagggtgggcagcgctgcgcattgtcttggtgcccatgacacttcctgcccgtcgtaccaccctcgcctgcctgctccttgattctgcaccgcgcaggtannnnnnnnnnatgtcttggtgcccatgacacttcctgcccgccgtaccaccctcgcccacctgctccttgattctgcaccgcgcaggtannnnnnnnnnggggtgttagtgcgcctgcagagaggacaatgcagagccagggagggtgcggggcagggggtcgacaccggagggtgggcagcgctgnnnnnnnnnntgctcgccttgtcgcccagctgcggcccttcatcctccaagcaaagcctcttgtgagtttgctgttctgcagtgcaatgaaacgaggcacctctggaccagattccgtgcgcatgctttcgcagtcggctcagaggaggaccttgctccgggggattggactctctgcctcttcccccctgcacggcacctgctgaatcagtcatcgatgcccgcccccaatgtcctccctcctttctcaactccaggcagtgggttcgtcccaggccctggcnnnnnnnnnnccccgccccgaatgtcctccctcatttctcaaccccaggcagtgggttcgtcccaggccctggccgccttcagggtgatcaaccaggggctggacctgggctccctctttgcgcccagcacccacttccagttcaccagcagggagggtgccgacaccatcctggatagcgtgcgcagcgtggcgagcgacctcggctgtgccgtgcatggcgcacacgatgacaggtggggcacaagtcagggtgcctggcagcagtcggccttgcctgggaggcagtggaacttttgcttactgggcatcccagtggagaggctgtcgtcgatacaccgataccgtcgcaacaccaggacagaatacatggggcccagctgttcccccaagtcgggcacaattgctgcaccctctttcgaacttcgaccacgccctactcttccgcagtctcacgctggagcggaggacgnnnnnnnnnnccccagtagagaggctgtcgtcaatacacccataccgtcgcaacaccaggactgaatacatggggccctgctgtccacccaaatcgggcacaattgctgcaccctttttcgaacttcgagcacgccctacctttccgcagtctcacgctggagcggaggacgggaggggccaatgaggcgcctctcagcctgcgcttccaggtcctgggggtgcttccagatctccaggtgtgccaggtcagcatgctggagggggctcctaccgagttccagcacctgcgggctgacctagtttgcggcctgtcaggcatcatgacggcatcttctgggaagaagggccacccgtgaggcaggcgtggatcatttccagctctgaagcgtcgcctcgtcggcaaaccgcagcccatttgcaacagccctgtttcttctcacatcaaggattttgcaattctatgcaccatggtcaacctgaagcgtggtctcttgtaccttattactccagcatgaaagatnnnnnnnnnntgtggatcatttccagctctgaagcgtcacctcctcgtcaaaccgcagcccatttacaacagccctgtttcttctcacatcaagattttttcaattctatgcaccatggtcaacctgaagcatggtcccttgtaccttattactccagcatgaaagataatatcaagacacccaaggtactggggtataccatgtgcttcttgaggcgcgaaacctccaaggtttgttttatgagaggaaatggcagagtcttattgatttgtcaactccaaggacgagccctgaatgggataaactccttcaaaccacgtgagccagacactccatcatccagaccctccgattctgccaccaccccaggaacaccacacaccatcgccagaaattaattctttgtggcgaattctcattgcatttggtagtatattctcccgagagtgctccgtgcaggccacgacctcagtcccaccaagcacgggacaagatgggctccggcactcgcgcctgaccccctcgatacccatcacccctttcccccgccccccagcacatcttcaccatgctggggacatctcaattgggacgcatgtccctcggcagcgagctggcctccagcggcgctcgcctgggcctgtccctgaacgggaagttcctgccgtccagcagcgggccccggcccagcagcacccgcgcccccccgcccggccgcatgctgagcctggccatcgacctggacccccggcacgcccctctggcccgggctccgcccctggtccagccccaggacccgaaggcccggcggcgtagcatggaccgcgacaccccccctgcccccccttcccgcccctccnnnnnnnnnnaagttggtagtatttcctcctgagagtgctccgtgtgggccacgacctcagtcccaccaagcacgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctggcccgtgctccgcccctggtccagccccaggaccccaaggcccggcggcgtagcatggaccgcgactcccccccagcccccccctcccgc

SEQ ID NO: 47471 - DNA, 61 bp, Chlorella protothecoides
agaggcccagaccgacgagaccctggcaagccatgccgtggcggatgtcgggtcggaggtc

SEQ ID NO: 47472 - DNA, 61 bp, Chlorella protothecoides
gtcgtccccaatggcagcggctggatcacctatggcggacacagaggcgcccgctgagccg

SEQ ID NO: 47473 - DNA, 65 bp, Chlorella protothecoides
cgggcgcggccaggtcgtctccggggtcgacccaggcctgcccctgcacgcggcgcagcagcgcc

SEQ ID NO: 47474 - DNA, 69 bp, Chlorella protothecoides
ccctcttcccgcaggtgcccgacccacaagccagccagtaccgaggtgctgctgtcgcgggcggtgtgg

SEQ ID NO: 47475 - DNA, 61 bp, Chlorella protothecoides
ggggggttgggtggagaggagggggggaggaggggaggagggaggaagggagctgtcgggc

SEQ ID NO: 47476 - DNA, 92 bp, Chlorella protothecoides
cgactgataatgcctgcaagggtgtggggggggtctgtggcggagccatgcatgcggaggtgacgtggtcggacgcagcctttcagcacgcc

SEQ ID NO: 47477 - DNA, 61 bp, Chlorella protothecoides
acccctggcagctccggcagaggtccggggggtgagcgggtggggtggggcctgcctgagt

SEQ ID NO: 47478 - DNA, 62 bp, Chlorella protothecoides
tgcgctccgctgcctgcgcaggcgtcgagcggcgaggtggtgtgccgtgcacggcgccggca

SEQ ID NO: 47479 - DNA, 108 bp, Chlorella protothecoides
gccgcggcgggcgggccctcggtcgcgggcgggggcgggccccgcgtgtccccggcacgcggggcggcgggcctggcctgcgggggtctcggcgctgggccccgcgcc

SEQ ID NO: 47480 - DNA, 68 bp, Chlorella protothecoides
ggcagcggcgacggccaaggagtgcggagcggcgatgcccaaggagtgcggagctgcgacggccaggc

SEQ ID NO: 47481 - DNA, 80 bp, Chlorella protothecoides
tcagccaggcaccagtccaagagccctctcaaagcgaaccccccccccttactcctttccatgcacagaacagcggcacc

SEQ ID NO: 47482 - DNA, 61 bp, Chlorella protothecoides
cgtgcaacctggcagaagagggggggggggtgtcttccttgcacgtgtgtgggctggcggc

SEQ ID NO: 47483 - DNA, 61 bp, Chlorella protothecoides
ggcggcatcctgtccaggctggggccgggggcgaacgaccccgcccggtacgccagcagct

SEQ ID NO: 47484 - DNA, 61 bp, Chlorella protothecoides
tgtgttgtgctgatggcatggctggaaggggcgtgagctggagacagatgtgcagcaagca

SEQ ID NO: 47485 - DNA, 61 bp, Chlorella protothecoides
gacgggtgcggggggggggggtttgcatggggcattggcatgccagggcatgctctcgttc

SEQ ID NO: 47486 - DNA, 153 bp, Chlorella protothecoides
ccgccgccgccgtctccacccccgagcccaccgcccccgtccccaccgccagagtcgcccacctcccagcccaccgcctccgtccccaccgccagagtcgccccccccagcccacctcccagcccaccaccatctccacctttgccaccgcca

SEQ ID NO: 47487 - DNA, 61 bp, Chlorella protothecoides
gacgggaggcctgcgccgaggcgcggcgcgcgctgcgcgaagcgctggcgcgcgacccccc

SEQ ID NO: 47488 - DNA, 61 bp, Chlorella protothecoides
ggagtaggaggcggcggtgaccatctcgtgcacgtcctgccaggacaccaccttctggtcc

SEQ ID NO: 47489 - DNA, 61 bp, Chlorella protothecoides
cgtcacccctggtggcgccccctcgggggcgcccaccggggctgtgcttccgtgggcacca

SEQ ID NO: 47490 - DNA, 61 bp, Chlorella protothecoides
tgcgcagcgcgtgagcgcatcattggctgggaccacaccggccccaggctgcgcgagtctg

SEQ ID NO: 47491 - DNA, 61 bp, Chlorella protothecoides
cgtcctgccctcgctgtcgttgctgccccgcgaccccgcgccggcagtccaggtagatggt

SEQ ID NO: 47492 - DNA, 64 bp, Chlorella protothecoides
cgctcgcgcgcacgcgcacgggggagacggtggaggctgggggtggtgcaggcgcaggtgcaga

SEQ ID NO: 47493 - DNA, 77 bp, Chlorella protothecoides
tgggaggggagatgaccttgatggcggggcatgcaagtgggggcgcaccgcccgccccctgccacaccgccgtggaa

SEQ ID NO: 47494 - DNA, 61 bp, Chlorella protothecoides
gtccagtccccagccagaggagtgtcggggggggatccccgccttgaacgtcgaggggcca

SEQ ID NO: 47495 - DNA, 114 bp, Chlorella protothecoides
cgtgtcgcggcagccaggcacccgcatgcttcttgtctcagcccgtcctgccgcgcctgactatctctaggcagacagtgagggctcggcgtcaaagcggcagaaggcggggtc

SEQ ID NO: 47496 - DNA, 61 bp, Chlorella protothecoides
caccgtggtgggcgccgacgtgatcgcggtggtgggcggcgggcgcgtggtggaggccggg

SEQ ID NO: 47497 - DNA, 61 bp, Chlorella protothecoides
tcagcgcagacacgtagcaggtggcggcgggattttctgctgcacaagcatgcacccattt

SEQ ID NO: 47498 - DNA, 61 bp, Chlorella protothecoides
ccccttcctcggcgacctgaagcccggggcgcgccagctggcggtggagacggggctgttc

SEQ ID NO: 47499 - DNA, 713 bp, Chlorella protothecoides
  modified_base (291)..(307): a, c, t, g, unknown or other
  modified_base (412)..(421): a, c, t, g, unknown or other
gcgcgcaggtgcaccgcctcggccagcgcctcggccaggtcggccaggccggggaccaccagcgccgcgccgtgacgctcggcgcgcgggccggcggccgcgccgggaaccgcacaggcatgcgcccagaccgcggccagcgacccgcgagcgcccaggcccgtcagctcgggctcgtgcagcatggaagggaaatagatgcgcttgatgtacgtgctcagcgcgcggcgctgcggggggaggaggtgtgtgtgtgtggtagtggtgggttgatgtggtgtgatggggggnnnnnnnnnnnnnnnnntcccattccctccacgggactccacccccccccaaaacatgttgcagtcactcccagacacccatcaaaatcacccccccgggcccctcctcgcctggagcacgnnnnnnnnnncttcataattccctccacgggactcccccccccccaaagaaaacatgtcaaagtcactcccagacacccatcaaaatcaaccccccgggcccctcctcgcctggagcacggggtccgggtggtccagcagggaggccagcgcgtcatccacggcggcgggagcctccacaagcatggccatgcgcgcgtccacgctggcggccgccgcgctcaggttgcccagcccagcgtacaggccctccaccagcgtgggccggcgcgcgaccccggcgggggtcggagtgctggccgc

SEQ ID NO: 47500 - DNA, 61 bp, Chlorella protothecoides
accgtccattgcaagcggccgacgctcgaggagtcaacactcctcgcatgtccggcactgc

SEQ ID NO: 47501 - DNA, 9539 bp, Chlorella protothecoides
  modified_base (1292)..(1343): a, c, t, g, unknown or other
  modified_base (1510)..(1519): a, c, t, g, unknown or other
  modified_base (1586)..(1595): a, c, t, g, unknown or other
  modified_base (1662)..(1752): a, c, t, g, unknown or other
  modified_base (2173)..(2182): a, c, t, g, unknown or other
  modified_base (2677)..(2686): a, c, t, g, unknown or other
  modified_base (3389)..(3487): a, c, t, g, unknown or other
  modified_base (4185)..(4194): a, c, t, g, unknown or other
  modified_base (4710)..(4719): a, c, t, g, unknown or other
  modified_base (5279)..(5288): a, c, t, g, unknown or other
  modified_base (5729)..(5738): a, c, t, g, unknown or other
  modified_base (6391)..(6400): a, c, t, g, unknown or other
  modified_base (7253)..(7262): a, c, t, g, unknown or other
  modified_base (7987)..(7996): a, c, t, g, unknown or other
  modified_base (8196)..(8205): a, c, t, g, unknown or other
  modified_base (8323)..(8332): a, c, t, g, unknown or other
  modified_base (8493)..(8621): a, c, t, g, unknown or other
gtggaggccagcagcgccacgcgctccgcggcgccggccgcggcgccaggagagtcgacgtcggtcgagcttcccgccccggcatccggtaccctcgctgctgcgtcaccgccctccgcgccgccctctgggccccctgcggcgatgcccccacgacccttcgcggcgtctccgccccctgcctgccgggaccccggttggccgccgcgcaggcatgcctggaccagagcctccagtgcgccggcctcgacggccagcgccgccgcccccggcgctgcagcacaccgcgccagcaccgcgcaggcttcgcacgctgagccctcctgcgccagcagagccaggccctgccgcacggtggcggtggcggaggcggctgtcggcagcggccgcttggcgggggagggcgtgcagcgcgggtgcagcggggacatgggcggcggcgcgggaccagcgcgtggcggcacgcgcggcggggacgaggggatggtgggcagggtgggggaggcggggagggcggcgacggccctcgccctcctgcccccggaacgcgggcccccgaccgatggccccgcccccggtgtgtggaccggggcccgctgcagcgccgtctgggcctcggccagggaggtgacggagcggaggcaggccggcggcgggatcgtgccggcgggggcgccatccccggggtcacacagctccaggcaggccaggtggaagttgaggcgcagcgtcacgtgcctgccgtcgggcgcgctcagcctcacgccctgcagggcgcagtgagcggtgcacggtgagaggggaggcctggtgcaggctttgggggcaggagcgcgtggcatgcacctgggacgccaacggcaggaccagaccctggagtgccacgcccaccctgagagcaccgagaccagcggacctggggcaggggggtgcaggcgaggcgaggccccgctccacctgctccggggctgcgctgctctcccgccccgcgctcccgctcgcgctgcagctcccggtccatggtctccagccgcgggaagaggcaggtcacgatgcggtacagggtggcgtgcatacgctccggcaggaaggcgcggcatgccaggcgcagggccggtgctggggtgctgccatccttgaaggaggcctggcggtggggctgcaggcggatgggcttgaagggcaggacctgcaggcacggagggccccccaggctgcatggaggaggagaggagtgcagagatttggagggtgactgcgtggtgctgtgcttggagggggcgcgggcgggnnnnnnnnnnnnnnnnnnnnnnnnnnnnnnnnnnnnnnnnnnnnnnnnnnnnccatggcagggatgagaaacttcacgagtccttaccggtagacaatgttgagctgagctcggccgtttgcgatgctggacgcgtcagcccacaaggccgggcaggagatggtgccctacggagtgcatgggtacatactccctcttttgaatctacagagcatgcgnnnnnnnnnngctgggaacgcagggcccaggcctcactgctgagcccgtggtgctccaccatcggggctgcggcatnnnnnnnnnnactgggaacgcaggggccaggccccactgccgagctcgtggtgctccaccatcggggctgcggcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccgattgcgatgctggacgcgtcagcccacagggccgggcaggaaatggtgccctacggagggcatgggtacagactccctcttttgaatctacagagcatgcggatgtgcatccacgcgatcggaccatcgccccatccaactcacatcttggacgctcttcaggactgatccggtgtccaggacgtagaatgagaggctttcggcgtacgtgggctccccattctcgcccgaagggggggggcaagactgggagaggcacaggaactcccgaatggatggagacaggcaacctccagctctttgcaacagcccgattgttgccatgacttctcctcagggttcgggcgagggctattgatgtcgcgccacggcgtctgcctggtgtatcattgcaagccgagcactggcccggccgannnnnnnnnnattcgggtgagggctattgatgtcgcgcctcggcgtctgccttgtgtttcattgcaagccgagcactggcccggccgactccgcttgtgtgcgaggtgaggcagcctctgcagctcgccaagctataatacaatcaatcagatgagaccatgctactcatgggaagccgagatggctgctgcgctgcgccattgccgcagtcccgctctgttacggcccaaggggaacatcctcgggtcagctcagctcgggttgaaatcctccatggaagaaagggtggggttggggaatatctctggtaccaccccctctatagaccagcccatcgtctctgctgtgagccgccggggattgaatcacaccaacaaagtgaccaagggcatcatcattgcaatcgggaggcatgggtcagcgtcaggagggaagggcggggcccccccacaccgctgcctcccatccccaagcatcacatgaacccgaaatctgcccctgtcnnnnnnnnnnccattgcaatcgggaggcattggtcagcgtcaggagggaagggcgggggccccccacacagctgcctcccatccccgaccatcacatgaacccgaaatctgcccctgtcccgccgcgcccagggcctggctgcatgatgtctgggtggatgccccccctccccgggggcccccgtggcaggttgccgtctgggtggaagcctggcaggccgggcggggcgatggggtcccacctcgccccggggggtggcctgggtcccccatgcgccgggccccgccccagcctgtcgtcgaacagggggtcgccaggtcccacgtgcatgcccccgcccctgcgcggcgggccctccatcagcggcaacagccctgtgggggcgatgggggtgggtgggtgaggtcaggctgcagaggcctggggtatgggggttcgagcctgcggccggccacatgacacagggaaaccccgtgccgacatggaaatctgaggataccggcagcacaccctgacctccagctcccatatttcccctgctccttcgcacccccccctcccccccctctcgcacccctgctcacctggcatggcccctcccctggccggcgccaggcccagggggtaccggtcccggtcccccacggcgtacccggggtcacgcaggccgccagcatcccggacataggcaggctcggcctcgccccgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccggcgcctcctgtcccgaggccgactgcgccgcgctttcccccaggccagcagcggccagggcgccgacgaggccggccaggtcagagtagccggcactcacgccctcggcggcacgggtatatttgtccagggccaggtccagtgaggccggtgtggaccctggttgctgccccccgtcctgccactgcaggaccaggttacctcccagcaccatcgccttgagatagaggtgcgcacctgtgagtggtccagggtgcaagcgagctgggagcttgggtcgggaagggcaagacgatgcagtccctctggggagtcacagtcgactgtgtgtgttgcgctgtgcggcccgcagcactcacatgcaaaatgcctggccgacaggcaggccctgtccagtgcaacatccacggtccctctcatcaggctcaccttgctcattgacataacggaatgcgtaccgctcttccagatctgtccatccagagaggggagcaggctccctaccgacgctgtcaaacttgcttcctgcccaaccgaaggcattattttttgaaggggggagggggggcagattgcatggcaggaggtctcgtgaggaacatcactgggacactgtggaacacagtgagcgcagtatgcagagcatgtatgccaggggtcgtggcgcaggaagggggcctttcccagtctcccnnnnnnnnnntgcagtatgcagagcatgtatgctaggggtcagcgcaggaagggggcctttcccagtctcccatgccactgcaccgtatccacgactcaccaggaccagcttcttgatcggcttccgctcccgtggacaccagtgtgtagcctctggactccaggtatgcgtgcaccgcaaaggccagccgatcgtgccgattcctgggtgggggatatgagtcagccaacatggggctcagactgcacactggggcacgatacgaaacaacatctacaccgtgtcctccatgctgacacaccacagcttcgccccacctgaatgtgggcgcatgggcccgaatcacagccaatgtcgctgctgccataatgtgatccagaccctctccgcccagatgccgagcggatcgtgggcgctgaatagattcctgtttcgatcactgtttgggtcctttccttttcgtctcggatgcgcgtctcgaaacaggctgcgtcgggctttcggatcccttttgctccctccgtnnnnnnnnnngctgtttgggtcctttccttttcgtctcgaatgcccgtctcgacacaggctgcgttgggctttcggatcccttttgctccctccgtcaccatcctgcgcgcgggcaagttgcttgaccctgggctggtaccagggttggagggtattaccgcgtcaggccattcccagcccggattcaattcaaagtctgggccaccaccctccgccgctctgtctgatcactccacattcgtgcatacactacgttcaagtcctgatccaggcgtgtctcgggacaaggtgtgcttgagtttgaatctcaaggacccactccagcacagctgctggttgaccccgccctcgcaactccctaccatgtctgctggtaggtccagggttctttgccatgcacacaggaccccgtttgtgggggtccccggtgcatgctgtcgctgtgcaggcgccggtgtggggcctgggccccgcgggagctcaactcctccctatatgcctgccgcccctcccacccaccgcgacctagccccctttacagaggaaggcgaagtcagcgccatcgtgtnnnnnnnnnncatatgcctgccgtccctcccacccaccgcgacctggccccctttgcagaggaaggcgaagtcagcgccatcgtgtgcgataatggatccggcatggtcaaggccggcttcgccggcgacgacgccccgcgatcagtgttcccctccatcgtcggtcgcccccggcaccagggggtcatggtgcgtgcggcgggcgatcacatccatgcctggatctggtggaggggggaaggcgccacgcatctgcttacgtgccgtgtggtctggcattcccgggcggatgttgcgcggagcggctccagtgctggctccccaaacccctagcccaacagggaggggccctgctcgtggcatgatcctggccatggccgcgctactgctgaaccccccccccctcttcactcggcgctcccgtgcaggtcggcatgggccagaaggacnnnnnnnnnncactgctgagcccccccaccctcttcactcggcgcccccgtgcaggtcggcatgggccagaaggacgcatacgtcggcgacgaggcgcagtccaagcgtggcatcctgaccctgaagtaccccatcgagcacgggatcgtgaccaactgggacgacatggagaagatctggcaccacaccttctacaacgagctgcgcgtggcccccgaggagcaccctgtgctgctaacggaggcgccgctgaaccccaaggccaaccgcgagaagatgacgcagatcatgtttgaggtgttcaacgtcccggccatgtacgtcgccatccaggcggtgctgtccctgtacgcctcaggccgcaccaccggcatcgtgctggactccggcgacggcgtgtcccacaccgtgcccatctacgagggctacgcgctgccccacgccatccagcgcctggacctggccggccgcgacctcaccgactacatgatgaagatcctgaccgagcgcgggtacagcttcaccaccaccgccggtcagtgcgtggggtgtggtcttgcatcggttgagggtgacgggggcccccctataacctgaggcctggcagggcctgggtgcgctgtgcttccggtcgccagtaaggtctgagcgtacgcgtctgnnnnnnnnnnaccttgcatcagttgagggggacgggggggggccctacaacctgaggcctggcagggcctgagtgtgctgtgcttccgttcgccagtaaggtctgagcgtacgcgtctgatcgcggccgccctggcaatccatgacctcccccagtctttgggtctccagctccaccctccacacccaccccccaccttgcaacaacagagcgcgagatcgtgcgtgacatcaaggagaagctgggctacgtggcgctggactacgagcaggagctggccacggcggcgggctcctccacgctggagaagacgtacgagctgcccgacggccaggtcatcaccctgggttccgagcgcttccgctgcccggaggtggtgttccagccgggcatgattggcgtggagggccccggcatccacgagaccaccttcaactcggtgatgaagtgcgacgtggacatccgcaaggacctgtacggcaacattgtcatgagcggcggcaccaccatgttcccaggcatcgcggatcgcatgtcgcgcgaaatcaccgcgttggccccctccagcatgaagatcaaggtggtggcgcccccggagcgcaagtacagcgtctggattggcggctccatcctgtcctccctgtccaccttccagcagatgtggatcgccaagagcggtgagtgggcaggaagagggagttgtaaggaggaggggggggagggaggactcaggtgcaggagagggctggaaggcgtgtggctattgatgtcggtatggggttgatgggggcacagcgcagggtgcatgtgcgacgggctcgcgagctctggagctcgcgcgctctgcctctggcgtgcgcgannnnnnnnnngttgatgtcggtatggggttgatggaggcacagcgcagggtgcatgtgtgactggctcgcgagctctggggctcgcgcgctctgcctctggcgtgcgcgagcgtggcggtgtgtggcgcggcatgcctgtacccagtcgctcagcccccttggtcatctggtcacccctgtccccccgatgactcgcccccctcgcagagtacgatgagagcgggccctccatcgtgcaccgcaagtgcttctgagtgggatcgtcgcatccgccctcgaggctggagccgcacgagatccgcaccacaccacgccacccctgcagcgctattttcttgcccccgcttcacccatgtgccgtgcatgcacgcctgtcacttgttgcatggcacaggggcaagggcatggggtcaggggatgtgtatggcgtgactgcacgcgtgtgtcctgggcgattcacaactggtcagtcgggctcggggctcgcatggtaccgtgtgggcgaggaaaaccgggaaccttgatattggtaatgtgtagggcaggctgtcacgtgattcatacaggcacacagtccccgccggtcccccaggcgtaggcgctccccgcccgggaccagcgatcgaagggacgcacgttggcaaccgcacatagaacaactcaattcctgtgggggtgagagttgccgggtatgcaccccgggcgcgctggagatatcagatcgattccccgannnnnnnnnngactcaattcctgtgggggtgagggttgccgggtgtgcatcccggacgcgctggagatatcagatcgattccccgatcttcctccgttcgtccccggtcatgctaagttagggggtcccatcccacctctggcctcctcgggggagcaccgatgcgtcaacctgggggcatgaggagccgtgggatgggcgatagggagnnnnnnnnnngcgcgtgtgtcctgggcgatgcacaactggtcggtcgagctcggggctcgcatggtaccgtgagagcgagggaaaccgggaaccttaatattggtaatgtgtagggcaggctgtcacnnnnnnnnnnaaagagtagaccttgaagtgatttcacacgccgccgaaccccgcgcgacgaagggtgcacacgccacacctcattcggcttctgcggggtgctatcctccctcccggcgcacttgccggtgagccccatccttgggccctcgcgccgctgggcacagtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatggatgtgctttgttttgaaccggacacttcgcggctggcgagcctgctggacacggacgaggatgtcctggacttttggtcatgcctgggaccccccgaggggcccaagccgtaccgggcctccacccctgccaacgtcccgctccacgcctctgcccccctggcgattgcggggggtcgccgggcgctcgcggtcacgctgcagaacgactccgcggaaagtgcggccacgatgctgggcagctcctacggggaccgggaggacccaggcctgggccgcgccctgtcctcctccacctgggtgccccaggccccctcccccggccagtggcccgtgacatacgagcccgccccccagtacagcctgccgcccggcctgcgcccggccgccacccccgcccagaccgcgtatcagtgccagtactacggtgcgcccgcccccggccccgcgtcctgcccctgctgcagcctgcagtacatgggccagcacgcgccgcagtacgcgccgcagtacccccccatcccccccccgccccacgtctggggcgggcccccggccgcggaggagtcgcccgcctggcagtaccgccagcagctggcggcggcggagcacgccaccccactccccacccccatgtccgcgctggagatgtttgacgccgcggcggccgcgccgccgcccgccgccgtccccggctccgagggctccaccatgcacggcgggcgcagccgcggcagctcctacagcggctgcgaccaggggtcggtggtgggcgccatggagaccgccgcctcgctggacatcctgtccttcgaggacagcgaggaggaggcgctgcacctggacgacggcggcggcgcaggcctgggcgcctggtccgccgccccgggccccggcgacgcgcagggcccccg

SEQ ID NO: 47502 - DNA, 74 bp, Chlorella protothecoides
tcctccagcccactcacctgcatggcaccatccgccccccttcgccaggcgacgccgggcccggctcgctgagc

SEQ ID NO: 47503 - DNA, 61 bp, Chlorella protothecoides
gggaccggcaagcgacggggccgaagcgagaacttgcatccacaaaacccatctgtgatgc

SEQ ID NO: 47504 - DNA, 75 bp, Chlorella protothecoides
cctcccttcaactcctcccccccctcccccccacacacaccaacccacacagccgctggtgaaggaggacctgag

SEQ ID NO: 47505 - DNA, 61 bp, Chlorella protothecoides
cgagcgcaagacgccacgcgacgtcgagcgtgcggaggtgcacttttcgtatgccgcccgc

SEQ ID NO: 47506 - DNA, 61 bp, Chlorella protothecoides
tcaggggcctggcattgcgccaggggggggggcggtggatctttgcatagaatgcaaggct

SEQ ID NO: 47507 - DNA, 61 bp, Chlorella protothecoides
aggtgtgtttttttggggggggggggggggggattgtttgaatgaggaatgagggttgccc

SEQ ID NO: 47508 - DNA, 64 bp, Chlorella protothecoides
cccccccccccccccccccccccccctcacgactccaagccatgcccacctgcgctggccagcg

SEQ ID NO: 47509 - DNA, 61 bp, Chlorella protothecoides
gatgtgagggcaggacttgggtgggaggggaaaggtggggggtgatgtgagggcaggactt

SEQ ID NO: 47510 - DNA, 61 bp, Chlorella protothecoides
tcttttattttttttttttttatttctttgtgtttctctttttctaaacctttttgtggtt

SEQ ID NO: 47511 - DNA, 77 bp, Chlorella protothecoides
ctgggcggtgcgaggtgtgagctccgcctccgcgctctctgtggcctctgacgcagcacagtcgccgctggcgagcg

SEQ ID NO: 47512 - DNA, 16900 bp, Chlorella protothecoides
  modified_base (2911)..(2920): a, c, t, g, unknown or other
  modified_base (3730)..(3739): a, c, t, g, unknown or other
  modified_base (4057)..(4066): a, c, t, g, unknown or other
  modified_base (4485)..(4494): a, c, t, g, unknown or other
  modified_base (5176)..(5185): a, c, t, g, unknown or other
  modified_base (5547)..(5556): a, c, t, g, unknown or other
  modified_base (5709)..(5790): a, c, t, g, unknown or other
  modified_base (6089)..(6098): a, c, t, g, unknown or other
  modified_base (8863)..(8987): a, c, t, g, unknown or other
  modified_base (9712)..(9721): a, c, t, g, unknown or other
  modified_base (10718)..(10727): a, c, t, g, unknown or other
  modified_base (10813)..(10948): a, c, t, g, unknown or other
  modified_base (11197)..(11349): a, c, t, g, unknown or other
  modified_base (11818)..(11827): a, c, t, g, unknown or other
  modified_base (11924)..(12025): a, c, t, g, unknown or other
  modified_base (12179)..(12188): a, c, t, g, unknown or other
  modified_base (13408)..(13417): a, c, t, g, unknown or other
  modified_base (14969)..(14978): a, c, t, g, unknown or other
  modified_base (15165)..(15174): a, c, t, g, unknown or other
  modified_base (15729)..(15757): a, c, t, g, unknown or other
  modified_base (15948)..(15957): a, c, t, g, unknown or other
  modified_base (16024)..(16033): a, c, t, g, unknown or other
  modified_base (16100)..(16202): a, c, t, g, unknown or other
ccccccccccccccacacacacacacaccaaaataccaacccctcacccaacaagaatcccctggccaggccagtccagacgtcggcggccaggagtgagaggttgagcagggcagcgccccgcgccttgagcgccaggggcacgagggagtagaaggcgaacatggctgccccaaacccggcaaagggcgccaccacgcccagcgtccacgtcgtgcgcaggagcaggggcccctcgagcgccagaccctgggccagggaccacagcgccccggccgcgcccagcccggccagcagctcctccgcgtccacgctcgcgcccagcagcgcctcctgcgccacgttgctggcggcgtacagcgtggcgcccagcaccgccacgccgtcgcccagcagcggccgcgagggagagggctggaggctggaggccgcgggccggccggcgctctcatctggcaccgcacccagccccaggccgcccctccagccgtcgctggcggccagggcgaagaagcccagcacgcacagcgcggcccccgccacgtggccccggccgtaccgtgcgcccaggcaggcggtggaaagcaggagcacggcggggatggtccaggcgtccagcagctgcacgctggtcaggctggtccagcggtaggcggccaccaggcaggcgttggcctccacgtccagcagggccagcaccgcgtagacccagggaggggaccgccagggcgcccgcacgccccgtcgccgggcgcgcacgctgccccagacgcaggccagcgccacgtaggtggcgcaggactgcagggttggcgccgagacgccctgtgtgggttagggggggcaagtccagtgcacggccgtgaagggggccgaagctgggcaacctccatgtcatgagttagccgggtccatgcatccgagaccttgtgcggctgtgctgtggggtcccccatcagtgcttcagtgctcaagtatggggggtgagtgaatgccggctgggtactcccctcatgcttccccctggcccagttatcacctgtcgcacgagcaggacggagcagagggcggtgcatgcaatgagaagcgcgagcacctggcccagcagcactgcacgtagcaggccgcccatggcgagcgccatgggcgccgggtctcgtgggtctcgcaaggaggcgtgtcacacaccaacctcacaggcacccttgcctctgcacggccccatgccgggatgctggcaatgccgcatattatcgcaaataagcccgtgcatacagagcactgcaggggacaggaggcgcatgtttcactgcgcatgtcggtgcacctttcgcgccctgatcccaagcaaccagacttgaccatcgtcaccatcccgaaacagtgcaaacgcccggccacacggcgcccatactgccatcaaatcaggcgtatgcttacttcactgactgaatcatagatcgcacccaggagtaggccatcgcttgcgataacgtcactggtcagccacggggtcgtcgcaggtgactgagcgcgtccctcggcaccctcccccccgcgatggtggacggggaggtggtgaccgtcacccgctggcccgatgacgcaccaggcacgcagttgctgtccatccgggtggataagtcggtggacgacctcttcctgctagcctacgggtccagcaccgacttcaccgtgaggggcctgggcctggatggggatactcctggggccagggcacgcctctgcccgggaagtggagggagtggcttgtatgtactgatgttgtagtgcctgcaagggatctcattcaccggcttgttgcatggtggctgctgtagcgtggctcaccctctgggtgtaggtctcacctgaggccctcgtcactgagcattacacctccggcccctggaccctgccccaaagcacgccagctgaccaggtcccaccaccacctcacccccctcctcctgccccacgctccgcagacccagctgcacgcggcggtgggcaaccgggaggtggtcgccagcgactggcgcaccagcaccaaccagctgtcgaccagcgcggacaccaacacgccgcctgcgctgggcgcgctgcggcctggctgggtgcgcagggtccgcttcctgggcacctccatgggctccgccttcaagacagtggagttgcagcagctggaggaggcgcggccgggggcggcctaccgtttggaggtctgcgtcagcaccaccgccacctacggcgacaagttccggcccgtgctgcgacacacgttggccgctgcggggccgggcgccagcgtcctcaccatctccgccaccgtcgtattcgtgggcaaggtcaacggcttcatcaagggcatgattgagcggggtgaggcctgtgctgtggtggcatcgcgggagtgcgtaatcttgaaatggatgggggcctgatgtatggatcctgtcacagacagagccccaggctggtccctgacgctccacatcgatggcctcggggcccgctgtcttcgcacgctccaccttggcacaggcccctctcacccaccctctccctcccacccaacccaggcgcacgcgacggcatggtgaagaactacgcggccttccggaagacgctgcagggctttgcgacggtgaccgacgccgcaccaggggaggggctgggcccctccgtccccggcgccgcccccgtccccgagcccgcagcaggggccctgcccgcgcccggcctgcttgtcaccctggtgagcgggggtcgagggtggtggcagcatccatggtgggtgttcaggacaggctttgtgggagtgcctggcctcaccttggcactggcttgcccactcttacacccccacccttctcttccccccacccttccgtggacttcccgcagtttnnnnnnnnnncgggagtgcctggcctcgccttggcactggctcgcccactcttacacccccaccctgctctcctccccacccttccgtggacttcccgcagtttggctcggagctcgtggaggccactgccccatgggcgcaggcagcgcaaggcctgccgggcctggccacgctggggccgctcgttctgcagggcgcgctgtgcacgctgtgcgcgctgtccctgctccagtttgtcgtccaggtgctggccttcctgcaccgcgccagccgcgacccgcaggacacggtctccggcctgacgcacgtcgccttcaaggttggagacggcgccggggaatggacgccgtgggaggccttccctgacgggagctggggatgggggggcccgtgccctgcatcgattttggcgagcccggggtgggcgcccgcgtggcggtcctgactgcgccgccagcccagggtcaaacctgccaggatttctgatccctcagtgcccttccttcatgtcccgcacacggtggccctgtctccccttgcaacaaatctatggcaggtcatccccgtccccgagtccagcggccatgtcctggcggccgccggcatcctgctggcggtgcgggcgatgctgggggccctggccggggtcatccccgcgccgcccccgctgggcgctgctgcgccggccgcggccgacgcggcgccgccggcgccgcaggaggtgaggggccgggtcctgtggaggtctcgaggaggggcagaccccgtcagctggcctggacaccgaacaccatgctcgggcacggggcaggcaggcgnnnnnnnnnntgggtcccgtggaggtctcgaggaggggaagaccctgtcagctggcctggacaccaagcaccatgctcgggcacggggcaggcaggcgtcctccattcaatctcacgcccaatcgccgacttgccacgtcacagccggcgccaggcggcacgccagcgccgccgcccgtggaggccgagggccagagcgagggcgtcaagtacgaggggtatgcggaggccatagccatagcgcagggccaggtgagctgggcccgtacgtggctggatcagtggtggggtgagcgttcggggccggggatgtgcacgatggcctgtnnnnnnnnnnttgtatgtggcttgatcagtgttggggtgagcggtcggggccggggatgtgcacgatggcctgtggcggaagtggcgctccgcatccgttgctccattggtgtgctcgtgatatctgatcatcgcctgtacgtttgagagacgatgccaaatgtcgagatgttgtcgccctcctcacccatcgcctgcgtgggatgaattgcagatccaggcgcagtcaaactcgcgatccttctcctccctcctttctttcccttgggtgggttgaggtgatggggcggctgggtctctgtactaatggaggaatgcaagcttggtcctgggttgccttgctgtggtggtaatagattcctagtgccagctcgtttgcagtcccaacccatgccccagccaagtccaggcaaacagtgaactacccannnnnnnnnnggattcccagtgccagctggtttgcagtcccaatccatgccccggccaagtccaggcaaacagtgaactacccatggttgctgctggcaagctcaaccttccagctgctgtactggaccatgacccatctcaacctgcctgctcacctatgaccatgctatcactgccaagccagtgcctcactcttccctctgacggtgcaggcttccagtcctgccgccctgccacctgccccccttgccaactcgacgccagacaaggccgtcccaaccccagacgccagtcccgccaagtcggtgacatcgacgggccctggctccgtcccagggacacctgggacaaatcctgcccctcaagccatcctagaaggtgggcaagtggtactcgcttggacccctcagccgtgggaggtagcccgtgacccgctccccagccagctagaagtagacctgtcgagctgacccacgctttttgaggcactgcagagggaatccctcctgcaatcagaccatgtccgatcccaaccttggcttgaaccctaaaaccctggtgcaggcctggagcggggggagagcgagacggtgggtcacggggcaccagggcatgtgcccaaccttgcgatgtggcttccttagttccttctgggaccccgtgtcggccggagctagggaaagggctaccnnnnnnnnnngcgtcatttccttcggggaccctgtgtcggccggagctagggaaagggctaccttctctgagctgcgacacggcatgccatgccaaaacgacttcagactccctgcccgatagactcattcctcccttgcttctccttccatgcaggatgtgctagcggagcggctgatgagccccaggggccgggccagagacctactgggccccacctcgcgccaagcgggcggccaggccgtgatggaggaggtgtttgagaacgagaggctccaggtgagccggggtggggtgggcccgggagtgggggtgaatcatcgtcagcctctcgggtgtgcagcctgctgagcatgcggccccgggctcgtnnnnnnnnnnggggatcatcgtcagcctcttgggtgtgtagcctgctgagcatgcggccccgggctcgtcgggtgagcattgtgcggccacatgagccatccccccctccccccctttcaaacctgtgcacccttcacacccccccccccccccccccccccnnnnnnnnnnnnnnnnnnnnnnnnnnnnnnnnnnnnnnnnnnnnnnnnnnnnnnnnnnnnnnnnnnnnnnnnnnnnnnnnnntccgaggctggggccacacgtggccgggccacttcctccctaccgaccgtgtgaatcgctggtcgctgcgcgaggtcccggggaagcccctggtggcctcgcaggagttcaagcgcgtcgtgccgcgcgtgcagcaggtgcggggagggggtgcgcaggagtgatgggtggggaacagggggctggggagggcaatcgtctgtggaccaggggagagcaggggcgcaaaccctgggcgtgttccctctgcgcaatccgctcacggccagcccctgcctcgtggtcatgaggcctggccnnnnnnnnnnactgcgcgatccactcacggcccgcccctgcctcgtggtcatgaggcctggcccacccgcccctgccaaaccccaggctcccccgccttcctcccgcccttccctgtgaatcctgcaccccgcctgaatacacccgcccagggctggcgctggctggagtccacctggcacctggacctctccggccagctggtggatgcggtggatgccgacggctgggcgtacggcctggactttgggtggctggtgttcccctttcccgagggcggcgggcagaagaagtactctgacttcgtcaggcggcgacgctggatccgcatgcgggttccggtggaggaggggctggggggggacgccgcgccggcggagggggacgaggcggtgctcgcggccgagccgcgcggcgactccctgctgctcccggggtccagcgcttcgggctgcgcgggcccgatccaagacagtgagggccagtgcagggcgctggcggccaccctcgcggccgcggccgtcgccgcagccctgtccctggccgcaggggagcgggggagggaaccccttgtggatgcctggccacgtgagggggacgggggccacgtcggcgtggaccctggacccagcgatctgcaagtcggtgacggtgagaccccaggcggcgcccatgaggaggggagaagtgagtcggctgccgagccggcagcggcccctgccgagctggacgaggggacggccggcgaggatgccgcctcggtggtgtctccggccagctctgatgggactgaaggggactccgtggcacctgacaccggacatctcatgctctagacctggctgatgtgaaggcgctcgattgacaaggccgctggatggggtcacaacaccaaaaatagtggaggcagggaaggggcagatccgggtagtgcttcggcaggcgattttcggggctcccggtttgagtgtcgatcaggaagttcggcattggggagccaagtcaaaggtcggcgctggtacaagggaccagctccgtcgcccatcgacgtggacctctctcctcgcagccgggaagctggtcaacgggagctggatcagattcgataaggcgagactggttcaaagctggtgtccgaaaaacccaccaagggtcacatgcccaggatccactttcttgtatgtacttgaaccacaggttcgtgggggtcgatggaggagattcgggtgtgctgatgcaggtggtcaacgtgggccaagggagacggggccgtggacgtcgtgcccggtttgaacttcagatttggtggtcggggtcgaacaaagatgcggtcaggggaccggcgtccgcgttgaaactgaaaatttgcggtcagaattgaccgccagggtcgattattttgacgaactaggggccaggatttgaaattgtcgaagttgtggtcaagccttcacgagtcggcggtcatatttcactcctgtgctgacattctgccaagcgatcgggcgccctgtagccctcccattctcttcacttacttgaagaagcactgctccagctccgtccgtcgctgcccgtcggtcgactgagactctctcccgcttgcagaccctgccaggcgttggagccagcaacctgccccgcagacatactgctcgtgagcctcctaccccacccctgatgccatcagctatgctcgccagctacccccccgcgagtcgactgaccaacgactgctcgaccccgcgatacaagcgtcgcctgccgatcgacgatcccatgctggaggagctctccatgaccggtatgcgatggtcttattggcaagtggaagtggtcgagtcctgcacgatgcttgccagcattccccatccggtggccggaaggggttggggaggtacccgacctcctctcctggaggttggcgggaaggctcggacctggtcgggcccggcactcccgttccccgcccagctcacctgaacacccgccctcgggctcccccaatcctcaccatcattcctgatggtgtcacctgcaatgaccccatcaacgccggtccacggcgaggttctccccttgcccgccgttttcggtgttcaaacagattctccgtcggcccccctttttccagagactccgatcgccttccgcgttgacaacgtgatccgagctgtgagtggctacagctccgtttttttgtgtcgagggcagctctatagagatgcgaacggccagataggagccgcggcccaggagccgggcgtctcagacctcgccgacgacctgctccgcgacgcggagctctacatccggtgagagtgcgggatcacggtgcattgccgggtatgtcgcgggccggagggcgaccccttcctcctatcgacgttcgtccccgagagctcacatatctggcatgcctcccatcaggtacgagcccccctcgcccaaggccaagcgacgatgcgccggcctctcccccttccgcctcaccctgtccacctccgacggcagcatgctctcctccttccgcggcctgagcttcgagttggatgtggatgaggctcaggggatcgtgcactggggcaccagcctcgccctcgcgtttcccgccagcaaggacctgcagtccttcctgacctgtgtgggagcgctcagcctccacaggtgccacctccccctctccctcgcgctgtgtgagctgaccgcaccggcagccacgcccccttcgcccctcgcccggaaccaggctgacctggcccctgccacccccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccgcctccccattttccctttctacccccaagctggtcttgcaaagggccctgtcgacagagttcatgaccctgagggcctgagccgtatgccccaaacccagtccccagacgccagggtgtcctgattcccaagcacgcacgggacggggctgttccccgtaggacaccctcccacaaccacacccacaccacagcacctccactttgcttctctttacctcgaattcatgtgagcagcgtggtcgctttggtgcccctgcaccatcggagcagcgttctttccttcttgtcctttgctttgctaggcaccctcacctcgaacacttggaccccggtgagagacgggggtcggcagtcatccaaggctgaccccccggcacgcaccgtggtcttcatcatcaccccaccaacgtcttgttgtgccaaacatcaggactctgtcttctccgctatgggcgaggggcctctgcccagcttcctcacaccgcacatgccgtgtcagtgccaccgcttaccaccccaccccgcatgacgctgaggtctgtacgccatccccacttcccgccaccccattgctccaaacccacttttgcctgggtggggccacatccgcccattgtttcttgtgataacagccttgtcagcctggggctccagctctgggcggcaggcgtctggcccccatgccccccccccaccacatcgcttgcttggcgctcgnnnnnnnnnngccagctctgggcggcaggcgtttggcccccatgctaccccccaccacatcgcttgcttggcgctcgggggcgggggatcgtgcggctggcgtcctgcagcgctgaccacccccccttcacctactacggcgctgaatctggacggctggcccggtacaaccctcccatggacatccaacaactgcagcgtagagcgagcgccaacccttcagcccgcgcccctggctccttcctgcctgcctgcgcccggccccaccccaacccttcctctggtgccacacttgaacgggcctgtcgtgctcctctaggtcacatgccgtgccattccttcgtttttcccgcactcctccctgctattcacggacttaacgacgtagagtgatcttgccagagcagggggatgcgcggggtgggggaagggtgcgtggcggaggcaggggggggaggggtgatgggagtgcagcgccggcgccaggtcagccgcgagccccgatgccgaggtggaagcgcggcacgccggcgtcattccaggcgtactccaggcgcaggggcccgatgggcgtgtccagttttaccccgacgcccagcccgtgcccgttccccggcttgccccgcgccccggcgggatcgccgaggacgagggccccgctgtcgagatctgcggagatggcggggtgagggtgtggctttcggaggggggaaggacccactcaggcagccggcctgggggccatgcatttccctgagaggggtgtgcagtggctcgaatgccagtcagatgagcacccatgcaggcgggggcgcatggggcgctccggttgtggggtggtccttccaccgggcgtcacccacccccagccatgcagctcagtggtacccacacccacctgtgccatagtcggcgaagaggacgccctcgatgggcgccaccagggggacgtgcaattccgcagtgcccacggcataccgcctcccggaccccaccccgcctgtcgnnnnnnnnnncggaggggtccttccaccggccgtcacccaccccagccatgcagctctcagtggcacccacacccacctgtgccatagtcggcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagaagggcgccggcgggggaggagggtgggcggccacttgttgaagcgcagcgcatgggcgacagtcctctccgtgagatgtacggagacccaatcggccccgcccagcagtcagcatgcaatcctggcgggctgcagcgccgtccagcctcgccagtcctccttccaaccccgtccttccccaccttcaacatagccgcggacggagtttgttcccccgatggggaaggcctcgtagggggggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctttagtgcctgcaagcgagacaaagcatcccagacacaccccctgctctctcatccctcatctcacttcatgggccccaaggggagggacttgtcggcccgcagcgtgaatcggttgaaattgagccagtcggtctggagagggagtgcctgctccatgcacgccaggatctccccgccgcccgagggcggtctgggacggtgaagaaaggagggagggattgggtggtgagacctcaaggcatccagccgcaaggccttgctgaggggccagatgaccaccattccctcaccctgcaggcttcatacaaccccatgcagcagctgactgccggccagaagttgctggcaactctatggagcttggcggttcacaagggccctccaataatccccggcctccacctgctctgatgcccaagaccagcctggcacgcatctcccccccccccccaagaaaagcccccnnnnnnnnnngatggtggtcatctggcccctcagcaaggtcttgcggccggatgccttgaggtctcaccacccaacccctccctcctttcttcaccgtcccagaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggtctcgcttgcaggtaccaaagggcgaggctggggggccactggaccaatgatactgcatgccgcaaggggacagtccaggcacgcgctgcaccttcctttcctgcccgcacaggctctggttctcaggaaagggcgggcttgtggtgggcgnnnnnnnnnncccagaagttgctggcaattctatggagcttggcaattcagaaggaccctccaataatccccggcctccacctcctctgatacccaagaccagccgggcacgcgtcttcccccccccccaaaagtcctctccctcccctcacgcgtatgccagccgcagaatgcccagcgccatcgtgtcctgccccgtcccggagatggtgagctggccgccatagcagtcctggtccaggggcctcgcgcgctcgtccctgggggtggccctctgccagctggcgcccaggccgccctgccagccgatgcccaggggtcggctccactcgacgctgccgccgaccctcgacacaaagatggacccggccgaggcgtcggcgaggctgctgcaggcagggaggaagagacgatgagcgggtagggaggtgtgtgcgtgtgtgtggggggggttccctgaagtacgcacgcatgaaagtcatcgccgccgccaggatggagaggaaggctggcagacagagggcatactgccggtgcagcctgccacgtcgagcctgcgcttggggccgcgtgtacgctgtgccctgcgcgattccaagcccggcccattccaacattcgtgtcccctgcaagctccccaacaccataccccctccccggttcaaacccagcctcgcacctcgcgccctgcgccccgggcctcggctgcggcgggcggggagaccccggcccgggcccggcgacgtcctctccgactgccttgccgtggatggcggccaccgaggccttggtgctctgcactgtgatgctgcgggaggtgtggtaggggtccccccggatccaggggtcggtgtgggacacccggaaggtggagtccacctgtttgttttgtggaagattggagatgggattcatgatgatggggctgtcgtgggggatgagagatggacagcgatgatggttgctgtgtacttccagtgaacaaacgaagtcatgtcagtgcagagggaccgagggaccggccccggcgatggcgcaaggagcagtgtctccatgccaacccctcactcccagcgatgtgcctgcacgcccgatgactgggcttcccctcccccagtcgagacacacccctatttcacacaccccctcgaaaacaagcgcttgcagggtggtgcgaggtgcagcgcacacccccctttgattccagagataccccatcagacatcagtnnnnnnnnnngggagatggaattcatgatgagggggctgtcgcgggggatgagagatggacagcgatgatggttgctgtgtaatcccagtgaacaaatgaaatcatgtcagtacagagggaccgagggaccagccccggcgatggcgcaaggagcagtgtctccatgccaacccctcactcccagcgatgtgcctgcacgccctatgactgggcttcccctcccccagtcacgacacccccctatttcacacaccctcttgaaaacaagcgcttgcagggtggtgtgaggtgcagcgcacaccccccttcgattccagagataccccatcagacatcagtcccgcacctggcccagctcggccgaggcggtgaggcgctgacccaagcccatcaggttgcgctgggagtaggacagctgccctatgaagcccggcagcgcgccctcccccgtccccgccgccgagacacccgtcccggcgctcaggcccccaaacttgcgctccctgacctccaggaagaggtcgacgcgcggcgcgtccatggtggacccctccgccggctgcggccggatggacacgtcgtcgaacaggcccgtggcgtacaccgcctccacgtcacgccgcgcctgggccagggagtagacctgccccggctgagtcagcatgtggcgcagaatcacctcgggccgcgtccggccctcgtcccgggcctgcggtgtggggatcagtggggccacatgggtgcaggaagcgtgtgggcatgcgttcgtgtgtgctgtgcgcaccgcgggcatccgggcgctgtgtgtgcggccgctcgcgcaggtgtgtgcgtgcgagggagccgacgggaagaggtgacaaaggtgtccgtgcaagcgccagggaggtgggaaccagcgcggccccgacccaaggcacgcctgactggcagcgcccctgccaccggctcctccctcttccccacacacctccccggtcttcttgtccaggaaacggaggtgaagccccgccacctgcgcctccgacaccgcaatctgcacggtgttggactcccccagctccaccttggtgacctggcccaggatgccagaggcctcgtaccaggcgttgagctgctcggtggcttccgtcagcgcctcgaagttcagggtgcggccgtgcaggcgggtgagcgccgactggatcaccgactggggcaggcggtcggcgcccacgaccaccacgccgttgagctcagggttgggcgtcacctgttcaaatgtttgattggggagggggggagggtctgaactggcaaggagggtgggggctggctacaccttgccagtctccagcaaccagcttgcaccaggtcaccctgcccgtcaccagtcccctcatccccctgcccagaccttgatggtgagcttgactccgtctcgggtgtcctccgcgctgggctcgcaggccgcaaagtagcccgtcccaaagatgcgtcgcaggtcggcctggacctcctccagcgtataggcaaagttggggcgcataatcagcgcctcgcgcgccagcttgcgcagctnnnnnnnnnngtaggcaaagttggggcgcatagtcagcgcctcgcgcgccagcttgcgcagctcctcgtccgcgccggtcacctccagctgggattggtggggggtggagggccggggtcagggcgaataggccggtgactggacgacgcagggctttgccacgcatggtgccgcctacccaactcatgcagcagcnnnnnnnnnntggggtcggagggccggggtcagggcaaataggccggtcactggacgacgcagggctttgccacgcttggtgccgcctacccaactcatgcagcagcgtctgccatgcacgctgaggggcagcacgagtaaatttcgtctccctcacctcgctgatcaggatggggtccgaagacaggggctcaccgggggggccccccaccgcagacttggaggcagaggcaaatgctagacgccccggcctgcgacgcgaggggggcgatgccagggcgtcccgcaccccatccagggccagatcgagtttatgatggcatgtgcgctgcaggatggccccgctgcgaagcacgccctgccatcgcgcccgtgcctggtcgagccacaccgccagacccggcgccccggcctggggctccccctccctccgtttccaccggcgcgacgcggtcaacatcggaagctctgggctggcctgaatgcaccggggctggatgtgcgctgcatggtcgcggggggcctgcctgctgctgcagtgccgaatggatcattttgcatccgnnnnnnnnnnnnnnnnnnnnnnnnnnnnntcgcagctggggagcaccaggcctcgggacgcgaccgagaatcttacagcaatgcatcctctggaggtcaacaagggtagaggcgggggggaagggctgggagcaccccttgcgagctcccagcgtcgccgcacgcaaccagcacatgtgtcatcggagggcgacgctctgccccgtccaggggtcccccnnnnnnnnnntcgccgcacgcacagcagcaggggggcctttcagactggggactcggctgccccaggcccagatccnnnnnnnnnnacgccgcacgcacagcagcaggggggcgtttaagagtggggactcggctgccccaggcccagatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggctgggagcaccccttgcgagctcccagagtcgccgcacgccaccagcacatgtgtcatcggagcgcgacgctctgccccgtccaggggtcccccgtcagcaggtccaccacccctacaccagggccctcgggcgagcaggcgggctccccgctgccctggctggacccgggcaggggatggtccgagggcgacgccgcccccgcgcccgccaggtggcgtgcccagggcgcgtcggagggcgccttgcaggccgccagcagcgctgggtcgacgctgaggccctgagccagacgctgcagcgtctacaaagtacaggggatcggatcggcgcgggggggtgggtgaggagcgcagagggacgccgcgttccgcgtggcccggcctcgcacccagtgacctctgaccgcttgccagcgcccgcctgccacacctgggcaggcatcgaccccggccgccaggccccgctttccaccctctcacctccaggtacgtgtcgtgaccgggtaggaccggggtggggggcaccacgacgtggagtgcggtgcccgagctcgcagcgccggcgccgcgcatcgtgtgctccacctcggcgtcgacgcccggccacgcgtcgagcgccgcgcggctgcggccgccctccgcccgggcccgtccgccctccgcccggacccggtccccgacctcgccctgctg

SEQ ID NO: 47513 - DNA, 69 bp, Chlorella protothecoides
gcacacgtcgccctgaatcccagcacccaccaggacccctcccgccccccccccccccccccccccccc

SEQ ID NO: 47514 - DNA, 376 bp, Chlorella protothecoides
  modified_base (166)..(290): a, c, t, g, unknown or other
cgcagcagcccccgcgcgccggccggggcgccctgcccttcgtccccggcaccggccccagcccgctccgccgcccccgccgccgcgtcgcccttgcagactggacagagggtggtgcgggaggagagccactggtcgatgcaggcggcgtggaagtggtgctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcagcgcgcgcagcttgtccccgtccacgtagttgtcgaggcagatggcgcaggtgcggcgcgtgctgccgccggcgcgcggcgc

SEQ ID NO: 47515 - DNA, 368 bp, Chlorella protothecoides
  modified_base (88)..(284): a, c, t, g, unknown or other
ccgaggccgcaccctcgccgcggcgcagcgcacctacacctggccggggctggagaaggacgtccgcgagttcgtgcgcacctgcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgacgccacgcggccacaacgccgtcgtggtcttcgtcgaccgcttctccaagatggtgcattatgcacccaccaccaaggag

SEQ ID NO: 47516 - DNA, 61 bp, Chlorella protothecoides
ggggcctgggtccccgcgcagaccaacttcaccagcctggccactcccggcagcgtgggct

SEQ ID NO: 47517 - DNA, 65 bp, Chlorella protothecoides
ccccccccccccccccacacacacacaaaatccatcaggcgccatcgctgcgacgggggcgccca

SEQ ID NO: 47518 - DNA, 29091 bp, Chlorella protothecoides
  modified_base (92)..(101): a, c, t, g, unknown or other
  modified_base (763)..(810): a, c, t, g, unknown or other
  modified_base (1002)..(1011): a, c, t, g, unknown or other
  modified_base (1216)..(1225): a, c, t, g, unknown or other
  modified_base (1747)..(1756): a, c, t, g, unknown or other
  modified_base (3095)..(3104): a, c, t, g, unknown or other
  modified_base (3622)..(3631): a, c, t, g, unknown or other
  modified_base (3923)..(3932): a, c, t, g, unknown or other
  modified_base (6023)..(6032): a, c, t, g, unknown or other
  modified_base (6266)..(6275): a, c, t, g, unknown or other
  modified_base (6354)..(6392): a, c, t, g, unknown or other
  modified_base (6492)..(6501): a, c, t, g, unknown or other
  modified_base (7023)..(7032): a, c, t, g, unknown or other
  modified_base (7096)..(7105): a, c, t, g, unknown or other
  modified_base (9027)..(9036): a, c, t, g, unknown or other
  modified_base (11747)..(11756): a, c, t, g, unknown or other
  modified_base (11984)..(11993): a, c, t, g, unknown or other
  modified_base (13519)..(13528): a, c, t, g, unknown or other
  modified_base (14994)..(15003): a, c, t, g, unknown or other
  modified_base (15342)..(15351): a, c, t, g, unknown or other
  modified_base (15778)..(15787): a, c, t, g, unknown or other
  modified_base (16573)..(16582): a, c, t, g, unknown or other
  modified_base (17728)..(17737): a, c, t, g, unknown or other
  modified_base (17958)..(18036): a, c, t, g, unknown or other
  modified_base (18131)..(18368): a, c, t, g, unknown or other
  modified_base (18442)..(18451): a, c, t, g, unknown or other
  modified_base (18774)..(18783): a, c, t, g, unknown or other
  modified_base (20419)..(20428): a, c, t, g, unknown or other
  modified_base (20689)..(20698): a, c, t, g, unknown or other
  modified_base (23129)..(23138): a, c, t, g, unknown or other
  modified_base (23666)..(23675): a, c, t, g, unknown or other
  modified_base (24210)..(24219): a, c, t, g, unknown or other
  modified_base (24364)..(24373): a, c, t, g, unknown or other
  modified_base (24699)..(24708): a, c, t, g, unknown or other
  modified_base (25268)..(25277): a, c, t, g, unknown or other
  modified_base (25721)..(25730): a, c, t, g, unknown or other
  modified_base (27062)..(27071): a, c, t, g, unknown or other
  modified_base (27877)..(27886): a, c, t, g, unknown or other
gcctcctggccggtgggcgcatcatgggcccaaccaggtcctgcccctgtcgatgcgctgagcgaggtggggctctcttccggccccacctnnnnnnnnnntgcaaacaggcgcacgaccacctgggggctgtccggtggcggggggtccggtgcagggagggaggaggagggagggaggacggagggggggaggggtgggcgtagggaccggcgcgggtcggactggcgtggggcctcctggccggtgggcgcatcatgggcctcgccaggtcctgcccctgtcgaggcgatgcgcgaggtggggctctcttccggccccacctccccagagcctggggcgtctggggaactgttggccgctatttcactccggtcttgcgcctcagacctggtaggcgccattcctgccggcccctggcctgctgggctgcgctccagagattgcctagcttgcgccccgctttccacctgatccaccacgccgtactgcagggccgtctctgctgcctcgctggcgaggctgggtggggaggagtggcgggcggaggcctggccggacagacaggcgtcgacgggtgggctcaatcggcgagcgctgtggatagggtcgggctgacaggtactgggcgatggggtggaggagccggcgccaggagacgcgtcgggaggggagtgggtgtctgggattgggccaagagtgccactctcggtggccgggccagccgtctcgacaatgccagaagcttctgggcaagcagggnnnnnnnnnnnnnnnnnnnnnnnnnnnnnnnnnnnnnnnnnnnnnnnntgtgtcaccgcaggcgccatggctcagatcgggtgtctgccgcctcttccctggcgtgagggccttgaagatgatggaggggaagcgagcggcctgcggtattaggacgtggagggcatgtcagggtgcagaatcgagacccgccccggacatcatgtacttatggcaagtcataccatttggcattggagnnnnnnnnnntcggcatgtcagggtgcagaatcgagacctgccccgcacatcatgtgtgtatggcaagtcataccatttggcattggagaacggaagggatcagatgcatggttatgaaatatagatgcttccatgatacctcgatatcattatggtatccgggtatcagataccctccgaccactcccaccaggcatctccaccacagcaaaannnnnnnnnngactatagatgcttccatgatacctcggtatcattatggtatccgggtatcacataccctccaacccctcccaccaggcatctccaccacagcaaaacacaaaatacccccgtctccccatcgtgcctgggctcggagggactgcctgcgctgggcacctggcgtcatctcggtggccttgctggcggattgctccgccggcaggtcctcctgcaggactggcatggagggggcgcccttcctattggcgccgatgcccgtgccactcagagcacctcgtcgcactgcaggggccatcttgttctcgaagacatcgatcttcgtcctgattccccggagctgggccaggctcgggcgtcccacgggagcaggggccgggatctcgctcagcgtcttgaggaattggtctgatggggaggggaggttcggccagatcatcgatagtcgaggcggggtttgggctgcgcctcaggatacccctcaagctggaatatacctgctggaaggaaatcatcctcttcnnnnnnnnnnaaggcggggtttgagctgcgcatcaggatacccctcaagctttggattatacctgctggaaggaaatcatcctcttcggaagctatggtgggcatcgaggtgggcagggctcgccccggagttccaggtgcgcgatacggaatccgagttgctgaggatttattcggccgagagccctatcaagagctcgctgcttcaggcttagccggcaagactccacgggtctatcattctaggcatacttcattcgggcgtatcgcgtcgcgatgcgcaagtgtgcctgccaacagctgactccacttcgaaattcaggcgcggaatgcgccctccctgctgtggccccctgagttggtccatgctgcggccggttgcgcactatattgtcggaacgcggtggaggccatgtcaagcagtgcaaggagtttagagtgggcacatgtgtgcctatagggcacatgggggtcgaggggtacagtatgtggactttgtgagttgcaggcggcgcgagcctaccgcgccgccgcctggctcagcacgctcagcgcgctggagcgccacctggacgtcacccgccccgccatgtgcgcgacgcttgcgtccgggtgcttgcgcagcgcggtcaccgcccgcgacaggtctgtgctgtccagcgcggccaggtcgacgtcgcagtgggacagctcggacaggatgggcagcgccgtggtcgcgtgcagaggaggggtgcctggaagggtggggtgtgagtgtggaggggggtgcaggggtgggcgggttggcggttgggcggcagcaggagcgctgggcgtgtgtgcccgtcctctgtcgaggcaggcgtgggagggtgacgcctgccaaagccctggcccatcgcccggggcccagccaccgtcagcgcctgccttcccccacgggcacctgggaggggggggctcaggacctgcgcccagtgcatgagttgatgcggagagatgagggagcctgagcctggcttgtgctcctcaaactggggctgtgtggcatggagagggagggggatcaaaagggggtgcagacaaggcgccgccgccatgcatcgacatcatcgagcagcattcagagtttgttaaagatgctgcccttgaaggaccatggtgtgtgtcagccagtccatgaaacgccccatcccagccacctgcacacctgtggcggcctggcgagaaggtgcatgtgctgctgctgctgctgctgcgcctgctgtgccggcgtgtggaagtggcccacgagggctggggtgttcgggggcaggccggccgccggctgcagcgtcaggcacccgctcagcgccgggtcctggagnnnnnnnnnntgggggtgtttggtggcaggtcggctgccggctgcggcgccaggcacccgctcagcgccgggtcctggaggcaggccatgcccagatcgtccccggtgttgatcagggtgacgggggagagggaggggaaggcgaggtcgtccaggccttccaggtcggcgccgtggaaggctgcgggcaggcgcgggcgcaccttgccgcccaccgccgccgcatggggcccgggcccgggcaggaaggcctgcggcacataggcatagcagggcggcgaggggaggtgcaggtagctgccgccgcagccgggacccgcggccacgtcgtcacctgcagggcagagaggggggaagaatcgtatgggagggggagggaggtgggcgtggagggagggtggtgcgaggcagtgcaggcacagggcgtgaggaccaggccgagaagggtgggcccacttgcttcaccaccaccgccaaccccgctcataccatgcgagaggtgggactccagccaagccaccaggctcnnnnnnnnnnctgagaaccaggccgagaagggtgggcccagttgcttcaccaccaccgccgaccccgctcataccgtgcgacaggtgggactccagccaagccaccaggctcgcgcgggaggggaagagggccccgccaaacgctggctccgccctgaacaccgagttcctgtgtggcgtggaaggaaagcaaggcgtggtgggtgtgaactgccctgagagatgtggagcaaggcgcgagcctggtcctacccggagggtccttccttcggctcgagatcctgcaatccctccctgtgccnnnnnnnnnngaccgagttcctgtgtggtgtggagggaaagcaaggcgtggtgggtgtgaagtgccctgagagatgtggggcaaggcgcgagcccggtcctacccggagggtccttccttcagctcgagatcctgcaatccctccctgtgccgcaaggccctccctgcccaggctccacgaccattggtcgcgtgtcctacccgttggtactggtggctgccagcgcctgaccgccataggcgttgacgaggaagaaacggcggctgaggtgcccgcccaggtgaacggcctcctccctgggaggggggccatggtgatggagttgctggcacaggttgaagcactgtcgaacacggcatgtccgtgctttgcaaccacacagctcagaacgacaggggtgggatcgaccacccttgcctccccatctcacacagcatctacaacctccatccctcgccctccctcaccgtccgtgcactcacctcacgtcgacccaggcgcagcccacggtgcgtgctccctctgcgaggtgcaggagggctgcgggagacaggctggggaggatgcaggtcccctcctggacctggttatggatgcccagctggcccagccagttcaacaccctggccctattggtgcaggtcaggggtgggccggggaagtcaggggccttggtgtatgtgtagtgaccgctggatcgtgcgtccgtaccctgggtgggtgggggcattgggggttaccatgacaggttgtgagggatccgagggtgaatgcatcccgtctcagcaccgcttggcacagacgtttgagatatccatgagtcttcccaagccaatctgtggccatcagacaccaaaactcccccaagttcaccccaggaagggagcaacgattaccatcacaggacggctcaccacaacggccagggtgctgacgtggcgggcatcctgcacccagaccagcatgtactgggtgcggacgtggcagaccttctgcaagcagaacgacacgtactggccgggggagctgggggaagccccgctgggggggacctccggggcatgggcactgatgaaaaagttgtttctgcggattcgaaggtcgtggggttgattgcctcggatggcgggatcgggatggcgagggaggaggaccggctgcgcgagatgtcacacgatccttcaagtccccacaaatcagcataaacacatgcaccaagaggtctacgtgcacattaaaatctagaaagaccctcgggtgctcacccgcgagacgtctccgagtcgctgttggtgggggagtagctcggccgagcaaacttgtggtggcgcccgtccgaccaaccactcctctccttgtccttcacctccggccgcctggtgcccagttcctccccagggcggaggtctggtcttccagctttggcccagcgctgcccacacctgcgagtgttggggtggggacgtgaacatctaggcatgaatgctgatgggaattcctcggagaggggcggcttggggcggcatgagcggggagcgagatcggcgagccaaccccttttttgcttcggcagccaagagggataatgatcaggacgcacctgttgcacaagttggcccatgcatcgcctccgatgcccaaggcccagcctttgcgccaggagcctgacgtggaggttgcgctgcaggtggcgcaggcgacccccgatgctgcaccgccgacgtagatctgggcaggatcgattgcatccatggagcagaactgttacgatcgtggggatttaggcgaagcgcaagaccgactcgtcgagatggtgttgggcccacgggtgcagtatcgaacttgcgaccgtcgggtcccaggcaaagcgttggggctccgccctggccgtccggtgcctgcgcgcatcttcatggcgcgccggatggagatcaccgccaagtacaaaattcgtgaaggaaagagacaaaaaatttgacgctgaggagtttgtggcccgtatattacaacagtgcctgacggaccagtccggaagtatactgctcaagacggacgcagcgccacggcgcgtagcagcgtctccatggtatcttcgcatgnnnnnnnnnnaaagtgcctgacggaccagtccggaagcatacagctcaagacggacgcagcgccacggcgtgtagcagcgtctccatggtatcttcgcatgacagtgatggcctgcgtgtcttcaccaccaaacatcagccgttgacaatggtgccgccgttgggatgcagcacctggccagacatgtaggaggagtcctgcaaaggggaaggaggtggcacagtcagcacgcagccgcatggnnnnnnnnnngtgcagcacctgaccagacatgtaagaggagtcctgcaaaggggaaacaggtggcacagtcagcacgcagccgcatggnnnnnnnnnnnnnnnnnnnnnnnnnnnnnnnnnnnnnnnagaggaagtgtttgaagaggatgatgcatcagcatgcaggatttggtgacaggtcacgccatgaggtttctgagaaacctcacagagtagtggacacccnnnnnnnnnncggcgcacgtttgacgccaagtagacatatgcaggccccatctcggagggctggtagggagaggatgaagggtttgaagaggatgatgcatcagcatgctggatttggtgacaggtaacgtcacgaggttcctgagaaacctcacagagtagtggacacccagagcagagccctcgcgcacattcccacctgacccaggcgtcccagcgcagggatcttgttgtaccagccctcgaggttgtcttgctcgcgggtggcagggtttagcggcgtgatgatctgccatgcatgagatgggggggcagtctgtggtgaatatttccgctggggagttctttggagagcaggtgtgctaggagccagacatcatgtgctccttcacctcccccgccttcacagccagcggcctggcgcacacacccccaggcagcgaggctctcaccggcccgggtgcgacggcattcacgcggatacccttgggagccagttgcagggagagggagcgggtgaatgccacgatgnnnnnnnnnncagaggtcctctgccatcccccccgagctgtcaaacccctggatgccgacctgtactccagcannnnnnnnnngctcccttggtggagctgcatgggattgggtggcgggaatgcctcggtgggtgagagggagagggggctcgagaggtgctctgccatccccccccgagctgtgcaacccctggatgccgacctgtactccagcagggaggcactgccgtagtaggcagtgacagaggtcgagttcacaatggtcgaacctcttgccatgtggggcaggacatgcctgttgtgggcgggaagagtgggggaggtccaaggtgggaaagtggtggaaggcggcaaagcctcctcccggccgcactgcacaaagtggcaagtaatgcaccccccacgatctcttccccttgtgcaagccagagctagactcactttgcgaggtaaaacatagcaaagacgttggtcctggagcagcagcgaagggagctttgagcagaagatactgtgcatggccagggcaggtgctcgaggattcgtctcccggggaacccccaacaccctccagaatgacagaaggaagagcgagacccagagggactagcacgtggtcccgaccacctccaacaagccacccccgaacccacttgaaggtggattccaggtattcggcgtcggtgtcctcgatggaggacagcttgtgctgcatggaagcattgttaatcagcacgtccacccggccgaagcggtccaccaccttctgcaccacagacctggctgcctcctccccggttgacaggtcctgggcgatgagcagggcttccaccccctcggcctcgatcagctccttggtctgctccgcatcctgtggtgagtggggatgacagcatgaggcgcgctggtgggctgctccatgaacgccgcgcttgcctccaggcaaggcaggcacatgcaccttcaggggtaagcatgtggccgtgacggctagcacccccgtgctcccatcccacaaccaggccagcagctcctcagcacctcctgttccttctccaggtagactatggtgacggacttggcagactccctggcaaacatggccgcgatgctgcggccgatgcccgaatcgccgccggtgacgatgcagacctgggggtgtcgcacgtcgaaaggatgttgggcgctgggcgcatacttcaccatgctggttggaagctcagcctccaacgtcccagctcaccttgtccttcagcttctcggcacccttgtatggccggaagctcaggacgtcgtcattgccaggctggtagggcaggtctgtggagtggggttggtcctgcacatcggtggcaggcatggccatgtgagcgtggatctggcggggtcctgctattccacattcatgagcacaaagcctttcgaacctaccttcatgcctttctggagtcctggctggttgtgggaatcctgcacgtggagggagtggtggcggcacgtgggcccgttgatcgaccgtcagtccgggggcggtcatcgagcgcaaggccaccgcgagcaatggcatgcgggagcgcacagacggtaatgccacacctgggccgaatccttgatctcgggacccactggaaaccccttggtcgccatgccctcgggcttcttgctgttatctccacccatggcgcgtgtgaccgttcggtgatggcgagatgagcaggggcgggatctcaatggcacctgcagacaagtgcgggctgtgactccaaacaggtatctggacatggctcttccacgtttacctggccatctggcgatgtgccttgggatctcgccggcctcttggcctgacgccgggggcggacagcttccgtcccattccctgcctattcttcgtaccttccccccactctcgaagcctgctcccggcacgcgtcttgtcaagcgtgatagatttatgctgaatgtgggggggttgtggggttgcaatggaatcgcgggcgtannnnnnnnnngttcttcgtaccttcccccacactcgaagcccgctccctgcacgcatcttgtcaagcgtgatggatcaatgctgaatatggggggtttgtggggttgcaatggaatcgcgggcgtagcgcagggcaaggcgctactcctctgtggccagcttcttccagccggtccagccgggcctcagcacggccgccttccccgccagggacaccgtcgcctgccaaccgggccccgcccatctcctcagcgccagccacagggcggcgatgtcgatgaggacctggatggccagcatgccctgggccgccatggccgaggtctggctggtcgagctcgcggcgacctccctgatgctgctgggcatggggttgttcccccccttgcactgctttgtctggaattccgcccagaactgggcctcggggatgctgctccacacgtggagctcctgcttgtccttgatgccggcggcatggcgcgccgcccacgtcacgccaaagcgccgcatggtctccctctcctcgtcccaggtgctcctgctcatcgcgtgggcattgggggatgagagtggaggtgtggtgatggtgcgggggcacggcgggaaggaaaggctgtggggagtggcaggggctggaagcacacgggtgcgggagggaggaggggagtagggcgctccccgttcccagcaggcaacgagcatggttggagctctgagcaagagacccctgcctgggaggctgccaggggcgggcgagcagccggcgatgcgcggctagggccgccgggtacgaccacgtctgccctgtcacccctccctgccctgccctgccgacaccgagccatggcacgcaccagccacgggggtgggggttgttgtacacccgcctcctgttgggggcttggtaggcggggtggaacatgcagacggcgtcgattaccgccactcggtccttggggtagccgagcatcctgggccaggcagagtccaggcctgaagaaagcgtggagggtcgggggagaagggagggatcgagggcagcccggacgggaaagggagtcggcgcggagggcggacatggccgtcatcgcccccctccccaccccctcctccccagtacatgcacccaccgtagccggtgtagctgtcattcaggttgggcatgatgagctcgtccatgaccttggcggagaacatgggggccatgatctccacaaacgcggtgtagcgcaggcccgacccgggctcacgcagcatcagtcgctgcatggtggtgctgtcacggtgctggcacaccgccggctgcccgagctgcaggttgaagtgcaggaaggcctggaacgccgtatttatcactgtgcggggtgggcatttgggggtggggggtggggaggcagggtggagagggagggtggacagcagatggcagagtgggaggtgggagcctggctgaccgtgcgccgccgcctgcggcggctgggggctgtgtcgtgcacccgcacggcatccccaggccctgcagctcaggatcaggccctgctcatgcctggactgggggcagggtgtcggcgccccggcacagcacagtgtgcaaggctgggcccaaagacacagcaagcccgggccccgccagcccctttcccatgtcatttcccgcccctttccctctacgggtgcaggacgactgagtgcagggcacacacacagacgtagagtggcagggggtggtcgcggtgggcagggggggtttcctatcggggctacgtggccgtgtacttgggcgactacaccctccccccccacacccctcctttccactgaccgtgggtggacatgaggagatcgtcgtccggcaccatgaagacggagtacctgcccttgatgtcctgccagagctgcgacacggcgaggaggtgcaggaggtgccacttggcgtccttggcgcggaacaccgccacacactcggggcactcgaacttgtcgtcggacccaaagtacatcgccaggatgtcgaagcagcggtgctcgctatcgtccagccacctgcagcgggtgggggagggttttgaggggtggggggcggagccaggtgcgtctcacccccaccgggggcccaaagcgccagggagttgaaccagcgcctccaacagaccctagccctgccgcgcctctggccgcgatgagtagcccgagtgtgtggcgggcagcatcaataccccgccccgcctcacatgttgcgatgctgggaggcatcccccatgggcactatcatgagaaaccctggcatcgactgtacgggggtgggggccggggcttcgacctccccttccaacagctgcctggaagccacatgtacaacggtaagtgccagaaacaggagcgggccgaggcggggcatgtccgccagggtagggtaaggggggggggggcggagagggcggtagtggctgtccttccaaccaacgcgtgagaagggtggtcgacccccgcggggttaccaggtgctcaatctgccaatctcgggctgaagctcctatcgtacgcggtccaccaggcgcgcaccagcccaacagccggcctatttgaaccagccacgcggagggtgggcgacagaggcaccctctcacacttcgtacacctgaggccgtggagctatatattgatagtggctccgtacaaggtgttaaagagtgccacggccaccggtaacaaaaagannnnnnnnnngcttcgtacacctgaggcagtggagctatatattgaaagtggctccgtacaaggtgtaagagagtgccacggccaccggtaacaaaaagattcaaaccccaagaagatgccccacacgcgtcgttgtttcctgcggctcagtgatgaaacacctcctgaggggctccaatgtaagggatcccgtgcctctcgccccgttcgatcggctcctcccaggacttcaggcgnnnnnnnnnngtacgcgtcgtcgtttcctgcggctcagtgatgaaacccctcctgaggggctcgatgtaagggatcccgtgcctctcgccccattcgatcggctcctcccaggacttcaggcggtatttggcatgcaagtcctgatcaagcgtcatgtgggcggcacactcaggaggaaggcatgcggtgcaatactggagcctcggaaactgccccggcagctgaagcaccaccaacagcccttggcatcacatcacccccctcccctctctatggggtgtctggctcctaccgcacatcagaacagaggatgggagtattctagtgtgattacagggtcattgcccaatgtcgttcctacttctacagatgtatttgttctttccccatgccctcctgctctccagccccgtcccccgtccgacccatggctcccgcaggccccatttccctcatacgtgccccgcctccggtcccctggggccctgccgaccgcgcactcgccgtcggcgccgcagcagcagggccagcaccgcaagaagcgcagcgggacccagtgcccatggtcgcgggtcccagcaggtcgcagggacatcctccatctcctccgccgtcttaaacaggtcgcccagcattatctcctcctccgcatcggacagggtccagttgagcttgtagatggggccgccttcttccctcatgaagccccacagcatccgctgggggagtacgggcatgcctggaggggcgcatgggcagggaatgagtggagattgctttgggcagggaggtcttctggaggcagccgctgcaggtcccagtctgggggtggggggtggctcgcctgcacccgctggcacccagggcggcactgcctacctctggcggccattgtttctggggtcagaccgaacttctgcagcgcgtacaggtgctcctcccactcagtcctgtcgtttgcgtgaagagtttctcattttgaagcggaagagaggcacggcagtgcgacagtgtgcccttccagtgcaccccaaccaagatgggagggcttgctctgaaggatgctgggcctgcagtgccctgccgccttggggtagactcgccccgtccccctccccctgaccatcacctggccatgggattctggaagccgtaggtggacaccttgtccagctgcgcagccgggtggaaagcgcagacgctgtcgatgatccccacggtctccttggggtagccaagcaggaagggccagacgatgtccaggcctgtggtttggcggcggataagggggaaaaggctgtacggcatggcgaggcctgaatcaccaggcagtacgatctgccgctgcaggctggacccaggacagtacgagcctctcagtttgaagccatgtgcgttccaggcgggcaccgcccgcggtcccgctctgggctccccatcctggccgtgcgcccgccgcatgtcccagcctcggccccccccgcactgcgactcaccccagccgcagtacgcctcatccagcgtgggaccgatgnnnnnnnnnnctgtcccagcctcgacccccccgcgctgcgactcaccccagccacagtacgcctcatccagcgtgggaccgatgactcggtgcaggacgtccatgcgcaccatgggcaccatgatctccacaaatgcagtgtacctggaacatggggttgagaggaggtcggcgtcgtgctttccgtctggcaagctgtgcgcagatgaggcccgaccagggctcagcactggtcgcagctcccgcaggtgctttgtctgttgagcagtgccagcttgcaggaggtcctgtcccgccagacatgccctggaggtggcgctcccctctttgccccactgctgaggaacctccccccagtccacctgcgctcccccgaccctcccccaaaagcattgtgccccgccgcaccgcatgaacagcgacttcctctgattgaccacgggctgcagcgtgctggactgggggtggtcgcacacagagggctgggccagaaccagcccccgtgccctgaagatccggaaggcctcgctcaggacgtgggtagacatgatgacgtcgtcgtccgccagcatgaccaccccgtagcgcgggtggagggcgtgccactcctggctgcgcagcacgtggcggatgagctgccacttggggccctggccgcggtagaccgccacacaagccgtgcaggagaaatttgcgtcggagccgtagtagatggccaggatgtcaaaggtgcgggaggaggaagcatccagccagctgtggttgtttagggtgggaattgggcgaggttggggcagggaaggcgcgcggccgccctgccgtgaaggcctgcccagcagcaacccccacctccggccacagccgcccgggcgcgcctaggcgaccggtcccacctaaactcgtgcacggagttgtccccgatgggagccagaaccagattggatcctttcagaccctggggcctgtcgttccagtggctgaagctgggcgtgcgcatggctcgctcaggttcggagtcctgggcccgggccggcacggtggcagcgaggaggagcaggagcagggcggtctgccacgacttgagccgcgccatcctcgatgagagcctataaacgcattacaagatgatttatgcttgggtaccaagcctgtctggcctgatcgctgaacagggcagggagcactgccccccactgcgcgccttgtgcgtcgaggagctcgtccggaggatggcgggagatgcaaaacgacggggccatgcctaggtgatttggttcgcaatttgatcagtcgccgcagtgagatcggggtctccaagtcccggagtctcgtgataaatggcaaaggaggaagtaaatggcccggaccggctcggagctgtggggatcttcctcgttctttttcccatgtggatctgagggcttggggtgggtgcagatctgatccgactcgggtccacccgcgccatgccacccnnnnnnnnnngaatgggcccggaccggctcggagttgtagggatcttcctcgttatttttcccatgtggatctgagggctcaggtgggtctgatacgactcgggtccacccgcgccatgccacccggccctattgtgataacaagccatgaagccggcccactcatgtgcctctacataaacgttgatctcgcactcccctcaaggtgaatgcaagcctcctgattggggaaatgtggcccttgcattcaacagcctgcctgcagggacactgggcccggctcttccccctggcccgcagcccgccccggggagcagctcatttccagttctgcacggggtgggcgtcnnnnnnnnnngctgggcccgactcttccccctggcctgcagcccgccccggggagcagttcatttccagttctgcacggggtgggcgtcggccccctcatccatgcctgggcccagaacttcgctccccagctgcttgtcgtgcttctggcggcgccgcgcgtcgtgcgccgcccagccctccgtattgcgcagctcctccacggtgatggggttgtcgtgcagactcagcgtgcgcagcgcgccacagtcccggagcacggcgggcgggacggcctgtattctgaggggcaagggggggaaaggaaaggctccatgggcgtgggtcactgcgcccagcatggcatcagatgcagcaggcagtgcctcgcttgtggcctttctcaacgccggcaggtgtgaacactcagcagcgccgctgatgctggtaatggatannnnnnnnnnggatgcagcgagcagtgcctcggttgtggcccactcatcgccggcaggtgtgaacacccagcagcgccgctgatgctggtaatggataccacagctcatcacaccgacattgcagttcccccggcgagcatccacctgttgcaatccaggttcagggtcttgaggagctgcagcgcagagacttgggcgggaatcaccgccagcctgttgtttcccgccagcagggtttccagggacgtgcaggcccccacctctcccggcaggcagcgcagctggttgtgcgagacatccagcagggtcagcgtggtccagcccgccatggctgctccgggcagggactcttcatggtggcaaggtgaacgaggagcttcgttgaggaggggtcgccaggcgtaggctgctagcaccccctgggttccatccccctccaccgcgccccacatcagccccctcgcgcctcaccaagcaggttgcaggctacgtccaactcccgcagtgcgggcaggtcgccgacggcgcacggcagcgcgtgcagcgcgttgcctcgcagcgacagcttggcgagggcccgcagcgcgcccagcacgcgccagtcgagggcagcgctcggcagcccgcaccctgtcaggctcagccgctgcagggcgcagaagggcgccagcggggcggagaaggggttggccagcggggacagcgcaccgtgacagctcagcacccgcaggccgggggcggcctccagcaatgcgggcggccacccatccagggtcggggcccccggcccggcgnnnnnnnnnnagagaagggggtggccagcggggacagcgcaccgtggcagctcagcacccgcaggccgggggcggcccccagcaatgcgggcggccagccatccagggtcggggcccccggcccggcgcccaggctggcgatgccggtggccttccacaccctgatctgggcctgggtgacgggaaagcccgaaaccataccagcactagccgggcgagggtctaggccagggcttgcggcaacattctgtgacggggttgggtgggggggtaggagactgcatggggtttacgaatgccgtgctgacaggtggctgcaccgcacagccccatttctatccagtccgatccttatggtgccctgggactgaaagtatacaaacaagaatctcccgtcatatcccgcaggctgcgcaccgcgcgttgagagggccgctcagcgggtctgcccacggccctcctgggtcccggcccggtcgcggccaagagcataagcttcgtgcccgcaaccagacccatggagctgagccttgtatcgtctctaccggccccaggttcggccaggaccttgcctcggcacagcagcttttgctgtcgcgccagcacacccgtggcagcctcgacaccagcccgcaggtcgccgagcgttccctctgctggcaacgaaacgatgtgtgcactagatccgaatcttacgcttacttccatggtcgaagttgtgatcaggcactgttgatacacgaagcagggcgtcggagtggtcccctcggcttcctccggtggtcgcctgccaccgactcctctccctcgagggctcacataccggggtgaggtgataggtgaatcggacaattcttacttattccgaactgatgaatgctcatcagggatacgcgcgcctggttgcaagtgggcgaggaccccaatatccaatcacgcccccgcgcgcgcggacggagccgcgagtgctcccaccgactcgtgagcaagagaggatggacgaccaacaatgagttatgggcgttcttttacaggttgagcaacgggaatatgctcacagcttgattcaggttcaggaatgctgggagcacgatcaatgtatcaagttgcaaagggaggcgccggaccaggccaccaagggacccacggcgcaagnnnnnnnnnntgaatcggacaattcttacttattccgagctgatgaatgcacatcagggatacacgcgcctggctgcaagtgggcgacgaccccaacatccaatcacgcccccgcgcgcacggacggagcccctgagtgctcccaccgactcgtgaacaagagaggatggacgaccaacaatgaattgtgggcgttcttgtacaggttgagcaacgggaatatgctcacannnnnnnnnnnnnnnnnnnnnnnnnnnnnnnnnnnnnnnnnnnnnnnnnnnnnnnnnnnnnnnnnnnnnnnnnnnnnnnttgcggcctgtgccgcgtcagccggcgccgcagcatggccgaccctgctaggaggccggtgagaagaaaggcggtggccctccagtcggaccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaggagggtctgcttgcctcgccaccgcgtcgctcaagacgctccagcagcatgggcaccctggggacccannnnnnnnnnccacgagtgccgcggcgggaaaggtggcgggagtgttcagggcttgaccccctcgacgctcatgaaaggctgcaggatgcgggggttaggcggcctgtgccgcgccagccggcgtcgcagcatggccgcccctgccaggaggccggtgaggagaaaggcggtggccctccagtcggaccccgggcccgcactgaccctggctagtgggctcaactgcggcgaggacggctcctcctcaacttgctgctggagggtcacggcgggccttcgggccacttccagggtaacaaattcccacgtgatgtcctgcgggtaggtgtcgnnnnnnnnnntgcccgcactgaccctggctagcgggctcagctccggcgaggacggctcctcctcaagctgctgctggagggccacggcgggccttcgagccacttccgcggtgacaaactcccacgtgatgtcctgcgggtaggtgtcgacgcctgcgggggtcaggtggggagtgggagcttcatggggcacaaggcggtcttcatcagctgacacaggggctgacaggattctgcggagggtccgcttgcctcgccaccgcgtcgctcaagacactccagcagcatgggcaccctggggacccaccgtaggtctccacggcgtcgtccgtcaggccgtatttcatgatcatgtacttgaactcgcctcgcgcatcactgagggggggggggaaggggcaccgcagaggggtcaaaacaggggagatgtgagggtatgatgcctgtgatgctgaactagtgctgacggagggtagactgcgccactgccgcaaacttgggagcagtgcgaggtgggcaggtcccccatgacttcactgctggcctgcgccacaccccgtctcccgtcacccaccccgcttttgggtgggtgaagccgtacgaggagaccttccccgcctggctcttggggtggatggcgcagatggcatcgatcaggccgatgccccgccgggggtacttgagcaggaagggccacacaaagtccaggcctggtgcaaaggagggggaagacgtgacctgggaaagaaagcctggcgagggcacagcgcagcacggcgcggctggtagccctttacccccagcagtgccattcgaaatgtgtggtaacccgctcccccacccaccccaccccactccgccagcgccgcgctcaccccagccagtgtaggcgtcctcgaatgtgggcccgacgacgctgttcaggacatccatggtcatgatgggcatcatgatctccacaaagggcgtgtacctgtggttgtcgggcaaggggcttgtgtttgcatctgtgtgagagcgaccccacaggatggtcctgatccggcacgctggcgatcagccgcaccgcagaccaccagccgcaccgcagacaatcagccacgctgatcctcctccctccatcctgcacccccccccttttccaatagtcaccctttcccacttgggggtcagggtacctgatgaagttggactggttctgcagcaccacgccatggctgacgccgacctgggggtgccggcacagcgtgggctgcgccagggtcatgttgaacgtgccgaagatgcggaaggcctcgttcagggtatgcgtggacatgatgatgtcgtcgtccgccagcatgacgacgtcgtagcgcgggtggatggcctgccactgctggctgcggaggacctggtgcaggagctggaacttgggtccctggccgtggtaggcgccgatgcaggcggggcatgggtggggcggctggggggtgtagtagatgggcaggatgtcaaaggtcctggagtcggtatcgtccagccagctgggagggggtggtgggggcagttggggttgggggccggcaaggttgccggctgtccacgtgcgtcgaagcccccggattcgaacacgcacctgatgaagtgcaccgagttggcgccnnnnnnnnnntgccggcaaagttgccagctgaccacgtgcgttgaagcccccggattcgaacatgcacctgatgaagtgcaccgagttggcgccgatgggggcgaggatcaggttccgtcccgaggaattggcaaaggtcagacttcctgtagtaaaggtgacggggaccatgcgcctgggggcatccttgccggccatcgcacaggccagcgcggccagggcgaggagcctcatgaccatccggcccccggggccgagccgccctatacnnnnnnnnnncgaattggcaaagttcagacttcctggagtaaaggtgactgggaccatgcgcctggggccatccttgccggccatcgcacagcccagcgcggccagggcgaggagccttatgaccgtccggcccccggggccgagccgccctatacccattcctctcaagcttgacatgccatgcagtgcggccttgtgaggtggtgtcgcggatcagtctggggcatgtttgggcccggcacgggcagtgcagtctgcttgcatcgaggtgccccgaactccatcgcacctagtgcacgtacccttccaaatcccaacctaaatcattgaacaaaactactcgagtatttgcttactcgaacaaaccgccagcactaccctcgagatgatacagggggcagcggcctgtacttctcctggctcttatatcctcagtgtcgctgctctcttacagctgaacagaagcgcccgtcgtacctccctgcagtcacacccgctcctcacttcagcatcaccagcgtcagttcaccttgacacaccaagtccgtgcccacatatgccttggcatccaccttgcagatgccatgcctcttgttgaacttgaccacgtccaccctcatcatctggaaggttgggaagaattgtcccgtgatgcggcaagtggtggttggacatgacaagtgatcgaaccatcccttgtcatgatgccaatggggttctggtggcttacgcctggcggccaatccctccatgatgggagcacaccaagggtggcagtcctgaccccaagattaaggcaggcccccatctcagacccatatgggccccgaccccaactcaccaggacatcgccgggcaccactggcttcttccagcggaccccgtccacgccgccgaagaagaagttgttctgctggcccttgtcggcggggtcaatcatggcgatgccccccagctgggccagggcctccacctgcagcacacctgcagagcaggatggagagaggaggggttgtttcttgcaacagggctcactgctaggcactcgacttctcaacgctcgatggccttctccatgaggtcaggctcccatcccctctgcctcggccttcccaagctcacacccatcccgtgcctggcatgatggcgcggtttgggaagtggccggggaaaaagttgtcgttgatggtgatgcacttgtagccgacagcatacttgccgctctcccattccagcacccggtccaccaggaggaagggaaacctgtgggacaaggagggtccggcggtgcctcccagcatgcctgctggccatacgaaatacaacgctagcagatcatgcatgcagacccttccagtgcacatgcctgtgcggcaggatctccatgatctcctggatgtccttgagcggcttgtggttgggcccggacttttctatcggcagggcggccgggggcgcgctgctggtcgcggcatcggcccaagcgatcaggcggctcctactgggacgggagcatgcacaccgacccctgaatggagtgctggcgcgtcgggagagcggtcccgggagggcggtctgggaagtacacgcagtcagtgccgacattgtgccgagccagtgccaatgtgcaatgggtgagggtgccgatctattgaatatgagtgggcatgtcgggtttcgcgcttctcacggccaggaaactcctcgcatcgggtctgccagtttcatgggctgatcgcgcccgggcgctgtccagggggtgtcaagaatcggagtcaaaggcacgggcttccagtaatgcaagttcggcgggcatggggacaagcgcccagccccaagactccaaccacacaaaaggcatgcagcagggcccgatacaagtaatgtgggagaatgcagcattgcggacagtgctcctatcagactgctgtcttggacgccttgtatgcactgatgttcccccgcgtgctccgcgaggcgtctgccaccttcagggcgctctcctggtctgcgcggggcgggcaggtgtggaggaaaggctttgagcggagagcccctcgccaaggagcgcggcgtcacgccagggtgtgagccccgacgacgcggcgctgccctcacccatcagggagcccgagagtcgtcccccccccactccccagccccccctcatagctcactccgcgtcatcatgccgcagaactccgcgtagtcaattgtcccgctcccgtcaacgtccacctccttcaggatggcgtccacctccttctccgtggcgctcaggagccctccctgcgggggtgcggggggtgtcggcgggtcggcagcaggcagtgccacgacaaaggtgcttggggtgcagagcaccgtcgacgttggatcgacagtgttccggcttcaaggcgcatcatgcactttcccatcccctcctggcacctctggnnnnnnnnnngaaggttcttggggtgcagagcaccgtcgacattggatcgacagtgtttcgctttcaaggcgcgccatacactttcccatcccctcctggcacctctggctccatgccctccccttcacatcccttctgagcatgcgtccacacacaggatcacacgcctcctccgcgaaccttgctgagcgcggcgatgagctcctcccgcgagatggtccccgacccgtcggcgtcaaagtggtggaaggcgcgcagcatgttttcctctttttccagctggtgccggctcatggtggccgccaagaactagcggggtcggcaggggcaaccacggcgtgagggtgcgaacactcgcgccgagttgcttccctggactgggcacgctgcctgttgcactccatccgccgccctgtccccacccactcacccactctcctgtactcgtgccaccctcgctcctccaaccccctcccacgacaacaaaaatgcaaccccacccaatgactcacctcctcgtactcgatggtcccgctnnnnnnnnnnatcgtgccaccctcgctcctccaaccctctcccacaacaacaaaatgcaaccccacccaatcactcacctcctcgtactcgatggtcccgctggcgtccacatctatcagcgacatcagcgtctccaggtcggcggcgcgcaggacagcgcccttcatcttcagcgcctctcgcagctcctcggcggtgatggtcccgctcctgtcgcggtcgatggcctcgaagagggctttgagccccgcgatctcctcggccggcatgcccgtcgcgatcacgcgcatggcctcccgcttcagcttgttgtgcgtcgcaaacgtcctttagggcgggaaggagaagggaatggggaaaggcatgtgtgaggggagggcagggagggaggaggctgaaggtggagaggcacgtgtggggggtggggcaagggccaggtggctgccgctgaatcgcgacagggaggaggcggcagtggccggcaagtgctgatgggcatcttccttgggggggtagaatgtaatgcatatgacacacctcttcnnnnnnnnnntgcagtggcccggcaagtgctgatgggcatcttccttttgtgggttagaatgtaatgcatatgacacacctcttccaaattagaatccacagcatgagggggtccgccaagcggctgtgcccctgctcacctcctccaacccccnnnnnnnnnnggaatccacagcatgagggtccgccaagcgtctgtgcccctgctcacctcctccaaccccctcgtgcacaagcaagcaggacaccaagcccttcccccacacggcctcccgggaactcaccccagccgggtgatgatgacatcatccagccgcttgtcggaggccacgccgttttcccgcagccaggggtgccgcagcagctcgttggcacgcgcccgggtcttggggttctgtgagatggaaaggggtagcaatgcgtgcagagagtcgcaggacccgggccttgcatggaagaacagcaggggcccagccgggacgcatggccnnnnnnnnnncgagatgggaagggggagcagtgcgtgcgcagagtcgcgggacccggggcgtgcatggaaggacagcaggggcccagccgggacgcatggccccctgcacaaacaccccgcgcaagacagggggggtccacccccatgcgccctgccgcctcgcacacccagccgtccccgctttccaaaaacagaaagggacgcacggggtcgagcatcctggccacgcagtccttggcctcgggcgagatgccgggccagggctccgtgtcaaagtcgatggtgcccttgagcacgcaccggaagatctccttctcggtgtcgccgtagaagggcggcatgccggagaggaggatgtacaggatgacgccgcaggaccagatgtcggcctcggggccgtagttgtggtgcagcacctggggggggggtcgcagacggaggtgtgctggggtgcatgcgtgtgcgcccaggtgtttgtggctgtaggaggggagggggtgtcccttgaacccccagttacccctccgagaagccttcgtcacactacctctggcgcgatgtagtaggcnnnnnnnnnnggtgtgctggggtgcatgcctgcgcgccaaggtgtgtgtgggtgtaggaggggagggggtggtcccttgaccccccagtcacccctccgagaagccttcatcacactacctctggcgcgatgtagtaggccgaccccaccacgtcggtgaagcgctccccggccttgaagaaaacggagaggccaaagtcggtgcacttgatggccgcgtcctctgccggggaagccagcagaaagttctcgggcttcaggtccctgcggtgggtccggacaggggtgggggcgtacatgcagcgcccctatgccccggggtcgtgggggcgacgccatggctacgaggacccgcaagccttcaggcatggcacggtgtgtggggtgtgtgttgtggcacctgtcaggcccctattctctcaacgccattggcacctcaccgatgcatgacgtnnnnnnnnnntggggtgtgttgtggcacccgtcaggctcctgttctctcagcgccattggcacctcaccgatgcatgacgttcagggagtggcagtaggccaccacgacgatgatggtgcgcaggagggcggcggcgtcagcctcactgcaaaatgttgggaggattggaagagggcgctggtgaggggaggtgcatagggcttgggctcagcatgtcctcgaacggcttcgggagaccagagggggagggagaccaggctccccccccgcgtccctccccgccccccctctccaacccacctgtagtagcccttggccgtgatgcgatcgaagagttcccccccggagcagacgtccatgaggatatggatgtgctcccggtcctcgtacacagcggcgaggaaggtgatgttggggtgtcccttcaggtggtgcatgatctgcacctcccgttgcacatcggccacgtcctccgcgctggtaagcttgcgcttggcgatggacttgcaggccagggactggccggtggcgcggtgtcgcgccaggcgcgtggtcccgaactggccccggcccagcaccttgcccagctcgtagtctgcctccaggttctttgtttggggaggggaaaaaaggggggccaggaatgggtgagtgcggggccttggtggcatgcaagacgggagaaggcgctgtgggaagggcttggccagacctgccgcacctggtagcccttgcctagcaggctgccggcaatcgaggcaggggaggggtccggttgggaggcgacattcgcgggggcacgcgcctccttcctggcgcccgcgacctgcagtgtcgcacaacatgggttcagtcccgcacattgcagagtcgcgggagggcttagaccctgccgcacagcccgggtcgcacctcaggcctaacagctggcgtgcttgccccacatcccatgatctcggtcagagacaagcagtatctctgaagtctgtcatatgataataagattatcgcattgtcgccagtacgaggctgctttggtcttaagcgaccgaacgcgctctcaccctggtatgggcgccagatcggattaccgagcgatagccgagaccacttgcccagatcggccaaatggttatttgcaaccggtgttgtttcacgactcggaatcaaggacaccgaatatttaaactgcgagtatgccatcttgcgcatcatacgccctcgaatgcaatgtaagcgacacacagaggcaggtttgctgacctcaaggcgaggctttcccacactgacaaggccgcgatggatgtgatcttatataagcggacgtgcatgtattgttgnnnnnnnnnnccccacactgataaggccgcgatggatttgaccttatataagcggacgtgcatgtattgttgtttcgtcagattcaacttgaagcgacctgtcatggctcacaggagcactggtgtaagctgatcctggagggccgaaaaagcatggaggtgcggtcctaccccttccccgagcccctagctggccaacgtgtcctcctactggccaccaatggccaggccgggagacccgcgctgggagacgggatatcggctggctccaccgatgcaaaggcggtgcgtgagcgggcgcagggtgtggtggatcaccagcggacctgtccggatttgccatgcttgagacccgagcccatccaattcgctgccacaggttggctgggtggtatttgacggaatccagaggtttgaatctgcatcagagttcgagggtgcgtacggggagcactgtgtaccttcagactctccctttgcctgggcaccccgtgggccagccctatacggatggcgcataagggagtacgaaagggctcgtgaaacttgcccacttccaagaatgacacggctgttgagatctgtgtacgagatcaaaccatgatgagcctcgcattggtcccgtcgatgccacggccgagctcaagatttcattcgttggcattgactacatgcggcaaaaatgtacatgtcgatcacatccagcctactccatggcgctgcatcacgatgcaccaatgaatgcctcatagatgtgcctcatctctgtaaggatgccgtccttcgtacgcggtcctcccgcatgagcggcgcgannnnnnnnnnatactccatggcgctgcatcacgatgcaccagtgaatgcctcataaatgtgcctcatcgctgtaaggatgtcgtcctttgtacgcggtcctcccgcatgagcggcgcgagggtcctggcatgccaggccttcccaacccaccctgcccagggcccacagcgccccgccggacatgaccaccggatggcgaccaggagaacgctcctcgccacgactctgggcgcgggcctgctcccgacgatctccatgaggtcgcgggcgggagcgctgtacgacgagtatgccggtgagggagagtgcgtcaattgtgcatgagagcgcgagggggtggagggagggcagtgcagcgcgattgccgggtcaagcactgtaagggaccacacagattgcacaccccctcttcattcccacccgcagaggagtacgacggcctggaatccggccgggcagcgcagctcctgggcctggcaggcctgcgcggccgcctggcgagcatggcccgtggcgatgtgctggagatcggggcggggacggggctgaacctgccctggctcctggcccggcccctggcctcctacaccgcgctggacctgtcgggcgccatgctggcgggggcgcgggcaaggctggcgcgtgcgccgccaccgcccttccccgtgcgcttcgtcgctggggacgcggcgcgcctgcccttccccgcccactccttcgactgcgtgctgagcagctacgcgctctgcgcaatggaccgaaccgacgccgcgctctccgaggcgctgcgcgtgctgcgccccgggggccggctgctgctgctggagcatgcgcgcagcgagctgtggcccctaagctggtaccaggaccgcacagcgcgcgccgtggcggccctcagcaagggctgccgctgggaccgggaggtgggggcgctggtgcgggccgcgggaggggaggtctgggccctggagcgccacctgctgggcaccgtggtgctgctggacgcggagccccgtgcttgaccccaggaagggaggttctctccttggagggacggcaaatgtgcaacgaagagctggcgcccccccttgtctgggtcggtgagatgcgtctgagagggccgcctgccctccttttgggggttctactgctgcatgcgcaccgctgccaacacaaagtataacatcgggggaggggggggaaaaaaggggggg

SEQ ID NO: 47519 - DNA, 61 bp, Chlorella protothecoides
gggggcgatggtggagggaacggtggagggttgggaggaggggatggcagcgggggaaatg

SEQ ID NO: 47520 - DNA, 61 bp, Chlorella protothecoides
ggggttgggtgcagctcaccaatggcgggggggggttcaagaggttgttcaggtctttgga

SEQ ID NO: 47521 - DNA, 61 bp, Chlorella protothecoides
cggcccgctcctctctgttgaggtgggtgaaggagtgggaaaggggtcctagggctggaac

SEQ ID NO: 47522 - DNA, 61 bp, Chlorella protothecoides
cggcgtgtccaggaaggtcagcgcggtgcccgaggcggggagcgggaagctgaaggcgccg

SEQ ID NO: 47523 - DNA, 61 bp, Chlorella protothecoides
gcgcagagggcgaatcgctcgccggcgagcacccccacgaccgccaccgccaccacggcga

SEQ ID NO: 47524 - DNA, 63 bp, Chlorella protothecoides
agcgagcacagaggtgctcctgtcgcgggtggcgtggatcgtcccaaacctgcgacagggcct

SEQ ID NO: 47525 - DNA, 61 bp, Chlorella protothecoides
gaaactttcatgtgtctgttgtggcagcccctgacctgtctgatatgccctcccggaacaa

SEQ ID NO: 47526 - DNA, 66 bp, Chlorella protothecoides
ccccaccccacccacccacgacaacaaaaactaagacaaagcctcacgcttcgtaggcgacgatgg

SEQ ID NO: 47527 - DNA, 61 bp, Chlorella protothecoides
cggcgatgagtagagcgaggcatagcaggggccccggaatccggtgaccaggcatgcagga

SEQ ID NO: 47528 - DNA, 61 bp, Chlorella protothecoides
ataccctgccattcagcggcagtgacagggggagttgcccagcatactgcgtggtgttgtt

SEQ ID NO: 47529 - DNA, 87 bp, Chlorella protothecoides
caagggggccaggggagggttgggacaagattctgcaaggcagctagtcgctgtagggacctccccagggtctgcaccgccagcgcg

SEQ ID NO: 47530 - DNA, 61 bp, Chlorella protothecoides
gatgacgatggcgggcatcactggcggaggggaatggggaatggggggaagggagggtcga

SEQ ID NO: 47531 - DNA, 61 bp, Chlorella protothecoides
ctttccttccattccacaccctgtggctggggtgtgtacagtggtgaatcggcttccggtc

SEQ ID NO: 47532 - DNA, 63 bp, Chlorella protothecoides
cgcggctgccgtagccgccgcggccaccgccctcgcggctgccgtagccgccgcggccaccgc

SEQ ID NO: 47533 - DNA, 61 bp, Chlorella protothecoides
cgaggccatggagcagcagaccatctccattgccaaggccgggatcaccaccatgctgcgc

SEQ ID NO: 47534 - DNA, 74 bp, Chlorella protothecoides
gggtgcattgacccagggcgcggcagtccagggggcgtcagccgagggcgcggcagtccaaggcacctcgaccc

SEQ ID NO: 47535 - DNA, 61 bp, Chlorella protothecoides
cgtgccggccaggcgcttggcgggcgcggcacccggcgccctcggcgcgggctccgggggg

SEQ ID NO: 47536 - DNA, 61 bp, Chlorella protothecoides
ctggattgaggcggcctcagttttggcggggtgcagcgcgcatttcgattccgcgacaccc

SEQ ID NO: 47537 - DNA, 61 bp, Chlorella protothecoides
gccgaagccgttgttgccctcagtggcggggcagaaactagatcaatagcccggcattcca

SEQ ID NO: 47538 - DNA, 36167 bp, Chlorella protothecoides
  modified_base (95)..(173): a, c, t, g, unknown or other
  modified_base (1059)..(1068): a, c, t, g, unknown or other
  modified_base (1620)..(1629): a, c, t, g, unknown or other
  modified_base (1890)..(1899): a, c, t, g, unknown or other
  modified_base (2601)..(2610): a, c, t, g, unknown or other
  modified_base (2935)..(2944): a, c, t, g, unknown or other
  modified_base (3222)..(3231): a, c, t, g, unknown or other
  modified_base (3707)..(3716): a, c, t, g, unknown or other
  modified_base (3872)..(3881): a, c, t, g, unknown or other
  modified_base (4204)..(4257): a, c, t, g, unknown or other
  modified_base (4795)..(4804): a, c, t, g, unknown or other
  modified_base (5573)..(5582): a, c, t, g, unknown or other
  modified_base (5829)..(5838): a, c, t, g, unknown or other
  modified_base (6545)..(6554): a, c, t, g, unknown or other
  modified_base (7054)..(7063): a, c, t, g, unknown or other
  modified_base (7315)..(7324): a, c, t, g, unknown or other
  modified_base (7844)..(7853): a, c, t, g, unknown or other
  modified_base (9686)..(9695): a, c, t, g, unknown or other
  modified_base (10213)..(10222): a, c, t, g, unknown or other
  modified_base (11610)..(11619): a, c, t, g, unknown or other
  modified_base (12481)..(12542): a, c, t, g, unknown or other
  modified_base (13520)..(13529): a, c, t, g, unknown or other
  modified_base (15420)..(15429): a, c, t, g, unknown or other
  modified_base (16710)..(16719): a, c, t, g, unknown or other
  modified_base (17599)..(17608): a, c, t, g, unknown or other
  modified_base (21339)..(21348): a, c, t, g, unknown or other
  modified_base (21999)..(22008): a, c, t, g, unknown or other
  modified_base (22193)..(22231): a, c, t, g, unknown or other
  modified_base (22864)..(22873): a, c, t, g, unknown or other
  modified_base (23191)..(23200): a, c, t, g, unknown or other
  modified_base (23721)..(23853): a, c, t, g, unknown or other
  modified_base (26292)..(26301): a, c, t, g, unknown or other
  modified_base (26401)..(26410): a, c, t, g, unknown or other
  modified_base (26622)..(26631): a, c, t, g, unknown or other
  modified_base (27063)..(27072): a, c, t, g, unknown or other
  modified_base (27535)..(27544): a, c, t, g, unknown or other
  modified_base (30765)..(30774): a, c, t, g, unknown or other
  modified_base (30962)..(30971): a, c, t, g, unknown or other
  modified_base (31174)..(31183): a, c, t, g, unknown or other
  modified_base (31777)..(31786): a, c, t, g, unknown or other
  modified_base (33283)..(33292): a, c, t, g, unknown or other
  modified_base (34028)..(34037): a, c, t, g, unknown or other
  modified_base (34234)..(34243): a, c, t, g, unknown or other
  modified_base (34791)..(34800): a, c, t, g, unknown or other
  modified_base (35540)..(35549): a, c, t, g, unknown or other
ggccccacgtcgcccgccgccgctccggcgcaccccctccgcgccgcgctgcacctgctggagcggtcggcggggtgcctgacggcgggcggcgnnnnnnnnnnnnnnnnnnnnnnnnnnnnnnnnnnnnnnnnnnnnnnnnnnnnnnnnnnnnnnnnnnnnnnnnnnnnnnnagccgcccgtcgcgctgctggccacgctgtgcctccggctggcctccggcgcccagcaccgcctcgccttcagcggcgcggggccccagggccccggcgcgcacagcctgctggcgcagagcgtgctgtacggggggggcactgtgctggtcgaccccggtggcgcgacggccgagggctgggaggtcatgccgatgcccgtgtacgggcgcctcatccccccaccccccagcgccgacgacgacgtggagcactggatgcgcgccatgtacgccgaggagggcgagcgccggggcggggccggcgcgggcggggcgacgggcggcgcggcggcgctgctggggccgggggcggccgccgcggccgccgcgcagtacgtgcggctcagggacgcgctgtggggcgtgtgggatgcgggcgtcgggcctcgcttccgctgagcgtgtttgaggggggtggacgcccccagaggagaggacagcggccaaatgggggcggtggcatgccctgtgtaggggaccggagactgagattggccgctgcacacttcatctccccacttccatgctcgtgcctgacatgccttctgcactgcagcaaatctcccagcttctgtggggtgcgattttcttgtatcctaagtctctgtatctgtacggtcccacatccatcttggacttgtggcatgtgatccattttgggggacaccctcatgccaccaccagctccctccgcaatgacgacctgcacatgccttgcaccactcaagccgtgcaggagtcgactgcttggccccattggttccgcacaccagaattctgtatccttgactgtaatgtttgcacacgctttcgtcagaggcagccggagaatcgtgaccctgcannnnnnnnnngaccagaactctgtatccttgactgtaataattgcacacgctttcgccagaggcagccggagaatcgtgaccctgcacgaagtaaggtggcgctgaatagtcagtcctctcgccattcctcatcgcagagtccctacttgctgcaagccaatgagctcgctggttcttgggggactgctgcctatgggtctcctgtaagggaccatgtgagagccaggatcatgcagaacatgtcgctgagccttcctctagcaccctttatttcatgcagccgccagtgccatgcgatgcagcagcatggaacttgatggattgtaatgcgatgcgacatggtttgcacgacttttcctgggcagccaatggcatctcattcatcctgacaagtagcaacaaaacttgtgggattatcatgaacctaagtttgatgcaggttttcaagcgtccaatgtcatttattcttcatgaagtaacaaaacatccaaaacctaccgacttcacagcgcatgtaaaggaatcaacttcaggatgtgatatgaaggttctgtcagatgnnnnnnnnnnatgtgggattgtcatgaacctaaatttgatgcaggttctcaagcgtccaatgtcacttattcttcatgaagtaagcaaacatccaaaactaccgacctcacagcgcctgtaaaggaatcaactgcaggatgtgatatgaaggttctgtcagatgtctacatcccagatctttgaacaggggggaagggttgattgcccgcccctggagattcgcgcgcggaataatgcacaggggttaaccagaggccgaggatgccccgnnnnnnnnnngtatcccagatttttgaacaggggggcagggttgattgcccgcccccggagattcgcgcgcggaacaatgcagaggggttaaccagaggccgaggatgccccgacttcgcagcctcaaaactccatattcctgtgttcgagacaagacagagcgcctcctaaagctcattatcctgatttattctccaaaattagaatcgagtgcttgttcaccggagcttatattcccatggaggactagccacgtgcatagctccatgtccagccactcctcccagctcaccctggtcggcaagccggccacgaccactcctcggccctgctcgacgtgctttacaaccacaaaatcaacggatcgtggcatcgtcttgaagaggaggctccatgtcgtgccccatgtcgccatgcgagaggcgacggggacgaaggtccgcacacgaaagggggggatcggctggcagctgggcttgaggccggttcatggtcagctgcagaacgctggaactgacctgccccatctataacccttaccagacagcatcaatgaaggacatggcgctggagatgaagcgcatgcggggccagatggaggacaacaaggacctggcagtgctcatggcggggttgaggggcaagaacctttcccaatctgactttgcagagaacgacgtccaggtcagcctcgtgcaggcatggcggggnnnnnnnnnncagcagaagttggccatgccaggcgtggtgatgcaggctggccagtgaatggagaacggttgacttgatcacacatcagcgtctccaccaagcaccactgctctgccctgcagatgcaactgctggagatggtggatggcgtggatgaagagcagctgccccaggtgtactctcccgccggcatccagctgtactggggcaggaggcccgtggccgtctgcaggcgcatcacccagctcctcagtgagtttggatggtggacaaggtggtgcaggacagttggtgtgcagggtaaaggtcttgtagggtgctagcccacgtcggnnnnnnnnnnactgccccaggtgtactctcccgccggcattcagctttactggggcaggaggcctgtggccgtctgcaggcgcatcacccagctactcagtgagtttggatgttggacaaggtggtgcaggacagttggtgtacagggtgaaggtcttgtagggtgctagcccacgtcgggtcgatgtttcactctttaggcaggtttgaaacgcacaaggagttgtactaagaacctgcctccgctgtccacacttacaaccctgcagaacccacttcgctctctcnnnnnnnnnngtttaggcaggttgaaacgcacaaggaattgtactaagaacctgcccctgctgtccacacccacaaccctgcagaacccacttcgctctctccacccctcccctttcccccaaacagccatcggcgccggcttcctattcagcttggggcgggacgcgctggccgggacgctgcgggacaatgcagtggtgcacgccatccgcctgcgcggcatcctaacctccctgggccctgcctacatcaagctgggtcaggcgctgagtatccgccccgacgtgctcccacctgccgctatggtagagatgcagaagctgtgcgacaaggtgcccagcttcgactcgggcatcgccatggccatgctctctacggagctgggccggccctggacggaggtgtatgccgagctgacgccggagccagtggcggcggcctcgttgggccaggtgcagatggggattggaagcgcagatggggannnnnnnnnnggtggcggcagcctcgctgggccaggtgcagatggggatgggaagcgcagatggggatgggaagcgccgatgggtggccgcgagagtgccctaaagggggctgaagagttgccttgggtccatttcagaagcatgacattgatattcactgcgttnnnnnnnnnngggaagcaccgatgggtggccgggagagtgcactaaggggggctgatgagttgccttgggtccattccagaagcatgacattgatattcactgcgtttccccagcctcatagactctgacgaagttgcttcaacccaccttcgaatctgtcaatctcaatgccaggtgtacaaggggcggctgcacaccggggaggcggtggccgtcaaagtccagaggccgtacgttctggagaccgtgactgtggacctgtacatcctcagagagcttgggacgtttctcaggaactttccaaagatcacggcggtgggtgctgctggggnnnnnnnnnnnnnnnnnnnnnnnnnnnnnnnnnnnnnnnnnnnnnnnnnnnnnngcgggcggctgtggatacttggaacatgagctcagagcacttgcgtgctggttgtacatgagcagataaatcttcctaaaacctacgcagctgtccttaccataatcctctccttgcccattcctcagcgtcttgaccttgtggctcttctggatgagtgggcagctcgcttctttgaggtgtgttgcatggcgagcggcggatatattcctgcagtgctactaggaagatgcatgctcaggcgctcgaagtgtgtctaggctgttcgacagggctttctgtgaagttgacattgtgtggccaatcatcccatcgtgcatcaggagctggactacatcaaggaggggcagaacggactcatctttgcagaccagatgcgggaggatctcccacaggtatattgttgccagacctttcttgctgctcaccctttgcagcaggggtgattattagaaggagtatctactgtatgggttttgcactgcaaccagcagcaagacatcgtgtccccccccccccccccccccccctccccgcnnnnnnnnnnatacttacttactgtatggttttgcactccaaccagcagcaagacatcgagtccccccccccctttctgtgcaggtagtggtccctcggacatttcccgagtacacatcgcggcgagtgcttaccacctcgtggctggagggcgagaagctgagtcagagcagagagagcgatgtggggagcctcgtgaacctgggcgtcatctgctacctcaagcagctccttgagacaggtaggtgaagggtgaacctggctggaatgccagtgtatctgaggagggtcatcctgacggaaggattttgtttcaatgtcacgtgggcccatgttccccgcctggcaagagtgatgcttgggccactgtgcacttggccactgtcactcacctctgtggacgttctttgtcccacaggcttcttccacgccgacccgcaccctggaaacctcatacggaccccagatggcaggctggccattctggactttgggttgatgacccaggtggacgaggacattcgtgtggggatgattgaggcagtcagccacctcatccacagggactacgaggccattgttcaggactttgtgacccttgggttcattccaccggggaccaacctttcccccatcctgcctgttttgagcaaagtgagtgtgctgctttgacaggagggaagtgtgagggatgatggggtgctttgatggagtagcttgtgcaggcgggtggttttactccgttctttgtctagtgatggtcgatctacatccttatnnnnnnnnnntgtgtgagggatgttggggtgctttgatggagcagctcgtgcaggcgggtggttttactccgttctatgtctagtgatggtcgatctacatccttatactccggtatccacacccaggtatttgatcaagcacttgagggcggtggcgccaagaacataaacttccaggtaggatagagcgaggacaccctctgcgctaaatctgcatgataagtggatgaagctccttgtgacgcttgcagcttannnnnnnnnngtagagcgaggacaccttgtgcgctaaatctgcatgataagccgatgaagctccttgtgacgcttgcagcttattccaggctcaatttcagccccaccaaccacttgtttcaattatgcagggtctgtctgctgatctggcacaaattacctttgactaccccttccgcattccaccatactttgcactcatcatccgagcaatcggtgagcagaagatgtcttttattcttgtgcacaaatgtcggattccattcggagggtggcgagctccagggatgcatctgaccttggtgctcctgggagagggatagaatcgatcatgacacacctttcagcatccttgatgtgctatacccatcgtcactgaccggtccacgctcttcgatcgacatgtcacaggcgtgctggaagggattgctttggtgggggacccagactttgcactggtggacgaggccttcccatacattgctaagcggctcatgactgataattcgccacgcctcagggccgccctacgctatatggtgggttttgaggagtgaatgctggcatctcgacagctctgtgctccctctgttggtgcaagggcgctgttgatcggtccccgtctgcctggccgaagatgactgtcaccatgccaacccacagtcgagcccactctcgccactggccctcacgaccactcctcgtcacagatttatnnnnnnnnnnagttttgaggagggatgctggcatctcgacagctctgtcctctctctattggtgcaagtgcgctgttgatcggtcccctatctgcctggccgaagacgactgtcaccctgccaacccacagtcaagcccactctcgccactggtcctcacgaccactcctcgtcacagatttatggcaagagccgcgtatttgattccacccgcctcatcgacctgctggatgcgtacgagagcttcacactggcttctaagtcggcacagggtaacctgggcttggagcactttgtccctgccacgaatctgcggagcagcagtgtccaggtggtccccgcagcggggctgagcccccacaacgcacaggcatcctatggacatggggcagctgggaacctggcgcgacacaacggcgtgcctgccagctccatggcggctccccttgcacctgtctctgcctcaatagatgcagccctggagacagagaaacggcgggaagcactccnnnnnnnnnnctgcacctgtctctgcctcgatagatgcagccttggagacagagaaacggcgggaagcactccggtaagggaagggcagcatggacaatcgatgccttggccaggtgtcagccaatgcatgcagcagatatcgtcgctcggcactctgcactgcttggctcttctcgcagggacatactcgatgcttgggattgctgcaccccacactgtgagtagggccccacctgtcacctcgaatccctgctctgctcnnnnnnnnnnacactctgcacagcttggctcttctcgcagggacatactcaatgcttgggattgcagcaccacacactgtgagtagggcctcacctgtcacctcgaatccctgctctgctcgcaggttcctcctgtcgccggagggaagcttcttccgtgagttcctgctggacgagatcgtcaagactgtggacgccgcgacccggacccagcttcggagcgtcatgctggcgatgagcagggtgccactgccgccctttggactgccaggcgcaaacaggtggggtggggtggtggacatggtgctgtacagcctgctgagctcttgggggtgggcaggctgttgggagccctcagggtacctgacgcaatggcactccccaagccacagacacctcaccgccaccctccagcaaagcacccccccttgtcagcacgatgtgcagatctaagagccccctcccctccccccccacatgccctggcaggctgctctcggtgctggcgccccaggtcagccccgaggacnnnnnnnnnnccaccccccctcgtcagcacgatgtgcagatttaagagccccctctcctccccccccaacatgccctggcaggctgctctcagtgctggcgccccaggtcagccccgaggacgagcaaatcatgcagagcatgtcgcgggtcgtggcctacctgtctggccgcgatgcggggccgggctcgctggacctggacctgctgcgtgggctggagccgcagctggcggccgtcgcgtcccgcatggcccctgacctcggccagcgcctgctcagccgcgtggcggcccgcgcgctgcggcggggggccggctacgactgacgacgtggtgcaggcggcccttgaagtggcatgggattgccaggcgcggccaggcgttgtctagtgcgtgcagtccctcatgtggaggctgtcaccacgttggccctgcgggagtagacctccactcaacctccgggccagtcttgcaccccttgcctcatcattctttgaataaaactgtcccagtactgtacacaggcagatgctctccaatcagagcactgataaaggttgtgccctgggaaggttgcactccacgtcctcaatgtagcagcattctagagggccacgctgacccccgtcgatccgtagcccccagcgccgcgcactgtggtggggagctctgccacctcctccacctccggggtctggatgacctccaggatgagctgtgccacacggtcgccacgcttcactgcattgagcagggcatgaaagatgtggagagacccagtatacatgccggtgaggtcgaaacaggcatcgcccaccctgccagctggcaccccagcccagcaggcacagcccaccatggaagtcgacgtcgctgtggttgaaaaggaccacccccacattgcctctgtagtcctcgtccaccacgccagcgccggtgtctataaagttcttcactgcgaggccggagcgcggggccacgcgcgcatacgtcccaggaggacaggcgatgctgaggtcagtcttggcgacgcccttgccccgagccgggatcacaacatcctcagcactgcaagtgagggattcagcaggatgaggctggtgtcagccttgtagcaacccctgtgccgagtcgacctgctccactaagctacaccacctacgtccaattcaaccacccttcccaacatgcacctggccaggtcgtagcctgcagctcccactgagcctcgcttcggaagcacagcgtactcggatagtttcttgacgagaagggcaggcgcatgcccggtcttgatcagcttggaagggggtgggacagacccgtcatgtgcagccacactcggaacggtcattcttaacgagcgatgcccacgttgcaagcaccacaatgatctgcgaggtacagggactctggatgctggtaaaggactaattccgagcatcgatatcagcatcgaccagcctcatagtgcgaggttaaaaattgaatcttaagggcgcgcggcgtcctggtgagatctggaatacaaactctgcacgagcagatgttcccgcatcgcctggatgtcacctttcgaagccaaaagatatgggagatttccagcatcattatgcactgaccacctcaaactggggtcgccctgccgaggtattgggatccgtctgaatggcggcacctatttgcttcacacggaagcggccccggtaggtcgactttgcgtgagagtttgttcgtgcacatgaatgacatcctttaggatgcagacaagtatgccctctcaatgttcctcacagacctgtggcagaatcaattcctgtcgccagcccacagccagccttgnnnnnnnnnnaaatgatatcctttcgaatgcagacaagtatgccctctcaatgctcctcacagacctgtggcagaatcgattcctgtcgccagcccacagccagccttgccaacagcttccagtgctgcgcctaggaacggtgcaagtgccaccctgcgccagtccttcctagacctggggcagcgcagcttccacttcgtgcaatgcccatcctgcggcctcacctactcccccggccagccagatgacgaggccctgcatcgccagcatcacgccaaggcgtgcaggccagcagtgtacagggcaggcaagggccacactacggtctggtctgacgccgatgcctccatcatacaagtcccccacgacgcttcccaagcccaggtacttcaagcttgcttggaatcgagatgggtgcatcaacaaggctgtagtggtggcatcgtgggagctgcatctgacatcaggcaacctggtgcatgataacgaatgcaaacctgtacctctgtcccagaccctcacagcannnnnnnnnnatactggtggtatcgagggagctgcatctgacatcaggcaacctagtgcatgataacgaatgcaaacatgccctgtacctctgtcccagaccctcacagcaatgctggctcgggagatggggctggatgccgcatggcttgggcgcacccggccgcgactgtggttgtatgtcgtccaggagtccaagcacgtcctgggggcggtctgggcagagcgacggctcgtccgcctggccgctcagccttcagacgaccatcccactcaggtacagcccttggcatgatcctcctggcacagaagcaaggcagcatgctgcgtttacacggatgttggcatgcacctgcgtccacctggacgaacaggtggcacccatcagccatggccgctccgccccgacgcaggggcactcgccgccgggccactcccatgtcggcgtgcgcgcggtgtgggtgcgcgcctcagcgcgccgcagaggcgtcgccagccgactgctggaggcggtgctgggggtcgatgccgcgctgtcctgtcgactgccgagaggcaggctggcgttcacagaccccacggccgacgggctggcctttgcgcgcgctttcctgggacaggccggtgcattcgagccgccgcggtacacagacacgggggtgcaagcggagtgagacggcgcgtgactgcagtgacgcgagggaggaccgccctgtggacggcgcaccctcaggcttcacttcatgatgtacccacgccgactgctccagcggagctggtgcaaagggacagcgctgccgaggccgcggggctgggcgggtcacggctgtagctcaagcctttgcagcgatcgcttcctgcacaaaggtgcacgttgcagcgggctgacacacatcgatggaccccgccatggtcaggaaccccctcaaggccttcctgcatcccactctcacagatctccaaggccttcccacctttgtgccgctcttgccagatggtttgcccttggcggccttgcggctggtctcgctcaggacggcgcggcaggccttcaccctgcgatcgatcgctgcaatttcctccaggtcgagtgtcgctgagcccagcgcccccagctcatcgatggatctgagcacggcagccagcttgtggaccgtctcctccggctgctcgccgggcgacagcacaagagccgcagggttttggatcttgataccagcctgtgttcgcggaggatgggaaactagggctggagaaggcgcttgggtcggcctgcaggcttgtgctgaataaaaacgagcttgggcaatgtaatgaaaggctctctggattaccctgagctccattcatggccaaatactgttccgcactcccgcatccagctggcccacagcatgannnnnnnnnnagggcaatggaatgaaaggccctctgggttaccctgagctccattcatggccagatactgttccatactcccgcatccagctggcccacagcatgatcatgtgccccatcacaaacaaccttgtgaaagccggaccgcagagccgccagggccagctggcctggcgtgaagaggagtggggcatccgtcagcatcagcgcgtcggcagctgcgagggcagcacgtcgtgccctgtcggccgtgctttcttgcaagccaagaagggcaggctccacagcacctggaatctgtgccctttcttgaatgacctgagggccaggatgatggagaatgcaagaaggggaagggggggttggaaagagtctgaggagccattgaagtgtactgcctccttattcttccatcttcagcggaccaagcggaggaattggacccctgcaatcgcctcggaacacaaaatccagacacgctttcctcaggctccccgaccatcacctgcatgaagccctctatggcgttgaagggcgagaagacaatcaggtcgaacttcaggccctgaagcagggtcagctctgtccccagcacgatctcggcccgcatgcctgacaagcgccccagctcagcagccgagatgtagctctcctccgtctgtgccagtggagaaatggtggtgggactacctgattggtgcatggaccacactcagtgatgcacatgcatgtttacccccctgcgaagatgggctgacacagcgcaccaatgcacctcctcccgttgtccaactgggctggtgcccgggtcccctactccccaaaggaaaaccaaacccaccttacacgccaggtagaggcaggtcaggaannnnnnnnnnnnnnnnnnnnnnnnnnnnnnnnnnnnnnnnnnnnnnnnnnnnnnnnnnnnnncacgcagctgtgcacgtacatgcgcttgaggaaggtgacgcaggtgccgagcaccttgcgcggcagcttcagctcggcgcagatggcctgcagcttggagccgtagtaccgcagcagcagctcctgctcctccagggagggcggggcaaggtctgcgcatgcatggcaggggaaggggttcagcctgcgatgatctacgtgcagtgtggactgacgtaagccttgcttcaattccgcagctcaatgccactgaggaccagcgtttgccggtagcacttgcctgctggcggcggtgtgtccccattgccactgcccgaggcctgtgaggaggactcctgtgcctgtgcaggaagacatgggcacacataaagcccaggcatgcttgctgtgcaccagtgctgcccatctccagagtgcaagtgttaattcaccacctctaacccaccgcctccgcaaaagcacctgtgtcaagagccgcagggtgctctctagcttggccccccgcagctcagcctgtcgatgggaaggagaaagcggtgaaggcccatctcgatccgtgtgcagcatagcaaggggaagaacgcggctcaccgcggggccacaccccagcctgcaagtattagccacctccgtgtctcaccagctgctcgtttgtgaacacccagcgatcgcattggctggattccttatacttcatgctattcagctaaatgtgcattgaaggcatgagcatcgttgaaacgatgtcgcagagcgaaggtgagtatgtgtacgactacgaggctcaggggggcatccctgtctacgatcaactccagcacgcgatgtttctacgtttataatggcccaatcggattatgccctgaacgagtccacctgcgaatgttgacagggcttccgtcgcacaccctgatcgggaccccggaaacccgcacaccccgacaattttcgggaatccctcctcacttcggctttagnnnnnnnnnntctcaggggggcatccccgtctaagaccaactccagcacgcgatgtttctacttttatgatggcccaatcggattatgccccgtacgagtcctcctgcgaatattgacagggcttccgtcgcacaccctgattaggtccccggaaacccgcacaccccgacaaacttcgggaatccctcctcacttcggctttagtcgataggctctgaatggcatttacattatacggcgcagacattgctcaggactcatgatctgtgacgctgctttctcagcaaaagatcacaggagtgaagggggtggtcacagagccagtgcaatgcaccctaccgccacccatgtcccatggtcacactgcttcactcgaaatcagactcgggggcgggggcaggcacatctgcggggatggaaagggggattgagagtgacgtggttgcacatgaccctggctgccagccgcaaggcaactggagctaccaatcaacgtagcccctttgcctgatgcagatggagcaacgacaccagtatctcaccgtggtggggaggagggggaggggacacgacgggcaggaaggggcagtagccggagctcaacttgttggcagcatcctgggtggtaaagttggggccatggccaaacacggtctccaggctcgcgacaacctcctcgggggcatcagtgacaccgcagaagttgatggtgatggtgttctttgcctgaatcttctgctgcgtgccgtcgatgggcaggatcgcccaggtctcggagtcgatctgcgacaaggtcggggtggctgtttgaagtacacactcacgtggcctggcgatcacccccacatttcaaatcccaacggttccggcggcctcccgatgccgtgcaatgcaacgcaccatctcaggggcgccgatgccggtgggaccagaggtgatggtgatgccggacacggacagcagagctgcccaggaggtggaggtctcgttgagggtgttgcgagcgacgatgttcgcgcacagcccggacgaccacgaggcagtgacgtgcaggttaccgcatgacctgacgatggccagcttggatgggacagccatggtgctgctggcaagcgccagagcgaaagcgaagatgaggacgcgtggggaagccatcgcagcggttggtcaggactatgcgttgatcggtggacgggggatctgagggacagaggcttcgctatgtggtgattaaaagatcgataattatgaaattgatggcgatcaggcctcggcctgtgctttacaagcagtttgaacgcgctccgttgattccaaaagaatctgactggggcgggaacctgccagcggtattcatgttttcttcatatggttgttacccaaccgctctgagcaaccgcccaggatgcttcggcacaggtgagctgtgctccagctcctgggggatgcatgtgcagtatgttgatgaattacaagacatgagagcacagagttgagggggtgcacaaaagaagttgcccgctccttcctcctttgcgccgatggctagaactttgcgctttgacttcgctgcagcttccgatcccggctcgcacctccccccggccccttccagaagtcctccgccgggagccggcactgcagcttgtcgcagaggtgtgcagggttggagccctggaagacagctgcaagaagtgtatggggtgtggggaggtggtcggctcaacctgtcacacagaagcacacaggagggagcggatcctcataatcaagggcgtccacagcgacactcaccactggcacgcgtacatcgagcacacctcattcagtcacggtcacaatcatatatttacatggtcctcaacgccacggtttccaccacaggtgttcacagaatcgnnnnnnnnnnagagcagatcctcattatcaagggcgtctttagcgacactcaccactggcacgcgtacatcgagcacacctcactcagtcacaggcacaatcggttatttacatggtcctcaacgccgcggtttccaccacaggtgttcacagaatcgctcccccctcacctcctcctccccttcactgccacgtgcagcgctggcccgaaaaaaaaatccatgctccctcacctgtgacagccgcccctacggcggatttgaccacggcgttccccggcaacgagggcggcgggggcaggagggcgggggggctcgcccccggcgccaggcgcgcgcgctgcgcgtcggccctgcccagcgcctgccacctcagcgcagcggcgtccaggcccatgcgccgtgcgtcgtccagcagcgaagggaagaaagtgaggccgctgacctcctccagggaggtcagcggcaccgagaaggccgacagcgggtactcagcggggatggccgagttaggcatgacaaaggcggccactgcggtggaggcgtccccctgctcggccagcaccaccttgaagaagtgggtgggcacggccaccatctgcgggggctggcctgcgcagggttgtggcagtacaggtggggtggtatgggggcctgttggtgaccaggggtgggcgactgcgggctcaatgcagcacctgcccgacgcccttcccgcactctgtcaccgtcctcccctgcgccaccattcccccacacccaccgagcatggggtgctccagcacccagccgctggggccaggccgcgggatgtagagaggtcccgtgactacccagacatcgtcaaaggacttggtggtgtcctggacgaagcgctcgaagcgcgcccagtagtcgcggttgaagcccccgcccacctgcggcgcgatgttgctcagcgagaaggtctcgtccatggacccctggctctccttgtggttgctggcgggggccatgtggcctcgatcgtagcccgtgccgcggtagtcagacagcttggcccggaagcgggcgcccacccccgcatcctcggtgaactgagaggagctcctgcgagcagggtggaacgccagggcagcgggttgaatgcttgaatgcgggggttggtggtgccccacatcacaggcaataggaggcctgagaggcacccacagggtgattcatcgacggagacttgtgacctggctggcctggggatcttgccacgcgcagcacgtacctggtgccatctcccttgagtttggagcgggtgnnnnnnnnnncaggaggcctgagaggcacccacagggtaattcatcgacggagacttgtggcctggctggcctggggatcttgacacgcacagcacgtacctagtgccatctcccttgagtttggagcgggtgaggtgctctatcacccacttggggttcctcagccgggtgtcgatgctggcaatgaagttggtgtacatgcggattccatcggacatgggcaggcctatgagggaaggcggtggaggagggagtggaggatgcttacacgaatactcgggcaagcacaggagccagatcagaacaatacgaccaagaggtcaacaccctcccctcccttcgcgctacatccccgattcagtgatggccctctccacaccatgcttgaggcagggatgggaggcatgaccaggtaaaggggacggagtgcttcctgttgagtattgcgaccacaggcttcgtgaaggaagattgcagaatgggacaccctcctcaagctgcagaggaccagcaggccaaagaatgcaacagatttcacggccatatcatgccaaggaaagagaggccacccgacccagtaaggaattctgatgggcaggaaagcttcacctcaaggaaatactgacctggtcccaccgacgaccttgcaggatgccgacgtaccactacaaaggtgagcgctccgcccaccgccgcacccgccacggctccaatcgccagccggctggatggagtgagggctgagtcagggccccatgtacgctttcatagatttaaaacaatactcatgcattacatcatcaacaaaagtgcggcatcgccctcttcctgacctggccatgcctctcaatgggcactatcccaacgtgagagtgagcaatgccgtacnnnnnnnnnnacccaccgccgcacccgccacggctccaatagccagccgactggatggagtgagggccgagtcaggggcccatgtacgctttcatagattgaaaacaatactcatgcattatatcatcaacaaaagtgcggcatcgccttcttcctgacctggccatgcctctcaaagggcacaatcccaacgtgagagtgagcaatgccgtactcgatagtgcgatcagcagaggcgctcgattagcctctcatcagagacaccagcagtatatattgcatgctcatgatcaatgccgttctctacttgatcacgacactgcagcccgcatgctgactccgtcttcgatcgcatgctgaggatgcgatgcctccaaaccaagatcagccctcccacagccacggcctttggtgcgatgccaaagggtgctacgcaggcatgcacttgacacattgtggtgggaaaattaccatgcattcactagctcctcaaaccaggcatggtgtcgctgtaagagcgcacaatgcagcacctgtgcacgtgggtcctctcgtggcacctcctcccatgggagcatatgcgccacatgcaatgagccccctggatcgacgggctgccctggtcggtctaatgggggtcggatacctcccttggatccccgtatcccctgcgagcgccgctcgctccccaccctcccagcccgtgagggcgtacttgccacctgcctcgacaccaggctttgtacagtacaccccagatgagaagaagacccccgccatccgagcgggtgtgatcaagcctgacccctccttctatacctttgtcctcccagagaactggtcggaggtgtgtgggtgtatcatgagttgaagatgttgtctgccaggacaggcacgcagaggcattgacgggcgagaggttttgctggggccacacccaacctgctttctgttacactgccgtaggggctcattctcaatatcctctcgggcaacttctgcatgccccgctgcgacgagccttggtacgaagccctcttccaaaatcaggcagagggcaaagcacaggtgggaaggaggttcatgccatcgacgccaacgagggtcataattcaatttttgatgacttgttcagatactcttacaggcctcagtgtgatccaatgcagctcatcgtggctccactgttccggcttatctccaaagccggagcccaactgagcgacattgggccgccagagcgggccattgagaaggtcggcaactatgtcacaggtacagagcatggggccagggacattgccaaggatttggttgcacaggacccactgatcatttgctttgaaactgtcacaacccaatatcagctaattctgtaccacgccccaacccttcacaggctcgtccctggaagccgaggacgatgtgatcagcgcgacttccaagactctcccggatgggcgcacctactacatctatgaactcaatgccctgcaggccaaggacggaccccacatcctggcttccctcaccatcaaaggggaccaggcctacctctttgtggtcagcgccagcgagaagcagtgggcccgcagccagagcaagctgcagaccattcgtgacagtttcagggcctgatgcggcgcataggcgcggtgccgcggcatttttgcagtgagtcagagagcgaggcagcatccttggatgatgttgcccgggggaaatgctctgcttggctgtctgccttgctgagatttgaaggtggtgtctctggcatcagatgctcccctggaccgcagacagggtatgaggatcaatcaagttcatgccaggtccattgatcttcaagcttgctgctcatttcttattttgttgtggagacacatctgaggttcactctgaaaatcctagtctcatttcagggcgtgggaacaaacctgcatgctgctgagagtagggtgtaatcgtgggcaggatgtcctgtagaggaggacgctgtttctccgtcagggcttgcccacgtggatgtttgtgtcggaacatcttagcaattacttttcaatgccgcgcccattcagctattcgctaagaccaacgcagtgcatgcattccaatacaatgacattctagctttgttgtctcttgatcgctgtagagactcagtagcatggcatccttgcgtggtgcgtcggctttcgtaacagggggtgggagcggcattggacgtgctatctgcgtcgatctcgcaaaacacggctgccatgtgacggtatgtacgtcgcgaactcgattgctttgcgtgtgtcgctttgggttgcccatgcttgctcctccaaggatggtagaaccctcattcccccaccccccaacattacaggttgccgatgtcagcgatgcgggggctcgtgccaccgccgacctggcaggccccaatgcaaccccagtgcactgcgatgtggcctcctcggcgtcccaggaggctgcattcgctgaccacatccgtcgcaacgggggcctcgacatcgccgtgctgaatgctgggatccctgagagaggtactggtccagaggaggggctctggcttgatctctggagtgtgatccggggcccgcgatgtagatcaatggctacttgcattgccaagccaacatagcccaccagtgcaacgtcaccactcatctagcttcttcatcctcacaccctgcgttctcctaaactgaccgagtccgcggcgccctcgtcaacccccccttgccgctcaattacccccccaaacccggcctccatcaggcgacctgctcagtgcacaggacgactcctggcgccccaccctggacatcgatctgggcgcggtgctggacggcatccgcctggccagccaggccatggcccccgccggcgggcggcgggaggggcggcagggcgtcctcatcaccgtggcgagcgccggcggtttcttctccatgcccttctcccccgtctacgctgcggccaaggcgggcgtggtgcacgccacgcgctccgtggccaagcctctcctcgagcgcaacatccgcatctgcgcgctctgccccgaggtgagcttcccgcagggacctggcatgctcctcggtgccagccagacgcctcaggacctgtttcttcaagctcgcacatgcaccctccagcctgtctaaagccacgctcacccaccaacaccgcccccgtcagtaacaagcctctccactccccatcaactcagtttgtggacacgccgctggtcgctgaggctcgtgcccagagcgggccccagtccccgttttacagagcaacggcgggcaccctgctcaccgcagacaaggtggcagaggcggcgcacgtgctcatcaccgaccccaatcgcgtcggccagtgcctcgtcgtccgcatgaccggggagtggatggaggcggtgcccccttctcaaacgctccagtgagtctttgccggggtggaaggggttgcaagtgtgcatgtagtgggtacacgcgcaccacacgctctgccactgggcgtctgcatgaggtcatcaaaccggaggcccatggcctggcgcgatgcacacggagtgcccgaccgattcggaggcccattgctcgtcgcagctcccctgtcgatgagcccataccccagccgcccagcccgtcgcacccgacgcgccccccttcttcacccccccctcccaatcaccacccaggtacatccctcgccccgccacctccnnnnnnnnnntgcggcccccttcttcccacccccctcccaatcatcgcccaggtacatccctcgccccgccacctccaccagccccatcgtgccggcctggcgcgagtgggccacgcagggccttgccggcggccgcaccacgcgcaccgtcatgatccggcggctgtccaacgacttccgcgccgccacacggctcgagacgcggcccgtgcccgcccccggcccaggccaggtgctgctgcgcaccgtctacgccgggatcaacgcctccgacatcaactacacgtcggggaagtaccacgcctccaccgctgcggccgaggcccagctgcccttcccctccggcttcgaggcggtgagcgtggtggcggaggtggggcccggggtcaagcacccgcgcccgggccaggccgtggccaccatggtgtcgggcagcttctcggactacaccctcgtccccgcccgcgcctgcctggacgtgccgggtccctcaccagagtacgtggccctgctcacctcgggcctcaccgccagcatcggtgcgagggggtgtgctcggctgggcgggtgccaggggtgtctggtatttggtcagacatcaatgcacatgggggaaggggggagacaggggcgggcgcggggctgcctcgttcccccgannnnnnnnnnatctactcgggtgggctgatggcaggggtgtgtggcatgtggtcaaacatcaatgcacatgggggaaggagggagacagtggcgggcgcggggctgcctcgttcccccgacgcggctggcaggcaatgggctgcgcctgcatcctcatcgcgagggagcctccccttgtttctggtcggccttcnnnnnnnnnnnnnnnnnnnnnnnnnnnnnnnnnnnnnnncagcaagcaaccacacccacctgtccgcactgctgcaggcctgcaggagtgcgggaggctgaggaagggggagaccgtgctgatcactgccgcggcggggggcgcggggcagtttgcggtgcagctggccaagctggcggggtgccacgtcatcgccacggtggggtcggaggacaaggcgcgcctgatccggtccctgggcgcgaaccgcgctgtcaactaccgcaccgaggacctgaaggcggtgctgcgcgccgagtacccgcgcggcgtggacgtggtttgggagtcggtgggcggcgagtggtttggcacctgcctcaacgcgctggcgcagaaggggcggctgatcgtgatcggggccatgagccagtacaaggggcccgacggctggaagccgatgccgcacctgggcctgccggagaaggtgctgaacaagtccaccaccgtgacaggtgggcatgtcggttggggagggaagggggaggaggatcctgatgcaaaggaccaggtaccgaggggagtgttatgcagggccacttcacaccggcaggggtgcgctgaggcctgaggggccaggtcctggcgatatcccacccggcggcgtgtgggtgcatcgcaagcctcccgggnnnnnnnnnntggttgggggagagaagggtgggggaggatcctgatgcaaagggccaggtaccgaggggagtgtcatgcagggccacctcacaccggcagggccgcgctgaggcgtgaggggccaggtcctggcgatatctcacccgggggcgtgtgggtgcatcgcaagcctcccgggcatgcatgggtgtcgggatggatggcagcaaatgtgcatcaacccccatgtaccctcatggcggaccctccctgagcccctccccacccttccaaaacccaattctcagggttcctgttgctgcactacacgcacgagttcaggcgccnnnnnnnnnntgagtgcatcaccccccatgcaccctcatggcagaccctccctgagcccctccccacccctccaacacccaattctcagggttcctgctgctgcactacacgcacgagttcaggcgccacctggctctcctcatcagcctgtacagcgccggcaagctgaagatcatcctggatttgcccgagcacgtgggcatcgaggctgtgcccgctgccgtcgaccggctgcagagcgggcaatcatctggaaaggttcggcgagggtgccaggggattgggactgctgtaccctcagaccatctggctgaccgactcgcaggcagtgacaccggcacggcacctggtatggggatgtcatcaaccctgggcgacatgcttgatgcaggtgtacgtgcgcatcagcgaggaccctctgccgccggtgggagccaagctgtgatgctactggcctcaacctagcacttggattggagtgcagacccaagcaaatgtgcaggaaggggagtgatggcctgctctccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaactaactgtaaggccggagccacccacatcgtgcacatgcagcatcctctcgtgtggtggggataacgaacacccctccacagatcgggacactagtgcagggcgcaaaaacacaagcatcgcgagaaagattttgccagctgcgtgctgcatgtatacggggctttgtgcatgcacagcttttgcattgctgcgagcagacattctcatgtaacgcccttgtatcccctcatgatggccagcccagagcacaggcaggctccagctggcgtagtggagacacccgacaccccacccgaagcgcgacatgagtcgcctagcgcacctgcacttcagcaggcaccaggaactacagcgggcgatgcgcggcaccaactcttggcgagcatggaggaggctggggctccgagcaggtgggaaggcttgtcggagtgcgtcgtgggggggagcgctgcccctcgtcaggcaggacgagctctcgctcggggataactttaccgacatgagtcccttcccacttcacaggatatcacagccgcggtatgccacgtccctgacgggttcacccatgcccgctagaaccacctgggcgccgatgccggcctccctccccgaaccggctgtcgaccccagcatcgtgaccatcagtgacaggagagtgcggctgccaggcgcaggacaggaggccccttctctctacggcctggcaagggcatgggtgcggaatgccccagacattcccatcgagcaggaggtgagcaagcgatggtttccgcttgggagggggtggagcaagggatgcagagattctctccctgtcatgccccgtcgtacatgaagacagatcgcggaagaggtctgccccgcatagcaatgactgccctttacccccgtgcaagatgcctcgggcggcagctgttcctgaccaaccgtccacactctttgccactcaccaccccactgactgccagttgtttaaagctgcgcccagcggacgtggatggagggaggaggtagacggaccccgaccaagcctgggcccgccccccattccccccccgctccttcctggaccggggggggccgccccctctgtggacgtcctgctgcagcacaaccttgcgcattggaaagcgtgtcgggctcgtgtgcgctccctggaccggagactgccagcagccagtctgcagtacctggcaggcctcatggcatcagccgtgcctgaggccatggtcggggaggcgggggacgtggaggcggccggcgccggcgacgcaagggagcaagaggctggcgaggaggctgctgttggtgctgagctggagcaagcgtgatatggaacccttccctgacatacaccatggagctcctgccatgttcttgccatgactccatgcacttgacctgatgcaacagatggactgctgacagatctgggtggcataagggcaactagggcgaggacggacaggcgtctgtcgtctttgggcagcacagcgatgtcatgcaactacataccgagatgaaccccaccgcacagcggagcgcgtacgaggctgaggtcagggaggggcatggcatcgccctgggatgaacgacgagatggagttctgcgccacggaggtgtgctcacaagcgcctagcgcctgatcccttccaccagaccctggccgctagaccactccgcacgcagcgcagccagcatggcctcggcggcggggcgcacccccaggctgccggccgcgagctgaggccgcagcgtgcccagcgcggcctgcacgccctggctggactgcaggtcctccagaagcccctcctccgccgccttccacgcgaggtggatcgcctggtctcggcgcagctgtgggtgtggggggatgggaggatacgccgggggttccacagactgctcctacacgctgagccctcagggagtgtccagtcagccccaccctgcaacccatcgtctccacgggaccacatccctccacaatcatcccttgccccccccctgcccccacaggcacccataaacctgctgcagctcgccgctggcgaggagggcctgcctgtactccctcaggttgtcgaccagggcgccgacgccctcgcccgtcagggccgacgcggtctgcacccgtgcggtccaggctcggcgaaccgcgcggtggaagtgcagcgtgccgcggaaggcggcggccgcacgccgcgccgccagctgcgtggggccgtccgccttgttgaccaccaccaggtcggcgagctcggtgatgccacgcttgatcaccttggtgtgttgggcagggatggggagcacggggtggagtatgggtgtgcttggagaaggcctctcccgctactttgaagcagcaccccatgctgtctcaaccagccgacccctgctttgacaccacggcctcccacctgcccaccttgnnnnnnnnnntggggccacatccctgcacagccatcccttgcccccccctgcccccacgggcacccagaaacctgctgaagctcgccgctggcgaggagggcctgcctgnnnnnnnnnntgtggagtatgagtgtgcttggagaaggcctctcccgctcctttgaagcagcaccccatgctgtctcgatcagccgacccctgcttcgacaccacggcctcccacctgcccaccttgtatgcctgcgcaagccatcgcagcttgctcaagggcacccccgcggagccaatcccccctcacgcacctgcagctcatcgccgcccacggggggnnnnnnnnnncggtcaagggcacccccgcggccccactcccccccacacacacctgcagctcatcgccgcccacggggggcatcaccagggccatacagtcgcagagccgggacacggccacctcgctctggcccacgcccaccgtctctatgagcgtccaggtgaagcccgccgcctcgcagacggcaacggcgtcggccgtcgccctcgccaccccgcccagcgtgccgcgggagggagtgggccgtacaaacgcgccgtccaggcagctcagcctggagggggggggagagggagaggtgggtgagcctgaggggggcggacacgagggggcgtcattgcagatgcccagggaaagcacccactgtaggcagacactggtgccgtggcacatggcacctccatccctggcccatcgcctcacttggacatgcgcgtctnnnnnnnnnnatgaggtgggtgagcctgaggggtgggacacgagggggcgtcattgcggatgcccagggaaagcacctactgtaggcagcccatggtgccgtggcactggcacctccatccctcgcccatcgcctcacttggacatgcgcgtcttgtcgccgaggatggcgccgccggtctgggccgaggaggggtcgatggccaggactgccaccttctcgccagcgtttacgagggcgcagcccagcgcctcaatcaggctggacttgccagcgcccggggggccggagatgcccacccggaggcccagcgggggtggggccgagccgggacggaaggacagctgtgacagcagcgctgcagcctggcagggcgagggggacactgaggagctatcgcaagtgttgaaacagcgctcatctgagcatggtatcgtcctcacgagcgccaagatcatcctcactgttcctcnnnnnnnnnnagacacggaagagctttcacaagtgttgaaacagcgctcatctgagcatagtatcgtcctctcgagcgccaagatcatcctcactgttcctcatatcatgagattctaggaggaacacagtgtggctacgagcagccaccacaactcgcaacaaatgtcagttctgcgccgctcagccacatcgcatcgtccccctcaccgactgcttgtgctggggccgagtggactctacgagggtgatcgcccgactgacagccagtcgctggccatgccggatgccgtccaccagctctgcgacgtccttggcatcaaaaaggttcctgagccgagctgctgctgccgctgcagaggcgatgtgggatttgggcatggacgcgatgcatgcgatgcatatctgcaggtgggccactggtgacagctgcagggcaaacacacggcatgggcaggaggaagtcctttattgggacaattacctcaagggcacattgtttgatgatcaaataaactatgtacacatcgcccaatccattcaacacgattgcaaagacaatgactctaaatgccaacctgcagaggagtatgtgctcatggccttgccaaggctccgaaggacaggcgccgcatgccgatgcatggatcgctgcagccgacaacaagatccctccttgacggggatgacaccgaattgtctactaagcaatgccttctgtgcgctgtcaaggttgctccatgacagggatgccttgtgcctcagtttgggtttacagtctcggagggcaagtgatcgcctttggtcacagaccagtgcagtacgccagatccatcgggattgcacatattggattatataccattatcttaactctggtcacccatgcccagagcctgttgggatatgttccgaggcttgcaagcgcgacacaataaattcctgccacgtcatctccaggcttggggcacaagcgggatcccgtcgcagctgcacatagggcgatgcacgccgcctcccccgcccgcattgcaccctcgcatgcagccatggcgaggtagagaggtggctggtgagagcaagcgcgccgtgttcccccggggagcgccatgttcggcgacgatgaggacctggcggtggccgaggaccaggagattgaggaaaacgatgcgtggtacgcgatgttcggagcggttgcttgtttggtgcctgtaaagcgtgtttgacgcatgcgaggagtggtttccggccccacctctgctccccccaacaccgaccagggcggtgatcagcgcctacttcgaggagaagggcctggtgcggcagcagctggactctttcaacggcttcatcaacagcagcctgcaggagatagtggacgagaacagcctcatcacggtcacgcccaacaaccagcacaacccggggcagtcgctggaggaggaggcggagagcaccacatacgagatcaagtttggccagatttacctgtccaagcccacttttgtggaggcggacggcgagacggtggccatcttccccaaggaagcccgcctgcgcaacctgacctacgccgcgccgctgtacgtggacctggagaagcgggtgatcacgcgccgtccgggcctggacggcgagggggaggagagcgaggagcacgtgacgccttacgacaaggtgttcctgggggacgtccccatcatgctccgctccgactactgcaacctgcacggccgctctgagcgcgacctgagcgacctgggcgagtgcccctacgaccagggcggctacttcatcatcaacggctcggagaaggtgctcattgcccaggagcgcatggccaacaaccacgtgtacgtgttcaagaagagccagccgtccaagtacgccttccaggccgagtgccggtcggtttgcgagggcagcgtgcgcgcgagcagctccatgtcggtgcgcatgctgtcgcgggcgggggccaagaagggcgcggggcagtgcatccgcgccacgctgccctacatccgctccgacatcccgctgctcgtggtcttccgcgcgctgggcttcaccgcggaccgcgacatcctggagcacatcgtgtacgactttggcgacgacgcgatgctggaggcgctgcgccccagcatcgaggaggccttccccatcggcgaccaggaggtggcgctggactacatcggcaagcgcggcaccaccgtgggcgccacgcgcgagcgccgcgtggcctacgcccgcgacctgctggagaaggagttcctgccccacatctccatggagccggcctgcgagacgcgcaaggcctacttcctgggctacgtggtccatcgcctgctcctggtggccctggggcgtcgcgacgaggacgaccgcgaccactacggcaacaagcgcctggacctggggggcccgctgctggccaacctcttccgcgcgctgttcaggaagctgggcaaggacacgcgcgcgcacgtgcagcgctgcgtggaccgggggcgcgagatcaacctgaccgccgcggtgaacaaggacaccatcagccgcgggctgaagtacagcctggccacggggaactggggcgtgctgggggggcccggggagctgcgccccggcgtgtcccaggtgctgaaccgcctgacctacgccagcacgctatcgcacctgcgccgcatcaactcgcccatcgggcgcgagggcaagctggccaagccgcgccagctgcataacacgcagtggggcatgatctgccccgccgagacgcccgagggccaggcctgcgggctggtcaagaacctggcgctcatgacctacgtgtcggtcggctgcgccgcgggcccgctgctggagttcctggaggagtgcgccaccgaggcgctggaggacatcgcgcccggggtggtggctcgcgccaccaagatcctggtcaacggcgtgtgggttggcgtgcaccgtgaccccggggacctggtggcgcgcctgcgcgccatgcgccgccacgtggacattgagaccgaggtgggcgtggtgcacgacatccccctgcgcgagctgcgcctgaccaccgacgcggggcgctgctgccgcccgctcttcatcgtccaggatcggcgcctgcgcgtgcgcaagcgcgacgtggtggccctccaggcgcgcgacgagacgggcttctcctgggacagcctcattgaggcgggggccatcgagtacgtggacgtgnnnnnnnnnngttttcctgggacagcctgatcgaggcgggggccatcgagtacgtggacgtggaggaggaggagaccaccatgatggccatgagcatccatgacctgaaggccgcgcgagagggtgaggctgattggggggggagagcgtgtgtgtgtgcgtttgtgtggagcgcaggattggtccggggtgcaaggnnnnnnnnnntgggggggggagagcgtgtgtgtgtgcgtttgcatggagcgcaggattggtccggggtgcaaggaggcggagagggggggattggggctggaggatggggtggagcgtgggccgtgccgcgcgagtgcagggcctcctacctcggcgtgtccttcgctgcagaactgctgcgcgcctgactcccaaggtcgccccttccgggnnnnnnnnnnaagcatgggccatgtggtgcaagtgcagggcctcctacctcatcgggtcctttgctgcagaactactgcacgcctgactcccaaggtcgccccttccgggtgcccaaaccctcctaaaacgccctccaacctgcccccatgacctccctcccccccccacacacacacaaacacagatccgctgcacgcgtattcagacacctacacgcactgcgagatccaccccgccatgatcctgggggtgtgcgcctccatcgtgccgttcccagaccacaatcagtcgccgcgcaacacctaccagtcggccatgggcaagcaggccatgggtgagatggctgggacagtcatggatggtgttgggagttggggtgccaagtgggatcacgatggctgaggatgaagtgggcaaggatggcgcacaagatacgatgtactgtacttgctaattggcgttcacagcgaggcaggcgaggcacgccatgcatcgcaatgggccatggtctcagatgattcccagtttgtgattactcccagcccggcaagcactcaccctcctctcgccctcactcccgctcaacaggcatgtacgtgacnnnnnnnnnnttttgtggttactccaagcccggcaaccactcaccctcctctcgccttcactcccgctcaacaggcatgtacgtgaccaactaccaggtcaggatggacacacaggggtatgtcctgtactatccccagaaacccctggtgaccacgcggtccatggagtacctgcacttccgggagctgccggcaggtgcggggggggttggggaggtgggggtgggggtggtgtggtgatggagacaagtggatgtggtgggatgcctggcacaagcttctggacagggagttcttacttgctcagctgcagtcaaacgacaatgtgatgcacgtacctccgtaactcccaccctgtgcccgcccaggcatcaacaccatcgtggccatcgcctgctattccggctacaaccaggaagattctaccatgatgaaccagtccagcatcgaccgcggcatcttccggtccatcttcttccgatcctacaaggtatggcttttgtgtgcaacgggttgtgggctgcatgcagtgatcctgcctgggcagagtaggacgtacctggcaatgtgcccggatctgggaaccacgtctctgtgctgtcataccccccacccccccttggacacaagtagctcctcgacagtgccctgagggagtgcgaccggcacctcccttgcctgcaagccccgcgttttgcatcctcaccaccccactgccctcccgccatcacaacagacagaggagcggaagcagggttccatcgtgcaggagttcatcgagcggcccagccgggagatcactgccggcatgcggcacggcacgtacgacaagttagacgacgatggcatcgcagctcctggcacccgtgtctcgggtgtgtggaattgggagaaggggcagggagcagggcacacttgtggcattcatcggtgctgaggatccacctggtggtgaggatccgatggagcatagggcgaattcctgaggctcctgggtattgggtgggcacggaagagctagggaggcacaggaggttgccctttagctgtcacgatgccaatggattccatccagcaggcgcaggcagcatccgcgtgcgctggcatgcagtgtgtctcactttctttccttctcgactgaggcatccatctctacccgcttttcctctcctctccccccccccgcgagcaaccgatgcacctttctcatcacccccccctccttttcctatgcacgccaggcgacgatgtggtgatcggcaagacctcacccatccccgacgacggctcgggcatgccccagcgcttcaccaagcgcgactgcagcagcagcctgcgccacagcgagagcggcatggtggatgcggtgctactcaccaccggcgcagatggccagcgctttgtcaagatgagggtgaggagagggttggaggggcaggtgataagcgggagagggtggtgcattgctttctgggttgagcaaccaggaattgaatcctcaccacnnnnnnnnnnagggtgataagcgggagagggtggtgctttctggattgagcaaccaggaattgaatcctcaccactccttgcccatgatgaccacacccctcagactccccccccccccaaaaaaaataatactcacaccatgcaggtgcgatcgatccgtatcccccaggtaggcgacaaatttgcttcgcggcacgggcagaagggcaccatcggcatcacctacacccaggaggacatgcccttcaccgcggagggcatcgtgcccgacctgatcatcaacccgcacgccatcccgtcgcgcatgaccatcggtcacttggtggaggcgctgatgagcaaggtggcggcgtgcctgggcaaggagggcgacgccacacccttcaccgccgtgaccgtggaggacatctccactctactccacggctgcggctaccagcagcgcggctgggagaccatgtacaacgggcacacggggcgcgcgctggcggcgcccatcttcctcaaccccacctactaccagcgcctgaagcacatggtggacgacaagatccacgcgcgcggtcgggggccggtccagatcctgacgcgccagcccgtggagggccgcgcgcgcgacggcggcctgcgcttcggcgagatggagcgcgactgcatcatcagccacggggcctctgccttcctgaaggtgggtggggtggggggtgggaagtcggggttgggggagtgggttgccaaagggctnnnnnnnnnncgcctctgccttcctcaaggtgggtggggtgggggttggggagttggggttgggggagtgggttgccaaagggctgcatccaacaagcaggggctgtgtcgtgcgggcattcacggtggagtcccgacagggaggcgatcgtgccagccacgcattccattttgaggcctggccttgggacccccacaaccaagtgnnnnnnnnnngcccgacgggggggcgaccgtgccagccacgcattccatttcgaagcctggccttgggacccccacaaccaagtgatcacagaccccccttccctcccccttcaacacccaccatacaaggccccactgttcaaccccccaccatccaacctttcatgcgcaggagcgcctgttcgaccagagcgacgcctaccgggtgcatgtctgcgagcgctgcggcctgatcgcggtggccaacctgaagaagaaccagtactactgcaccgcctgcaagaacaccactggcatcgtggccgtgcacttgccctacgcctgcaagctcctgttccaggagctgatggccatgtgcatcgcgccgcgcatgcagttctgagggcatgggaccggcgcgtgcctgcgagggcggcagctgcagggtgttccgagggcggtgcgtctgcctgccaaggcgggcgtccgatcaggcgccgctgcggacctgcgtctccagtgggtttgccaagctcatacactggctgtcgatgcagggcatcccttcccccctttcnnnnnnnnnnaagtgcgtgggaccggcgcgtgcctgcgagcgcggcagccgcagggtgttccgagggcggtgcgcctgcctgccgggtcgggcgtccgatcaggcgccgctgcggacctgcgtttccagtgggtttgccaagctcatacgccggccgtcgatgcagggcatcccttcccccctttccttcctgcttccccccctcccctttccatatcgttgtgccagttacaaaatcgcgaaaactgccgaccacggccgcaagagactggcaaggcgggggcagatgcacaagaaaaaagggaaacaggatgaggtgctgggtgggagctgcgaggcgcagccaagtctgggtccaaagccttccctcgccccgtttcaaagcttgctgtgggccagctgggccttgagcacggtgtgccaggccggcccctctgcggtgtcgttcagcggggacccctgcgcggcctccagcagggcctggtacacgtcgccgtcctttcttcccagagcagacgacaggaggtagtcctcgtacccaaagccgtcggtgagggcgaccgcgtcggggcgcacggcgcgcaccagctcccgcttggccgctcgcagctgcaccgcctgggtgcctggtggtcatacaggggtttggcggatgtgatgggcgggtgtgcagcaaggagggggggtgcgtttgtgagagctgattgattgaacggcactcagtcgactcgagcaccgagatggtgcgcnnnnnnnnnnccgcagctgcaccgcctgggtgcctggcggtcatacagggggttggcggatgagatgggcgggtgtgcagccaggagggggggtgcgtttgtgagatgtgattgattgaacggcaatcagtcgactcgagcaccgagatggtgcgccctgcagatccaccaccaacgtggcagctcttcctctacagagctgccatgttgggaaccagtttctcacccctcctccagcaccagacttgggaacccgctccatccccgccccttcccacccacacaacaccactcactgttgatgtacccagcttcgagcaagtcccccgcggcgtccaccaggagggtgacgccgtggagctggcacagcgtgcgcagcgcgcgcgtcgtggcgggcttcagctcccccgccgccgcctccaccgcctccaggaagttgcggtggaggaggagggcggagtgggctttcgccaggcggatgaggtcgacgttggtcccgttccagggctcaccctcgaaaaccagctcgccgcccgcggcggccctcagcacggcggcggcctgcaccgccaggtggcgtgccgcgcgcgtcaacgcctccacctgcgcgggcgcggcgcgccagccg

SEQ ID NO: 47539 - DNA, 61 bp, Chlorella protothecoides
ctgacccaacagaagggcaatgccggcagggcaagcaccagggtgtggatggcagcccgga

SEQ ID NO: 47540 - DNA, 71 bp, Chlorella protothecoides
gcagcgccctgggaggggatggtaagtgtgctctgtggccgcgatttggtggcatgccaccgcggtgtcca

SEQ ID NO: 47541 - DNA, 68 bp, Chlorella protothecoides
ttgtggctttctggggtcgtgcggcgagccagggcaggcccggcctgtcctgccgcggccttgcctca

SEQ ID NO: 47542 - DNA, 61 bp, Chlorella protothecoides
ccccgaagcccggctgcgcggctgctgttcggaagcccggctgagcggctgctgccccgaa

SEQ ID NO: 47543 - DNA, 70 bp, Chlorella protothecoides
tcgcgggatggtgccgcaaaggggacgggggggggtgtgcgtgagtgtgggtgggcgtgacatcatgtct

SEQ ID NO: 47544 - DNA, 61 bp, Chlorella protothecoides
cctttggccgggacttgcagagctccagcaggaagttcatggccgcagtcttggtggagtg

SEQ ID NO: 47545 - DNA, 61 bp, Chlorella protothecoides
aggccttgttgccgcaccgcttggtgtccctcacgtccaccagcttctcctcgccgttgcg

SEQ ID NO: 47546 - DNA, 61 bp, Chlorella protothecoides
tgatgggcgggtcaggtgccggccggggctcggtcatacccaccagcaggctggcgaggat

SEQ ID NO: 47547 - DNA, 61 bp, Chlorella protothecoides
agtgcagcttccgcgaggaagacaggcaggggcctggggaatcagacattcgaagcaggca

SEQ ID NO: 47548 - DNA, 61 bp, Chlorella protothecoides
ggacgtgctgctggcgggggtgagcgaggttgaggccgggtacgacacggccctggtcctg

SEQ ID NO: 47549 - DNA, 61 bp, Chlorella protothecoides
tgaatgctttcagtgctgcccccctgacatacatgaagtggccggggtcacaccagggccc

SEQ ID NO: 47550 - DNA, 61 bp, Chlorella protothecoides
acgcatggatggacgtgcatggacatggacggagccgccacgcatgaatgaatggacatgg

SEQ ID NO: 47551 - DNA, 61 bp, Chlorella protothecoides
acgacacaaagaaacacgaaaaagacagagggttgaaccatccatgcgagtggaatggcag

SEQ ID NO: 47552 - DNA, 61 bp, Chlorella protothecoides
agacccggcctgctgcacgccatcagccagcccagcctgccgacccacctctgccaggatt

SEQ ID NO: 47553 - DNA, 72 bp, Chlorella protothecoides
atgggcattttcgatggaggcccccatgcatggcggccaaacgacatccatcgttgcaagccacaatgcacc

SEQ ID NO: 47554 - DNA, 61 bp, Chlorella protothecoides
actgcgccgacctggtccgctggtgagggggctgttggggtcgtgtgtcaacgtgagggca

SEQ ID NO: 47555 - DNA, 61 bp, Chlorella protothecoides
ccagcagcggcaagaggagcggcggggggggggccgctgctcgggcgccggatcgcgatcc

SEQ ID NO: 47556 - DNA, 61 bp, Chlorella protothecoides
gtgggtgggtgtgggggagtagagggggttgtgtgtgtgtgtgtggtggtggggggtctgt

SEQ ID NO: 47557 - DNA, 77 bp, Chlorella protothecoides
tcccgcaatcgcaggatgacctgcggcgaccaagaccacatgcccttcccacctctgcgcattgtgcagctttgcaa

SEQ ID NO: 47558 - DNA, 61 bp, Chlorella protothecoides
tgatgtcactggagttctcaagtcctgccggccgcccccctcccaggtggttgttccgttc

SEQ ID NO: 47559 - DNA, 61 bp, Chlorella protothecoides
acgcctgtggagcacaggttacacggcagggggtgagaattggcgccagtactggctctct

SEQ ID NO: 47560 - DNA, 124 bp, Chlorella protothecoides
ctgatgcgatgtgctggcaggtgtgaggcagacttgaatggctggccactggccatgccataagaacaccttgaatgtcccccgcagaccaacctgcacccccctcccccctccccttccctcc

SEQ ID NO: 47561 - DNA, 10304 bp, Chlorella protothecoides
  modified_base (113)..(177): a, c, t, g, unknown or other
  modified_base (624)..(633): a, c, t, g, unknown or other
  modified_base (2440)..(2449): a, c, t, g, unknown or other
  modified_base (2567)..(2576): a, c, t, g, unknown or other
  modified_base (2694)..(2703): a, c, t, g, unknown or other
  modified_base (2936)..(2980): a, c, t, g, unknown or other
  modified_base (3355)..(3364): a, c, t, g, unknown or other
  modified_base (4139)..(4148): a, c, t, g, unknown or other
  modified_base (4385)..(4394): a, c, t, g, unknown or other
  modified_base (4601)..(4610): a, c, t, g, unknown or other
  modified_base (5992)..(6001): a, c, t, g, unknown or other
  modified_base (6371)..(6432): a, c, t, g, unknown or other
  modified_base (6538)..(6547): a, c, t, g, unknown or other
  modified_base (6653)..(6882): a, c, t, g, unknown or other
  modified_base (6982)..(6991): a, c, t, g, unknown or other
  modified_base (7146)..(7225): a, c, t, g, unknown or other
  modified_base (7865)..(7874): a, c, t, g, unknown or other
  modified_base (8074)..(8083): a, c, t, g, unknown or other
  modified_base (8509)..(8518): a, c, t, g, unknown or other
  modified_base (8606)..(8615): a, c, t, g, unknown or other
  modified_base (8735)..(8744): a, c, t, g, unknown or other
cgcagggaggcagaggccccgccgccggccgcggtgacggacctggcgcgctggggcgccgcctcgccacgggggctggcgcgggcggaggcggaagtggtgacagagccgcnnnnnnnnnnnnnnnnnnnnnnnnnnnnnnnnnnnnnnnnnnnnnnnnnnnnnnnnnnnnnnnnntgacggagccgccggagcgcatgggcgggtggcgcacggcgctgggtggcagcccgcgcggtcctgggccggtctccgcgtccttgcgcggggaggctttggccaggcccgcgacgcggggcagcttcaccgaggcacggggtttgggcccgccggcagggccggggccggccgaggcgctgccaccgctgctggctgagcgcagcgccgacgaggagccgcccgcacggcgcgggacggatggggagccgcttatggacctgcagagggttgggttgggggggtgccatggtggagtggagtcagacttctacactgtgtgaggcatcaccgcatgacggtcgcatcaccaagaggctatacttgccaaaactcctccactcctctgccaacacaacaacccaacccccccttttcagctcactcggcatcctctggcttggagannnnnnnnnnttcgcatcaccaagaggctgtacttgccaaaactcctccattcctctgccaagcgcaaccccccaaacccccctttccagctcactcggcatcctctggcttggagaacgagtcggcggtgctgctgagggcggggaagttggtgctggatgatgtggaaatggcggagctgggcccaacgctgctggggttgctgggcagcctggctgggttgcccagggaggcctcgctggcataggggctgcgacgaactgtatggaggggaggaaagatgagtgagcatggctgactggtgtaggcgctcgcccctcgcgctcgcccccatcgcggctgcccacctgacaggctgtgtatgtggtccagtgtcagctcctccccattggtcaggaagtcgtccacccctgctccatcccctcctagggcggaatccaggtttccactgcttttgcgggcaaggaaggggctgtccatgccgtgcgaacgagagggtgggtcccaaccacctccaacgcggagttgacggagcaggtgtcacaagcccgcgccagtcatgcgcttgatccacttcccacgatgcttggtgcttagtagaaagcttcctcagatgtacgttctcagcgggggatagacgggggacctggatgcccagattcaggttcccgcaacgcttggagtctccgaaaaccggcatagtcggttcgggtggtttaatggtggcggtcgcgcaggaaatgttgtgctcgctcctgactctgttgatgcgctcattttcacgttgtgtgaggtatgttgggaatactttacgttttgagggcacacaggctttcctggaggtccctaaaggggctgagcaaccattgtgcacggttgagtgggtagcagagataaaccagtcttcacctctgtcgatgttttgtcttcgtcctatgtattggccatgagcagaaattgcaggtgctgccttgaaagattgcttgtccccgataatacggaatgtaagtttgcaatccacccaaggcaaaggcaccatgacgactaggtgcggtgaggacatcgttgcggatgaacggtttgtcacccaagagccatcttttggatcctgttcccgcttggtgatccacgacaatggtccatgcatccagcaggattggcatggtgttcaaccacctgccatgcgcccaccatacggtgaggccacccagagtgccaacttgacacaagagagtgcgtgacagagatagatgcgcattcttgggatatgggtactaaaatgcagggcagttcttccatcattgggactccagcatacccctgatctcgacagcgcccaggatcctttcgaaagggcaggccgggcgatcacacccaccggaaggattgtcaagcagcgctgggatgatgctggagtttagatccctgatgactcccctagccatcatccatctggtgtgagagctggtgtcgagagtgggtgggggtgtggctcgacccctcctcggcccagcggggcagcggccatgaaggccagcctgcaaagcaccgcctcggagttcgtgcctggcgatcagaagccggcggggcccgtaggcggagcgaagggatccccatcgctcactggcaccctgtcggccacgcccttcgtgccctctcccaagctcttggtggggctcgaggcacctcccttcaacccaggtgggcccaggcctcgacctgcacccaaatatttcagtcgggatatgtactagcgcaatgcgcatctcacctcagcgatggtcttcatgccacacctgcacaggactggcccctnnnnnnnnnnagcaactttccggacagggtgcaggctgcaggaccgctcagccacctctaaagtctctctggcatgtgcacatcttctcggacaccctcgtgctcccctgcacatctccactgagccnnnnnnnnnnggcaactttctggacagggtgcaggccgcaggaccgctcagccacctcttaagcttctctggcatgtgcacgtcttctcggacaccttcgtgctcccctgcacatctccactgagccnnnnnnnnnnccccaggtgggcccaggcctcgcgctgcacccaaatatttcagtcggggtatatactagcgcaatgcgcttctcgcctcagcgatggtcgtcatgccacacctgcacaggactggcccctgcccaagttcagcctggtggcggagtgagtgcggcgaagcagcccccgcctggggtgccaggcggcatcggaccgggtatgccagggacgcaggcttttgttaagggaaggcnnnnnnnnnnnnnnnnnnnnnnnnnnnnnnnnnnnnnnnnnnnnnctcctcagcccactgcttgccccctcactccccaggcggccgcagcggccgcggcggcccagccccgcagcccccgccaatcgtgcgggcgccgtcgcatccgcccaaggcactggctgcacatgccgcggcagcctttgcggtgctgagcgcggcggggcagggacccttcgtccccggcggcccgggagtggcggcgggccagcgctcgccgcaggcgagcaggggccgagggaggcgtcccgcggcgccgtacgctgccacgctgggccagccggcgacggtgcccgcctctgcgctttccatccccgaggccctgcacgccgagctgcaggccgacctggcagcgcagcaggcccaggtgcggggtctgannnnnnnnnntaccgaggccctgcgcgccgagctgcaggccgacctgacagcgcagcaggcccaggtgcggggtctgagcatgctgcacagggtctcctggccctagggtgctgggtggaggccgagtgacggtgcagtggaggctgcagggcgtgtatgaatgcgggaggcacccacgcgccgcctggtcccctttgccaggccgcggcccgtgctgtagaacccacccaggcccctgccgcgtggtttgccctccctccacctctatgatctctgtgggacactccttccacctgcccaccctctctgaccaacccacccacacagcccgacccgggcctgcccgacttcgtggggagctaccactcgctgtgcgcgctggaggacgcctcccccggcgcggcccaccccgcgcccgccctgggcgtgccctcccgcgtctaccgcgccgcctcggcccgcgacgggtcctgcgtggcgctgcggcgcctggacccgcaggccgtggcccccgcgccgcagctgctggccggcttccgcgccgcgcaggagcgctggcgcgctgtggaggggcagcctttcctggccgcctggcgcgaggcgctggtcagcgccgagctggacggcgcgcccgcgctctggctggcccacgcctttgtccccggcgccgtcacgctggaggccgcccacctggcgcccggcgcgcggccgccgggcgtggactgcctctggcagtacctcgtccagctggcagcggcgctgcacgctgtgcacggagcggggnnnnnnnnnntggcgcggtcacgctggaggccgcccacctggcgcctggcgcacggccgccgggcgtggaccgcctctggcagtacctcgtccagctggcggcggcgctgcacgctgtgcacggagcggggctggtgctctggggcgcggggctggcgccctccaaggtggggcattccggtgggggggccgggaggtggactgaaggaaggcagtgggctgggaggtcgagccccagctacttccnnnnnnnnnnaacgccctccaaggtggggcattccgggagggggggccaggaggtgggctgaaggaaggcggcgggctgggaggtcgagccccagctacttccgcccagaagcgggcaccacctcaggctgtgggctgggttgcggggggggaagccctcagcatccttggtgagttccaccccccccttcccccttgtcaaccaccatccaccccnnnnnnnnnnaggcaccacctcaggctgtgggcctgggttgcgggggggaagtgctcagcatccttggtgaattccacccctccttcccccttgtcaaccaccatccaccccaccaaccctcacccgctcttacacctgtagatcctggtgtcgagcgaggcgggcggcgccccccgtctgcgcatcgcggccgccggcacgctggacgcgctgatgcaggtccccggcgcgggcgaggaggacctgcgtcgcctgcagcgctccgacctggctgcgctgggccacacgctgctgaccctggcctgcgccgggctgggcgccagcccctccctggacctgctgccggggtcgaccccgcccgacctggtccgcgtcatcgcggggctgctcgcctcggcgcagggtgtgtggaaacggcgcgtggctttgtgtgtgttttgtgtgggtgcggagtgcatgtggcagtggggttgtgagtttagatgccagaccaggtgtgcgtgccagcagcggtctaggtgggaacgcattctgggacagggatgcccgccgactcaggacccctccaacccttttctctccgccctccctctctacaggcggcggcttccaggacacgtccgccctggccggcgccctggcgacgcacacgctgggcgcgctttcttcggccgcagcacgcggcgacgcgatgcgcgccgagctggccaaggagtgcgagaacgggcgcctgctgcgcctgctggcgcggctgggcaccgtggccgggcggcccagcctgggcggcgacactgagtgggcggagacgggggacaggtgtgtgggagggaagggagggagggggggggggggggggggggtggggggggggggggggggggcgggggggggggggggggggcgcgtggatggcggcagggtgtgcccggcccacggctgatgagggagcctgctgggcgcacgagatgctcgcccgggcagcaaccccgccctgtgcgctcgcttggagtcccactcatctggtgccgtgcccttgtagctcctgggaattggacatcgtgctcaatggcaaccacaggcacatgcctctccccatggatcacgaatcaacctccacaggtatatgctgaagctcttctactccttcctactgcaccaagtggacgaggcgggtcagcccaccctggactggggggtgctggcggagtccctcaacaagctggacgctggggtgccggaatcggtgggatgggcgtggtccttgggagggtggcggtggtgcggccggcatggtgacaacgattgctgaacatgctcatcaactggcatccaacgacctttgccccgatgtcccacccctttagatcttgctactctccgcggacgaggcnnnnnnnnnntaccaattggcatccaacgacccttgtcccgatgtcccacccccttagatcttgctactctccgcggacgaggcgtcgatgctggtggtcacgtacgccgacttgaaacgctgctttgagcgctgtcaggctgagctgaggggaggcgcagaggcgccggcccggcatgcacttgcccgagttcaagcatgacagtctgcacttgtgtgttgcttgactcgtggcaggatgtattgcgtcactcccaaacgttgtgatgtttatgggaacaagttaacccacagggtggcacggcagctcaacattccggtggaacggacccctgaccccagcacggctcagcatgccaaggggtgtggataccgagacnnnnnnnnnnnnnnnnnnnnnnnnnnnnnnnnnnnnnnnnnnnnnnnnnnnnnnnnnnnnnncagaggtatcatggccccatccaccaccccttgatcgcgcttccttacccatctgagacccggctctgaggcgtttccgcgacgctacagcctgcgattcaaccannnnnnnnnntagaggtatcatggccccatccatcaccccttgatcgcgcatccttccccatctgacacccggctctgaggcgtctccgcgacgctacagcctgcgattcaaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtctcatactctgctctaccccagtggtcttgtgaatataaacccctcccacggtacagcaactgtcgatggacggcacagctctttgggcttccgctnnnnnnnnnnaccggtggaatgaacccctgaccccagcacggcccagcatgccaaggggtgtggataccgagaccggctttcaaaacacccaagtatcacgctgtgtggattacaatatccttcgcgacttttcaattgcgtaatccaatcgtcgatgggcacannnnnnnnnnnnnnnnnnnnnnnnnnnnnnnnnnnnnnnnnnnnnnnnnnnnnnnnnnnnnnnnnnnnnnnnnnnnnnnntcttctttgccaaacctccctaatcgccatggaatgtaaatgcagtgggacagcgcccctggaatcgaggcaggccctggaagacttactgctatgcttgtgtgggagcaagcccacccccgtacatacgctggaaatcaccctgcaaggccccaattcttcgactgtggtgctttctcgcggcatgaatgaagcagctacgaggtgcggggcccatggagcctgcaggtctcatactctgctctacctcagtggtcttgtgaatgtaaacccctcccacggtacagcaaccctcaatggacggcacagctctttgggcttccgctgcggggcaagcaagcggtcggcctggaggctagcgtgcgaagtgtggcgacgtcctcctgccagggccccgaagttccagcattctggacagcgctgggcatggagatcgagtacactgtggagcgtcgaggatgtgcagtcaccctccatgcccccagatctgggctggaggtccaggtgatcaagcgagaagtgaagatccttgagcccgctgggcatcttcggaggataccatgggcgtgttgaccagatactgatggcatcctcactacagacccgccataatcacaccgtcttgttcccaagcgtgcannnnnnnnnnagtgggcatcttcggaggataccaagggcgtgttgaccagatgctgatggcatcctcacgataggcccgccgtaatcacaccgtcttgttcccaagcgtgcaggtggtggtctcgcagctgtacagggctggagccgacgaggagggtggtgatgggcacgcgccaatcgtccccaatcatgtgctggtagaggccaggnnnnnnnnnnaggcggtgatgggcaagcgccaattgtccccaatcatgtgctggtagaggccagggccctgtgtgtcgatggcgcacacgtcgaaacgtgtgccggcctaggtacatgctggagaggggttcctatgaggtagactgctgctctcgcctccttggcgcatggagccgacaggaacccattcccaccctcctcagatgagattcggcgcctgcttcgtcagtacacgacgctgcaagtcgtgccacagcctccccccggaagaaggaggtgaagatctggagaaagcggggggagcgtggcaggagcagccgtccccacgcgcaaggcggagctggccggtccaaatatgttttaaggaaacctggaaaacagctgaggcgggcgccaggagtgcccgggaccataaccgcacccatcgaggcaggnnnnnnnnnnctgaagatctggagaaaacggggggagcgtgacaggagctgccgtccccacgcgcagggcggagctggccggtccaaatatgttttannnnnnnnnncctctccacttgctcaggcactcctgggcttgcaataagacttcccaagtgcccgatcccgtgcgcgaagccccgcgaccccgatacggctgcctcgacatcccggcgatcccgcgcccnnnnnnnnnngctctccacttgctcaggcactcctgggctcgcaataagacttcccaagtgcccgatcccgcgcgcgaagccccgcgaccccaacacgactgcctcgacatcccggcgatcccgcgcccacccgcaaccgtcttggacctcgcacccacctcgaacccgctggtgaggagtggttttggttcatctgggtccagcatggagatgggtgatgggggtttgggctgatcttgcggttccccaaagtcgagtcggttgtggaacccgcggtgcgatgcaggccaaccactgactttggtcccgcccgcaccgggcatgggacgtatactcggcaggatttgggggggttcaaagcgagttgctacccgacggcgccccccctcaccgcaccgcagaggtccagccgatcacagccgtcccagcgagcggcatggcgcccctctccctgccctccggcctccccggctgcatcgaggttgaccccggcgcgatgtacctgtgctgcctcacccccgacgccgccctcccagactcggaggtcctggccgcggcggccctgtgccacgtgctcgaccccgacctggtgtacgagcctttctgcgccgacttcggcccctgcaacctggcgcacacctggcgcatctgccagagcctgcgccggctgaccgccgccgcggccgctgcagacctgcccctgctcctgctggtaggcgcgcacccacaccgccatgccaacgcggccgcggcgctgggcgcctaccgcgtcctgctgcgcggcatgtcggccggcgcggcgtgcgcgccgctgcgcgcgctgtgcaacctgcccccctttcgcgacgcctcctccggcacccccctcttcggcctgggcgtggaggcggtggtggcggggctggcccgcgcccgcgatgcgggcttcctggcctggcatgccggcggcgggtttgacctggaggagtacgagcactacgagcaggtggagaacggcgacctcaactggatcgtccccggcaagctgctggccttcagcggccccagcgccacgccgcgtcactacggcggctggcgcaccttcaccccggaggactacgtgccctacttccgggccacgggggtgcaggcggtggtgcgcctgaatcggcgcatgtacgacgcggcgcggttcacggcccacggcctggcgcaccacgagctctacttccccgacggcacctgccccgcgcgcgacacgctgcacgccttcctggccctggccgagtcggcgcgcggcgcgctggccgtgcactgcaaggccgggctggggcgcaccggcgtgctcatctgcgcctacatgatcaagcaccacggcttcggcgcggaggaggccatgggctacatccgcgtcgcgcgcccgggctccgtcattggcccgcagcagctctacctgcgtgccgtggcgccggagctggccgcgcagggcgccgcgctgcgcgcgctggcagcgcagagggcgctgcctccgctggaccggggcgagcggggctcgcccgtcgccgaccaggagaacggcggcgactggac

SEQ ID NO: 47562 - DNA, 61 bp, Chlorella protothecoides
agatgcatgcgcaggcgtgttactcccaggaactcggatgtcacgcatgcccagggcggag

SEQ ID NO: 47563 - DNA, 61 bp, Chlorella protothecoides
gagcgcgcgcgaggtccccgggcgacgggaggagggcggccgcctgctgctcggcgccgcg

SEQ ID NO: 47564 - DNA, 61 bp, Chlorella protothecoides
ggaggaggagacggagtacaaggtggatgcggtggcccacgtgctggccgaccgcgtggtg

SEQ ID NO: 47565 - DNA, 75 bp, Chlorella protothecoides
tgggtggaggcggagccctccggggtggaggaggggaccgtttgggggggggaggggatcgcatgggtgaaggag

SEQ ID NO: 47566 - DNA, 61 bp, Chlorella protothecoides
cagaacctttgtgtgtggggagggggggggggaaagggggatagaggactctgaagcctgg

SEQ ID NO: 47567 - DNA, 62 bp, Chlorella protothecoides
ccatcccggggtgacgaccagagctgccgccggtgaccccttccccagcttcctgtggcagc

SEQ ID NO: 47568 - DNA, 106 bp, Chlorella protothecoides
tggcccgcctgcggtgtggtgggagtgtttcatttgtgtgtgtgtgtgaggtgggggtaggttggggtctcaagtcgcatggggccaaagggtcagaccgacgccc

SEQ ID NO: 47569 - DNA, 61 bp, Chlorella protothecoides
acgccggacgccgtggccggcgcgctgggcacgctgcgcggcctgcgcgagctgacgctgc

SEQ ID NO: 47570 - DNA, 69 bp, Chlorella protothecoides
aggggtgcggggtctcgtggtactggcgggccgcggggcggggggagtgggtcgacaacccaacagctg

SEQ ID NO: 47571 - DNA, 61 bp, Chlorella protothecoides
tcatgtctaatattatcagtcttatggcgggctttcgtgctacacctgaccaacagcggtg

SEQ ID NO: 47572 - DNA, 61 bp, Chlorella protothecoides
tgaccagggaggccggcgtggcctggctcaaaatggccgacgcctccctgcggggtgattg

SEQ ID NO: 47573 - DNA, 676 bp, Chlorella protothecoides
  modified_base (87)..(334): a, c, t, g, unknown or other
  modified_base (449)..(616): a, c, t, g, unknown or other
cactcagagattgtgcatgggtgtgggcaagtggaatatgcttgtcaagcacgatcctcctgcccctcattctcgggcaatccttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgggacctgtgaaggttgataaggagaagtcgatcaatgacaggagtttcctcgatcttaatgtcctatcaaatgaccggatatgtgtagtcaagccacattcatgcaagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgcgatccatacctgttggaaatggtattgggggggtgggggggggggggggggggggg

SEQ ID NO: 47574 - DNA, 61 bp, Chlorella protothecoides
cgcggtgtgccagctgctcctagaggagggggcggatgtggagcagcggaatgtggtgagg

SEQ ID NO: 47575 - DNA, 64 bp, Chlorella protothecoides
cctctcgcctgggtgaggggtcgggaggggttttgtgcagtctcctggtgcagaggggattgtg

SEQ ID NO: 47576 - DNA, 61 bp, Chlorella protothecoides
gcgacgcatcatcctaacggcttctggcggggccttccgcgacctccccgtctcggagctg

SEQ ID NO: 47577 - DNA, 61 bp, Chlorella protothecoides
aagaaactacacagcgggaagggcgaggggcgggggggggggattgctggttccagggcaa

SEQ ID NO: 47578 - DNA, 61 bp, Chlorella protothecoides
agtcggaaaggagattgatgtctcggtgggggctttccgctgagttgggggggtgtacttg

SEQ ID NO: 47579 - DNA, 61 bp, Chlorella protothecoides
aggaggcgagggaggaggcgagggaggaggggagggaggaggaggcgagggaggaggcgag

SEQ ID NO: 47580 - DNA, 93 bp, Chlorella protothecoides
tgcccgggcccgggccccatgcggcggcggcggtgggcggcaaggtgcgtccgcgcctgcccacagccttccacggcgccgacctggaaggcc

SEQ ID NO: 47581 - DNA, 61 bp, Chlorella protothecoides
gactctgcatgtcacagcatggggtgagggcgggcctggctcgcctccgcccagctccccg

SEQ ID NO: 47582 - DNA, 8323 bp, Chlorella protothecoides
  modified_base (2765)..(2774): a, c, t, g, unknown or other
  modified_base (2991)..(3258): a, c, t, g, unknown or other
  modified_base (3452)..(3461): a, c, t, g, unknown or other
  modified_base (4381)..(4390): a, c, t, g, unknown or other
  modified_base (5447)..(5456): a, c, t, g, unknown or other
  modified_base (6078)..(6087): a, c, t, g, unknown or other
  modified_base (7627)..(7636): a, c, t, g, unknown or other
  modified_base (8170)..(8179): a, c, t, g, unknown or other
ggggcgggggggggggcgcgctcctatcactagccatcaggctgtgtgcccagctgtcgtagtggcttgcgtcagagagatatcatcatctggtgctagcgatcacatctgcaccttctgatgtccctggcaggagaagttgcggcgcatgacgcctcagcagagggagaaggagctggagaggagggagcgcatcaggcagcgcaggggaatgaaatcgatgatgcgcaagggttaggcagggggcatgatggtgtgcagggagaaagctgccgataagcgaccttgctgttgcttatcaagcagatgtgcaagtcgatgaaatggtgtgatcatgttgtggcctgacatgagtacactagactactcatgacgagtccctgtcatcagaactctgccaaaactactcatgacgagtccctgtcatcagaactctgccaaaagctatggtttcgcgggcaggctcaagatacgatttcccgcgcatcgctccttatccgatacgtggcccgttccatgatcaccccatacgtgaaggtacacgtctccaagccccctgagcggatagaaaagctgcaagagactcaggatcattagaaactgagttgcaatgcagagcgcgatgatgtccaccacgatggcctgcaagcctttcacggcccacggcgcagggttcgcgcagggccccagggctgtgccccgacggggatccttcgcacagcccatgagggcggcctccaccgccggtgcttctggcgatgagctgagggacgagctgggtttcaagctcatgcgcaagggcgtgaaggagttcagcggggagaccatcctgacgccacggtgcgcggtgtggtccggtgtgaacgcatgcttggatgtgtgacacagcaacacagtacggcttgggccaatgcacctggtgggccaaagcatcagatcccgcgtgggtgcgcggccgatgtcatcacgcgtccatcccggatccgccccagattctacaccaccgacttcgaggagatggagaagatgtactccctggaggagaaccccaacctgaaaatggatgagctggaggcgatgctggcggagttcaggcgtgactacaaccagtgccactttgtgcgcaacgctaccttccctgaggcggccaagaagctgacggggaacacgcgcaagatcttcatcgagttcctggagaggtcctgcactgctgagttctccggcttcctgctctacaaggagctgggacggcgcctgaagaaggccaaccccgtgctcgccgagatcttcaccctcctctcgcgcgacgaggcgcggcacgcgggtttcatcaacaagtccatgagcggtgagtgtgctttggggtgggtggtgtgaccatatttgactgggccacgttggcttttttgcctgttgaaaggcttggtttgattctgtgctcacaatgactggcggttggaatagcgacgacacatgtgtatatctgaagcacaatgtgacgtcgaatccatttctcccattgtccaaagacttcaacctggcgttggatctgggcttcctgacccgcaaccgcaagtacactttcttcaagcccaaggtgggaggcatgggattcagcgcaatgattctcattggggagtgttcaggcatctccagtctgacgtcttggcctgtcatggacgttggctctccagctggtgagtctgcctcagaggcacttccctcaattaccccactttccctgcccaccccctgcagttcatcatctatgccacctatctgtccgagaagatcgggtactggcgctacatcagcatctaccgccatctccagcgcaaccccgactgccagctgtaccccctctttgagtactttgagaattggtgccaggtgaggggcaaggggtggggcttggaccggcctggaggtgcaggctggtgagatggttggccacacgacctgcctggggagtgcatcatgtggagggattgccaggtcaaggctgtcctgagccctccttccgcaccccaacccccacatgctcaggatgagtcccggcacggtgactttctggcggccaccctgaagtgccagccggagctccttgagggcacggcggcgcgtctctggtcccgcttcttctgcctgtccgtatacatcaccatgtacctcaacgaccaccagcgctccttcttctacgagtcgctgggcatggacaccacgcgcttcaacaagcacgtcatcctggagacaaacaacaccacggagcgcatcttccctgaggtgagaggggggatggcggcattctgggagtctgaagtgggagttttgacaggttgtacgcctgccaagggggaaaggcatgtgggcgcagcatttctcacctgaatgtgtgtgcctctcccccgggaagtggcaagctcaatatcttgagcacggcatcccacccatccccctcgtcgctgaccaacctcaccgcaggtgcctgacgtggagaaccccgccttcttccagcgcctggacgagatggtgaagcacaacaacgccatcgtgcagattgggcggtcggacgcccccaactggcttaagaacctgcagaagctgccgcacctggagcgcatcgccaagggctgcatcctcctcttcctggctcccgccaagcgtgtaggctccttggatgtggagggtgacgccgccttccagtactgagcaagtggcgctgccacaatttcatccccgagcatgctgtgatttgctgtggcggnnnnnnnnnnggggtggatggaggcattctgggagtctcagatgggcgttttgacaggctgtatgcctgccaagggggatgggcatgtgggcgtagcatttctcacctggatgtgtgtgcctcttccccgggaagcggcaagctcaatatctcgagcacggcatcccacccattcccctcgtcgctgaccaacccaaccgcaggtgcctgacgtggagaaccccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgctagaccttatgtggacggagttgagggcaagagggcgagaaacaatgggccctcttgaggacaacctgagcagggcttgtagtttgggcagcgtgtctgtgttcaacaagctcaatatccctgcaacttggcatcaattctggtccgttacagatgccgcacagccacatatctaggtcaggccgccacnnnnnnnnnntcttataattcgagcagtgtgtctgtgttcaacaagcataacatccccgcgacttggcatcaattccagtccgttacagatgccacacagccacatatctaggtcaggccgccacattcttgaacgccccccatgcgccagggtcaatgcgcttgaccatggccttgatctgcgcacccggccccagctcgaacagctgattcttgcctgtaggaaagtatgaatgtggaggtggtgattggactggtggactctcgcagcaaggcaaaggcaagcaagtacacgctgtcccactcccttcaccgtacccgcagcaacgagggcacggatggtaggctcccatctcacgggctccaccagctgtcggggcagcagcgctgcgatttccttggcgtccttgaacaccttgcccgtgacgttgctgtacaccgggatgcgaggctccttgatctcgatgctgttcagcacctgcgcggaggacgatgggggagcgtgttgcttcttcatgcgctgctcatgccagctgcaacaacactactgtcgagcagctgcagcaagctgcgtcgccggggcagagcatgcaatggctgattcatcgtacctggccattgcagcccaccagtccctcacacagaccctcaaactgccccaccaccagcagatcctagcccacctcctccagcgcctcgcgagcgggctgcatgagcgtggtgtggaaagcgccgctcactgccagcgacacggccttgatggcgccggcggccacggccgccttctgggcctcctccagagcatccttgtgccctgcgggggatggaggcaggttgtggcaaagattggattaggggtttcagtgcgcaatggatgaagagctgagacagggcaccatgctggatctctgtccctctcaccagccgcannnnnnnnnntgaggcaggttgtggcaaggattggattaggggtttgagtgcgcaatggatgaagagctaagccagtgcaccacgctggatctctgtccctctcaccagccgcacacgtgcgccccaacccttcagaactgctcccccccgccccagcaacaacgcccagaggaccccttcccgtagacttcaaaccccccatactttaatacgctcccggtcacccaccggagacgacgcggccagaggggaacaggtagtttgccacgcggcagacgctgtccggcagcttcgtattgacttccgccaccaccttctccaggtcagcgtcgttcagccccaccacgctgagcatgccgtggggtcggcccgacttggcggccgccgccatggagctggcgcggaccttgaccaccttgagcccatcctcgaaggagatggcaccggagaagacgagggcagtgtactcgcccagggagaggcccgcggccgaggcggccccatccacggccgccgggttctcggcgcgcagcttctccacggccgccagtcccgccacaaacagcgcaggctggtgggtgggtggggttgggaaatgagatgtcgcggagggggggaacacttgagtctcagcgccgtaagatgggggcagcctccacgccgcctggaccacaggagcccgtcctttccaccgcctttcagtgcctgccctctccggtagctgaatgcagccgctcagggacccccccccgatccctaccctctcacctgctcctacccccgccatccccaaccaacctgggagtagatggtgtcgtccagcttctccttgggcccttcggtgcagagcgccagcaggtcgtagcccagcacgcgctcggccctttccagcatggccttgactgcagggatgtccttggactggttcagcatgcccacggcctgcgagccctggcccgggaacaggaaggcgatggggccggcgggggctggggccttcttggcggcgggcaggccgccagcggccagcgctgtcgccttggcgcggcggtgctccgccttggcnnnnnnnnnntggccttcttggtggcgggcaggccgccggcggccagcgctgccgccttggcgcggcggtgctccgccttggcggccttgcgcgccgccgcgtcgcgctcgcgcttgacctgctcggggtaggggtgctggtactctgcgtcccaggtcttcacccgctccaggccgtagtcatacagcgtccaccagcagccgatatcagggtgggggcggcgggccttggcgaccccagcgtacttcttctccaaggccagcagcttgtcgcggatggcctggtcgtcgttggccacctccacgggcagcttgaccccgggggagaggtaggggtcaaagtcgttggtggtgatggaggggtccgcgccgcgagactgcggggggacgaggtgacggtgaagtgggggggtcaggcttttagagggggagcgatcaagggatgaggttgatagttggggttaatggcttgcgtcaaagggtgaggccaggggttgcggcaaggagggcattctgcatgcaaggggggtgcatgattttgcttccatccaccccgtcagtaccgtgagtgccaagcgtttctcaaagggcagccagcataaaggataattgagctgtggaacacagaggannnnnnnnnngccgtgagtgccaagcatttctcaaagggcagacagcagaaggataattgagctgtggaacacagaggaagcactgccactttcacaaagtgtgtttccctcatcacagggcgtaccagcagatactcgtagatctccaggtacccgtcaaagtgtgccaggtaggcggcgcggtgcaggggggtgaaccccttctcgtccctctggttgacctcggcaccgttgttcaacaggtggtgcagctgcggcagcgggtggggagttggcatgaggtggtgggtgtggaggggcgccgggaaggcctggcgacaccaggttgcggaggaaagggagataagagatcgcaaattggcgttcatgtgccccaagaattcacctgctccaaggatccacctgctcctgcgggcagcacccctggaggccatcccaccacccccccacctttcctccgacaccccaccactcgcaccatgtccagctgcttgtaggtggtcgcaaagtgcacgggggctcctgcaccgttgtcctgggtgatgaagtaggggtcagtggccatgatcagcgccagctgctcggggtcgccgagtcgcacggcggagtagaaggcgatgggcgggtgcttggggacgggagggtacctgccgaggagcacgcagatcgtgagccaaggtgctgcaacgggatccagggccgggcggtagcagctcgcgttcccttacctccccgtggcagtcatgtcgcgcggcatcttgacttgctcgggagttgacctcgcagtaacgtgccccgatgaatgcaggggagggtgcaatgatctgtgcaggtgccgaacgaagatgccgactggtcggcccggcaggacagaggcggtctttatgcggacgacggtggcggggatggggtcacggacttgcaccccaccaggagccaaaaggccaccacgcgcgccaattcaaatgacagtcattgctggaactggaaatgtacatgggggatcacccagattgggaatgattaggaggaaaaacatgagttacagggggatcattgtcttatccaagcatttggctattcctttgcatgagggccttgctgcacagcacctgcttgacgcatcctcaggaccatttctgcaccccagatggactctgcattccctcattcaggcctcgctcagatgtacaagatcacattagacacgggccgagcatgacatcctcggcctcccacaaggggttgacagtgcaccagggcccgctcctggggcacggtagcctccaagacccacagcttccactctgtgtggcccagagcacggtcgtgtctggacctgccctccccgcccaggagcaggggggacctgcggcccccttcctctcccctgtggcggcacctgctgagccggcggcggtgccgtcgcaccctacgagccccctggaccctgcatgctagtcgccgtcgacctcggccaagctccacagctggctctgcatcgaggggtccatgtcggcggcggccttgagcagccccgccttgccgnnnnnnnnnnccgcaccctacgagccccctcgacaccgcatgctagtcgccatcggcctcggtcaagctccacagctcgctctgcatcgaggggtccatgtcagcggcggccttgagcagccccgccttgccgtgcgttgctgccgctgcctccagctgctccctcatgaagccccgcatgctcagcgtgtgcacggggtcgacctgccagagcgcgtcgcgccggcccccctcccccgccgcatcctcgctggcgaccgcctcggcctcgtcgtgcgcggggggtgggggcaggaagtccagcctgagcgcgtcccgcgccgctccctccctcgacggggaccccgcccacaccacgtcgtagcacgtcgcggagtagtgcgcggtgacctcgcccaggcacccaagcaggccctgcacgggtgcgggcagcatggccgccagccccagcgcgtgcagcacgcgctgccccgggcggccaaccgcgtccaggtggtccagccagacgcgcatgaggccgcgcgccgcagtctcgtccggcagnnnnnnnnnngactgcgtccaggtggtctagccagacgcgcacgaggccgcgcgccgcagtctcgtccggcagcgcggccagcaccgcgtggggccccgcatgcagcgccgcgcgcgccacggccgacagcgcgggcgcgacggcgtgcgcgcc

SEQ ID NO: 47583 - DNA, 61 bp, Chlorella protothecoides
tgctctgcaggaggggtgtgtcgaggcgggggagtcgggggggacatgggccacgtgtgct

SEQ ID NO: 47584 - DNA, 62 bp, Chlorella protothecoides
gtcgccgcgcacggcctgcatgcgcatggcgttgtccgggaatagcaccgcctgctgccaga

SEQ ID NO: 47585 - DNA, 61 bp, Chlorella protothecoides
taggcttccatgagggtttctagatggaggggtgcctgcgccccccatgcatgtcggggag

SEQ ID NO: 47586 - DNA, 61 bp, Chlorella protothecoides
tgggagggtcctggccagaggcttgattcccccttggggactaagatctgtcctgccagcc

SEQ ID NO: 47587 - DNA, 704 bp, Chlorella protothecoides
  modified_base (115)..(124): a, c, t, g, unknown or other
cacccaccccgcccatgcagggaggcaggggacatggcacacactcaacacccacggcaagtgggctgccaaggggtcaagcggccagcctgctgggcctaacgcctggcgtgcnnnnnnnnnnggacacggcacacactcaacacccacggcaaaggggctgccaaggggtcaagggaccagcctgctgggcctaacgcctggcgtgcagccatgccactaatcgcaggtactgtggtcccccctcccctccctcctcatgggccccagcaacaaccctgccacaaaaccctctccactcaccagtttaggcgccacgaaggccatgaccttgtgaatcacccccgcctggatggcgggcgcggccagcgtcccgccgcactcccataggcagcgcaggaagccgcggtggtaggcgtactgcgccagcgccagcgggctcaggaagtcgaactccacgatctccacgccgcgctcgcgcaggcgctgctggaaagcgcggcgcgcgccacgctgcaccgccacgatcgtgtgcgcctcccgcacgtcccacaggtgcgcctcctgagcgttgggtgtgggtgggggggggaagttgaggtgtgtggggtgggtgttggatggagaggcttgcgaaccgtggaccgggcgcctatcattgcaggccctccctgcgtccaaccccccccgcccctccccccccc

SEQ ID NO: 47588 - DNA, 61 bp, Chlorella protothecoides
cagggtgagtggggggccgaggcaggcggggggatgggaatgtgacgtatgcactgcatca

SEQ ID NO: 47589 - DNA, 61 bp, Chlorella protothecoides
cggcccgggctccggcccgtcgaccgcgatcggcgccagcgagatcgtcggcgtcgtggtc

SEQ ID NO: 47590 - DNA, 61 bp, Chlorella protothecoides
aaggaatgggagcctctatggcggatggaggcctgaaggaccaaactgcgtggaaacccct

SEQ ID NO: 47591 - DNA, 61 bp, Chlorella protothecoides
gcccgccatattggggggactggcgagcgggtcacgtctccacggaagtttgggagggcat

SEQ ID NO: 47592 - DNA, 61 bp, Chlorella protothecoides
accaacatccggaaggctatgctggcgggggacttcatgcaggtggcccatgtggagcgga

SEQ ID NO: 47593 - DNA, 64 bp, Chlorella protothecoides
ccagccgcccccagccccagccgccagcagcgatgcagcacctccacccccctcgggcagggcg

SEQ ID NO: 47594 - DNA, 61 bp, Chlorella protothecoides
gccagatcaggagaggcagcaaggggcggggcagatctgggtggctcctgtgtcccatgca

SEQ ID NO: 47595 - DNA, 519 bp, Chlorella protothecoides
  modified_base (117)..(126): a, c, t, g, unknown or other
  modified_base (213)..(328): a, c, t, g, unknown or other
gggagggcggcggcgccgggcggatggacaccggggcggacgccggcgaccgcgtctgcagcacgtatgcaaaggcgcgggcgtgcagctgggcgccaaaggtctccagcacgaccnnnnnnnnnntcggggtggacgccggcgaccgcgtctgcagcacgtacgcaaaggcgcgggcgtgtagctgggcgccaaaggtctccagcacgaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcgttcgtcagggcctcgacctcccactgcgtgctgacgtaggtggcgctgacagagtaggcgcagccgtaggtggtcccggtcacgatccagcaggtgcccttcagctcgggggccgacagggaggacggcgacggcggcggcggactggggctggggtcgggggaggggctgggtgggggaaaggggg

SEQ ID NO: 47596 - DNA, 73 bp, Chlorella protothecoides
cgcgcagaaccagaggtcgtcctgggcgggggcctcaggcacaccatagcagctctggtgcacggtcagcccg

SEQ ID NO: 47597 - DNA, 61 bp, Chlorella protothecoides
ccctgtcggcgcggcgctggcgttcacggaccccaccgacggcaggcgggaggagggcgcc

SEQ ID NO: 47598 - DNA, 61 bp, Chlorella protothecoides
caccacgctcatccgcgtggccgcgcagcacggcgaggcgggcgaggcgctggccatctac

SEQ ID NO: 47599 - DNA, 97 bp, Chlorella protothecoides
caggtggggagggagggcggtgggaagggttgtgggggtggcttctggggacggggggggggggaatgtgaagctggcgtgagggcccaacgacggc

SEQ ID NO: 47600 - DNA, 61 bp, Chlorella protothecoides
tggtggtggaagtggtggcagtggtggtgggggtggcggcagcggcggcggtggtggtgat

SEQ ID NO: 47601 - DNA, 80 bp, Chlorella protothecoides
caccacccccctctcacaagccgtcacctctgccgcctgtcaagaagccgccacccccctctcacaagccgtcacctccg

SEQ ID NO: 47602 - DNA, 61 bp, Chlorella protothecoides
ggccaggggcaggctggcctccagctgccagccctcctccaggcccaggtccacgctcaca

SEQ ID NO: 47603 - DNA, 61 bp, Chlorella protothecoides
agggtggaccacatcttatccaaaggccggcgtctaacaagctgcgcccctccaattgcca

SEQ ID NO: 47604 - DNA, 61 bp, Chlorella protothecoides
tgcccaggtcgggcgtggccccggagcgcaggtgcgaggtgtgcgccggcttcaggtccag

SEQ ID NO: 47605 - DNA, 61 bp, Chlorella protothecoides
gtccctgtgagggcaatgagctgcggctggggacgacgtacagcgacggtcacgtggtgga

SEQ ID NO: 47606 - DNA, 66 bp, Chlorella protothecoides
cagcccctctcccagccccagcccgtctccaagcctcagcccgtctccaagcccgtctcccagccc

SEQ ID NO: 47607 - DNA, 61 bp, Chlorella protothecoides
gatctcggccacgcgcgcgccaaagggcgcgggcggcggccggatcagggaccacagcgcc

SEQ ID NO: 47608 - DNA, 61 bp, Chlorella protothecoides
gctgacccaggagctgggggccgcgagccatccccccgagcaagccgcggtgggttcgctg

SEQ ID NO: 47609 - DNA, 61 bp, Chlorella protothecoides
taaatggtgttccggatggaccggcggagggatttacaactgcggcacacggtgatcactg

SEQ ID NO: 47610 - DNA, 61 bp, Chlorella protothecoides
gaggaaagggggcattgcaaggggggggggggccgatcagcagcagggcaaccggccaggg

SEQ ID NO: 47611 - DNA, 79 bp, Chlorella protothecoides
ctccttgacgtcggcagggttggccagcgcagacgcccaggcccccgcgaccgaggcaaagaggcggtccggggcgtcg

SEQ ID NO: 47612 - DNA, 61 bp, Chlorella protothecoides
cgtggcagacacgtctactgtctcggcggggtcatccaaagtcccatcacctcgctccccc

SEQ ID NO: 47613 - DNA, 61 bp, Chlorella protothecoides
ccggtaccgcgccagggcctcggccaggaccagcgtgcagtggccgcgctgcgagggtggt

SEQ ID NO: 47614 - DNA, 61 bp, Chlorella protothecoides
cctccccgacctcctcacggctgcgcagggggggagagcaaggagggggctggagctcagg

SEQ ID NO: 47615 - DNA, 70 bp, Chlorella protothecoides
ccccagcccgtctcccagcccgtctcccagtcccagcccatctccaagtccgtctccaagccccagcccc

SEQ ID NO: 47616 - DNA, 61 bp, Chlorella protothecoides
tggttcagggtcaggctgatgtcctgcaggatgacgttgttcagcgcgatgttcagggcca

SEQ ID NO: 47617 - DNA, 61 bp, Chlorella protothecoides
acccagaggttggtgcggcggtcggagagggagagcggggacacgacgtccaccacctcca

SEQ ID NO: 47618 - DNA, 2728 bp, Chlorella protothecoides
  modified_base (96)..(105): a, c, t, g, unknown or other
  modified_base (251)..(260): a, c, t, g, unknown or other
  modified_base (869)..(878): a, c, t, g, unknown or other
  modified_base (960)..(988): a, c, t, g, unknown or other
  modified_base (1968)..(1977): a, c, t, g, unknown or other
gggggggggcgggggcgccgccgggcctgccgccagcgacccgacggtgcgctcccggcgctgcaggccgcgcgccaggcgagcgtctcgcgcctnnnnnnnnnnctcctggccgcgcgctcctcctccgcgtcggccgccatcacgcgtgcgatggcggcgtcctgctcggccagcgcggcaagtgtggcgcggcactcgcgctctgcgtcggcgccgccgccggccgccggggagggcagcgtgccggnnnnnnnnnncagcgtggcgcggcactcgcgctccgcgtcggcgccggccgccggggagggcagcgtgccggggagcggggtggcgtggggcagcagcgatgtcagcgtggcatgcacgaggtccaggaactcccggctgctggcctcctcctcggatgcgcagggcaggcgcagcagctcgcacccctccaggtcgcaagctacctgtagaacgggtggaaggaggggggcgcctcaagcagggggaagacaacctttggtgggccagaccagccagcggtgcccgagcctgacgggggcgtgcggcatgccgggagatgaggtccaccgcatgagccacccctcgtaccaccagctggtcctcgatctggaacacgacataggtgagcggcgcgacatctccggcctccatgaggggggcggggaggcggcacgcaagggtggattgaggatgcagcccgctagctgggctcggttcagccaggacggggtggactcagcgaagacgacatggagctcatgcttgttgcgatgttcttccttatagattgaattcgattgagtgaggtcgattgaaggtgtcaacagcggttgcagagcgatgaacggcaagctttnnnnnnnnnnttgtcacggatctgtggactgaggcaatgcagcccgctcagcttcgcagtactagctgggctcggttcagccaggacggggnnnnnnnnnnnnnnnnnnnnnnnnnnnnnatctgcacctgtatgtatggctggcatggacccagaatggtgcaagtccctgcccttgacctagaaatggaatgcccttttatatcagcaaactgagtcagaggttggatgccgtacagcccaagttctatttgtacccttctcagggtgaggggaatgttcaagactggccgtcgcactggctggctgccccactgtacagtatacactggtgcgccagcacgaacattccaccctgatgaagaatatgaagacggggtgtctgcaagactcagactttgagaaacgcggtgagggcgcaggcactcgcaggccaactgctgattacaaaaccaggcaaactgagtgagtccccacgtatgcggcatcccagtagctaccccgtagttgcctgccacagcctgcactcgcccgagccccgcatatacgagaccagaggccagatccggggcatctatctcccacacccagcccttccatcgaaacaaaactcacgaacaaggtcagacatatccagcagcatgagcggcaacaacccctacgaggccctgcgccgcgaggcctccgcccccggcacacaggtcgtggagccggacgcaaaggtgcagaccatccccgcacccgagacggtgagggcgtggctgatgttttgacatggtcttttgctgctcctcaatgctgcatccatcgtgactaatgcctctgatgtactgtgtcgagaatactgactcgccctccccgcccctctacctcctgaacatgtgacaggttgcgccacctgcacccaagccccacagtgagtgggacttccagggaggggtgtttgggactgccctcgcgatgctctcgatggggttatgcgtttcgactttgccttggaggccttcacaatgttctcctcctgcggtggtagggacaaaatgggcgatgctcccacacacccctcccaaatcacagcctgccggtgtctgcatgccagnnnnnnnnnnaagttccagggaggggtgtatgggactgccctcgcgatgctctcgatgggattatgcgtttcgaccttgccttgcaggccttcacaatgttctccttctgcggtggaagggacaaaacgggcgttgctcccacacccccctcccgaatcacagcctgccggtgtctgcatgccagccccactccccccttctccccctgcagagcccggcaagccagatgtcagcaaggcccccggcgacatctcctatgcccagaccgtgaaggagggtgagaccaagacgaccgacacatcctccaccaccggcagcaagccctctggcggcgcggcgcgcaagaacaaggccggcgaacccctgagcaacgagcccaacttcaactacgcccagaagcacgccgagaaggctggagataaggccggcgaggccgcgcagaagggcaaggagtcgctgcacgaggcgggcaaggctgccaagtctgcggcgggcgagagcgtggaggccggcaagcaagcggcgggcgaggcggcgcaggctgcgaagcacaaggcgcgcgaggtggatgaggctgcgggtgaggcgctcggccatgcgcgtgaggcggcgggcgaggcggccgacgccgcgcgcgagtacgcggccgcggcgcgcgacaaggttgccgaggctggcgacgccgtgtacgagcaggcggcgcgcggcgtggagtacatcaaggagcacctgcccacggtgcacgtggagcacgacgagg

SEQ ID NO: 47619 - DNA, 61 bp, Chlorella protothecoides
aggcgttactcccagggagaacggcaggaggttctttgcggagacttctacaataaacgtt

SEQ ID NO: 47620 - DNA, 61 bp, Chlorella protothecoides
gtccggcttgtcctggatcatcagcgccatgaggtcgccgtacaggccggggtcaaagtcg

SEQ ID NO: 47621 - DNA, 61 bp, Chlorella protothecoides
gcagaaaaccagggcgagcaggaggaggggggcggcgacgcgcatggtcccggatcagcag

SEQ ID NO: 47622 - DNA, 73 bp, Chlorella protothecoides
cccgctccgccatcgcaccgccgtgcgcggtccgtaccgcggcgcgcagcctcctgcccgccgccttggcgga

SEQ ID NO: 47623 - DNA, 71 bp, Chlorella protothecoides
ccctaaccctaaccctaaccctaacccctaccctaacccctaccctaaccctaaccctaaacctaaaccta

SEQ ID NO: 47624 - DNA, 61 bp, Chlorella protothecoides
gcccgaccagccgcccccagccccagccacaggcagcgatgcagcaccgccaccccccccg

SEQ ID NO: 47625 - DNA, 61 bp, Chlorella protothecoides
ttgtacacgctgatccactggctggcgggggagccgaggcgcaccttcttgcgccgcaccg

SEQ ID NO: 47626 - DNA, 61 bp, Chlorella protothecoides
tccgggccaggcggaggaggggcccatctttgtcgtccgcgcccccagccaggtgatggaa

SEQ ID NO: 47627 - DNA, 61 bp, Chlorella protothecoides
agggggaggcagcttcttgggtgaaggggggggcagcttcttgggtgaagggggaggcagc

SEQ ID NO: 47628 - DNA, 113 bp, Chlorella protothecoides
cccgggcgggggcctcggccagcctggagggactgcgtgccgagtacgaggaggccaaggtagaaaggacggagtgtgtgttttgggtggggggtgttgtgggcacacccggg

SEQ ID NO: 47629 - DNA, 61 bp, Chlorella protothecoides
cgggacatggagggagttgcaaggaagaggcgagccactcactcagatgcccctgccccgg

SEQ ID NO: 47630 - DNA, 61 bp, Chlorella protothecoides
agtcaaactacccactatacgctgttgctgggcttagaaaaacaatatagaaagggtggta

SEQ ID NO: 47631 - DNA, 61 bp, Chlorella protothecoides
aaactgcctcagggcaggcctgaccggcgggcttcaggagaggtcctgcccttagtatatg

SEQ ID NO: 47632 - DNA, 61 bp, Chlorella protothecoides
ggtgggttcaggggttggggtgttggggggaaagaggagggcgggcgagggtgacaactct

SEQ ID NO: 47633 - DNA, 61 bp, Chlorella protothecoides
tcggggtgcggattcaggtgcgattgagggtttgcacggcggcgggggcggggcccgggtg

SEQ ID NO: 47634 - DNA, 61 bp, Chlorella protothecoides
aggggtggcaatgtgacagtggctaggcaaaattgactagcttagagcttgccactcaggc

SEQ ID NO: 47635 - DNA, 73 bp, Chlorella protothecoides
caaaccctgcagctgtccacctccctactccgtgacaaccaccccatcccatacagtccctcacccgaccagg

SEQ ID NO: 47636 - DNA, 61 bp, Chlorella protothecoides
gcgctgcgtgctggtgtcggccacggtcacgcgcggcgtgcgcgcgctgatggaggccgag

SEQ ID NO: 47637 - DNA, 61 bp, Chlorella protothecoides
gggggggggggggggggggggggagggggagtgaagtgggttcaaagaccctggggcgaca

SEQ ID NO: 47638 - DNA, 61 bp, Chlorella protothecoides
aaaaaaaatttattaaatattaagtattctcggaaatcgacttgtcacttaagaaaagaat

SEQ ID NO: 47639 - DNA, 95 bp, Chlorella protothecoides
gctgcaccccacggtgggcgcctgggtgtcttgggtccagctccgccccgctggccgggcctcggaggtgggccagccaaccgcacctcacaccc

SEQ ID NO: 47640 - DNA, 61 bp, Chlorella protothecoides
cctcgctgcgtggggttgatgcagggggggtgagaaggagagaatgaaggttttggggggg

SEQ ID NO: 47641 - DNA, 61 bp, Chlorella protothecoides
gcgcctagatcgggatggtaaattgcggggggatcaccaggagcatgctcctcgtggccgc

SEQ ID NO: 47642 - DNA, 61 bp, Chlorella protothecoides
ggttttgttgttaccatttggaatggctgggttcgttagtcatatgtgctggattcagggc

SEQ ID NO: 47643 - DNA, 97 bp, Chlorella protothecoides
ggggggggggcggtccttcagacaactgcccatcgccctctgcgcctgaccggttccggggcattgagatgggatccttgaaaggatgcacgcatgt

SEQ ID NO: 47644 - DNA, 114 bp, Chlorella protothecoides
gcgtggccgcccgggccgcgcgctttccacctcgtactcgctgtcgggcgcggcgccctccagcgcgccggacgcgcggtcgcgcgccgagcgcgagccgtcgtcgcggctggg

SEQ ID NO: 47645 - DNA, 61 bp, Chlorella protothecoides
tcgtcccgggcttggctgcatgaatgggggccgcatggatggacatgcatggacatgaaca

SEQ ID NO: 47646 - DNA, 61 bp, Chlorella protothecoides
gttggatttgccctcgtcgtctacggctgggccataccaggtgtgcctttggtagtaggca

SEQ ID NO: 47647 - DNA, 61 bp, Chlorella protothecoides
gcgctggagaccttggcaggatacgggaggggtatgagcgcgccatcgctaacgtgccccc

SEQ ID NO: 47648 - DNA, 61 bp, Chlorella protothecoides
gtcaggaaaagggcgtcattatggtggggggtccaaggtcggaagcctttttcgccacggt

SEQ ID NO: 47649 - DNA, 87 bp, Chlorella protothecoides
ccaggcgcgggaggggccggccgtcccgcataaagtggaccagcccgccccgtcggcggcgcagccgcaggcgcagcgtgagctggg

SEQ ID NO: 47650 - DNA, 61 bp, Chlorella protothecoides
ctcccctgagccatctcccagtcccagcccatccccttctcctgaggagtctcccagcccc

SEQ ID NO: 47651 - DNA, 61 bp, Chlorella protothecoides
tcagggccaccttgtgggcttgcaggccctgtagcctctccctgcctcgcctccccttgtc

SEQ ID NO: 47652 - DNA, 61 bp, Chlorella protothecoides
gtccatcccccagccccagccccagccccaaccccaaccccagcccttcaccaagcccaag

SEQ ID NO: 47653 - DNA, 61 bp, Chlorella protothecoides
aatacatgcttgaaccaaataaaagagactgccgtcctttattacgaaaattaactcctaa

SEQ ID NO: 47654 - DNA, 73 bp, Chlorella protothecoides
cgactctggcggtgattctgatggcggcgcacttccgagcgcggatgccatcaggagagcaaaggagacccgg

SEQ ID NO: 47655 - DNA, 67 bp, Chlorella protothecoides
cagcgaggtgcacccacctttcccacccacccatttccccgccaaccacccacacttgccgcgctcc

SEQ ID NO: 47656 - DNA, 61 bp, Chlorella protothecoides
acgccgtcgtcacctacattggctaccaggggggtaggagtgactgatcgttggtgcggcg

SEQ ID NO: 47657 - DNA, 63 bp, Chlorella protothecoides
ctcggacggggggacgaataccatgtgtgcacacccccccccccccccccccctccccccccc

SEQ ID NO: 47658 - DNA, 61 bp, Chlorella protothecoides
gcagaaggagagcttcaggagtgagtagggggcggtgccgcccttgaccctgcatgtgcag

SEQ ID NO: 47659 - DNA, 61 bp, Chlorella protothecoides
ttagaaagctgtgggggtggaagcaggggggggtgagggacggacagtcatggatcactcc

SEQ ID NO: 47660 - DNA, 61 bp, Chlorella protothecoides
ttgctgtcttgcagaggaggatgcggcagggttggaccctcaggccggacccgccctgaac

SEQ ID NO: 47661 - DNA, 61 bp, Chlorella protothecoides
gggtctgggggtcgtgtggtgcagcagaggcgtgaggccccgactcctcgtcgctcacacc

SEQ ID NO: 47662 - DNA, 61 bp, Chlorella protothecoides
tcatgagcacgtagaaggcgtagtggaaggggaagttgttcgccacgatggcccagaccgc

SEQ ID NO: 47663 - DNA, 61 bp, Chlorella protothecoides
ccacgcatgaatgggggacgcatggatggaggtgcatggacatgaacagagccgccacgca

SEQ ID NO: 47664 - DNA, 64 bp, Chlorella protothecoides
gcgtggttggtggcgttggacagaggcaggggggcgtctgctcgtcccgcactcccccagggcg

SEQ ID NO: 47665 - DNA, 69 bp, Chlorella protothecoides
cggtcgagggtgccgcggccgcgcctgccatcgtatcgatcttcggcgctcggccacccaggcctgggt

SEQ ID NO: 47666 - DNA, 61 bp, Chlorella protothecoides
ggatgcatcggcatgcgtggcttctggggggggtgcaaagattggtgtgggctttgtttct

SEQ ID NO: 47667 - DNA, 61 bp, Chlorella protothecoides
atacaccatcattctgcgggtgcggctgggggggagctctttgggaagatgatggttgggc

SEQ ID NO: 47668 - DNA, 61 bp, Chlorella protothecoides
gcttgacccgggggaaaagccacctgggggggcagactccggcaccaggtcactgcgcagt

SEQ ID NO: 47669 - DNA, 61 bp, Chlorella protothecoides
tcttctcggcaacccggggctcctgcaagcacttctcggcaacccggggctcctgcaagct

SEQ ID NO: 47670 - DNA, 61 bp, Chlorella protothecoides
ggtccatgttcctgcagatcgcggtggcggggcagtacctgcaccacaaccacatcatgca

SEQ ID NO: 47671 - DNA, 61 bp, Chlorella protothecoides
agcccaggggctttcatgtcggctgcaggggtgaaagtgcagaagagtcttcaactctaca

SEQ ID NO: 47672 - DNA, 61 bp, Chlorella protothecoides
attgtagtccctaagcactgtcttgcgaaggtccttcacgttgcagaaattgaggatcgtc

SEQ ID NO: 47673 - DNA, 61 bp, Chlorella protothecoides
tgaatggtcgtctcgggcccagtggatggggaggcatgaatgtttgagggacactttgttc

SEQ ID NO: 47674 - DNA, 82 bp, Chlorella protothecoides
gcgcaccgccgcgccgtccacgctgcgcgcgctgggcccacaaaatggctccgcattcgccccgtcgcccggcccgaagtcc

SEQ ID NO: 47675 - DNA, 61 bp, Chlorella protothecoides
tcggggtgcggattcaggtgcgattgagggcttgcacggcggcgggggcggggcccgggtg

SEQ ID NO: 47676 - DNA, 61 bp, Chlorella protothecoides
tcgcgtaatggttttgtttttattggagggggaggcagaaggggctcgatcctgatgctgt

SEQ ID NO: 47677 - DNA, 61 bp, Chlorella protothecoides
ccaccgtttcaagctctgtcgcggcgggggggcctatccaggcaaaccctacgactccaag

SEQ ID NO: 47678 - DNA, 1260 bp, Chlorella protothecoides
  modified_base (109)..(340): a, c, t, g, unknown or other
ggcgcgggccaggccgccgaagcggccgcccaggccgttgccgtgcgcctggaaggcgtggtagaagtcggcggcggagggcccgccacccgcggcggaggcctgccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcccgggtcgtagagcgagaaggcgcgcgggtcggcggccgcggcggcggggggcgggaagcccgctgcccctcccagcgccgctgcgcccgccgcgcggctgctggagcggccccatgagatgcggatggcgccgccgcccagggcctggccgttcatggcggccagggcctgctctgccgccacgcgcagcacgaactggacgaagccgcagcccttgcccgccggtatcttgacgtagatgatgtcgccgaagcggccgaacacagcgcgcagctcgtcctctgtcacgccgccggacaggccgccgatgaagagcgtggtgttgctggtgtcaaagtcggaggggtggggcgcctgcagcgagctcgccgtcgtggcgttagcgttcttctttgccgttgccaagtgcacgcggatggggcggttggacaggaagtgaccgcccatgccctccagcgccgcgtcgcgctgctcctccgataggaagcgcacgaagccgtagcccttggaccgtcccgtgcctgcgtcggtgataacctggcatgcaggcagtgtgtgggagtggggtgggagggcaagggagggtgacgaagcaggaggagtgacacccgcgagcttcgcggggagggcagagcttgcttcccccgctggtgcgagaaggcgtgcgccggccctcagttcccatccacacaagccccaatctccccggccctgcccaaggagggaggccatgcacgggcaaccgcctgggccaacgccagcacagcctccccatcgacacccctcccctgccagcccagcaaaccttggcgctgcgcacggacgagtaaaattgcctaaagtactcctggaggatgaggtcggtgacgtccggggccaggtcccccacaaacagggagtggtctgcggggggggg

SEQ ID NO: 47679 - DNA, 61 bp, Chlorella protothecoides
cacttcgagtgcctgtgggtgccaggggggggcagaaaagctggagatcctgccgggtgct

SEQ ID NO: 47680 - DNA, 61 bp, Chlorella protothecoides
ctcgtgaaaaccatgcttcctgtggatggggaggtgtgagagtgcgactcccccagctgga

SEQ ID NO: 47681 - DNA, 61 bp, Chlorella protothecoides
cagaagcagaccgccttccgcctcttccgctcctggtactgggacgcgttcgacgacgacc

SEQ ID NO: 47682 - DNA, 61 bp, Chlorella protothecoides
aggatggcactctcgcactcgtcccgaaggatcgccctcagtccccgagcatctggatgaa

SEQ ID NO: 47683 - DNA, 61 bp, Chlorella protothecoides
tcgacaaatgtgtattgtgcttctcttcccgcgttcggcggaaaaatgatttcgcattctt

SEQ ID NO: 47684 - DNA, 61 bp, Chlorella protothecoides
tagcaacagagggacgatcctcaaagagaggctggtcacattctacccatgagcatatatc

SEQ ID NO: 47685 - DNA, 61 bp, Chlorella protothecoides
gcgcggcaggccgtcgccgcggggggggaggccggggcgggggaggccagggatggccctg

SEQ ID NO: 47686 - DNA, 64 bp, Chlorella protothecoides
gccgctgccgccgccgccgccgccgccgccaccccacgacgtcgccatcctggcggcatactgc

SEQ ID NO: 47687 - DNA, 61 bp, Chlorella protothecoides
cgccacgctgggcgcgctgcgctcccacgcggacgtcatgctgggcgcgctgggcgtggcc

SEQ ID NO: 47688 - DNA, 61 bp, Chlorella protothecoides
ggctcagatggggcgagaggggatgcaggggattttgttgttggcaatgttaactcggaca

SEQ ID NO: 47689 - DNA, 61 bp, Chlorella protothecoides
gccacgcatgaatgaatggacatggacagatccgccacgcatgaatgaatggacatggaca

SEQ ID NO: 47690 - DNA, 93 bp, Chlorella protothecoides
cgcgagcggcccggcgtagatctccttggatccctgagggggggtggtggagggtaggtggggtcaccaccacggtctgtacaggcatcccca

SEQ ID NO: 47691 - DNA, 61 bp, Chlorella protothecoides
cctgggcggcggtggcggctggcgcgggggggcaggcctccgcgctgcagtggggcgcctg

SEQ ID NO: 47692 - DNA, 61 bp, Chlorella protothecoides
agaaaatcgagcatggacatgagtggatggggtccctgatatactgcagcagacctgacag

SEQ ID NO: 47693 - DNA, 79 bp, Chlorella protothecoides
ggacggccgcttcgtggccttttcgctgccggaatctgatggcggggggctctacgtggccttcaacgcggggcacggc

SEQ ID NO: 47694 - DNA, 61 bp, Chlorella protothecoides
gtccgaccggcggtgacgtgcaggggcggggggccgccctcgtcaagaagctcctggccga

SEQ ID NO: 47695 - DNA, 19394 bp, Chlorella protothecoides
  modified_base (415)..(424): a, c, t, g, unknown or other
  modified_base (1176)..(1185): a, c, t, g, unknown or other
  modified_base (2147)..(2156): a, c, t, g, unknown or other
  modified_base (2436)..(2445): a, c, t, g, unknown or other
  modified_base (2507)..(2516): a, c, t, g, unknown or other
  modified_base (2928)..(2937): a, c, t, g, unknown or other
  modified_base (3245)..(3254): a, c, t, g, unknown or other
  modified_base (4615)..(4624): a, c, t, g, unknown or other
  modified_base (7038)..(7047): a, c, t, g, unknown or other
  modified_base (7751)..(7760): a, c, t, g, unknown or other
  modified_base (8319)..(8328): a, c, t, g, unknown or other
  modified_base (8977)..(8986): a, c, t, g, unknown or other
  modified_base (9060)..(9069): a, c, t, g, unknown or other
  modified_base (9638)..(9647): a, c, t, g, unknown or other
  modified_base (10530)..(10642): a, c, t, g, unknown or other
  modified_base (10766)..(10775): a, c, t, g, unknown or other
  modified_base (11481)..(11490): a, c, t, g, unknown or other
  modified_base (13591)..(13600): a, c, t, g, unknown or other
  modified_base (19141)..(19150): a, c, t, g, unknown or other
gcggcggccgaccccgggcccgcgccgtccccgcagcgggctgcgccgggccacgccacgcccgtggccgccacgccggcggcaccgcgcttctcggtgcggcagctggtgcagcacatcgacaagcccgtgctcctcctcaagtccacgccccccttcaagaccgcgctgccctccccaggcccgcacagcgggaggaggtgtgcagggagtttgttgggggtggtatcctcccgcgggtgtgcggtgcgaggagcctgtgcagggggccggctgactcccagtgtgggatgaccgacgatttggagctgaaatgtccttggccacgctacgaccactccaccttaccacaatattcctctcaccgcaaccctcctcatgttcggtttcaggtcgctgctgggtggcatccccnnnnnnnnnnggtgggtgtgaggtacgagtagcctgtgcagggggccggctgcctcccagtgtggaatgaccgacgatttggagctgacatgtccttggccacgctacgaccactccagcttaccacaatattcttctcaccgcaaccctcctcatgtttggtttcaggtcgctgctgggtggcatccccattcccggcgtggaaaggctgccatcgccccaggtgccgctgccgggggcctgcgcgcccggaagccagggagaaggcaccgcgcccaccccgccgtcgacccagcccacgccgtcacagcgcgcgcccagtccgggaccgcggccgagcccctggtccgcggaacggccctgggacgccccgagggagggcgccagatcacgcacgactgtggccaagagagcgcggaagaccacggggcgcgtcgtgcgccaggagccggctgccggcgcccagccgtgcgccaggcgggccgggggagccaaacttgcggctgaggtgccggtggcagaggagctagctggacccagggacccacagccgggcctcctggcgctgacctcgggtgaggggtgatgatgggtgctgtaatggagaatggactgaggatgagcgtggtgctggggagtgggacctgagcctctgcagggtccatgtggaaagcatcccaggcaggagctgtgtgatggcactgcctgtgcagttcccatcaacactccacaccgtcgtgcagtcgagaaggacgtcgccgnnnnnnnnnngctgaggatgagcgtggctctggggaatgggacctgagcctctgcggggtacacgtgaaatccatcccaggcaggagctctgtgatggcaccgcctgtgcagttcccatcaacactccaaaccgtcgtgcagtcgagaaggacgtcgccgagctggcgcgctccgccacgctgcgcctgcgtggcatacgactgtgttcctccggccggggggaggcgggcgcgacgcacctggttgtgggcagggagcgtcgcaccatcaaactcctgctggcacgtgagtggtttcagggtgtgctgcgggaagtggaggtctggcgggtggaggggagagcactgctccctccatagctcagtcacgccctggtgacccacccaatccacctccctctgccagtggccaacggcgcctggctggtgaccccccagtggatcacggcgtccctcgacgccggcgagtggctacccgtgcgccagttccccgtcggcgagcgcttccgcgccgcggccgagcggtcacgctcggcccgggagcgcggcgccgcgctgctggccgggcagagactgtacatccacgccaggaccgggtccggcaccgcacggccccggaagtcagatgcgagcgtggagcggcgcgaaggcggcgccgcctccgccgcagatctgggctcgctgcgcaggctggccggtgcattgggcgcagaggtgagggggccgggggggtgctatgaccccgtggtagcagcgcacgtgacttttgccaggggggacggcgtactgcatggaggagtacgcgatgaccaaggctctgggccgctgaaatctgctgtcgggaggttgtatgtgcatggccgcgtgggagaccatgcctgaacagctttaaacccgaagccttggggcctagactggaatgcactcctcacaagccccacttccctttgcgacgcagctcactggcccgannnnnnnnnntctgaacacctgtagacccgaagccttgaggcctagactggaattcactcctcacatgccccatttccctttgcgacgcagctcactggcccgacagagtgcagcctgtgcatcctggcgggggacgccccccgccccgccaccctgccgccggcggtgccctctgtgacatccggctggctgctgcacgctgccgagcaccaccaggtgccccctgtcgagacttcctggcgtgtcgcctgagtgccaactttgacgacagtggcggcaggcgggggcnnnnnnnnnntgtaggaaagaaaatgtaaaccaacagccccggggttgagaggggagggtcgccgcagccannnnnnnnnntaccaggtgccccctgttgaggctacctggctagtcgcctgagtgcctactttgacgacagtggcggcaggcgtgggcctggatttatacaacaatactgccgtaccagtggtagcatgcacgcctggcatgtgcacacaggtcagcagcaccgagatgtgctggcgcttgagaaaattgccgagcacgaccgtccagtaggaaagaacatgcaaacggacagccaaggggttgagaggggagggtcgccgcagccaggctggggggacgtgtggaccttggtcacaccaggcaggggtccctccagatctagaatcaggtctgcaggagcggggggcctcatccagctagcagtgagggttctataccagggccccaaattgggtctctggggcgcctcacaccgccgcgnnnnnnnnnngtccagctagcagcgagggttctataccagggccccgaactgggtctctggggcgcctcacaccgccgcggcattctcggaggctgtgcggttgccaaaggacaccgaggtcccctccccggacctgagcgcgttgccgcgcagcaggctgcccacggtctggaccagcagcttgacgtcattcaggggcgtgccgggcaccactgcaatacgatgggggggggaagggaggtgtgagggaaggaggtgtgagggacggggtccaaggaagtgagggaaaggaaagggggggggggggggggggggcnnnnnnnnnntgggagggaggtgtgagggaaggagttgtgaggcaaggggtccaaggaagtgagggagagggaagggggggggggggttattgaggatctgtacgagcatgggcacatgctgacgattggctgtctggcgattgcactctggaccggctgcgaatctgactcatcagcagtccttggcatgcttccgcaaacaccccaccaccatatcaaacaaacataggatccattcccacccaccctcacctgtcttgtagaggtaggagtcgaaggtcatcttctggacgtagtcggactcgcacatctccacaaaggcctcgcgcgcggggttgctgcggtagaacaccttctgcaggatgtccagcaccttgtaggtggcccagtactgcttgtcccacttgtccaggtagacgcggaggtcggcctccccaaccatgcgctgcccacgcgccgaggcctgcacgatggcctcggcggccatgcgccccgacttggccgcaaagtagatgccctcccccgagcacttggtcacgtaccccgccgcgtcgccgacgagcgccacgcgccccttcacacgccgcgggcgcgggtgctcggggatggggtgcgcctccacgcggatgatggtcccgccctcggtcttcacgcgggaccggtcgcgcgtggcctgctggtactgcttgatggccgtcttgttcacgacggtgccggtgcccaccgccacgtggtcgtacttggggaacacccagccgtagaagtcgggggagacatcgtcgcccacgtacatctcggccaggtccttgtagtactccatcttgtcctcgggaatgcggatgcgctcctggaaggcgatggcaaagtcgtagtccccggctccgatctccttggccacgcgcgagttggcgccgtccgcgccgatgacggcgtccacctccagcgtggagggcttgcccaccttggacacgccatcgtacttgttgtagtgcagggtgaaggggccgtcgccgggtgcctggtccatgcgcatgaacaagccgttgatcacgttggcgcccaggtcctgggcgcggttgcgcaggtagtcgtccagcaccttgggagagagggcgtggggggtggcagggtgttgaggcgaatttgaggcaaggtggagcaaggtttggccctttgctgccgtacttccttccagatcaagctaatcacagtggcaggggagatgctagtgctttactacgcaggtgtgtgaggacagggtgggccagactcttccatgtctggaaggacacaaccaaccagggatgattctgcccaaacccgcctcacctcgcgccggcacatgccgatccactccttgtcgttcaggnnnnnnnnnncgctgatcacagtggcaggggagatgctagtgcttcactacgcaggtgtttgaggacagggtggggccagactcttccatgtctggaacgacacaactaaccagggatgattctgccaaacctgcctcacctcgcgccgacacatgccgatccactccttgtcgttcagggtcttgcccacatccacctcacggttggagggggagatcatcttcatcttggtcacccggcggtcgatgatctcaggcggcaggctgaactcgtcgaccatgcagatggggatggcgccaccgcatggctgcatggtgaggagggtagaggggggacggatcatgtacgtaatgtgcagaacaatcgcacaaacacatagggaagaggaatagttaccctttattgaagtcacattccgtccaataaatcctgtcacattcaaccagagaaatgcttgccttgcagttgtccatcttccgctcgatgaggtaagtctccaccccacccttagccagagtctcggcggtgcaggctcccgcgggtccaccaccgatgacagcgacgcggagggggcgatccagcttggcaccatccctcaccgccataacctttcaatacagcaaggggaatgggggtgtagcgtgagaaactgccggagctggcgcgccatatccatgaagataccgtcgaccgaaaccctgattcgatctgtgcccaaggcacagtggcatgcctcccgcacctgcatggcccgtcgaccggccacaggcgatcgcatggggcgacccctgagcccggcgccagcacgcatggagtggcttgcggacagggccggggcacccacggtgcagtgggaggaggtcaccaccgccccaaatgcagatcggggggcatgcgtggcagcagcggcaacagaaagaccttgaagggctgccattgtatgctgcgaccagaatagggaccgacggaaaggcggtgtgaagagggcgatggacttgtgtataataggataacatgcacaaattctagccggggtcaagagcgaatctttctaatccgatcgcgccttgttcaaatcgggcgcctaagccatactatctcacacgcaatgtgaattttatcgagagcatggtcaaactgaccatgcttctcagaggcacttcccatgtttcactatccatatagtaaggtggtgtggcattaaaggcttccttgcagttgcctggcaagcttgagatagacaaccacaataggcaggggcagcactcgcactgtaccgcagctcgatcacagcctcttgacctatccgtctaccagtgtctaacagtacagatcccttggaatagaaaagacaaggtcgggtcgtattctcttattgtcatacaagccagaggaaaaaggagtggcccctcagtacttgtttatgccgaggatgcgcacgcggtgcatgctggccagcttggcgatcaccagcacgatcacgacgatgaggttgacgccgaggggttgccgtctgtagtctgtgccattggaggccaggaggaagaggaccacgggcaccgccgtcagaaacttccgggccggtgtgaactgctgcccgtcgtcgatctgctcccagaaggtttggctgcaagagagaagacaagagggatgattcatggcctcagcagccaccacatgcactctggaggcgttgtacatagtctgggagctccctggtgtgtcatgctgattgctggtctaccccgttgcctcgccaggccccctactgcccctcacctgtcatacacgccctggtcgttcgcgatgggggatcccttcacccagtggaatatgatgtaggtgaggacgccgtgcgcgatgtggacgtacgtccatgcgatgccagggtcggtgaagctggagaccaagagccaggacaggaggaggagggcgacgtagtatacccacgcagccggcgagtccagccagtttgtgttcttgttggcctcagatgcctttattcccagccccgcctgactgcgaggggactccatgggtgctgcgcaccagagggaaggggctgtagatgccgagagcccaccacttccagccgtgtgcacactccaatatacaatgtcgcgctcaggaaccgcagagaagtagtgtgatactccagatcccaccgagttgcctgtcctgtgatcagttggtccgtcccgatgcatggcgaaggctcccaggaaccaccttctccgggatcgcgcttccgatcgttcccgcgccgatgaacatttcaagcatggctgcaagcaggctgtcgcgagattctattaaatgttaatgagacactatgcacccaacatctcatgtaatttctactattcaggggtaaacggtttcagtatcctccttcatgactgtccccgacaccaccgggccannnnnnnnnncttcgactattcaggggtaaacggtttcagtatcgtctttcatgactgtccccgacaccaccgggccaggggagcctgcatgctcacgagtggtgatccatgtcgagtgcgccctgcgtgccgacagctgcgcgaccctggaggagacgaggcaccacctcatgcaattcctggggtctctcagcaaagttacatacgtcgagggtcccttgaccgtggacccacagatggcacctttcctggcagagcatgcagccagggtttgcatagtggacttggaggatcgcccagacttggcgggtcgacccatgctctcatgggacgtggaatgggaggtacatggtggacacatggggctgatctcgagggattctgaacatgaggaagggcttgcgtggtcatgacctcgggccctgaccagtggatgcactttccatgcaggtggcttgctttgcgctggatagacagggggccgccagcgacgatgaaggggaggagggctgccccagccatagagaatggatcctgccaaatgaggtgggcccgcatggtgcagctgcttccatctcccagccatggagcctgatggcaaaccaggcggcagccgccctgtggccccccgcacaccaaccactcatgtgtcctgatccctgccgcggatcccagatgcgaactcaaatgcccagcttgtccccacctcaacnnnnnnnnnnaaccccgcacaccgaccactcatgtgtactgatgcctgcaggggatcccagatgcgagctcaaatgcccagcttgtccccacctcaacctcatgcctggctgcccacccacatgtgcaggagtttgaggggcaatgggagacgctgtactacgagacgtgcatcaagcagcgcctgctgcgctatgccacctcagcgctgcgcttttccatgcagggggtggaccccggcctcatcagctggaacagggtggtcctcctgcacggtccgccgggcacgggcaagacctcgctctgcaaggccctggcccagaagctgtccattcgcctcatgccgcagtgaggccggggtggaccgggttcggccggagggagcgatccatcgatgcgtgcgatgggccaaggatcagtgtgatagcagccccctgtgcgcacagggtggaaacctgccagcgggccccccgggttgcacccatggtctccctgcgtgcagccagctcacggcccagccttatgcaccccctctggtcccttcaggttctcccagggcatcctgatcgnnnnnnnnnntgacccagccttatgcacccccccggtccttcaggttctcccagggcatcctgatcgaggtaaacgcccattccctcttctccaagtggttcagcgagtccggcaagctcatcggccgcctgtttgccaagatccaggaggtggtggaggatgcctccagcctggtgtttgtcctcatcgatgaggtggagagcctgactgcagccaggttggcatgggtcgtgggtgaggggggtgggggtggccgggtgacatcgctgtaacaatctgggacaagggtggaagcattgctgcttggacgcactctgtggtgcatgccgtcgcatgtgtccccctgacacaaccactccctgccaccctgactgcaggaagtctgcagtgggagggtccgaacccacagatgccatccgggcggtcaatgccatactgactcagctggatgccctgaagcgccaccccaacgtcatggtcctcaccaccagcaacatcactggtgggtcagcagtctggagggtgcatgcacggagtgaagcatcagtgatgttggtgaccagtggcagggaagatggccatgccaatatccgactgctccggtatgtccccaatgctggaaaggggtagggaagggcaagcagggctcacctacaannnnnnnnnntctcttcctcatgcacttatgccacgcactccctgcagaggcgattgatgtggcattcgtggacagagctgacnnnnnnnnnnaggatgtccccaatgctggaaagggctagggaagggcaagcagggctcacctacaagttcatggcaagggcatgcctgaggtgcatcccaccccccacaccacgatcacctcttccccatgcactcatgccgcgcattccctgcagaggcaattgatgtggcattcgtggacagagctgacataaaggcatacattggcccaccaaatttggaggctcggtgagggcaaggctgcattgaagactgtgtgatgggtgggtttctagggcagttcaggtgcagcatcacgcacagaatagcaatttctgagtgtccactggccacaggtacgccatcctcgcctcctgtctttcggagcttgatcgggccgggatcgtgcgggacatgggcagcatcccaggcttctcccatgcactccggctggggaccgtcatggacgaaggcggggcggagggcctcgcagatcatgtggccaggtgtttgggccccatcagttgattcattgggaccttgtgcccatgtctgtcgttcagaggagcagcatgggtattgctgtgcttgggcctgtnnnnnnnnnncttgggccccatcagttgatttattgggaccttttgcccatgtctgtcgttcagaggaccagcatgggtattgctgtgcttgggcctgtgtctgagcctgttgagtctccggacccccccatagatctctgctggacaccgcccgcttggcggagggactgagtgggcggagcctgaggaagctgccattcctggcgcatgccagccaggcatgggaccagaggggtccctgccctgctgcagcattcatgcgcgcccttcaacaggccctggacagcgaaggggttgaccgtgccaggatgctggcaagctgacgatgggaagggggtgtctatgcagtgatgaccatgggcccagcagcgaatgttgttcggtccctggcatgtcacaccatgctgcttgcagagtgtatcgcgaggttccttccgcagggaccttaattactccggaggcccgttccgtctcagtgcccctgctttatgcaggcacacgcatgccaccaccttgacctgctggtacaaaccacgtttggctgatggacacccattacaaacacacaccgcgctctccttgctgacaacttgcagagacgtgcatggcatgatacttctaggtagcctgaacaagcaccaagtaggcagagctccggggagcaacagtcaggctggctgaccctgagcgcgtccctcgggtcaagcgccagacaagcaaacagggggggcgctggcggcaggcagcacatcgccctcgcgcccttctgccccattctctcaccatttgtcgtcccagtcggcggggggctttgctttcgagctagggccgccgctcctagtagccggcacgtcctgccagtcccggtcgctggtctcccaattcaccgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcacgccgcctactccagaacaccacgacggctcccagtgccagcgccaccaaagccacaacaatcacactgaagggggggaagggtttttagcgtctggaaagggcgagggaggggctgggnnnnnnnnnncttgtcgtcccagtcggcgggggcctttgctttcgagcttgggccgccgttcctagtagccggcacgtcctgccactcccggtcgctggtctcccaattcaccggggttgtctggaccccggccttgacctccgtgtacctcgggcccagctccacagaggccaggtgcgccggctggagtgcgcgccgcctactccagaacaccaccacggcacccagcgccagcgccaccagagccacaacaataacactgaaggggggtggagggtttttggcgtctggaaagggcgagggaggggctggggagcgtggcagaggaatgcaccacacagacgctgcatcagcacatacttggctggcacgaccaggaatgcccctacccagcacctggaatagggaaggaatggggcgaggaggcctccgtctcccaccgtcttgagtggagtcctgcgcgggccgggtttcaaaatagcgtcgtgagggcgttcagctcctgatgcatggcaaccccgcaagcagactggagcaggagcgatgccatggccctccatgtaccagaagccctgtgttgattgctctacctgcaatccctcacctagcctgcaagtcatcttctagaatgctttccatgtcagtctcctcctcctccactgaatggtcatcccacagcgtgtcagcgatctcggcttggcccactggggggggnnnnnnnnnncctcctcctcctccgctgaatggtcatcccacaacgtgtcagcgctctcggcttggcgcaccgggggggggggggggggggacttccccggaggcttgagctgtgtcgtgttccggggggttggtatccggcggttggggtcggctggacgcggcagcagtggggacggtggctgagcagtcaccatgacagagctcgcgttatgagggagcagctcggccgtgggtgcatacgacccagtcggtgtagagaagccagggaatgtgccccttgcattgacatcctcgccagcttctagagcgtgtgaggaaaggtgcggagctctcattgtgccatacacaacagggcatagaggagtggacttgcatttttggtcagcatctactctgcactgacagccctcccaccttgtgctggtcccgctgctggtgcctcttgaggttgcaaaccatccgaccgcatcctgggttcaccagtctcgacggatggagctttaagcaggtccacctccgtcagcacttctggtgtcggtgcggtagctctcctcccaaggtcattgatcacccgctccaccctggtccctgctgcgagaggtggttgggtgctgcaggagtgcacattggcaaatataccgccactataaggaaatcaaaccaggaggacgcataatccgaacccacaaacctggaggatctgcaagtagttgccgggaatgggctgaagacacgaagagtgttacgctgagaagcagaactacctcgagcttcatgtcgcggccctccacgaaatcagggatctaacggagttgcattgaaactgagatcgcggtcgtgccactgaatgtcccacttgggggagcgtgtgcaactgatttaacaagcctggccgctcatggcgcgctcagtggcgcggcaagacatcctacacctagaagcacacattacagatgatcttcagaaaatgccaggagccacctaaaggcgccatagccgagctccgattttctctttggaaaggtctgagtatattacaatccccagcgcagtgcgccgaattgccctgcgctcccgtactgagcccctgccagagcgggccaatgcccatcaagaggggccggtacatttcacgcacaaagccctcgcagagcatgctcattccgacaatgaactctaccgggacccctctgaccctggccgctgttatcgttgtgggcgcgtccatcgctactggcatcctcgtcaggcgacggagatcatctgcaacccacgactcgaagcccacagcgacgtgagcgattgcccgcgttctttaattctgacgaaaatctgtattgtcgacttacacaagttgcagcaattttcatcagaccccaaacacatcccgagtctagcactgatcttccctcctcatgcacaggggccgggaggtggtggaaggcaacagcaagccatgtccccaggataacggagtgcctcgccaccagaaggacttgtcagctccttcacaaccagagaaggagtccgaagtgcacgctgagccacagagggtgttcccaccctcccctgatggcccttctgaggcactttcaggtgcagctggaactgccgcggccaatacccatgccgtgctcagggctcctgaccaagtggaaaatggtcctgtgcagcctctgattcccgcttcggagtcggaattgtctctggaaggaactgctgctccaaaggtcctagaccaggagccatcagctctcaatgagcccgcgtcagcaccgtcgccgtcccatgccagcagcgatcgtgaggtgcgccagccagactcggagggctcggtcccggctgccaatcccggctcctgtacccctcgggattgtgcgtctgcaccccctctggcacccccgactcctgcagcgcaccattcgccccctctcggggttgccagccccagcaagaatgaggacggggtgctgcagcccttagcaaaggacggggaaggtctcgatgctgtaaggaagctggtcattaggcccgatgctcgccaccctgccaatccagaggccggactcctggtcccggccgatgagactgtagcggctgacgagaannnnnnnnnnagggaaaggtcgcgatgcagtaaggacgctggtcattgggcccgatgctcgccactctgctaatccagaggccggactcctggtcctggccgatgagactgtagcggctgacgagaatggagcaaggaatgaggctgtggtggctgatgaaggcggagtggccgaggagagcctggctgcatatgaggatggcgagggtgttgagcatctggctgcagatgagagtggggctggcggcgagtctagagctgctggtgggaggcagggcgggagcaaagacgcggcagctgaggaatccaaagctgcaaacggagttgaagcccatggggccacagagatatccagcgacgcgggcgttgattcggccaacccagtctaggaggcactgctgctgccagcggcagagcaagacgacatcttgacgagcaaggagggcattgctttaggcagagagctcgacgttcccactggcattgtgcccccgtctgatcgtaagcaagtatccaacccccaggtgacgatcactgtgcatggtggggatggggatgcttgtaaacatccatgcagctcaggctcctccgtgagaagacctttccaccacccgatccgctcacaccaggatgcatcccctccctgcgcacatcaggcggcctttgaggctgctctggacgttgagatcccagacttgaagctggaggatattccggcgcctggagtccctgccactgctgccgagaagcgagtcgagcaggccaacactctggcagacaagctcctggatgacccccagtgcgtgccgtggacagcgagtggtgccgagcctgcgtgtctccctggctgctccctcgcatcattgaaatctttgcatggatgcccaggaccccctcctcagccttgccatcctcctgctcatctccccacgacagaaaaccgctgcatgtcgccatcaaggcccaacaggtggcgctgcggctggccctggcgggcggagtgcggcccgaggtactttcttccgcggccatgctgctcgccaacatgctcctgcatggccgacgctggggcgaggccaaggaggccaccgccatcgcctatgctgctgctggcagggccgagcgtcccgccgccaaggtgaggcgtgggagatgtggcacttgggcgggcaggagtgggagctgggatggtgaccatggcaaggagtggaatgaggacagggaccggtgttccctgctgcgtgtgtaatcatgcatcctcctccatgtgatccatcctgctcccgccccgccatgccagagccaagcgatgaccctctttgggctggcctggagctccgaggacaggctggaggaggccgcagcggcgtacgcggctgccattgggctcgctgaggtgagtgaagggtgcactggaccgaatatatttcaaggggtggatgaaattagaggcggcaggacgcacgagagctccacagagaacaggccaagaatggggtcagggtacggcaagttgtgatagcatgcctgcccctggcagcagtcctaggatccagcgccccagcactccaccatgcctcatatttcccgcaggagtcgatggatgtgctgaacccatccctgcaccgtgccaggcgcgacctgtcgcagatcctcctgaagatggggaggcaggtgggcagggccaagtgtcgggcaaaccgtgcagttgccggagcctgccatggtgtggctgctcaatgctgactgccacgatgccagattctctgtgcttggccagagttcttttcctactttcctcgccgtcttcctcaggacgaggccgtggcgctcctggtcacctctgcgcgccagctctgcggtctagcggccgacaccgaggcacggaccctggcggccggcgtgacgagggccgccctggcggccgcggtggcgggcgaggacggctctgccggcgagacccggccggcgcagcaggacaagctggaggtgagggcgggtgtggtgagctttgatcgtgctggccttggtgggaggccacaccccgtcgatgcctgcggccaccggggtctccaggccagccattgcaagcgtcaatccaacccctggtcaatttgccgcgaccctcagcccaccaccctccgaatcctgcagctggtgcacagtgcgcggcggtcggccatcaggagcctgtgggaggctgcggacctgctggctccacccgagggtgccgccggcgcggctgagcaggccgagcagctcctgcaggaagccatccagatggcgggcgagggctacggccggcagagcatggtgttcgtgcagtgcctggatgcgctggcgcgcttctcgcggcggcagtcgcggcttgaggaggccctgctgctctaccgccaccagctggcgatcctggacgggttcagggcctacgagctgcccatggtccagcaccgggtgctcttgctcaggtgcgtgggaggcggctgtggttgtgtggtttgtgtgaggggagtgtgggcagcctgcagggaggtgaccaaggggatggggttgggaggcatggtgggtggaggcgtgcttgagggcgggccgcatgtcacagcaaaagtggaggtcacttcataggcacgcaggcctggggagctggctcatgccctgggcaccgcaaagagctttcatctggacatcacaagcctcgactcgctgcatgtctagccccatctgagctcgtctcctggcactaccccgccccattgccgtccgtgcacagggcgtccgccgaagcgctggaccagctgggggagaccggcacggccgtggactacgccaaccaggccctcctccaggcgcaggtgggtgggaatcagaacacgggacgatgcagaggcactgcgtacgatcgaccagaggggtgccgtgccatgtggcagtctgattgtgccaggcgcgaggcccatctcagcatcgtcccacccctccaaaatgcaggccttggtgaaggtgggcagcgagcctcagcagcgcgctgcagcggcggccctggagcccctcttcacactcgttgccgagttgaaggagaaggtctgtcgtggggctgtacggtggaatgggaaatctctcatcacaatcgccccacgtgcaccgagcttatgcctcgccaaacgcgcttccaatccgacccgcatggcagacgggggacaaggagggcgccaagaaggcgcggcggagcatgctgcaagcccgcttggagaagaagctgccgacgttcacttcgccgggaaagaaggggcgcaaggcgactcgtcagaacaagctcaaggttcaggcttcatgatcgatacagccatgaccgttccatgcatagggatcaagctggtgttccaattgggagtgcgcgcttggaagacggtgcccagttcctgcccagtcgtgtaaagaggcagttggtgaaccatcatcgcggagctgggtaccgtggtaccatccgagctgagatgcctcaaacttcagatgcctctgttaactccgtctgtgggatcactagtgcacggacccttgaagcacaactcttcccagcaagtacgcaggctgaccggggctcgccgttcccaatgatggaggtggagccgcagatcccacccacttcgggggagctcgaggtggcctcggagccccaggatctgtctagaacaaagttcccggatgcagtggaggtgtccgaaatggacacggatgcattggaagagtctgagggtgcgacaggcagcactaccaattccctcgggggtacgcgccacgcagacgccctggccgtccccgccgtggagcggggaccgcgccggtgagttttcgtggcagtagcctcacttgagtcccctgatcgggggagcgcgtgctgctacccattgcgtcggagccgaccgctccgcgccatgccccagcgcgcgccgttgcctgccactccatgtcgacgtgcttgcctcctccctgccgcccaccgggggcgccatggatgcccatgcggaccccgcccatgcacctgctctactcctcacacacacacaggctgtggctcgtgagggtgcccaagcccccagaggtcaccgccctggctgccctcgagcaggagctggctgcctacacgcagcaagtcaagctcctgaatgaaagcgcctcggtgaagaaggtgggcgctgagcgtcggtctgcatgcttgttgggcacaggaccacttccctgggaggggtccgtaccaggctgtcacgctgcgccgtgtgatgcgccgccagcccacacacgtgcaaggaagaccccccccccccctcttctgccaggttgcacgggatgacgcgcgtaaggacacgcaggcggcgcgcgaggcgtaccggctgtgccgcgacgcgtacaatgcgtgcatggaggtggtgatccccctgcgcgaggcggcgcgcgggtctgctggcgccggcccccgccgccttcgcgagtcgtaccccgagctggaggtgtggagcgtggcggagctggacgagcggctggcggggatggagtaccgcctgcagcacgagtcggtcccgctggcggaggagaagcggctggtggcggggctgaagcgcctggcgggccagcgcgcgcgcgtggccgagtacgaggccgccgccggcgcggcgcgcgacccggcactgctggccgacgccgcgcgcgcgcgcgccgcgttggcggaggcggaggaggaggcgcgcgcgctacgcgaggagcgcgccgcgcagaaggaggtgctggacggcttctgggaggcggagcgcgccgtggacgcggaggtggaggccatcctggccgagcgcaggcgcctgaaggagctgcaggacgaggcgtacgcgcgcgtgtcggaggtgcgtcgcgcgcaccgcgagcgcaaggacgcctactactccagccggcggcacagcacgggcgtgcgcgcgctgctgcgcgagccgggcggggtcgagaaggccagggccatgtgcgtggagcaggtggaccgccagctggccgtcctgcgcgacaacgacgactacagagcaggtgcgtggggagtgtgtgtgtgtggagggatggggagggaggaatttgaaaagggggggggggacggcggcgtgcaggtgaaagggccgcacaaatccttggtcacccccaccccgatcaccaccacccacgcagagtacctcacgctgatcgagcagcagcgcgggcggcccagcacgtgggaggagggggaggaggcgggcaacggcgccaagcgcggccacagccggcagccgtcgctgccgctgactgaggaggagaccaaggagcgggcccagggggtgagccggggcacgggggggtggggtgggtctgggagggggcgctgcatgcatgcagaaccgatcagatgccccggtcgtggggccgggcgggcgtggcatcccctggggacgccccggtgccacacaaactctcgatcatcacgctccctccacctcgtcgccacgcccccacagaccatcgcagcggtgctggagcaggnnnnnnnnnnaatcatcacactccctccacctcgccgccacgcccctcacagaccatcgcagcggtgctggagcaggcgcggtccagggtggtggacctgaagcacgccgcggcggccgccaccgcggcagcggccccgcaccccgtggcggtggaggtggccgtgccagtcgccccggccgagccccgggcgatgcccaaaaaggcgccgcgcgcggagccggcgcaccccgagccggagcgtgcggcgcccg

SEQ ID NO: 47696 - DNA, 61 bp, Chlorella protothecoides
acagtcccattgtcgtctgcggcggtcgggggttgatgaggggaggggggggctatgtaca

SEQ ID NO: 47697 - DNA, 61 bp, Chlorella protothecoides
ggtcatggcgtttgagtccctgctggcgggggcggcctcaccgtctgagaccctgacaagg

SEQ ID NO: 47698 - DNA, 129 bp, Chlorella protothecoides
ccccccccccccccccccccccccctcatcctgcagctcctcacccaagtggagcgcgggaatcccagcgcccctgcaaggcttgcggaaggcagcgccgcctcgccgcagcacgccgcggcgagcggc

SEQ ID NO: 47699 - DNA, 61 bp, Chlorella protothecoides
gatgtgctggacggcctggctcccctggacgtgccgggcatcctcgtcctgtccgccagct

SEQ ID NO: 47700 - DNA, 61 bp, Chlorella protothecoides
gagacctcacagtcctcctcagtggcaggggtgggaacgcaaagccattctaccctccacc

SEQ ID NO: 47701 - DNA, 61 bp, Chlorella protothecoides
tgttcttgctagctttgctggcggtggcggggaggccttcatgccatcgttggacttgcga

SEQ ID NO: 47702 - DNA, 61 bp, Chlorella protothecoides
atctccgcggctgcgtgcggaggcgggggggggggtcatggttgaggcggcagcagtgtgg

SEQ ID NO: 47703 - DNA, 61 bp, Chlorella protothecoides
tctgcggcgcaagccgctgcaccccatccgtggcaatgtgttccagacagctgcaagcatt

SEQ ID NO: 47704 - DNA, 61 bp, Chlorella protothecoides
gcctgtgtgtgggggcaggggcttggctgggggggggggggatgtgtgcatgtgccattgg

SEQ ID NO: 47705 - DNA, 61 bp, Chlorella protothecoides
aacataccttcttgtggaagacaggcttgggctgaccaccgtaaccggactgcttgcggtc

SEQ ID NO: 47706 - DNA, 61 bp, Chlorella protothecoides
ttgtcaaaagaagacatcagcgtgtgggggggttttactgcttccttccgaggggaaaaga

SEQ ID NO: 47707 - DNA, 61 bp, Chlorella protothecoides
ctggcaaccccgcggctggtaggctgctggggcatttttcttgtgtgatccttcgtggctg

SEQ ID NO: 47708 - DNA, 61 bp, Chlorella protothecoides
tcacatttcactctttccctctttttgaggggatactaccaccttctgtgcatgtctggtg

SEQ ID NO: 47709 - DNA, 61 bp, Chlorella protothecoides
ggatctgctcgtcaacgacctgcggcaggggcaccagatgtacatgatgcaagggacctgc

SEQ ID NO: 47710 - DNA, 14932 bp, Chlorella protothecoides
  modified_base (174)..(281): a, c, t, g, unknown or other
  modified_base (356)..(365): a, c, t, g, unknown or other
  modified_base (3251)..(3260): a, c, t, g, unknown or other
  modified_base (4781)..(4790): a, c, t, g, unknown or other
  modified_base (5145)..(5154): a, c, t, g, unknown or other
  modified_base (6565)..(6574): a, c, t, g, unknown or other
  modified_base (6675)..(6684): a, c, t, g, unknown or other
  modified_base (8823)..(8832): a, c, t, g, unknown or other
  modified_base (9835)..(9844): a, c, t, g, unknown or other
  modified_base (10115)..(10124): a, c, t, g, unknown or other
  modified_base (10358)..(10367): a, c, t, g, unknown or other
  modified_base (10829)..(10838): a, c, t, g, unknown or other
  modified_base (11093)..(11102): a, c, t, g, unknown or other
  modified_base (11180)..(11395): a, c, t, g, unknown or other
  modified_base (11972)..(11981): a, c, t, g, unknown or other
  modified_base (12119)..(12128): a, c, t, g, unknown or other
  modified_base (12385)..(12403): a, c, t, g, unknown or other
  modified_base (12806)..(12815): a, c, t, g, unknown or other
  modified_base (13797)..(13806): a, c, t, g, unknown or other
  modified_base (14288)..(14297): a, c, t, g, unknown or other
  modified_base (14459)..(14468): a, c, t, g, unknown or other
  modified_base (14842)..(14851): a, c, t, g, unknown or other
gcgctggcggggccacgacggggaggtgcgcgccgtacaccgcgttggcggccgcgaaggaggccatggcggggacgaagaggtgcacgtacagcgccgcgctccagccgccagggcagcgcgcctccagcgcggcgccggcggctgccaggcaggcgtgcagggtggcggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcagcgccaggtaccctcccgtgcaccggacggccagcgagacgtccctcgcgaggtgcacagcgtcccgagccnnnnnnnnnncgccgcggcgaccgggtcggttgcgggcgcgccgactgggcgccagctcgccggcaccaggacgacgggcgccgccgcgcaggcagcgccggcggcccccgcatcccccttgggctcgacgtggaaggcggtggggtgaagaactgccacgggggccaggctgtcggcgctggacacgcgcgcttcccaggcgtccagcacgatgcggccccgggtgaaggcggggcagtccagggtgagcgtctcgtactccccgccctcgccgcaaacgttgcacccgaactttctgcgggtgtgttttgttccaggggggggaagaggtggggaatcagaaagtggccgggccgctggagatccgctggtctcaggtgagaatgctagggggcccgctgcgtggcgcccgggccagaggagtggccgcagagcaccggcctgtgcaccttgacaggccatcccaagaagacaatgtgagtttcatccctgtccttgggcacacgagtgtcagacagtgccttcctgccctgagccatgtgtgatggacatattcccaggtgcactagcgtgcgctgaagctgcatggcacacaccccacacacctaaaccccaacaccacatgcactacctcctgagggcatgcagcttctcctccatttcggcaaggggcgcccccaggtcctgagccacgctgaggcccgcggcagccaccttgaccaggacggcctcgaccccgccgtcgatctgcgggagggcgccggtgcaggaagagaggtgtctgacgaagggtccgaggtgtacgtgtttgacggtggagggcagcaggtctcccaggacaagcgcacacaagttcactgccgacctgcctcgtatggtgaatgaccccgacacacaagtcaatgcggcaccagccgcgcaccgcgtccaacccctccatcaaccacgcatgcgccgtggaccgaaggacgccccccacaaagccactggcctcctgccacgcaccatcctccgcagcagggtggactggggctggtgccagagcggggccagagacaccaggccgaggcgggcgcagacgttctccacccgcgtgcgctggtagtcggaggcgatggcgccgctgcacaccgcctgcaggccggggattcggtccttacagtacgccagcaggcaggacaggtcctccacctcgtcgctctcacaggcatcgtgctggtacaccagaccctggagggagggtgtggtgtggtgtgggagcggcgagcaggggaggctgctgtgccaatgcacagcgctgcggctcctgtgtgggccgccctgcaagaggtggggccaagggctgccggcagtgccgccgatcgaagtggtgctgccagaacatgccaagcttgcctgatccttggaggtgccctggatgcaccggcggtacagggggagccccatgcattgaccaagggcagcaaccacctggtgtcccacggtctggtacatccagctgtccagatcgtcgacgccctcctccatggggagcagattggccagggcaaccacctgatactcgtgggatcgaggattggtcgataatggacatgagatttggaagtttttacatgcgctgggcatgtgcatctggtcccttggtcctggggccagcatacgagctgccacccatcgccaggcgtcaagtgacccgagaggcccactgtccaactaccgaaccctcacctcgtggccaaatcgcgtgacctccatgatggtgaagcatgagtccttgcccccactgtgaaatcaatacaggaggatgaggattctaccgcgaccctcaacttgttagtatatgaaagggacctgcacaccctacacacacccacctgacgagggccacgaccttcatcgtgacgcgaggtgcctcctgtacctaggacgctcggaagtgtcgtattgtatacacatgccaatgcatgctgataggctgggagcgtgaaaccctacccacgccttgccgattaccaggtgagcgcgccctggcgacccagtcccagctttctacacgtgtacacccgtccctctcccaccgcagggtggggccctgtcaaggccttgagacaggcggcaggccggcgcaccaccgttacaccctccacgcattgcatgaggagcttgctgccccggcgcggcgctgtctccaccccagcccgcctcctgcccaccgcactccctcgctgtgtcggcggcacgccccggtcccccggcagggcatcgttcacaccttgcaaacgccaagcagctctcatccaggccatcagcatggtcggcgtcatccctgccaaggtacagtccaaatagcctgtgcgcgcccgcggggtgatggtgggacccggccgatggattcccgatccagcctcgctgccatcatccgttttcgtgcacaccattccgtagaccggcacggtgtcgagcaaggactatgaggacctggtgctcaagctgcacgacatccaggtgcgcctgcggtctgtccgacaaccgatactggccctgcctagacccaccgccttcctacacccttagtattgcaccgctccctcctgaaccatccctttcttggatcgctctgcgttccctgcacgcaggccgtgaagtttggcgaatttaagctgaagagcggcatcacttccccagtctacatcgacctgcgtgtcattgtatcgtaccccgatgtcctccttcgggtgggttctgggatgtgactggtgtgttatggcatgaggttgttgataccctgggccaccagtggcgtacatgccattcctctccgggtcctccccacggtgtcccccctcccgccttcattaaccccttccctctttcctccaccccttgacccaggtnnnnnnnnnngggtgtcgcccctcccgcattaaccccatccctctttcctccaccccttgacccaggtggctgaggccatgtgggaccgtgtgcagacggccagctttgacgtgatgtgcggcgtgccctacactgcgctgcccatcgccacggccatgtcgctgcagcacggcacgcccatgctcatgcggcgcaaggaggtcaaggactatggcaccaagaaggccatcgagggcgctttcctccccggccagacctgcctggtggtggaggacctggtcacctccggcgcctcggtgcaggagacggtggccccgctggaggccgagggactccaggtccgcgacgtcgtcgtgctcatcgaccgccagcagggcggcgcggcgcgcctggcatcccaaggcctgaccctgcactccgcattcaccctttccttcatcctggatgtgctggtggccgcggggcgggtggaggcgggcctggccgacgccaccaaggccttcctggctgccaaccagacggggccggcgggggcgaccggcgccgcgccggcggccgaggcaaagccggccgcggcgcccgcgccgcggcgcctggcgtacgaggcccgcgccgagctggccaagaacgcgcagggcgcggagctgttccggctcatggcccgcaagcggaccaacctgtcggtggcggccgacgtggagagcgcaaacgacatgctggctctggcggacgcggtggggccccacatctgcgtgctcaagacccatgtggacgtgtttgacacctggacccccgaccacgccgccaagctccaggccctggccgccaagcacggttggttcgactttttggaggggtattcttgggcggtggggcgccccggaaggggagggaaggggctctttgatggagggacccgggacagcaatacgcagctggagcctcgtgcgagggcctttgggggcgggaggggggtccgacactacacgcccaggctggtgcgcctggccactgccccgtgaatcgaacccactcctgtccatggcaagaaaccgaatcagagtccggcaaacccccatgcctcgacctctcttgacaccttgccacactgaccgagcccctgtccctcacggggacagggctccgcctgggggcggggggagagggggccgggcccgggactggggactgggggggtggaccactgccgcaaggcatgcagtccacccccggccccggaccccggcccggcccccgtcggggcttcgtgccatgtcaaggctggccccagccccctcgtgcccaggcacactctttttcgtgtattctactcaccctcctctttggagtgccctccgtcggcagtgtctgtgctgggcagcggctcctggccatccttcagcctgcaaaacagacgccctgcccgggcccaggcaatgctgctgcgccatggttccacccacttgttgcccctgattgtgcactgtctgcactttctgtcgtccattgtccccacctgcaccagctcannnnnnnnnnggggactggggactgggggggtgggccgctgccgcaaggcgtgcagtccacccccggccccggaccctggcccggcgcccgtcggggcttcgtgccatgtcaaggccggtcccagccccctcgtgcccaggcacattctttttcgtgtattctactcatcctcctctttggagtgccctccgccggcagtgtctgtgctgggaagcggctcctggccatccttaagcatgcaaaacagacgccctgcccgggcccaggcaatgctgctgcgccatgcttccaccccactcgttgcccctgattgtgcactgcctgcactttctatcgtccattgtccccacctgcaccagctcannnnnnnnnnccagacttcctcatcttcgaggaccgcaagtttgcggacatcggcaacactgtggtcatgcagtacggcggcggcgtgtaccgcatcgccgactggtctcacatcaccaacgcccatctggtgcccggccctggcatcatcgacgggctgcggcaggtgggcgcgcccctgggccgcggcctgctcctcctggccgagatgagcagcaagggcacgctggcgcgcggcgagtacagcgcgggcgtggtggcggccgcggaggccaaccaggactttgtcatgggctacatctccgtgtcccccgcctcctggcccagcgggcccgggtccccgggcctggtacacatgaccccgggcgtgcagctgtcggccggcggcgacgcgctgggccagcagtacaacacccccgcctcggtgatcggcgagcgcggcagcgacgtcatcatcgtagggcggggggtcatcgcggcgcaggaccccgccgcggccgcggcagagtaccgccgcgcggggtgggaggcctacgaggcgagcctctgaggccggcggtgagggcctttctgcccggcgcctgacgcgcgcgcccagcccccgacagagtaccatgctgagaaggcctgtgacgagcgtatgtaattttgaggccgagctggaggggaaaggtgcacccagtgccatgcttgcggctgtcccagggccaagattcgaatctcaaaacgggggcctcgtccgccggttcggcacaggtctcagaatgcgctcgatcggcacagagggacgcatttctttggtcaaaatgacaagcaggaccccgagtggagcacgattgatgattgcagggtgagtggcagccagatcactccctgcgatggcccatcgaggtgttggtggtttaaaaccttgtgcatctcccgtatcggtcagggcttcaggatgcaggtgcgtgggaggggcaacagcttacggatgcttgtacgtgtattggcactcaatcgagtgccccgaggccggtcctgagaaggagtcctcgggagtggctgcctgcgactgtggtttctggcacccacctacccggcaggagcagtgttcaccatttcacctcgtcgcgccgtgcaggtgccatgccgcgccctccacacagcagacagggcacgctccattcaccatcggcacactggaggaggcctgccggtcggcggagcggtccctggtccagtacaggttcaagcccgccaaggcacaggtgtgtgtgtgtgttcttgtgggagggatggttatgcctttgctgactgagtgccccatggtctcagacatcctacaccgtcctgcgtcttggctgtccccgttccagagacacgttctgcctccccccaaccccacgcccatcagcaccctccccctcccccccccnnnnnnnnnncacatcctacaccgtcctgcgtcttggctctgtccccgttccagagacacgttctacctcccctcaaccccacgcccatcaccaccctcccccctcccccnnnnnnnnnncccccccccccccgcgccaggcgcaccccctgtccgcctggcaacgcctgcgcgccatcgagcgggagctggagggcgtgagcgaggcgcagcacgccaggctggccggcgcgtgcagcggctccagcccctgcagcaccctctggccccgcggcgaggggctgacctacggcgcctgggacgcggccgccaccgcgccgcccccggcccctgagggcagcgggcgtgaggtcctgctccagggcttcaactgggagtcctggcggcacggctggtacgaccagctggcgtcgcgcgcgggcgagatcgccgacgcgggtttcaccgcggtctggctgcccccacccacccgctcggtcagcccccaaggctacctgcccagcgacctgtacgacctggactccgcctacggcagcgaggccgcgctgcggtcctgcgtggccgcgttgcactcccacggcctgctggcgctgggcgacgtggtgctgaaccaccgctgcgcagagcggcgcggtccctgcggccgctacaacctcttcggcggccggctggactgggacgctgcggccatcgtgggcgacgacgccgcctacggcggcaccggcgccccctcctccggcgcccccttccacgccgcgcccaacatcgaccacgcctccccccgcgtcaaggccgacctctgcgcctggctggcctggctgcgctccgacgtcggcctggacggctggcgcctggactttgtccgcggcttcgccggcgcccacgtcgccgactacatgcgcgcctcggccccgcgcttcgccgtcggcgagttctgggacgggctggcctacggccccgacggcgcgcccgaccacgaccaggacgcgcaccgcggccggctgctggcctggctgaacgcggcgggggggcgcgccgccgccttcgacgtcaccaccaagggcgtgctgcaggccgcgctggagcgcggcgagcactggcgcctgcgcgacgcctgcggccgcgccccggggctggtgggcctctggccctcgcgtgccgtgacctttgtggacaaccacgacaccgggtccagccaggggcactggcccttcccggcgcacgccgtggcgcaggggtacgcctactgcctcacccacccgggcacgccctgcgtcttccacgaccacttcttcgcctggggcggcggcctgcgcgccgccatccgggcgctgctcgccgcgcggcgccgcgcgcgcgtgcactgccgcagcgcgctgcgcgttctggaggcgcgcgccggcctctacgcggccgaggtcgacgcggcgctggtctgcaagctggggccggaggactggcagccgccaaacgcgcgggattggagcctgagctgctggggcgaccagtgggcggtctgggagcgcgcctgagtgcgtggagggccctctgcgagccaccaccatgccagcggccggacccaacgctccgcatgtaagcctcgtggggaccaccctgaggacccctctggcccgctccccaccccgactggccccgccgcagggtccttcaccaaaatcaccgctcggacacgaccccccctgccaagcgcttttccggcgcaagcatcttcccactctgtgacattcttccatctcgaacacccccctgggcgtcacccccctccgtgccctcctcaagaacccccctgttgaccgtcctctgatatggtgcacccctttacctccctgtaacatccctgtgacccgctgccggtcggactccgctcacagcggaaatcacgcgcaccgcgctcccacccccgggctcactcggcggcgtggggcatggagggcaccagccagcatgccctgcccgagctcgcggccaccagccgggcgttggggaggtcgttggacgccacccgcgcctgcgcggcctccaggctggcgccgttggccacttggcggcgcgtgacgcgacgcatggcgacctccaggtcgcaggcgaggaagatgcaggcgtccaagacgtcccggacctcgcgccacggcgcctcatctgaggacgggggaagagggggagggggcgtacgggttgcgccggccgtcagccgctggtgatcgtgtaaggaacaggaaggcaggcagggcctgggannnnnnnnnnggagggggagggggcatacgggttgcgccggccgtcagacgctggtggtcgtgcaaggaacaggaaggcaggcagggcctgggaaatcagggcggtgcaaggacactgaacacaacgtgtgcctgcctatgagcaggtagttgccctccgtcaggatgatgctgtggtgcggctccacctggacgtcgcctgggcgggggtcgcccaccccgtggtcaaacgatgggcaggcctgcgagcctgcactttgcatggatgtagccagggacagtggtgtgcagcgtgtcctggtcttcattctgtgacgctgtgcatgtgcgcttctcagtgtaccacgcagcctggaaagagcgaccgcagaggcagtaatcacttggggtccaacatcggcaccacccaccactgcacaccaacgccagtcccactcaccggcgccaggcgtcctcagagagcgcagagtggcgaggtaggaccccgggtcaaaggtccagggcgcccccctgcgcatgtgcgcctcctctgggtctggcatggcgtccagctgcgcgcgggtcaggtggtagccatccatggggaccgcggccgccaccgccccgcctgtcagggcgtttatgcgcgcctggagatgcgccgcgagcgtcgatttgcctgacccgggcaccccagcaatgcccaccaggtacctcctgcgcagggcggtggtcatgctgaggagccaggccaagctgttgccctggtcgaccggggtgctggtgtgacgcccccccgcatcacctgttctctaagggcctcagcgcggcagcttgtgccaagatcctgttggccagggaagacacgatggaccccatgtccggccccgtgatgacctcctggcagcgcgctcgactgggcgatgcatagttgggtggttgataatcgtcacgttgagctccatcctggctggagcgaactcagatcccaccaaccccactccgccacggctctgcagcagcactgaaggcannnnnnnnnnttaatcgtcatgttgagctccctcctggctggagcgaacgcagatcccaccactcccactacgccacggctctgcagcagcactgaagacactttaccgacactcacacgcatatccgagccactggcggaaatatccgacacgaaacccgctgatagcgtcttctcatgcattgccgcgcgtctccatggtgtggcgtgcatgatatttgcatggagcctgcactggcagagttgggaaggcctgcccaggccggacaaccgaagcccannnnnnnnnngttgcatggagcatgcactggcaaaggtgggtgggcctgcccaggccggacaaccgaagcccacaacggatcgacacttgagcacaattatctaccgtgacagggcagaagtcatgtcctactgatctcgtaatacctgcttacagagatggtgtcattgcgctgtttcatggccgactgtcatgatgacgcggaacgacggagtagagtgaacattcagccagcatcaggccnnnnnnnnnngttatctaccgtgacagggcagaattcatgtcctactaatctcgttatgcttgcttacagcgatggtgtcattgcgctgttttatggccgtctgtcatgatgacgccacgcagaacgagggggtagagtgaacattcagccagcatcaggccaaacactgcgactcaagacacctgccaatcccacagatgctgtcgttggttcttcgatcgttcctacctttccgctgatactgcagttgcctcgtggaggaaggtgggagcaggtggtcagggagtgggtgtggcggccctggtactcgattaccaagggctacaaggaagaactcccgttacatccatgcccaaattccgagaggtttctaaactgctttctttgatcaaggtggagccatctctcgctcttggacccacggggacgtgtctgatgccgtgggagataagaaaggaccggcgcgctagnnnnnnnnnncatcaagggctaccaggaagaacactcccgttacatccatgcccaaattctgagagctttctaaactacttttcttgatcaaggtggagccatctctcgctcttggatccacgggaacgtgtctgatgttgtgggagataagaaaggaccggcgcgctaggtatgagacgggttcccatcacgcatctccgaactggcccaatatgttgctcttgtgcgcctcgcagcttgcattgttccatgatgcatgccttnnnnnnnnnntcttcgatcgttcctaccgttccgctgatactgccgttgcctcgtaaaggaaggtgggagcaggtggtcagggagtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcggggtctcatcacgcacctccgaactggcccaacttgttgctcttgtgtgcctcacagcttgcattgttccatgacgcatgccttgcctggtactttgtatcgaaatctggcaggttgccgggacatgttgctatactcgtggctgtgacctggctcgcgctctggtgccagagctaacgcttgacgcctgggaatggccctccagtcaaccccaggctccgaatctgaggtgataacggacattgctatatacgtgatgcacctggcgctgcgcaggtcttgcagggccgcgcccacatcctcggtcacgttgctccaactactgcgcatctgcgcccccgcaggctgccaccacatcatgcgagagtgacggggcgccatcggcccctccagggcctgcttcgtcgccagcaggcgaaccctcggtgagtcgaccagttcgcccagatttttgcccgttcgggacctgtcgagagggacacctaagctcacctaatcaccaccgcccctccgcagacggggacccgcgagtggaccaccccctcccgctcgccctccccctgctgcacacctnnnnnnnnnnagaaaataaaggctggggcgcacccacctctgagcgtgccgccctccctggtcctcgcacataccctggtacccagcgcggcagacgtgcaccgcacccaccctcagcggcaggaggtggtgcaccccagccctgctnnnnnnnnnnactccgcagacggggacccaagagtggaccacctcttcccgctcgccctccccctgctgcacacctgctttacaggttcttccaccagtagacatccgtcagcccccccccgccccaaagaagaagcaagtggcccggacaaaaatgaaggcaggggcgcacccacccctgagcgtgccgccctccctggttcttgcacacaccctggtacccagcgtggcagacgtgcaccgcactcaccctcaacggcaggaggnnnnnnnnnnnnnnnnnnncgacggctggacttctctcgtgagcagctggacgaggggaccggcctcgctgcagtccccatcccggatcccgtcggcgccgcgccgcagtcccgccagaggctggacacgtcgcgcaaggttcggaagctgcgctgagcgttggagttcgttttgacagtctcacgccatcctccgacacattgtcagggggcggcctggggcctgtctgttttctttccctgccactttctctctctctacccttgcatgatcggtaccaaacaaagctttcgggctctttctatcgccacacacgtacttatcgccacacaatgaattgacgacgacctctgactgacccgccttgcaaatatctagctgtgatacacatccagggtggggcatgttagtgacttacaannnnnnnnnnccggaagctgcgctgaacgttggagttcgttttgacggtctcacgccatcctccgacacattgttagagggcggcctggggcctgagtgttttctttccctgccactctctctctctctacccttgcatgaacggtactaaacaaagctttcgggctcttttcatcgccacacacgtacttatcgccccacaacgaattgacgacgacctctgactgacccgcctaacaaatatctagctgtgacacacctccagggtggggcatgttagtgacttacaacgagtttccaggtgagaatggttgggatcctgagatgcagcaagaccagtaatgcgcagcatctgtaccctccaggctcggattggcagcatggggacggagggatgtaaaggggcctgggatggaaacaacaatgcacggcaactcaaactcggatcgcaagcagggcgctgcgcgcttttcgagggtgcatgtgagcagtcccagcctggggctgcagactcttatctcacggattacgagcttcggtcagaacctttcgcgcagcgagcggccgacatggaggaaggggtgagcgggggagtggtgcgccgctgtgctcaacgccggggcctgcatgcgtggcgctcgcctcccggcgcacatcccggagagacttctgacatttaaacgctcgcaggatgggctggtgtgccccctttgcatcacccccctcgatgtcatggagagtggctgggtaccgtgcccttgtgggtaccagctctgcctcttctgctacgagcgcattaggaacgaattcaacaatcaatgtatggatgtcgtgagggttggtctgaggaattcagggctggctgctggaggtggttgcgctcttgtcacccttgaggcccaatgcccattgcgaaccggaggccgcccaggcgctcgtcttgatgggcgaccctcctccttgccacaaggccccacgcactgcccatccannnnnnnnnncattcagggctggctactggaggtggttgcgctgttgttacccttgaggcccaatgcccattgcgaaccggaggtcgcccaggcgctcctcatcatgggcgaccctcctccatgccacaaggccccacgcactgcccatccatgcacaccctcataggtcccgggtgccggacgccctacgacccctcttaccagggcaaggtgcgggccagccccggccccgccccacagccgcgtcctcagcccacccctgcccggcggcccggcaaccgagcgagccagactgcggcggccccgcgggtgctctcgctgcctgcggcccagcaacgcatgcccagcccgcgcatcccgccagcgcaggcggcagcagcgcccgcccagcagcagcagcagcggcaggcccaggcgcagcaggcccagcagcgcgcgccggcagagccacctgcgcagcatcggcaggctcaggtgcagcaggcccagcnnnnnnnnnnagcccaggcacagcaggcccagcagcgcgcgccggcggagccacctgcgcagcatcggcaggcccatgcgcagcaggcccagcagcgcgtggttgaggagcctcaggcaccggcgctgctcgccgcgccgtccacgcacgagcccagcccgtgcccgccccnnnnnnnnnngcgtggctgaggagcctcaggcgccggcgccgcgcgccgcgccgcccacgcacgagcccagcccgtgcccgcccccgctccccacggcccccggcaccctgcacaccgtccacttccgggccaccaccgtccccggtgaggaccccatcgctggcgcctgccaggtgaccgtccccctggccacgccctccccctcggcgggggcgctgctggcttcgctgcgcgcctccttggcgggggggcgatgcagcctggagcacgccgtggacacgctgggcgcgtgcctgcacgccctggaggcggagctggccgccgcgcgcggcggcgcggggcgggggcgggacggtgaagcgcacgtgtcccgcccggcctcnnnnnnnnnngtgcggcgtggggcgggggcggggcggtgaagcgcacgtgtcccgcccgccctcgcccgccgcggccgccgcgggagcggg

SEQ ID NO: 47711 - DNA, 61 bp, Chlorella protothecoides
gtgtgctggctcctgaacggcagcaaagaggtgggggacaggtggccgcaccgtaccggca

SEQ ID NO: 47712 - DNA, 61 bp, Chlorella protothecoides
ggccaacctgtcctttgccgtcgggcgcgctcacctgctggcggcagaggacgcgggcggg

SEQ ID NO: 47713 - DNA, 61 bp, Chlorella protothecoides
tgtgcagcgaacgggatggcatggctggagggagagggagcgggcacgtctcaagcaggcc

SEQ ID NO: 47714 - DNA, 61 bp, Chlorella protothecoides
agtagttggagctcatatatggcggcaaaaagcatggcttcatgcgcatgtactgggcgaa

SEQ ID NO: 47715 - DNA, 129 bp, Chlorella protothecoides
gggcgcgggcggggccgccgcctcgcggcgctgcgtcaggcgcgccgcccgtctcgcctcctccggcgcgtcgcccagctcgcgcgcgccataaaagtccaggccgtgcacggcccagaggtaccgccg

SEQ ID NO: 47716 - DNA, 61 bp, Chlorella protothecoides
cgagggcgggtcgtcgaaggccaggtacagagactcgcgccccgacaggaacagctccagc

SEQ ID NO: 47717 - DNA, 61 bp, Chlorella protothecoides
tccaatgggcttgcttgtcgcgtctgcaggggcctgcccctctgctgaggcagagcaaggg

SEQ ID NO: 47718 - DNA, 61 bp, Chlorella protothecoides
gtgagtatgtgtggtgtgtgtggggggggggggggatgtgtgggggtggagagggtttact

SEQ ID NO: 47719 - DNA, 61 bp, Chlorella protothecoides
caacaacaagttgcaagtctcctcggcaggggagcggtgctgacggggcagcgctgattca

SEQ ID NO: 47720 - DNA, 122 bp, Chlorella protothecoides
tggaggcgtggcgggtccagcagggcagggggcccaaagagcgacatgccggcgtcacctccgttgcctcctccgccgacagcctgctccaaccccgccatgtgagttctgcgcaggcctgc

SEQ ID NO: 47721 - DNA, 61 bp, Chlorella protothecoides
tgtttatgccgaagagaggttgagcggcggggtaacacctcccggtggtgaaccgaaatgc

SEQ ID NO: 47722 - DNA, 61 bp, Chlorella protothecoides
gcgccatgtggtcatggcagcaggcgcccccccctcgtacgcggccatgaagcagcacaca

SEQ ID NO: 47723 - DNA, 61 bp, Chlorella protothecoides
gggctgacattacgtgatgggtggggaggggggagggtcgggcatgtgggttgggcctgtg

SEQ ID NO: 47724 - DNA, 61 bp, Chlorella protothecoides
cagcgaacccaccgcggcttgctcgggggggtggctcgcggcccccagctcctgggtcagc

SEQ ID NO: 47725 - DNA, 61 bp, Chlorella protothecoides
caggaagcagcggcagatacctggcgggggggtggcagtgctgatgcgaacagaagccggg

SEQ ID NO: 47726 - DNA, 61 bp, Chlorella protothecoides
gcgcgcgcgagaggcgggggcgggggcagggccagcgcgcgctccgggcctcgaactggcc

SEQ ID NO: 47727 - DNA, 61 bp, Chlorella protothecoides
ggtgtgccaggtcagcatgctggagggggcccccaccgaattccagcacctgcgggctgac

SEQ ID NO: 47728 - DNA, 70 bp, Chlorella protothecoides
gcggcgccggcgcggtcgcccgcgccgccgccaccgccgccaccgccgccctgcgccgcggcctggaagc

SEQ ID NO: 47729 - DNA, 61 bp, Chlorella protothecoides
aatccaaattatacgaggctgagtggatgggggcgtcccaatgaaggcactcttccagctc

SEQ ID NO: 47730 - DNA, 61 bp, Chlorella protothecoides
ggtgcggcagtggctcagcctcagggagggggacgccgcgtcgcagcccgcggcctcgcag

SEQ ID NO: 47731 - DNA, 61 bp, Chlorella protothecoides
tggaggccgctctctccttatggcggcggggcgccgagcaggagcgctggagtggcgattg

SEQ ID NO: 47732 - DNA, 61 bp, Chlorella protothecoides
cgcggcggcggcgtgggcctgggccgcggcggccgccgcctgcagcagcgccacgtgctgc

SEQ ID NO: 47733 - DNA, 70 bp, Chlorella protothecoides
atctgcgcggcgggcggggtgtgagtgggggttttgtggcggggggggggggtggggggggggggggggg

SEQ ID NO: 47734 - DNA, 74 bp, Chlorella protothecoides
gggaggcggcggggatggcttgggggagggaggcggcggagaccttgtgggaggcggcggggatggcttggggg

SEQ ID NO: 47735 - DNA, 61 bp, Chlorella protothecoides
ccattggtccgccagtgccccgccgagtacaagccgcagccctcaaagcgccggaagttga

SEQ ID NO: 47736 - DNA, 61 bp, Chlorella protothecoides
attgcacaccgcgacaggcaggcccccgggggtctcaaagctccccaggcgcaacccacct

SEQ ID NO: 47737 - DNA, 61 bp, Chlorella protothecoides
agctcctggaggatatccggatggacaggggggaggaggtcaagttcttccagatgggccg

SEQ ID NO: 47738 - DNA, 61 bp, Chlorella protothecoides
atcttatccaaaggccggagtctaacaagccgcgcccctccaattgccatggcctttttca

SEQ ID NO: 47739 - DNA, 102 bp, Chlorella protothecoides
ttttttaagctccgctaacccatcgggtgaccaactacagccagattctgtagaaagtgattttgtaatagcttcttttgtatcatgaccaccaaaaatttc

SEQ ID NO: 47740 - DNA, 61 bp, Chlorella protothecoides
aaccccacccccgacgacaacaccccaccctcaaaccccacccccccgcttcccaatacaa

SEQ ID NO: 47741 - DNA, 61 bp, Chlorella protothecoides
ggaatgtctggattgcaaatgtcagcagagggcatcttcacgtctgccaaggtcgcatgaa

SEQ ID NO: 47742 - DNA, 61 bp, Chlorella protothecoides
ggagacgatgcaggccatgggaccttgctccccctcacaccaaacttcggcaccccagtga

SEQ ID NO: 47743 - DNA, 489 bp, Chlorella protothecoides
  modified_base (107)..(116): a, c, t, g, unknown or other
  modified_base (193)..(360): a, c, t, g, unknown or other
ggcgcggaggtggcggagacggtgcgctccgcggcgcacctggaatccctggtggcggccgcctaccgcgctggcagccccgacccgggtgcggagggcccgggcgnnnnnnnnnncggagggcccgggcgagcgggggccggacgactgcgtgctgggcgaccccgcccggctggccgccaccctgggcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagggcgcgctgctggtcacgctggcctccaagcttgcggcgctcagcgaggcctcctcccgcgcggcgggtgggaccccaggcccccagggcggtgcggcggccgccgcatccgcctgtgcgggcac

SEQ ID NO: 47744 - DNA, 61 bp, Chlorella protothecoides
cgctggcctggctgggcagcgggggggggggcgccctcgctgcggacctcggggcagacgc

SEQ ID NO: 47745 - DNA, 61 bp, Chlorella protothecoides
cacaggaatagtcagcaggacaggcaggggggggagcagagcagtgatgtcgtcgtgggcg

SEQ ID NO: 47746 - DNA, 61 bp, Chlorella protothecoides
ccaaagggcagcagcaggcccccccccggcactgcgcaggctgcgcccaggcacgacacct

SEQ ID NO: 47747 - DNA, 61 bp, Chlorella protothecoides
aatggagcattgtggctactctatagagggggtacccactgcctagccgggatgcattgca

SEQ ID NO: 47748 - DNA, 61 bp, Chlorella protothecoides
caaaaattaatgtagacgaggtaggtcgagcattatcagttggtgatggtattgctcgtat

SEQ ID NO: 47749 - DNA, 61 bp, Chlorella protothecoides
cacactcgtgagaggaggttttgtggctgggcttatgggataggagtgggggctggaaggc

SEQ ID NO: 47750 - DNA, 61 bp, Chlorella protothecoides
ggcgcaaaggcatcgtgtgatgggggggggggagtcgggaactgcacagcaaacagcctca

SEQ ID NO: 47751 - DNA, 20462 bp, Chlorella protothecoides
  modified_base (93)..(180): a, c, t, g, unknown or other
  modified_base (1158)..(1167): a, c, t, g, unknown or other
  modified_base (2175)..(2184): a, c, t, g, unknown or other
  modified_base (3640)..(3649): a, c, t, g, unknown or other
  modified_base (4193)..(4202): a, c, t, g, unknown or other
  modified_base (5165)..(5174): a, c, t, g, unknown or other
  modified_base (5797)..(5977): a, c, t, g, unknown or other
  modified_base (6057)..(6066): a, c, t, g, unknown or other
  modified_base (6558)..(6567): a, c, t, g, unknown or other
  modified_base (8503)..(8512): a, c, t, g, unknown or other
  modified_base (8687)..(8696): a, c, t, g, unknown or other
  modified_base (8844)..(8860): a, c, t, g, unknown or other
  modified_base (9137)..(9146): a, c, t, g, unknown or other
  modified_base (9667)..(9676): a, c, t, g, unknown or other
  modified_base (10028)..(10037): a, c, t, g, unknown or other
  modified_base (10414)..(10646): a, c, t, g, unknown or other
  modified_base (10907)..(10916): a, c, t, g, unknown or other
  modified_base (11667)..(11676): a, c, t, g, unknown or other
  modified_base (12443)..(12452): a, c, t, g, unknown or other
  modified_base (12745)..(12754): a, c, t, g, unknown or other
  modified_base (12840)..(12849): a, c, t, g, unknown or other
  modified_base (13302)..(13311): a, c, t, g, unknown or other
  modified_base (13922)..(13931): a, c, t, g, unknown or other
  modified_base (14961)..(15029): a, c, t, g, unknown or other
  modified_base (15334)..(15343): a, c, t, g, unknown or other
  modified_base (15536)..(15545): a, c, t, g, unknown or other
  modified_base (17296)..(17305): a, c, t, g, unknown or other
  modified_base (17992)..(18001): a, c, t, g, unknown or other
  modified_base (18182)..(18191): a, c, t, g, unknown or other
  modified_base (18583)..(18592): a, c, t, g, unknown or other
  modified_base (19086)..(19095): a, c, t, g, unknown or other
  modified_base (19746)..(19762): a, c, t, g, unknown or other
  modified_base (20057)..(20066): a, c, t, g, unknown or other
cgcccaccgcgcaacgcagcgcggcgtaccaggccgcgcccggcgcgttgaccgcggccagcgcggcgccggcacaggccaggttggccgagnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccagcagcgccagggcgcaggcgcccagcgccgcgcccaggaagaaggcgccggggaggaggccgcgctggaggaaggcggggcggcagaccaagtcgaagtcgctgagcggggaggcgctgctgctcggaggggagggtggggcagaggtaggggaaggccggcatgacgtgcgggggatgcaccaggattcgaaaatgagcagggggccgggaccaggcacatgtgccgggctggcagccacccatctcctgctggtgcccaaaatgcatgacctaagctccttgcagcagcttcctttgtgactgccgaacgccccctctccccagcctcgcttcccaggaactcacgggcgggtccagtaccactgctctggtgccagtgagcagggatcgggcgggctcaaggccagggcagcctggcaggctgcgtcgtcgggggcggtgcaggctagggctccaggcgtgagggggctcagtgaattgaagatgccgatgaaggcctggaacacggcgcagaaccatgcagctcccacctgcagagccgggcatcggtcatgggtggctgatgtcccgcgcgtcgtggcagagggcaggccgggtcatggggagtggcaccgacactcaaaaccgtgacgtcatcaggaagacccgcacagcgcaccacgctgagctgcaggcgctgcccatggccaaactcgcccacgccgtggtgcagggcttcatctatggtcacagattccagacgaaggcccgacgtgtccatcccaagggaccgccccgccgggccggggggagggaatgcgtgtacacccagaagaagtgcccgggtctacgttggtggaatgttacagccagtcactgccatctaaggtatctaaaatctgggtgaggaagatcgtgagacagtagcctcggcagtgcttgtcccgacatggagtcgctcgtcagggcgcgagatcccgaggggagtcgcnnnnnnnnnngaacctgggtgaggaagaccgagagacagtagcctcggcagtgcttgtctcgacatggagtcgcttgtcagggcgcgagatcccgaggggagtcgcatgcaagtaagtatgttgtcaggcatgagctacagaagctgcacatcaggagtccaagcatttcgtaactcaatttaggagtatgtgactcgatcgctcataccgtgcaggacgtgcgctcggtacacaggcaaggtgcccaacacgggagaacatacattgcatggacacgatggatccacgacactcggaagacgcttcagctcacagctcatattcgagctcgggggacgaggaggatgatagaagggccttcagcatctggcaggccctgcccgttccggacagggagcctgactgggctgcagaggaggtggacaacgtggaggagtacctgtgccgggtcaggtggggtgatgcgcatgggagcaagaggcctgggtcccagctgctggacattgtgtatgggccgcgccgcttgatggcgtggcgcgtgccggccgagcccaccctggcagcccctttggtcacgccgcaaaatgcccgaagcccggcatctgagtcccctgtgctcaatccttggcaccccaggtgggaagcccagcatctgccaaacgccgttgtgagcaccgtggaccccccaaccccggcaagcagcagggagctgcccaaccaactgccagacttggcagaccctgagccatgcgaccccgcgctcctaccactccgctcctggacgacccacttcctggcaacctttgagcaccaccggagttgcatgcagcggtgagggagggggcaggcaggcgcagctgtgtgggaagtggactgaggggtgaaggtacgcgagccccgactggcaagggcttctggatgctgaggacatttcggtgcggaactgccacccccaaaactactgcgcaccctttcttcccgcctcgcctttgaagggaggtggatgcagacaggggnnnnnnnnnntcggagttgcatgcagcggtgaaggagggggcaggcaggcgcagttgtgtgggaagtagactgagggatgaaggcacgcgagcctcgactggcaagggcacctggatgctgaggacatttcggtgcggaattgccacccccaagcctgccacgcaccctttcccctcccctttgaagggaggtggatgcagacaggggcaaatctctgctgggaacatcgctgggcgggtcaggcataaggtgcccaagccccatccagggcccggaccccgggatgccttccagctactcgggcatgcctgagctcgaggcgctgcgcatgctttcctccgccaccgtcgcgcagcgggtcccctcccgcgtcacacgcctggtgaaggcggggtttgaccccggtgccgccgccgagctcttcgcgctatcaatccggtgaggcgggcgcgcccggcgcggagcactccgtgcattggctttgggagggccctggccaggaggtccatgagctcccctgaccgccctcccctcccaccctccaaccagggtggagacccccctgcaggccaacacatgcgcggcctaccgccgcctgctgcgccactgctgctccctccgcgccggcctgggctcggatgcccacactgacctcctcccccacctcaacatcctggtggtgatctgcaccgctgtgtttgggcagggcgttctggagacaagagactgaggctggcccccgcgagacgcagggtggccccactgccgcgccatgctgctgggcctctgtggcagcatgcagggagggtggtggcgcgcttacccacagccaggcttggcacatgcagggtctgggccccagtgccagaccgggcaggttacagacggggtggacgactgccgttcactacaccgcatgcatggcctgcaggcctgaatacaactaaatttaatacgtctgaaggggaggaatagcaggcccgatgtcttcttgagcttgaccgtggaagtgacgcgcatgccgccccggtcgtcctgctcccccgccgccgcgccgcacgggctcgtatgcccttgctcagggggtgctggcgcatcaagaggacttgccgagcaccgacagcaggttcttcagctcggcggtgatctgggcggtgagttcagaggcgctgaccttcagcgaggtgtcgaagacggtcagtgtggtgttggtcgcggtgccaaaggacttggtcagcacacattcctgcgtggtttgtgtgtgctcagaggggtgggtgggtggagggcagggcgaactgagcaggcaggatgaggacttgcagtgctgtaggaatgacatttcgcccagcggtttctggctgagtgcagtgtggcgcccgaaggggcaagcgacaaagcacatgcgacgacccggtgacattccaggaggccgagcgccatacacacgtaagggctgtgacgnnnnnnnnnnctcctgcgtgatttgtgtgtgttcagaggggggttgggtggagggcagggcgaattgagcaggcaggatgaggacttgcagtgttgaaggagtgacatctcgcccagcggttcctggctcagtgcagtgtggcgcctggaggggcaagcgaaaaagcacatgcgatggcccggtgacattccaggaggctgagcgccatacacacgtaagggctgtgacggcgcctccaccgtgtcaggggaggggccgccctgtcatccaagcgttgtgcatcccacagcccccctgcgagcaccccccggccaccccctgagcactagggtttaccttgccggtgaaggagggtgcagcatagtacttgctgacatacttggcggggaccttcaggtactccatggagggctccatacactgcagctccttcacgccatcgactgcagggaggggcaggaggtcgtggcgtgacggttggtggagtggcgggagagcacctggtcagacgaaatggatgccgtgcgaggctcgcaagaagggtcaaaggggnnnnnnnnnncacactgcagctccttcacgccatcggctgcaaggaggggcaggaggtcgtggcgtgacggtcggtggggtggcgggagagcacctggtcagacgggatggatgcagtgcgaggctcgcaagaagggtcaaagggggtttggagagggagcgtgacacgatggatcttgtcagtgcactgctgccccaccctttcgacctgctgcaggcaggcacctgctgaatcaagggagcactgtttcctcgatgcaccgggcatccattgacaatcagggttttcccacaagctggacccgccggcatgccatctataacgtcattcgcaccgaggtatgcagtctcattgaagctgcatgacccagtcgtgaacgttaggttgaaagcggagccgatgaacttggccgggatgatgccgcctgccgagcggtgggagtgggaggtgtgtttgtgatgtagaggcaacgcagcttggccgtactttctgggaacaggggactggaactgactggctactcatcagatgtggacagtgcagttggcattggtagaggaggtgatcgtccgcactacaccatgccccccatcagctgaccagacggcaccatgcacactgcaaaccacttgcccttgctgaagctggccggggtgcagaagttggcgtcatacgccgcaaagcccgacgtgagctggtcggacaggctcctcaccgaggtactccatgaggtggccagggtatcgagccccgtgacccccgcctggtaccgggtcaccagcgcctccgacaggtctgcaggtggtaacggggggagacgagtgggcacgagcgtccctcgcgatggaaaggacccaaactccgcccacgaaacattacaaggcggctggaagcatcgcgggagccgaggtaggccgcggagagaccatattgaccagacccgggctcacccccgacgagtttgtcgtaggnnnnnnnnnntgccgcggagagaccacattgaccaggctcgggctcacccccgacgagtttgtcgtaggtgacggtggtggttgggggaggggggaccacgacatcgcccagcgccccatgagccaacacacaggccaggatgagatagtgaaagcgcatggtgtcgaggcggtggaaacgtgattcaagtgcggtaccgggtggagttccgaatccggagaccgatgaccagctggcagatgtcagaaagtggggtgcccaatcaagctggatacacgacaaataaggctgaaatgtggatgtctatgtcggtctattcaatgcatcggtggggtgtccgctcagagagtctcgaagtcgtcgcgtcctcttcgcagcactcccagcatgcatgctggggtcccctgaccgatcgtcaacggggcagggggcgggcgcccttctgttgcatagcgggcgatctaagaccagcccggggacacaattgaaaagtagtacaatgtggttgtttatatgacgaaagttgattcgagtttttcgaggaaggccgcccaagaagcactgcctggttaaacttggccccccgccactgtttctccttgcagtacagagggttgtgcttttgcgacgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcaatgcgaatgaaacccctacagcttcctccacattattgacgaggacaatgactgcgtcagatgtcgccggcgctcnnnnnnnnnnacgcccaacaagcactgcctggttaaacttgggcccccgccactaactctcctcgcagtacagagggttgtgcttttgcgacgatgcctcatagaaacggtaccatcgctgtcgacacaggaatgcttgggaatagggaatgccaggatctgtgcacgctcccagggggcaggacaacagagattgcggtgctcctgtaattttgagccaccctgccagcagccatgccttgttcaatgcgaatcaaacccctacagcttcctccacattgttggcgagggcaatgactgcgtcagatgtcgccggcgctcctgtacgcccatttcgtgggcccatggtctccacggtgccactgaggttgaccatagtgcactgcacttttcaagaccttattcagccgaaacagctgatggaacctctcagtctggtgtaatggggtccacggtgcacatgccggaaccaatccgaaacgatggtgctgccattcccggnnnnnnnnnncctggtgcaaagggggtcacggtgcacatgccggaacaaatccgaaacgatggtgctgccattcccggcaaggaatctccactgtgcccttcataaggcggcgtacggtgcgacggcaaaacacctcggggattgccgcgccccgatgggctcatgccgatccgccgatccgatccgctgggatctggtcttcgtcaaagattcctgtacacccagttcgtgatggttggaacgtgcaattgggtgtgaggcgcgtgctgcggctcaaaaaaaagttcgaccattaacaacagctggcctagagcaggtcgctcgtgcgtttcgaggcgcgttggggcaacgaaacaaacggactcggagcgtctgtgtgcacacacaaatcgatcgctcagagtccagatcaaagtaaaactccattacccctctcttgcaatctgccggtgtgcggtcgttcattttcggaacttcccccccgctccgtcagtcgacactccgagcacacccggcccccccgccctaccatgaagaccgcatacatcctcctggcccttgccgtctgcggcattggagctcaggtccgcgccgatgacgccgtgcatgactacgacaacctggtcgcaagtgagtgtaatggggcaccgaggcccagtccgtccggcaccttcccatggcgcacgcgagccaccaactgacatcccatgcctcctcccatcaatccacagccctcactcagaacatcctgggcaacgtcaaggacgccgcgagtggcctgtccaacgtcctccccaacaccgccgagctgcagtccgaggtgtccaccctgaccgggcagctcgagaacctgtacaccaccttcgagtcccagttctgcactgaggccgagttcgactttggtaagcggggctgagggcgatcgggatgtgccccaacaccgcgcttgcgggccacctcctcccgatcaacggttggctcattcgaattcccccccgcccacccgcaggccgcaagaggcccgccactttcaccggcccctccttcgacatcaccttctccaccggcagctgctccttcaacgagactgtcttctggagtgagtcgagggctgagaggatgtccatgctgtacccgcagggatgcctcagtgcacctgccgtcagaatgaatgtgtgtgcgctgatgctgacggccactccccccactcctacccgccttcagagaccggcgagaaggagttgaactgcgtggagccctccatcgagttcaccaaggagcccgcggtgttcgtcagcaagcgcaagacccccatcaccttcacctccaagtactgcaacgtgaacaagacctttggcgaggaggagaccaccatcctgtactcctttgatggctccaagcagctctccgtcaacgacctgacctcgaagatcaccgacgaggtcaagcaggccctgagcaccctcacctcctccgtctcgtccctgccctccagcctgaccaacctggttgactccatccccaccccctccgagatcgcggcccagggcgcggcgctcaaggctggcctcctgaacaagggcaagtcccccgcggtcaagcccccggtcgcgcccaagtcacccgcggtgcccgtctccggagcgcgcgccagccccgcctactcctccgccctttaggccgggatggagtgcgggggcgctcgcccccctcccccaccgtattgcgcaaaggcagcacagacacccgacaccttggtcacatggcgccggccccctggccacgcgccgccttggaacccctgacagatgttttgctgtatttgtccctttcatttgcaccacgtttgattgaagtcactacccccggcagttggaaaggataaccccgcttggctgcttgtaaaccacactcgcatacaatgacatgttggaatggcaggggnnnnnnnnnngatttaaggtgggcaaggacttgttgattgtacatggggcggtgaggagtcccagagcatccacgatcacggatgcctgggacgcacccggcattcctgctgaatctcccacactctgcaccgcaaactctcgggcatgggctttacatgctgctcactcattcaccctgcatgnnnnnnnnnntgtacattgggcggtgatgagtcctggagcatccacgatcacgggtgcctgggacgcacccggcattcctgctgaacctcccacactctgcaccgcaaaactctcgggcgtggactctacatgctgctcactcattcaccctgcatgnnnnnnnnnnnnnnnnnaccacacccttcgatcagggtaggggcaggctcgatgctgggcaccactcggtgtccggtcgtcgccggctggcaggaccgacttcgagacaaggcagtccttgcaggtgcgctcactgatgggcatgctgtacctgcgcatcgagcctaatctacatgttacatgtaaactcacgcacctacaagcaggcatctcgggtctgagtgtgggcacagtggtggccattgccaagggacaccccgtgctccggttcgcagcccagagcacgctgagctnnnnnnnnnngctgatgggcatgctgtacctgcccatcgagtctaatctccatgttgcatggaaactcacgcacctacatgcaggcatctcgggtctgagcgtggggacagtggcggccattgccaagggacaccccgtggtccggttcgcagcccagagcacgctgagctttgtgctgctgggaaccctgtatggaggtgagttgccccagggcttgtgcctcacgtcctggtcgcagtgtaaacgggcccggtgtctccaaccctgtgcacccccccatggcaggtgtgcaagaagcatgccggctagtgaggtgccacgacagccccgtcaacagcgcctttgccggtgccgctgccggcagcctcattcaccgtgccaacggtgagctggtgtatacgcggctgttgttccatctggcagccatgccgctccgggccccatccgtctggtactggagcttgtgccagacccctggcccccatcccccttcccaatcacacgatggcgcagggaggcaccccctgcannnnnnnnnncgctggagcttgtgcccggaccctggcccccatcccccttcccaatgacacgatggcgcagggaggcaccccctgcacggcgccctggcctacggcgccatcgccaccgcggcgcatgctgcatcggccgcgtggcggccagacgagacgctgcgggacgtgctggtgcgcattgacctcctggacccccccccgcccgaggtcctggccgcgcagcgtgcgcagcgggacagcgagctggcggcgcgagaggcgcgagaggcggagaccgggcccggctggctgcggcgcctgggggacgccatcggcatgcggcgcatgagcgaggccgagtgggcagagtacactgcannnnnnnnnnacagcgtgacagcgagctggcggcgcgagcggcgcgagaggcggagaccgggccgggctggctgcggcgcctgggggacgccgtcggcatgcggcgcattagcgaggccgagtgggcagagtacactgcagcccaggacgagaagcagcggcagcgggtgcaggcggcgctggagggcaagacctcgcagccgcggcggggcggtgtgtttgactgaagggtgcctgccgtcctcgattgctccttctcttgctcagactcctttgcgctcttgctcggctacatgatcccacgggaatcgcagaacatgggaggggagggcgctgccgcccaccgggtattttggaaaatgggtgacgcaggtcgttgtggagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaggactggtggagtagggacaggggtatagaattctcgaggtggcaggtggttgcaccaggtgtttctccagatgcacactttcacaggccgctggcttggtggctctgttgctcctctgcctagtagacagattcccaccaatctatgcatccccaaaccccatagcccttgcgtgcccccctctataggatggcagtcccggtcaccatgcggtcttccctcgcaatcgcctacctgggatgtgccactgtaaaggnnnnnnnnnngccaccgccccaggtgacaacaaaccatcgagcaaggtcattggtgatacacgtacgccgggcagtccccctgcttccagcagtgtgcagcctgagcgctgaatgggagcccctggtcaaacaccgtgtgacgagccttgaacctgatggagggagtggggtggggggtgtgcctcgagatcgacgaggggctgtgtagtgacgaaggaatggtggagtagggacaggggtatagaactctcgaggtggcaggtcgttgcaccaggtgtttctcccgatgcacactttcacaggccgctggcttgatggctctgtttgctcctctgcctggtagacagattcccaccaatccatgcatccccaaacccacataacccttgcatgcccccctcaataggatggcagtcccggtcaccatgcagtcttcccttgcagtcgcctacctgggatgtgccactgtaaaggccagagcggcggcaccgcagttccaggcagccgattgcggtgcgccgtggagatactccagctccatgaccatggttgcggccagatctaggaaggcatcctgccacgcaggcacgagcaaagggtgatgagattatgcatggtgcctacgcaaacttggagcgcagtaccctccgggtgctgcacaccggcagttgctgagcgtaaagagaaggtaggtcaaagcctggtaggtgcggtcgccgagcccctgcgccatgactgtaccttggtgcctgcgacggcnnnnnnnnnnacaggaccctccgggggctgcacaccgacagttgctgagcgtacagagaaggtaggtcaaaggctggtaggtgcggtcgccgagcccctacaccatgactgtaccttggtgcctgcgacggcgccgccgtcaaccctcatgccgtcggtcctggggggcccctccccactctcgtagcattcctgcagggcacggtacgatggtgcgattcctcgccgttctcccggcgctacatgacgccatgcatcaggtgcacattccgtcccagtcatccggctccgagccacatcagacactgcagccccccagggtgcacccctccgctttccggtccatgtcctaggacacaggaacacacgagaccgacgagccctgtcatctggcatccaaagtacccccatttcccccacctgctttggcacagcgtcagacccttcctggaccacgccgacccacaggtcgtgttgcttgcgctgctgggcaaaccattcccagggggccttggcaaccaggccgtccgccaggtccaaagccagcacccacgacacactgatccctgggccggcgagccagtcacggtacacagcccagcgctcatccgacaggctccaggaggtgtggctcagcatcactcgctggaagccgatggccgctgtggggatggcggcagaaaggggtgggcgtccggggctggcatcgcctgtcccgtggcatatgggcccacacagcgcaatcgcccaggcatggtccaggtgggctggtcccannnnnnnnnngtggcggcagaaaggggtggttgtccggggctggcatcgcctgtctcatggcacatgggcccacacaacgcaagcacccaggcatggtccaggtgggctggtcccagcaccgatgcccgcatgggtcagcctccccccttgcgtctcctctcacgggactgtagttcagagatgaaggcggggctcagcccgtcatggaagaccaccgcgggggtgccaaggtgctgcacgctggagtgccagcctcgcacgtatgccaggtcatctgggggaatggcgccgccctgcagtgnnnnnnnnnnagtggaaacaagcatggggcattgccccactcacggatcgcccaagcccactacgacccagtggcctcggagccactcaccacatnnnnnnnnnntttggccggctcggcagtgaggcgcggtgagcgtcgtctcgacatcccacacaactccccgtcgcgagccgccaggtggcgcgaaggctgttgcggggtggaaacaagagtgggcattgccccaggcacagatcgcccaagcccactacaacccagtggcctcggagccactcaccacatgcttgtgacagcgcacaggatccacccgactggtgaagtaggtcgtgaggatgacgcccttggctgcaacctgcaggcgaggttcttcaaagcctatggctggctccctgggggatcgtggggggtggctctggtcaagaaagggggagcgcaggggtgcaaacgcaaaagagacaaatgggcaggcagggtgactggtcacggcgtgctttccttgaacccgaccagacagtccgagcatggctgagcagcggagccctcgtgtgctggaannnnnnnnnncgtcaagaaagggggagcgcagtggtgcaaacgcaagagagacaaatgggcaggcagggtgagtggtcccggcgtgctttccttgaagccgaccagacagtccgagcattgctgagcagcggagccctcgtgtgctggaatgggcaccacacccaatcgcatctcgcccaccgcatgcagccccgccagcttactgcggctgaaggacgtggtagccacgccgcaatgccatcagcctgcagaatggctcgctgttgaggcccagcacgagcaggggatcgattgtggcggtggcatggctggcatccagcaagagaatcacgtcgtctaccgagacatcgtcgaaggctgcaccggcctcaatcgcttgcagctgcttgatggattgaaccagcaagtctccctgtggatcagttgtgggtatccaagggagcgtgagggttgagtgtagtatatatcggagcgctgcaagactgtgcataccgagagggccatggcagtgcgccatcatgcacccacatgataccctagggttgtcctgtgctggggcggtcatcgttgttacccggtcttgcagagattcacagagtagcatgcaccacactgaggtnnnnnnnnnnatcgtgtgctgtggccgtcatcgttgttacccggtcttgcagaggttcacagagtagcatgcaccacactgaggttgcagggggtgatcgcaagccacaaatcggccacactcgcctcacctgtccctctgatgtgagttcctgcgaccgtcgcctggtagggccccgcaggacggatgaatggttctggcccatgcccaggaagaagatgacattcgcaaagccgagtgccgcaaggatgacatatcggagtcccctccttccctctcgcgctgatgaggtcggtgctctgggcgtattcccaggcgtaatcatgccggaatgtgacgagtgcacttttcctgttatcgtcatcaatttcgagaccgtccgttgaaagttgacatcagctcgtttgcatgccagcagtgccttgggcaacttcttaacacatgctctggatggctagcgatcaggtcgcagcttgtcataggaccctgccctcgtgcagtggtagtgagggttgtcgcacgcggaatccacggtcgtggaacagctgctggattttggagagtgtttgaggaaagggaggccccggcatgaatttccagcgcgcgatccaaacctcgccacacatgcgtgcacgctaaagagcagcacgccctttcaccaatgcggggattgtgacatcgactgaatggcttccgagctcgcatccgcattatgacctccatccttatcccgccccctggtcctctgctcaggtcaccacacggtgctctccatccatttcggacccatgaggctctcttgcggcggtgcgggcatgtctcaagccccccgcgccgcatgacagtctgccaggcgtccgtccaggaccccacctatgcccccacattctccatcaccagcctgggcatgccagagcaggggtaccatgtccccccacgcctcgcctgccccctcccacccagcaccatggcccgcgacccggtctccctccccctcctggtctacttctccggcatcgacggctccggcatggcgggcnnnnnnnnnnnnnnnnnnnnnnnnnnnnnnnnnnnnnnnnnnnnnnnnnnnnnnnnnnnnnnnnnnnnntgtttgacatgcggcacctgctcaccgcccgcgccgaccacaccccctttgccgacatggtcggcctggtggtgagccagctggaggcggaggtgggcaccgcgtcgcctgcgcgcccggtgtacctcctgggggaatcctttggcggcctcctggccctcgccgtggccgcagctgcgccccacctcgtcgacaggctggtgggctgggaaggggaggatgtcgttcctgagatatttcgaaagggcgaggggggcagggcccgagaggtgtgggagcaaccctcagccctgcatgcttgtgcnnnnnnnnnntgttcctggaacattttgaaagggcgagtggggcagggcccgagaggtgtggagcaaccctcagccctgcatgcttgtgccttgaggagtgcgaaggaatcatgatcgggcgtgtctcaggtctcttcggcgcttcaccgcggtgcagaccctgctcacaccccacactccgcatcccgccggcctcgctgcnnnnnnnnnntgaaggaatcatgttcgggcgtgtctggggtctctccggcgattcaccgcggtgcagaccctgctcacactccacactccgcatcccgccggcctcgctgcaggtcctggtcaaccccgccacaagttaccctcgatccatctggcccatggtggcgccctatcttcttcaggtggggggccggaagcctgccaggctggagcctgcctgggacccccccctggaagtacaccacttccacccacgccgcagcttatccgggtggcgcaggcgcctccatgtcccccccctcctctgtccttctgcagacccccccggcgctgtacaagtctgtgctccccctggtcatggccccgctgatcggcaacccggtgagcctgctggcggccggcgtgcgggacggcgcggggcaggaaagcgcggcgcggcaggccgccgccctgctccagacggcgcgcacgctgtgggcccagctgccgcgcctggccgacgtgctgccgcaaggtgcagagggcgatgatcgcgtggcggggatgacgtgcgccatggtctggagacgtgcgaccgagccccgaccctctccacacccatccccccgcccgcccgcagagaccctggcgtggaagctggagctcatccgccaaggctgcgagcacgtgggccccctccttccgcgcatcggccagcgctgcctgatcctgatgggcacgcgggacatgctcatcccctccggttccgagggcccgcgcctggcccgcctgctgccgcgcgcgcgtctgaaggcgctggagggcgccagccactctgcgctgcaggagatgagccagggcctgggcgcggtgctggaggaggagggcttctacatccggcacaggcgcctgtccgcgccgctggagtccagggccagcccggggggtcgtggggaggcaggccccgtagaggtccccggcgtagccgagattgacaggtgattgtccgggttagggtgggtgtgaggtgggggcggagacgtgggtggatgtgtccgtctgatgggacaatctgcctgacacagtgctcgagtcccgacatggcggcgggtgtggctaggcgttccggcgccgccgccaaaccccgactcatcccaccggccccttcctactcctcctgaggccacctcaccccttctcaccccccccacccccccctcccttcaacacacaacacaggtacgccgccagcgccaccaggctgacgcggcgtctgaccagcccggtcttcctttccacctgcgccaccactggccggcgcgtgcgctcgctggatcacctcccccgccccgcccccggccgccccgtcctgctcgtgggcaaccaccagacgctgtccgccgacctgccggtactgtgcgaggaggtgctgcgccagaccggcgtgctgctgcggggcctggcgcaccccctgctgtcacacgaggccgaggcggagccgcgtgaggcgcgcccggcagggccctgggacgcgctgagtgtgctgggcggggcggccctgaccccgggcgggggcaggggcagctccttctcgcagatgctggagactttcggcgcggtgcgggtgtcgccccggaacatgttccgcctactgagcaatggggaggccatcctcctgtttccaggtgcgagggtcttgttctgaaggaagaaagggagggaggggtgagcacctgtggtccagcgctgctgttgcggggctgcggcgaggcggagtgcgcnnnnnnnnnnagagggtcttgttctgaaggaggaaagggagggagggtggagcacctgtggtcctgcgctgccgttgcggggctgcggcgaggcggagtgcgcacttttggagcagagctgcggttcttgacaaggccctggacgcatttcttcccttccacaggcggaatgcgcgaggcatacaagggcaggggggaggagtaccgcctgttctggccggacagatcaggtgagcagctgggcggcggcccacgatcctggaggctgtgtctgaggttttgggtgcatggatcctatcttcaatgctgggagcatccaaccatgggctgcctccatgagcgccttcctaccccctttgcaccatcattccctcatccgcacgcgcagagtttgtgaggatggcggcccgctttggggccaccatcgtgcccttcgccgcggtcggcatcgacgacagcctcaacatcctgctggatccctcccaggtccaggcgttgccctttgtcggcgatgccctgcgccggcggcaggctttgctgccacaggtgacgccttgggttggtgggagggacttggctttgggatcaacgggaggtcgatggctcactgggctgttctgagatggtgcatcgggctcgtggcatgtgcggctggatgggattgagcggaagattagaggggtaaacaagcactctnnnnnnnnnncggcatgtgcgaccggatggggttgaccggaagattagaggggtaaacaagcactcttcaagtacacacgcatcatacgctctctgctgaatcatgagttgcagcctgcgtatggcgccccgccccctcatgtcccggtccctgacatacccaggcgagatctggcccgatggcagatgcnnnnnnnnnntatacgctctctgctgaatcgtgagttgcagcctgtgtatggcgccccgccccctcatgccccgctccctgacatatccaggcgagatctggcccgatggcagatgcgggctggtctgatggcttcgtgccgcccgtttcgatcccccgtggtgcgccgcagcgactgtatttcctgttccaggctcccatccacaccgaccccagcgaggcgagggtgagatggccttcgttgctgatgcatattggtcaggatcaggcgcatgctgtgcttggcagggggcatgcgaagggctggaccgatcgagcctggcgtgccaaccaggccgcattccctcctcacgctcccccacctcccggctacgccaggatcgccaagcctgcgacgccctnnnnnnnnnnatgcatgccaagggctggaccgatcgagcctggcatgccacccaggccgcaccccctcctcacgctcccccacctcccggcaacgccaggatcgccaagcctgcgacgccctgcactcccgcatcaagggctcggtgcaggagggcatcgacttcctgctccaggctcgggctagcgacccgtatgccgcggccacgagccgcctgctgcgcgaatcactgcatcctggtcagccggcgccgaccttcccgctctagtgcagctgcccctgcatgcatgctgcagtggtgtgtgatgcaagtgcccacctgcacgcatgacccaggcctggctgcctgccagtgtgtattgctcttgcccattcctttcgtcccatgctcacaaccccggtaccgtgcgtgtccgccgaatcctgctcttcccctcccgctgctctcttctccggggtgcatgttttcatttggtgatgtgcatgccttggtcgatggacaggnnnnnnnnnnccctttcgtccaatgctcacaaccctggtaccgtgcgtgtccgccgaatcccgtttctcccctcctgctgctctcttctccggagtgcatgttttcatttagtgatgtgcatgccttggtcgatggacaggacgtgtgcgttggtcagaatacagggaatggacgaaatagagtcgtgtgcttgaggagcggcggccgtgacccagggtctaagagcttgacccaggctgcgtccgcgcaccataaaaaaatcagagggcccacccatcgtcctgtgctcagtcacccgcacccctcgagtcctcaggaggaggacaggtccggcacaaacatgctggtgtgagaggagggcgaggtgttgagcccgctgccgtcgccgcccagcgcgtcctccagccgcgcgtcaaaggcgcgggcgcccacgcgccgcacgccgcggaagcggctggtgcgctgcaccgccagcgcgctgtccttgcgcagcgcgcccaccacctggtcctcggagtgtgaggagagtgtgggcaggacgcgggagtaggtctcaggctcgtagttggtggccgccgcagggccgtgcagttttatggcggcgatgtcgtgggcgcgcgccgccgactccgcggtggggtaccgccccagccacaccgnnnnnnnnnnnnnnnnnctgttgtgtgcagggattccaggggagggtgaggaaggggggggtgggggggtgcgtgtctaggcggggacgctgggcccgagatagaatgcagggggcaggcagactgcacggctgtctttcctgcatgaaaagcacagctgccaaagacatcaagactacccacacggcacctgcaaggatgacaccctcccagacatcatggactccaccagtgtgccgctccaccacatccaaacatccttgaaacccttgaacttcccccgagcacctgcttgaagccgtccagcatggnnnnnnnnnngagacatcaagacctcctacatggcacctgcaaggatgacaccctcccagacatcatggcctccatcagtgtgccgctccatcacgtcccaacctccttgaaacccttgaacttcccacgagcacctgcttgaagccgtccagcatggtgctggactctcgccggtccacgtaggcatcccagaacaggctccacttctcgcggctgacgccgcgcatggtcccccctgcctgcccgccctcggcgccgcctacctcaggccccactggcgccgccggctccggcggcgtcgacatcaggtcctgggttaccagcgcggtcagcaggccgtgcgccgactggccgcgcaggtggcggccgctgggcagcgtgggaccgccggcctcgccggcggcc

SEQ ID NO: 47752 - DNA, 14536 bp, Chlorella protothecoides
  modified_base (310)..(319): a, c, t, g, unknown or other
  modified_base (967)..(976): a, c, t, g, unknown or other
  modified_base (2649)..(2658): a, c, t, g, unknown or other
  modified_base (3201)..(3210): a, c, t, g, unknown or other
  modified_base (3652)..(3661): a, c, t, g, unknown or other
  modified_base (3959)..(3968): a, c, t, g, unknown or other
  modified_base (4040)..(4049): a, c, t, g, unknown or other
  modified_base (4159)..(4168): a, c, t, g, unknown or other
  modified_base (5522)..(5531): a, c, t, g, unknown or other
  modified_base (5645)..(5654): a, c, t, g, unknown or other
  modified_base (5722)..(5894): a, c, t, g, unknown or other
  modified_base (6892)..(6901): a, c, t, g, unknown or other
  modified_base (7713)..(7722): a, c, t, g, unknown or other
  modified_base (8150)..(8159): a, c, t, g, unknown or other
  modified_base (8350)..(8359): a, c, t, g, unknown or other
  modified_base (8897)..(8906): a, c, t, g, unknown or other
  modified_base (9404)..(9413): a, c, t, g, unknown or other
  modified_base (10460)..(10469): a, c, t, g, unknown or other
  modified_base (10714)..(10760): a, c, t, g, unknown or other
  modified_base (10827)..(10836): a, c, t, g, unknown or other
  modified_base (10962)..(10971): a, c, t, g, unknown or other
  modified_base (11100)..(11109): a, c, t, g, unknown or other
  modified_base (11845)..(11854): a, c, t, g, unknown or other
  modified_base (11996)..(12005): a, c, t, g, unknown or other
  modified_base (12062)..(12071): a, c, t, g, unknown or other
  modified_base (12409)..(12418): a, c, t, g, unknown or other
  modified_base (13422)..(13431): a, c, t, g, unknown or other
  modified_base (13911)..(13920): a, c, t, g, unknown or other
tatcttcggctcgtgcgaagcatacgccgctagacgctcacaaccaagtgacgaaataccacgatctacccagactacagtatgctgacttgcatcacgagaatggatccctttcctcctgcaacggttttctcagagaggatggcttccatcacgccaatgatctctcagagaatgctgagcttaggtgcgagccgtgcatggtcgatcttgatttgacgagaccgtaattcaattcctctgagcagttggtcacagagtttgctggaggatctctcttacatctgagaagaaatacaaacatgacgannnnnnnnnntgttttctcagagaggatcgcttccatcacgccagtgatctctcagagaatgctgagcttagatgcgagccctgcatggtcgatcttgatttgacgagaccgttattcaattcctctgagcagttggtcaccgagtttgcttgaggatatctcgtacatctgagaagaaatacaaacatgacgatagcctgtgtccctagattataagacatgtaagtctggctccaatagcacctgttgtgatctcaatctgtgggaaaacgtccctgttttagatgaggagcaggagggggtcaggcaccatgcctcttttgagcgggaagcccgatctcacgacttgagagctgaagcaaaatggcgcagcatctgattgcagctgacaaggccgcggactgacagcatgatgacggccctttgcaagtttatcgtcgaccactcctaagagcgcgattagggcgagaagaggcggtgcccagtcgtccattcgagctccccgcctcacacccaacacatcgtttttcaataatcggatctcggctgattggaggccgtcccttcagcatcgctgttccgcagctagagccgagcattcaggaatcggtcgtgacatcggacttgggaagaagccctccctccagtgtggcgagnnnnnnnnnntttcacacccaacacatcgttttttaataatcggatctcggctgattggaggtcgtcccttcagcatcgctgttccgcatctagagccgagcattcaggcatcggtcgtgacatcggaccggggaagaagccctccctccagtgtggcgagtccagggttaggctggagtcaggcggagcccagggttcttcggccggagttgtgacgtcgaaccccgagccaaggagcgtgggcatgggaatgtcccggatatcttttgagctcaaagatgacctggaggcctcgcccagcgatggaatattgacagcatgcctggagggttctgctgcctccatcagccctgcgtacaatgcgtggaaggtgagaggcggtgaggggacgtagtggcgtggccatggcaatttccgtgagatgtacctgatgtgcagcccgtgcacaaccattgatggcaccagccagtaccggcagggtggtagagggccagaggggttgaattgcggttttctaagcctcagcagcaatcctgcccccctccatccgccctccttccacccacaatcgacccttctcaggcggagcatccatgccccatccagcaattcgacagcctcatgcgtcaggctgccggcaagctcgtcactgtcttccttgattatgatggtggggacggtgggagggggaaagagtctgtgcctgcgaggtgctggggtcgcctggacacgcagcgcccatccagaggcgtcacatccgcgtcatccaccccccctcgcagggacgctgacgcccatcgtgtccaaccccgaagcggcgaccatgtcggagtcgacccgtggcgtcgtgcggcggctggctgagctgttcccctctgccatcgtgtcggggcgcagccgactgaaggtccagtcctttgtccagctggcagagctcttctacgctggcagccacggcatggacatcacaggacccgcgccaggggccacggcgggggcggcgacctgggaggaccaggtcgccttccagcccgccgccgcttttcagcccgtcatggccacgctctgcgaagagctggaggagggtgagttcaaggggaaaagggggcaggagcaggccaggaggaggcgacaccatgaaatgggtgcaggcagggcaggtctcgccgggaagggatggaggctgcaatccactgttctggaacctgggtgatgataaacacgctgcgcttggcgtcctcgtcacccagctccccccgtgccgcgcagccgtgagaccctttcccggggctgtggtggagaacaacaccttctgcctcagcgtgcacttccgcaactgcgatgcccactcctttccgccaatcctgggcctggtggaggcggcggtggcctcccgctccgaccagctgcgcatgacccggggccgcaaggtcctcgaaatcaggccaaaggtgggggcaccggtggcgaggcacggggtgggtgggcgtctttggccctttcaagtcgggaggggcatggctcttcatccctggggcctgcccgtatcagcatcccatgcccagccagtgcccaccccggatcgacagcagcggtctgtgccttactacacacattcatgtgtgtgcaccttgactccaccaccgcacacccattgctcatgcagttggagtgggacaagnnnnnnnnnnccaccggtggcgaggcacagagtgcgtgggcgtctttggccctccaaagttgggaggggcatggcccttcatccctggggcccgcccatatcagcatcccatgcccagccagtgcccaccccgcatcgacagcagcggtgggtgccttcctacacacatccatgtatgtgccccttgaatccaccgccgcacatccattgctcatgcagttggagtgggacaagggcacggcgctgattcacctccttggatgcatggaccttgccgatgcggagcaggtctttgccctgtacatcggcgacgaccgcaccgacgaggacgcgttcaagggtaagctcgcatgggagggggaggaagggggcccctggacattgcgggagccgaccttcaaccgtgggccgcccctcagagtgccatttgggcaccaggtcttggctccagctgccacactcatgaggacgagctggcacagcaccggaaccccttgcccgcctgggcagaaacctgtggttgcgactcccagcctgcaggacgcgcagcttnnnnnnnnnntcgcaccgacgaggacgcgttcaagggtgagctggcatgggaggggggggaaggggggccctggacattgcgggagccaaccctcacccgtgggccgcccctcggagtgccatttgggcatcaggtccctgccccagctgccacactcatgtggacgagctggcacagcaccggaacccttgcctgcctgggcagaaacctgcggtcgcgactcccagcctgcaggacgcgcagcttcctttgatcccgcctcaaactcccaccccctcctgcgcagtgctcgcggagcgcggcctgggctgcggcatcctggtcagcacccacgccaagcccaccgcggcgtcctggtccctgcacagcccgtcagatgtggtggccttccttgagaagctggtgacgtgggggcggagcggcgccaacgcgtggcagtccaagcgctccnnnnnnnnnnctcggatgtggtggccttcctcgagaagctggtgacgtgggggcggagtggcgccaacgcgtggcagtccaagcgctcctgcaagggatggcacatcgccgcccggcccactgccgccgccgccacgcctggcctcccaccccgcacgcccacggcaccgacgcccgtggcgcggacgcccacgcaggggtgaccccgctgggctcgaccacccccaccccaggtatcttgagcggtcagccagtcaatgtgaaggtccaagcagcatgcaggtgccagaggggcagtcgctcgccgnnnnnnnnnntgccgggcctcccgccccgcacgcccacggcaccgacgcctgtggcgcggacgcccacgcaggggtgacccnnnnnnnnnncatccaggcatgcagcgctcaggagccctgctgctgtgttgggctgctgcctgcttgagcttgggcgagttggctttcgggatcctgcagcgccgcctcatgccgcctcnnnnnnnnnncggacatctctcctcccttcctctcatcatgctccagctctgtgtgctctaacagcagagcggtacgtccccatgttctcatctatacctgcagtcccctctgcagacctctctccctggtaacgaattgatgcgcacataagttgggggtggggccaagtgtgacagtttcagggtagcctttgccagccaaggtgctggggtggatccaggcatgcagcgctcaggagccctgcggctgtgttgggctgctgcctggttgagcttgggcgagttggctttctggatcctgcagcgccgcctcatgccgcctcctctatgctgtccaaccgactgcgttgcgtgcaaggggccgggggagtggtggggctggagcatgtcccccaggcactcatgccctgcatgaatcctttgccgggagggccagtggcctgaggaaggagccagcaccctcacccacgtgcccggccccatccgcacgccatccttcccccaaagcgagtcagtgcatcatgcagcgcaggctgctcatccgggagcgcgcacccgaaggagccgttgttgtgcaccgtggggtccaggtccggggtcaagtcggcgggcatgcgcgcatcgtacaggtgcagagcatccgacgcctcgccggcgtccatgtgcagcagtcgcaggaagccctcaaagtccatgtcgtccgcatctggcaggggtttgcgtgtgtggaggtggtggtgggtattgacagggtttgtggagaggggatggcaggtcacgtgctcgcatcgaggtcgacctgcaccggcgctggtgacgcaggaggcccctgccttgtgtccgcatgttttggcccacgcttcctgccctcccccctgccaggatcgagagcgcctgcgcgcaggccccgccacatgcttccgcagctcaacccgtcttcctcaactccacgcccaaagcgagcgcacgcaccagcgtgcccggcctccaccatcgcgtgctccacggcgtagtccacctcggccgccggcagcttggagcgcagcacgctcagcagcgcatcggcgtccacgcgcccatccttgtcggtgtccagccccgagaaagcgcggcgcgcacactccagccacaagtccctgtgcgtgtggatggggtatgggtggggcatgggtggggatagggcgggggtatgaatggcgcgccggatttcacggctccaccccgctgtcctggtcagcgcctgcctgctggtctgcacgtggccagagcgacgtgggcggccggagccaaccactgcgcccagaccacagaaccacgacacaaccgctggtcgagaggtctgcgagcctcgccccacccaatnnnnnnnnnntgtgctcacatcgaggtcgacctgcaccggcgcttgtgaagcgggaggcccctgcctcgtgtccgcatgttttggcccacgcctcctgccctcccccctgccaggatcgagagnnnnnnnnnncgcgtgtgggtgggttatgggtgggtttggggtgggcatagggcgggggtatgaatggcgcgccggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtcagagcgacgtgggcggccggggccaccaactgcgctcacaccacaggaccaccacacacccgctggttgagaggtctgcgagcctcgccccacccaatgtgcaccgcgctccccccccaaaaggaacaaagtcccccatacctgttggattgctgcatggcgccccagtccagctgacttgccacgaactcggaggggtggatggcgccgtcggcgtcgcggtccagctcgcgcagaagcatgctcacctctgagggctccaggtcgtagcccaggcggtgcagcgcctcgcacagcgcctccgccgacagcgcctcgccagggcggaaccgcatcttacgcatcaggcgcgacagctccgccggcgtggtcaccgtcaccgcgcccgggtccaccgaggctggcggcgcagcgcctgggctctgcgtgcccgccggccacgatgaaacggggcttgcgctcgcagcggggccaggggccgctgcaccagactccggagccggcgccgcgtcggactccgaggaccccgcacggcggtcgcccgcccccggcccggcctcgccgcccgcgtggtagctgggcagctccgcattgaaggtcacgcgccgggcgtggcccacatcctcctcgcccccgccctgcgggcgggcgggggggctgggcctacccagagcggccagggccgcagagcccccacgccgccgcccgccctgctcggactccggctcctccgggatggaggccggcagggacgcccccgcgctgcccggccacaccggcaccccgggcgcgccccgccgccccgcagggctcccaggccctgccgcggccggcgggtcggtgggggcgggccgcttctggcgctccttcctctcctgcttgtgcagcgaggccaggctgctggtgctgcgcgagccacgcatgccccccctcaggtccaggacggcctgcgtgggacggaccggcaagtgagaccagggtgctgagagttcnnnnnnnnnnagagccacgcatgccacctctcaggtccaggacggcctgcatgggacgggtcggcaagtgagaccagggtgctgagagttcgcagcggggcgtgctaggacgcgcccttgcgtcgcgagcgagcgctgtcaaaaactgccgcttgcccttccctaccctgttgttcaaggatgcgacgaggctggcactctgcagggaagctgttttcccactcactcccacactctgagcccaccttgtcaggccgcttgctctcctcctccagccgccgcagcaggcggtcgtagtcgctgccgccgtgggtcgaggtgtccagcgcgagacgggccgccttgcgctgctcgccaatctcctcctcggagcgggggtgggtgtgcaggtactccagcgccttggtcttgccgtgctgcgagcctgcaaggggtaactggacagggttggagtggtatccatgccgagcgtaccccgctacggcccgatgccattgctgtgacgaaatgatctcctgcacacacatcgctgtccgtgcgacaaccccaactccctctcgtcaaaacaagaccttctgagagccagtatcctacccatgagcgccagctccgacgcggcccggaggactctccagtactccttctcgccatgcgcgcttccttcgctgctgggagggccggagccgtcgcgcatacgtgcacgctggttcttctcgtgagcgctggcctgggggggaggatgggccaaaaggactcttgaacgcatgctcaatagggtttgcaagcccgataccgagtgcaagagccagcctgagattcagnnnnnnnnnnaggaggggccaaaaggactcttgaatgcatgctcattagggtttgcaagcccgacaccgagtgcaagagccagcctgagattcagcgactcatattctccagccaacctaccaggagcgacagcgcctggctggagggagagcgggcgaagaacctgcccccatggacagactgactgcggccgacgatctgctggaaatgaggaacgagcgggactgtcagtctcctagtacgtgggtgctggggtgggaagtgggaagtgacaagggcacaggctgtgagcctcacccaaaggaagcaagcacttcccctgcctcataaccactcggcaagccagcagcacacaatccagaccattgcctcgaccagtaccctgagggaggaggagccactgagactgtcggcccggctcagaatgctctgaggannnnnnnnnngcagaccatcgcctcgaccagtaccctgagggaggacgagccactgaggctgtcggcccggctcagaatgctctgaggatcatcgccgctgggtgacgcactgctgagcgtaggctccaaccccggcccgctctcgccgacctctgccaatttgcctgaatccttgctggcggccctgagggatgcagttnnnnnnnnnngactgctgagcgcaggctccaagcccggcccgctctcgccgacctctgccgatttgcctggctccttgctggcggccctgagggatgcagttgcccggacgttgctcaagtggggcagggcgacattggggagcacagcgcagaacggtgctcagccagaggatgtgaggctcgtgcgcgctggaactagctcgccctcccccaccctcacctgctgtagctggacatgccgtggacggaggggtcgagttggggcggcgccacctccaggagctcggcggcaatgagctccaggatgctgcgcttgagcatgggcgcctgggagaagcgctgcggtcggcaaaagggtgtgagggaggctcagccagaggcaaggaagtcggagacagggctgtgctgtggtggggcgcacagcagagagaggctgtagggcatgctggtgtgtgcaagggcgactcaatgcgtcagccgcccagaaccccggcacagccgggtcaagggagggtccctgctcccagggcgacggaagcgctgcggnnnnnnnnnngctcaatgtgtcagccgcccagcaccccggcactgccgggtcaagggagggttcctgctcccagggcgacggaagcgctgcgggacttggtcccgatggctggcagccgaccacatacctgcagacgttgtacgacggaggcggagattggccgagcattggttgtgtaaaaagaggactggagccaggcatggcccagcatgtcctttgcactcggccgcttcttgtggtcctgcaatacaacggcaatgggtgggggggttgagccaggagggcattacagcagaacggtgagacacgctgctgctgctgacaatcccccgccccaaatctcaagaacaggcgggcagctatgtatgaggggtttccgacggtgtgcgtgagagaccctgcaggtggagcatgcctcttcaacaagggacagcaagcatcacaccttcaccgcaataccctgacccaccttttcaagcagcttcctgacaaaatccttgccttccnnnnnnnnnnatcaacaaggacagcaagcttcacatcttcaccgcaataccctgacccaccttttcgagcagcttcctgacaaaatccttgccttcctcggagacctcgctccatgcagaagttgtgaaggagggagtgtccgtcagaatggacctccaaatgagggacagggagggtgaattggggttccgtcggtcgttaaatgggagcacccctggaataggaaggaggggaggttgggagggtgatggaaggtccctggatgtaccactcgcgaggctacggtgttggctttcatgccaatgccaagcccacagcctgctggcagggcatggctgatctgtcaacctcctttgggacctggccctgcctacagccccgccctgcgatgactcaccgcttagaagctggtatgccatgaccccagcagcccagacatctgaggcggggtacacatcagaggacagggtctctggtgccataaacctgcaggccgcattggaacttgaatgagcttttccaatgggtgggggtgggggtgggaggggggctgaggagcccatggcaagtgtgcggcaccgtaccagggacggatgcacgaagcatgcaccaggcagcttagctaactgctccccgctatcctcgtcagcgcagtgcaggtcaagtccagcatccgcaccatgtcgttccctccaggccgaggtctgtgcgggggagcttggcggggtcatagaatactgccagcccaaagtcaatggccttgaggggggagtcgatctcagtggtgaggagcatgaaattgcctgcggggatacaacaggaaatctgtgaggaagcatgaaaacccgatgccctggacatcaggtttgggttgaattccatgaaacacacagctgttccataacaggaaatttacgacatcttgcaggtgcggggtctgggaatgccagatgatatcgagcagacaaggttttctaagcattcccagctgattgactacacaccatccccagaaggaggggatgctgatggaagagccctgccctgaaaggcacnnnnnnnnnnaatatgatatcgagcagacaaggtcttttatgcattcccagctgattgactacacaccattcccagaaggaggggaccctgatggaagagccctgccctgaaaggcactcagccgtgcaacaccaatcagcaccagtgcctggctcacaggactgctaccctgggaacatacctggtttgatgtctcgatgcaggatgtgcagggagtggcactgagccagggtgtacagcacggatcgcatatnnnnnnnnnnnnnnnnnnnnnnnnnnnnnnnnnnnnnnnnnnnnnnnatggggtcggagacgcagaagcatatggattctgcgtcaggctccagcgtgcaacgaacatgacagnnnnnnnnnngatgtcctcatcatcctcgtacgcgcccttgaacaccaccacactgtcggtgtggtgggggtgggtcggagacgcagaagcatatggagtctgcatcaggctccagcgtgcaacgaacatgacagnnnnnnnnnncgccccgtgtatggtgatcggggtgacacacgccccctcacccacaccggtccagctcaggtccaccgtggtcccttccccatttccacatccagattgtacctcagggttccacgcaggcgtttgagnnnnnnnnnntgccccgtgtatggcgatccgagtgacacacttcccctctcccacaccggtccagctcagggccaccgtggtcccctccccatttccacatccagatcgtacctcagggttccacgcaggcgtttgaggatggcaatctctctcttgatgttgtcgatgtgtgcagcctgcttcgccgcagacaggttggggatgttcaaccgcttgcacacgctcttgcaagcatactcctgaccagttgccttctcggtggccaccctgcatcatcgccaggcatcggttgctgttgtgggggtgtcgcgctcgacgccaggggtgagagcgggtggaggaggagcagggcaggcccccagccgccccagtacctcacgaggccgaatcccccttttccaagggtcgccccgagttcaaacagggaatcaaagttctttgggagcccagcgtcgagggcctcgaggtcctctttgggtttgacgtcccagatatcgaccctcatcgtgggaggcttctgtgcccgaacctatcaatcaaatcgatggttggaccatgatctcgtatcacaggtgaaaatcggtgatgccgacaccagtttatgcatcaacaagtgctcctaaagagaagggtaatgttttctaccacccggaacctacatgtgggttttgcgcgctctacatcatgggccttcatgctgtacattgggcacacagccgtctgccgggatccattgcgcctccgnnnnnnnnnntgcgcgccacatcatgggccttcatgctgtacatcgggcacatagccgtctgccgggatccattgcgcctccgacacgtagatcgccgtcggaaaagcatcgtgcattcagtagctgcatgaaggaggcatagccgccgagnnnnnnnnnntccccagaccctcatgcagaccatcgtgtcgcacatggaagcctcgggtgtatgccnnnnnnnnnntgtcggaaaagcatcgtgcattcaatagctgcatgaaggaggcatagccgccgagaggacagctgtgatgacagtgggtgtgcatgggtatcacaccaccttccaagatccacatggggtgcgtcgggacttctcgcgagcccccagaccctcatgcagaccatcttgtcgcacatggaagcctcgggtgtatgcccttgcgaaagggaaggcggacagctcgaagaaggcgagtatttgcccggcatcattacgaaggtcaactgcgagcgggcacttgacgggctctggatcttcatgcctccacggcacatgcagtccgcttagcagctccctgnnnnnnnnnntgggatctggatcgtcatgcctccatggcacatgcagtccgcttagcagctccctgctgaacgcgcaggaggatgaacgcggtgcgcctcacgacaagccacatcagggtggcctgactgccagcctgctgttcaatgtgagtgcatggggggactggttcataagggtgttccagatatatgcacactagtcccccatcccaggttcccattcaccaacgcacaggccgcctcctggagggctcagcggggccagactcattgcatcacatgtcagggaaagggccaggtgcaatgcccccagtgcaaggtatggtgcaatgggtggggctgggagtcaccctgcaatggggcatgtgtctggatgccacggagcacgtcctcatccagcaccacctcagcgttccgcctttccctgtgcagggcacgggggtgggacctcgttcacggcaacccaccaaccccattcagcatgctgccaacaagatctccagcctggtgtccggaggcaaggccgatgacgtggagtggcgcaccagcaaccgctgctcgcgctgtcagggtaggggcgtgtgccgatgcgaagagtgtggcgggacggggcgaagagggccctcagaggaagaatcctgacccgtgtctgggtgagggcctgggagcgaacccctgtcgcccatgatgcgagatgagtgagagcgcttgagaagacatctcgttgtactggttgttgcacatgctggattgcaaggtgacggctgcgcacacccgctttcccagatgttgtgccaggccgtgtctgtttgttgctcccattcccaactcgagacctccatggcacccccgggcactttcactgtttcaccgagtcttatggcatgcaatcatctcaatgcgcgtactgggcctcgagggtcatttaaggcttggatgggaggcaattgggtgcacaagggcaatcgactgcattcaaataagggactgggcaggccctggtggctggatcnnnnnnnnnntaggcttggattggaggcaattgggtgcacaaaggcaatcgactgcatttaaatcagggactgggcaggccctggtggctggatcccagactgagccggcttgacacctgcgggattctcccgcccagcactggcagccctgctgctcagcaatgcagcgaaaggatcgacaggccggccattgctctgagtcgcgatcccagacggcttgaccgtgaatggatcactgtgtgatggggacggctggctgctctggccacgggcagcgtaggcctgctgcggctggtgtggggccaacggcagggctccccgctgccggggcgagggattggacgccacggggacgagggagagggaccccagcgacgacagcgtcccgccagacccctcccaccgctcctgctgcggcggttgtggcacggaggcgcgagcggggtgctggggttccctcctgccaggcgccgcgggcgaggtgtcggnnnnnnnnnnggcggcgggagtggcacggaggcccgagcggggtgctggggttccgtcctgccaggcgccgcgggcgaggtgtcggtggcggccagccagtctgcagggtctgccgctcccatggcgggcatcgcactcgccgtgcctggccgtgcctgggcgctcccggtgtggtgcggcgcagcgctggccacgctgccattctgcagcaggcggtaagagggtgggcgacgatgagcaggaaggaatacgcaatcatacagccgtttcccagcgagttcaaccatgcatccacccctccactgccaatgttcacagtgcgcctgcggacagcgcatggcacagcacagcaatcgccgaccagcgtaccacctcttccctgaacctcgggctgcccaattgcagcactcgccttccatatccccccccgccacacacacacaccttgtcggtggcgccctccacgacggcgaggagctcgcgcacggcgcgcatgagcgcggcgcgctgcgccgcgctgaggctgggcgccaccagcagcgggcagagcatgggcagcacgcagcgggcggccaggtccggcccgtgctggcgggccagcgcggcgcccagcgcggcggcggca

SEQ ID NO: 47753 - DNA, 61 bp, Chlorella protothecoides
ggctgggcctttggggcggagaggggcggggggtgccgtgctgctttgccgctttgcaggt

SEQ ID NO: 47754 - DNA, 61 bp, Chlorella protothecoides
cgtggggagcagagagtgcggcgggggggggtgtgtagaaggctttccgaggaccagccgc

SEQ ID NO: 47755 - DNA, 61 bp, Chlorella protothecoides
tccaccccctccacctgtcacagaggtgatcaaatcgtgccggttcctggggtgcgccgag

SEQ ID NO: 47756 - DNA, 61 bp, Chlorella protothecoides
ggatggcaaaaatctgtgtcaggggcaggggggcatacctggtcactcccacaagagtgcc

SEQ ID NO: 47757 - DNA, 61 bp, Chlorella protothecoides
cctcgcggtggttgtgcaggagctcttccgaatggtcaggcgggaggagggtgcggcgagc

SEQ ID NO: 47758 - DNA, 61 bp, Chlorella protothecoides
gtgagttacgaggagtttatggagtggctggctcctccacgcctctgagatggtccttgca

SEQ ID NO: 47759 - DNA, 61 bp, Chlorella protothecoides
agccggcgatgcgcggctagggccgccggggacgaccacgtctgccccttcactcctccct

SEQ ID NO: 47760 - DNA, 97 bp, Chlorella protothecoides
ctggcggccgcgggcgacggcctcgcccccggcgccggcctgcacccccttctgctgcccatgaccggcgacctggcggggttggggacctccgcgg

SEQ ID NO: 47761 - DNA, 61 bp, Chlorella protothecoides
atgaacttctcggctgctggtcgcggagaaacgcgatcgagctgccaatccgaacacttca

SEQ ID NO: 47762 - DNA, 61 bp, Chlorella protothecoides
gtgggagtgatcggagtggagagcgtcagggcggcatccggacccaacaggagacgagcat

SEQ ID NO: 47763 - DNA, 61 bp, Chlorella protothecoides
cctaagaggggaatcggcaggaacccagcgggccgacacgcggaaaaccattgggatatgc

SEQ ID NO: 47764 - DNA, 61 bp, Chlorella protothecoides
acgctgcgatcgcggcaaagctgcggctgggcctgacgccggtacggcggcagctgctgct

SEQ ID NO: 47765 - DNA, 61 bp, Chlorella protothecoides
cgacaccggtggtccagcggcaggggcggggccccaaactcgaaggacaacctccagcagc

SEQ ID NO: 47766 - DNA, 61 bp, Chlorella protothecoides
attgggccaggcatgcttcgaacgccggaggggacgggatccttcccaacttgcatatagc

SEQ ID NO: 47767 - DNA, 73 bp, Chlorella protothecoides
cggccttgcctcgtgggtggggggattgtcgagtgcagaggggggggggaggcgagcacaggcttggcccagc

SEQ ID NO: 47768 - DNA, 61 bp, Chlorella protothecoides
catcgatcgagactggacgatggttgacaggccacacactcaagccttcatcaagtccgca

SEQ ID NO: 47769 - DNA, 61 bp, Chlorella protothecoides
gatggacatgcatggacatgaacagagccggcacgcatgaatgggggacgcatggacatgc

SEQ ID NO: 47770 - DNA, 61 bp, Chlorella protothecoides
cgacgtccccgccgacgccttcgtggtgtatcagggccaccacggcgagcgcggcgcggcg

SEQ ID NO: 47771 - DNA, 61 bp, Chlorella protothecoides
gactgggaggatgcatgtggctgggcagggggcggtgtacatggtgcacccgagatgaact

SEQ ID NO: 47772 - DNA, 61 bp, Chlorella protothecoides
ctttcttgactgccccggctgaggcaggagggcatgctacgattcgcaccagcaaccttca

SEQ ID NO: 47773 - DNA, 61 bp, Chlorella protothecoides
gctcagcgtcaccgccagcgtccccgccgccgcggcggccacgcctacgcgcagcagcatg

SEQ ID NO: 47774 - DNA, 61 bp, Chlorella protothecoides
tacggcccatctccgtccccttcccccaagtccagccccagcccatcgcccaaggccagcc

SEQ ID NO: 47775 - DNA, 77 bp, Chlorella protothecoides
acacacagcgacggcccatcgcgcgccagatccacgacagcaccccacccacccaccggcgagaggatggcgggccg

SEQ ID NO: 47776 - DNA, 64 bp, Chlorella protothecoides
tgaccctgcagcgtcagccgccgcagccgccgcagccgcagccgcagcagcagccgcagcagcc

SEQ ID NO: 47777 - DNA, 61 bp, Chlorella protothecoides
agatctgctgccggaggatatatcagagggaatggacatgcgctggctctgggtcaagttt

SEQ ID NO: 47778 - DNA, 61 bp, Chlorella protothecoides
gtccagttgcattgggtggtggcggtggggggccaagggcaggggatggtgatgcagagat

SEQ ID NO: 47779 - DNA, 107 bp, Chlorella protothecoides
accccggtgcggatcctcagcggctgcgccgggcccgtaggcggcgcctggtgcgaggggctgcgcccggcggagccctggccggcctggttggcggccagggcatc

SEQ ID NO: 47780 - DNA, 61 bp, Chlorella protothecoides
cgtgtgcaaaaggatgagggggagggggggggatgcatcctctccctcggcccctcctctc

SEQ ID NO: 47781 - DNA, 61 bp, Chlorella protothecoides
actgctgcgccgcctgcgcgcgtgatgggggtgtcgggtggggagtgggggtcgggggaga

SEQ ID NO: 47782 - DNA, 61 bp, Chlorella protothecoides
catgactcagaggcagcatccaatggagggggtctgtactctcgtgatggtgtgacttcga

SEQ ID NO: 47783 - DNA, 61 bp, Chlorella protothecoides
cgcgtgagacgctcggtgaggaggggcaggggtcccttgttggcttcaaagactctgtccc

SEQ ID NO: 47784 - DNA, 61 bp, Chlorella protothecoides
tctgatggtagaactacacagtggacggggggttcactcccaggaaatgtaaagacaccct

SEQ ID NO: 47785 - DNA, 61 bp, Chlorella protothecoides
tgatgtgtctgtgaagtaggggggcggaggggattggtgatgtgtctgtgaagtagggggg

SEQ ID NO: 47786 - DNA, 61 bp, Chlorella protothecoides
ccgcccggcccgcagcatcgaccaacctggccgtttctaccaagggtttgagtacgagcat

SEQ ID NO: 47787 - DNA, 61 bp, Chlorella protothecoides
gcgtagcgctggccggcggggatgtggaggggctgcaggccctccaggcggtgcactgtca

SEQ ID NO: 47788 - DNA, 61 bp, Chlorella protothecoides
ggaaggcttggtctgcgatgcaggagcgggggttcaatgagacgctcagggctggaggaaa

SEQ ID NO: 47789 - DNA, 61 bp, Chlorella protothecoides
tacccggacggccatgcagcggaggcagggggcggcccaggggagcagcccatgtccctga

SEQ ID NO: 47790 - DNA, 61 bp, Chlorella protothecoides
ctgtctggtggtgtgattgtggatggggggggggaggtgggtgagcaagcgcggctcctgg

SEQ ID NO: 47791 - DNA, 61 bp, Chlorella protothecoides
cgacgcgctgcgcggcggcgcggcgcgcgaagcgctcttccgccgcatccagcgccagctc

SEQ ID NO: 47792 - DNA, 61 bp, Chlorella protothecoides
gggcggggcccccttccttgcggcgagggggacaagtcgggggggcgcgttggggtgcagg

SEQ ID NO: 47793 - DNA, 63 bp, Chlorella protothecoides
cacgccgccgcgagggcccgttgcggcgggggcggggggtggggggggggggggggggggggg

SEQ ID NO: 47794 - DNA, 61 bp, Chlorella protothecoides
cttccccttcgcccccttccatatggcagggggaagggatacacaggagcagggtattggg

SEQ ID NO: 47795 - DNA, 61 bp, Chlorella protothecoides
cgcccttccgtgctctgaaggtgtggctgggcgacgacctggttgggcacatacagctgaa

SEQ ID NO: 47796 - DNA, 61 bp, Chlorella protothecoides
ccctgcaagcccaccaccagtacaggcaggggcagaagggagctggaggacgtctgggaca

SEQ ID NO: 47797 - DNA, 61 bp, Chlorella protothecoides
actttaccgctactaaatgccgcggattgggttcgctgaatcaggttattaaagagattat

SEQ ID NO: 47798 - DNA, 61 bp, Chlorella protothecoides
ctccgcgctggctgccgactggctgctggggctgaagcgggccttgtgcgtgccctctgag

SEQ ID NO: 47799 - DNA, 61 bp, Chlorella protothecoides
agactggatctctttggttacagtgtcggggagagacctccaagcagaggaagcatcagct

SEQ ID NO: 47800 - DNA, 61 bp, Chlorella protothecoides
gcggcccgtgagggcttgcatcgcggcaggggtgctggggtttgcagtcggtgtctgcgtg

SEQ ID NO: 47801 - DNA, 61 bp, Chlorella protothecoides
cagccggcggggagagggagacggtggaggggcgcatcctgcgccacatctcccgcgtgtg

SEQ ID NO: 47802 - DNA, 61 bp, Chlorella protothecoides
ccaggtgtcgaaggctaggcgtaggactgccccatgtagagtggcaatccttgcagttcaa

SEQ ID NO: 47803 - DNA, 61 bp, Chlorella protothecoides
aaagtctggaaggtgagcctccagtggcggggtcatgagaagctggctggaggggggcaca

SEQ ID NO: 47804 - DNA, 61 bp, Chlorella protothecoides
acgacgaggacgaggagctgaagggcggggggggggccgtggaggcctacggcgaggaggg

SEQ ID NO: 47805 - DNA, 61 bp, Chlorella protothecoides
gtcgtgggcatggacagggaccggctgcgggctggggaccgggccaccgtgcgcttccgct

SEQ ID NO: 47806 - DNA, 61 bp, Chlorella protothecoides
ggcggggggaggaggcacgctggagggcggggtcttgggggaggggctggggctggccttg

SEQ ID NO: 47807 - DNA, 64 bp, Chlorella protothecoides
gccgctctgcatcccggaggtgcaagggcaggccgcccgctgaaacgaacccctcctgccccca

SEQ ID NO: 47808 - DNA, 61 bp, Chlorella protothecoides
gggccagggttgtgtggagggtggtggcgggcgcacctcggccatctcccagtgcgccctg

SEQ ID NO: 47809 - DNA, 62 bp, Chlorella protothecoides
gccggcggcggcaagggcgaggcggcggcgggggcggcgcgcacggccggcaaccctcgcgc

SEQ ID NO: 47810 - DNA, 61 bp, Chlorella protothecoides
gacgtcccgcccctcccggtgccggtgggggcgccacctggtgtgccaccgtgaagacaca

SEQ ID NO: 47811 - DNA, 61 bp, Chlorella protothecoides
tgaccgggctggcctcgcggctcgcggcgggggccggcgcaccctccccacccaccgaatc

SEQ ID NO: 47812 - DNA, 61 bp, Chlorella protothecoides
ttcctgcaagagttgacgtgtggatgggggggcatctgaatatgggggtgtgttgcgatgg

SEQ ID NO: 47813 - DNA, 61 bp, Chlorella protothecoides
gctcacctggagaggcaggaggagggggggggcgggtgggaacgccccagctccagcaagc

SEQ ID NO: 47814 - DNA, 61 bp, Chlorella protothecoides
aaatgcacggtatattcttttcagcggcagggcaggcgcagacaacgctacatttctcagt

SEQ ID NO: 47815 - DNA, 61 bp, Chlorella protothecoides
tcgggcttcagagccagggacatggctgggggcgggccaggggcgcactgccgccgctggt

SEQ ID NO: 47816 - DNA, 61 bp, Chlorella protothecoides
cggatggtgatgggtgctagaagggggggggactagcccgggtacacggcgcgtaaggagc

SEQ ID NO: 47817 - DNA, 61 bp, Chlorella protothecoides
cgacaccgaaaagttccaggagtggctggggaagctgctttcagagcacggccccgacatc

SEQ ID NO: 47818 - DNA, 61 bp, Chlorella protothecoides
ttccaccgcctgccgggcatggcggggagggaccgcgtgctgagcgtgtccggtaccgctg

SEQ ID NO: 47819 - DNA, 61 bp, Chlorella protothecoides
ccaggccaggcattgtcatggcaggggcaggggggtctcatcaagtcgcaaagggaacgtc

SEQ ID NO: 47820 - DNA, 61 bp, Chlorella protothecoides
ggggaagaagttcactggggcggggcgggggtgcttgctgtttgggccgcgccccctgtcc

SEQ ID NO: 47821 - DNA, 61 bp, Chlorella protothecoides
acgtcgtggatgggcgacaggtgaggggggggcagattttgggggactggggaggagtgtg

SEQ ID NO: 47822 - DNA, 61 bp, Chlorella protothecoides
gcaaggtgccggcgtggtctggcggggcggggcctgcacccggccgagcagcccccgctcg

SEQ ID NO: 47823 - DNA, 61 bp, Chlorella protothecoides
ggcctgcgtcgctggggctgtggcagggggggggacgatctgtgccccaacaagtgaagag

SEQ ID NO: 47824 - DNA, 61 bp, Chlorella protothecoides
attgaatgtcaggtgcacgactggcaggcggcaggcctgagcaagcccaggccctggttgg

SEQ ID NO: 47825 - DNA, 61 bp, Chlorella protothecoides
gggtgatggtgctgcaagatcacggcaggggcctctcgccctgcatctgcctctggcaggg

SEQ ID NO: 47826 - DNA, 71 bp, Chlorella protothecoides
ggatgcccgtctcgccctgggcgtttggaatggtgggcagggggacggggggggggggggggggggggggg

SEQ ID NO: 47827 - DNA, 61 bp, Chlorella protothecoides
ggagggtggctcgaagcggcacggcagggggccaacagttcataccagcaatcctgggcct

SEQ ID NO: 47828 - DNA, 61 bp, Chlorella protothecoides
acaggcaggtgatacagatgttttggcggggggggttgctgcaggccgcgcaagtcagagc

SEQ ID NO: 47829 - DNA, 61 bp, Chlorella protothecoides
ccttcccgcaggtgcgtggctgggcagggggggggaagttgcatgcccggcagctggaagt

SEQ ID NO: 47830 - DNA, 61 bp, Chlorella protothecoides
aacaatggtggcagcttcaatcatggtagggcgcagtggagtgccatcttcatttacccat

SEQ ID NO: 47831 - DNA, 61 bp, Chlorella protothecoides
catgtacactgttgcactgcttgggggggggggccttgggaggcgcgaagggctgacgagc

SEQ ID NO: 47832 - DNA, 61 bp, Chlorella protothecoides
cagtctggcggagcagtgggcggagcactcccggcgcggcggcgccgcgccgccgctggaa

SEQ ID NO: 47833 - DNA, 61 bp, Chlorella protothecoides
ccgatcttgatgaaggtggggcccagccgccccagcccctcccgcacccagcacgcctggc

SEQ ID NO: 47834 - DNA, 61 bp, Chlorella protothecoides
gcattacagtcggatggcattgcgtcgaagggggctgttgtgcgagggcgaggcactgaaa

SEQ ID NO: 47835 - DNA, 61 bp, Chlorella protothecoides
gggcatggcagcaggctccagacattgggggaaccggctcttcatccattgtctggagcag

SEQ ID NO: 47836 - DNA, 61 bp, Chlorella protothecoides
gctgggggagtcctcgggggaggggctgggagagtcctcgggggaggggctgggggaggcc

SEQ ID NO: 47837 - DNA, 61 bp, Chlorella protothecoides
gtgacaaagcgtggcctgcacgcggcggggggccctggccctgcccaaccaccgagatgca

SEQ ID NO: 47838 - DNA, 130 bp, Chlorella protothecoides
ctttggcggcggcggcttcgaccgccccgccaaccccaccacacccgtgcccgatggcggtgcgctgatccggctgcacgagctgccgccgcccacgcccgcggaggagctggcgcgactgacctaccag

SEQ ID NO: 47839 - DNA, 61 bp, Chlorella protothecoides
ctggagccaggtggactcagcggatggcggggaggatgcgcagttggcgacgtgggtgaaa

SEQ ID NO: 47840 - DNA, 61 bp, Chlorella protothecoides
tcattactagcaggatgaaaatgtgtcgggggcgtgtgtcgccccttgtgagttgtgccct

SEQ ID NO: 47841 - DNA, 61 bp, Chlorella protothecoides
gggaccgtcgggaccggaagcgagagaggggcctcactctgtgcagatgcctttccaaagc

SEQ ID NO: 47842 - DNA, 61 bp, Chlorella protothecoides
tcctgggtgctggtgacggataggcagggggatgtcgccatgatgtgcgcgcacgcccaac

SEQ ID NO: 47843 - DNA, 61 bp, Chlorella protothecoides
gatggttgcggatgtggctgcgtctcggagggagggtgtttatgactgtgtgtgattgttt

SEQ ID NO: 47844 - DNA, 61 bp, Chlorella protothecoides
agagggctgccattcctaggcacagagcagacatgaggtaggtgtcggggaggtcatcgtc

SEQ ID NO: 47845 - DNA, 61 bp, Chlorella protothecoides
ggcgtggccccgtccaggcgcatgcggcggggcaagcgagggtcatccttcggattgcaca

SEQ ID NO: 47846 - DNA, 61 bp, Chlorella protothecoides
tcaggcaggtcgagcgacttgcggcggggggtctccgcggcgctcattcggtgaggagcgg

SEQ ID NO: 47847 - DNA, 61 bp, Chlorella protothecoides
cacaggcgtcgctgagcaggggcaggaaggggatgctggcagtgatttggcgaatgatagc

SEQ ID NO: 47848 - DNA, 61 bp, Chlorella protothecoides
gtcgggggccgggggaagggcgggggggggggagctgcaggacctgtcagcaagcgagggc

SEQ ID NO: 47849 - DNA, 61 bp, Chlorella protothecoides
gatctatggcggacggagagactgacgagggggggcaggattcgtgctgatgaagggattg

SEQ ID NO: 47850 - DNA, 61 bp, Chlorella protothecoides
ccgactgaccctggaaggggcgggccaggggggccagctcgtacaggacgcagcccgcagc

SEQ ID NO: 47851 - DNA, 61 bp, Chlorella protothecoides
ctcaggcacagggtcgccggcggggcaggggccgggaactcagcaccgggctggagcactg

SEQ ID NO: 47852 - DNA, 61 bp, Chlorella protothecoides
gaccatatttgttaagtttatcacgttcaacttggataccatgtggaggtccttggaacgt

SEQ ID NO: 47853 - DNA, 61 bp, Chlorella protothecoides
cgcacctctgcctgccgctggccaggcgacccctcgcggagcgcgagaggcgacagccggc

SEQ ID NO: 47854 - DNA, 555 bp, Chlorella protothecoides
  modified_base (106)..(115): a, c, t, g, unknown or other
  modified_base (191)..(295): a, c, t, g, unknown or other
ggcgacgactacacggccgcgctgaccgcgagcggcgcggtgtacatgtgggggcgcctggccggcgcccccgccgcgcagacggtccccctccccgtgcgcgggnnnnnnnnnnggcggcgcggtgtacgtgtgggggcgcctggccggcgcccccgcagcgcagacggtccccctccccgtgcgcgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcggccccttccactgcggcgcggtcaccgtcgctggcgagctcttcacctggggcgagggcttcggcgggcggctggggcacggcgaccgcgcctcgcgcgcctcaccctgcctggtgcgccgcctggcccccgcgcgcacgctggaggtggcctgcggcgtctggcacaccgccgccatcgtgcaggagagcacctccctgggcgaggtcaacccgctggaggccgccgccgtgctggcgggggctgtggtcgtcgt

SEQ ID NO: 47855 - DNA, 61 bp, Chlorella protothecoides
gggacgcgaccacgctgcccgccaggtcattgcgcagtgcgcacagcgcgtcgcccaaggc

SEQ ID NO: 47856 - DNA, 83 bp, Chlorella protothecoides
tttcttagaagaactttttgaagatttagacttagatgtattttttgatacagtttttgtttgcgttgttgttgctaaatctt

SEQ ID NO: 47857 - DNA, 61 bp, Chlorella protothecoides
cagcgctggtgcgagagaggccggggccggtggcgttcgtaggatctcaaaggctgggccc

SEQ ID NO: 47858 - DNA, 164 bp, Chlorella protothecoides
ttacatgcccatactagtcatcgtgtgtttttggtgggtttgtatcgtatcgttgacgtcacccttgacatcatcttcaacctttcctgcggtccgtgctggggttgtgcgatcagtctcttcgatattccattactccagtgatactaccgtcgatgcctaga

SEQ ID NO: 47859 - DNA, 69 bp, Chlorella protothecoides
aattttcgtaaaactaatttgaaataaatgaataaatctcagttaaaataaatgaaatttattttaact

SEQ ID NO: 47860 - DNA, 66 bp, Chlorella protothecoides
tggccgtgaagtggcagactacctggtcgcgcatgttgttgatgacatgctgatatcatggaccag

SEQ ID NO: 47861 - DNA, 61 bp, Chlorella protothecoides
ggggggttgtccgcaaggcgagccatcgccggcggggttgtccgcaaggcgagccatcgcc

SEQ ID NO: 47862 - DNA, 75 bp, Chlorella protothecoides
tatgttaatataatatactaaaagataaaactcctcctagtatattaaaatatttgataaaaaactaatttgaat

SEQ ID NO: 47863 - DNA, 68 bp, Chlorella protothecoides
atatatatatttgtattaaaaactacatttttaaaaaatcctaaaaatgtttaatactctctactcct

SEQ ID NO: 47864 - DNA, 61 bp, Chlorella protothecoides
acaaacagggtatcgtcccagcgagaacacacccgcccgccgtccctgatcacttcccctt

SEQ ID NO: 47865 - DNA, 81 bp, Chlorella protothecoides
tacgaaaattgaaaaataatattaaattctaatcattactacaataactctaattttcgtaaaactaatttgaaataaatg

SEQ ID NO: 47866 - DNA, 106 bp, Chlorella protothecoides
gaaccagcaaattttcttgttattgctttgttagtaatcattaattttcgtgactcttcatcccacccaacatataaaggtaaactatattgatcatccaaagcaa

SEQ ID NO: 47867 - DNA, 61 bp, Chlorella protothecoides
ctcccctctccacaccattcacatactcccaccctcccccaccaatccaccagacccacca

SEQ ID NO: 47868 - DNA, 78 bp, Chlorella protothecoides
caatactgaggcagcttctttgtctttgtcatgctttgccaggagcactccataccttcctttcagaatcagcagggg

SEQ ID NO: 47869 - DNA, 66 bp, Chlorella protothecoides
aaattataaaaaccatctatttatgaaatttttattatttgcatatacagtaataccatttgtttc

SEQ ID NO: 47870 - DNA, 101 bp, Chlorella protothecoides
cagattggtatattccagctaatgatgattctgcggcaacggttaaattcttactttctaactttcaagacgcaatactttctggggaaaaaattaataat

SEQ ID NO: 47871 - DNA, 73 bp, Chlorella protothecoides
attaaaatagtcttcaactagcttttttatttggggttttgtaagttttttatctatatcaaaactaaattga

SEQ ID NO: 47872 - DNA, 70 bp, Chlorella protothecoides
ccatgatacatgcaatgctgccataccatacttgatggcatactggacatgacgaggggtgagggtgggg

SEQ ID NO: 47873 - DNA, 131 bp, Chlorella protothecoides
gggggaagatgaaggtcttctgtcatgtgcatgtgtcgcaccagacgcatacacgccacctgctccataccggtgcaaaagttgtttgtcagggggtgcgtcagctgcaccaccgacagctgctgcggcag

SEQ ID NO: 47874 - DNA, 22345 bp, Chlorella protothecoides
  modified_base (897)..(906): a, c, t, g, unknown or other
  modified_base (1986)..(1995): a, c, t, g, unknown or other
  modified_base (2704)..(2713): a, c, t, g, unknown or other
  modified_base (3546)..(3555): a, c, t, g, unknown or other
  modified_base (4112)..(4121): a, c, t, g, unknown or other
  modified_base (4715)..(4724): a, c, t, g, unknown or other
  modified_base (5344)..(5353): a, c, t, g, unknown or other
  modified_base (5661)..(5670): a, c, t, g, unknown or other
  modified_base (5996)..(6005): a, c, t, g, unknown or other
  modified_base (6113)..(6122): a, c, t, g, unknown or other
  modified_base (7467)..(7476): a, c, t, g, unknown or other
  modified_base (7961)..(8024): a, c, t, g, unknown or other
  modified_base (8341)..(8350): a, c, t, g, unknown or other
  modified_base (8725)..(8734): a, c, t, g, unknown or other
  modified_base (9109)..(9118): a, c, t, g, unknown or other
  modified_base (9459)..(9468): a, c, t, g, unknown or other
  modified_base (10036)..(10045): a, c, t, g, unknown or other
  modified_base (10290)..(10299): a, c, t, g, unknown or other
  modified_base (10641)..(10650): a, c, t, g, unknown or other
  modified_base (10889)..(10898): a, c, t, g, unknown or other
  modified_base (11289)..(11315): a, c, t, g, unknown or other
  modified_base (11383)..(11392): a, c, t, g, unknown or other
  modified_base (11600)..(11669): a, c, t, g, unknown or other
  modified_base (11725)..(11734): a, c, t, g, unknown or other
  modified_base (11790)..(11799): a, c, t, g, unknown or other
  modified_base (11920)..(12113): a, c, t, g, unknown or other
  modified_base (12175)..(12184): a, c, t, g, unknown or other
  modified_base (12642)..(12651): a, c, t, g, unknown or other
  modified_base (12903)..(12912): a, c, t, g, unknown or other
  modified_base (13325)..(13334): a, c, t, g, unknown or other
  modified_base (13759)..(13768): a, c, t, g, unknown or other
  modified_base (14281)..(14290): a, c, t, g, unknown or other
  modified_base (15061)..(15107): a, c, t, g, unknown or other
  modified_base (15252)..(15261): a, c, t, g, unknown or other
  modified_base (15316)..(15325): a, c, t, g, unknown or other
  modified_base (15384)..(15500): a, c, t, g, unknown or other
  modified_base (16115)..(16124): a, c, t, g, unknown or other
  modified_base (16503)..(16512): a, c, t, g, unknown or other
  modified_base (17437)..(17446): a, c, t, g, unknown or other
  modified_base (17650)..(17659): a, c, t, g, unknown or other
  modified_base (18839)..(18848): a, c, t, g, unknown or other
  modified_base (19703)..(19712): a, c, t, g, unknown or other
  modified_base (20722)..(20731): a, c, t, g, unknown or other
cagcgagccccgcacccgccgccgccgcgccggcccaggcgacggccgcgcccctgccggcaccggcggcaccgcaggtctttgccatcaagtccgccgcgcagtccagcaccagcgagagcgcagagggcggcttccgcctggccgccggcttcaaacgcccgggcgacaagcctgtgagcagcggggcgggagagacggcgcccccggccgcgccggccacgccgccgcggcagcagcagaacgtcacaccccgccgcgtcagcttcgccttcaccgcgtcggcggggccggtgccccagagacacaccccggccatgtgccccccgccggggcccggccgcccgctgcccagcgccatggtgcaggcgccgggggtgatggcgccgccgcaccggccctcggaggcggaggccgcacagcacgcgaagcgggcgtcggcgggaccggtggcccccaagaggacgggaatggggggcttctgcaggctctggtttggctcccgcgccgaggacgactgaggaggaggggggagcatggtctcctgcaccacacccctgacccgcccttgccagaccctgaacgacccacctccgctgacgctgagtagccctggcaaataccaaggagctgccacttttccctctgcttgcagacaccacctttgcacccccctttttgtccttctgttctgagccccgcagtgttgacgatggatgccccatagtatgtacagcgagtattgcacctgaagcgggcgagacagtaacggtggaggttcagcaagattcgtacagaaacggtggtgtgatttggacagcacatggttctactgtacaggctgggtgcaactcatccccgtgactgtcgctgcaggacagaagtgtcccctggaannnnnnnnnngacggtggaggttcagcaagattcgtacaaaaacggtggtgtgatgtggacagcacgtggttctactatacaggctgggtgcaactcatccccgtgaccgtcgctgcaggacagaagtgtcccctggaatggtgcctctcatgggtcgataaagtccatgggctagaggggtgcaggtggcggcgcgggccctcctttccttggaccagcgccgtgaccctttgtccccgcaagccgcgcctccgcggccgctgcggccgctgcggccgccgcctccgggccctgccccgccctgcactggtgcacgatgctcatgctgggcgtgcgcaggatgggtggcggggccgggggtgtccccgggaccagggccggggggtagggctgccagaggccctccagcaggcccccgccgtgcgacgccgtggagatgggcagcaggtgggcccccgccgcgccagcgtccggcatcgctcgcagcgttgctccggggtcgctggacgggaggccccagcgctgcacgatggtcgaggactccagcgtcgccaccgtggcatgagagggcatggcgaggcgcagcaggcccagcgccagcgcctggcccacctggaggaaaggcaggattgcgcggagggggattcgtatcgtccatgggggtccaggactgcgaagtaatatgttcgctgagccagcatgcagagcgtgcgacgtaaaatacacagtcccaagcaacttctacgctgcgggctcgtcggcaggacaccggatcttgcctcccttcatcccccttggggcacgcaccaacaggccggacaggtgccccaggaaggagacgtggggcaccatgagctggcaggccgccaggagcagccaggggtaggcgcgggcagggatcgtgactgccccaaacaggctgcagatgtgtgggtgatgggaagtggggccttgaaggcaacagcccgttggggctcttcggcgcgcggaactggcatatctcggccagacccatgccttcaagccatgcccaacaccctccatgcaccccccacagctgcaccaacctgtaggaggcaatgtgcgcannnnnnnnnnccccaacaccctccatgcacccacacagatgcaccaacctgtaggaggcaatgtgcgcaacctctgcgtggaccacgatgagaccaaacagcacgcccgagaaacccagaacgcactgaaaggacggctgcgaccaactacggcgggtccgggaaggtgtaaagaggatggtttattggctgcagccaagtagtgggcccctgagcaagattcaacagaccctcaagaaagggtgctcaagggtcctgccatcaaacccagacgccaccttgaactcgctgcccaacgcccacctaagcaggcgccaaactcacacccaccccaaaggcggcaggcccgcggcgagggcgaggcccacatacaggcagttgctcagcacactcagcgtggccaccagccaggagagctgcacgctgcccaggagcctctcgaggggaacgcccacttgcagcagggcaaccatgttgaataaaaggtggatgccaccggtgtggaacagcgaagatgtcagcagacgccaggctgggatcgtgttggtgttggggacaggggggggatgggaaggtaggcgggtactcaaaggcaccctgataaggaggcgagcacatgtaagccatcacactccggtagcgctgcatggcatcacggcccacagactatcgtgacaggccgggcccctttgcattcaccttgcatgtgccgcacgacnnnnnnnnnntcctggtaaggaggcgagcacatgtaggccatcacactccggcagcgctgcatggcatcacagcccacagactatcatgacaggccgggcccatttgcattcaccttgcatgtgccgcacgacgcggtcggcactgaggcaaacgtcggtcatgagacctccaccaatgagggtggtgatgcccagcagcagcgtgcaggtgacgacgaggaccctgcgaacggaatgggtgcatacaactcaggggatgaggcgccatcggtacacacgcgatccgagcgcgctacggcccaaaggtgctccgcccttccccacctcgtgacgggggggatactcctgacccatgctcgcagaatagctagaggcgacgcctacgtggcaagtgattaagagacttgatcatatgttgacaagcggtacttccaggcatcggctaccacaggcacaccagcacacaccggcgcacgtcgccgttgtgagtgtgcccacctcagacgacatgatgaacgccggaacgagtagctagattgtcgtccaacacgccatattgatgatcagctcgtctcaatcgtgaaggacagaagtataaaccacattgcaaacgacagtcaaggaccgatccgatcccgcgcgctaagtgcatggatcacaaatgcaaggaactcaccagcgagtttcaacacaacgcatacgtaataaaacatatatatgcggagaaggattagcagctaggagaccagctggctgagtacccaaggaatggcgctgagtctttacaagctcgtgcgaccttttgcgtccacagttgtgggtacgggggttcggcatccaannnnnnnnnnagagtagctagattgtagtccaacacgccatattgatgatcaactcgtcttaatcgtgaaggacggaagtatacacaacactgcaaacgacctccaaggaccgatcccgcgcgcgaagtgaacggtgcatggatcacaaatgcaagggactcaccagagtttcaacctgtgtcgggcaatacatatatgtgcggagaaggattagcagctaggagaccagctggctgagtgcccaaggaatggcgttgagtctttacaagctcgtgcgaccctttgcgtccgcagttgtgggtacggggggtcggcatccaagtgcatgcaatgcaaagcctgatttcagattttagtaggagtggactggtaccactaaaaatgcgcaggtcgtcgactggctgtcttgcggctggagccggctgcaccactcaggacgagattgggagctggacttgtcaaagacagtgggtgggcaaacatcgagctccagcagcttaggaaatgtgactcaatacgcatacgaccgtacgccaggcgagccgaggcgcccatggaggtggctnnnnnnnnnnaggtgggcaaacatcgagctccagcagctcaggaaatgtgactcaatacgcatacgaccttacgctaggcgagccgaggcgcccatggaggtggctggggatttgagttcagagccactggaggatggcgaggacgacgacgatggcgagcaggacgaggaggtctcacgcaacattgacacggcgggttgtgactggtcagtggcgagggtggatgcgggtctctaactttgaagcagggttggcatggatgacctgtgcagatgagcatgggtactccgatgtccaagtcaggctggagggtactgttctaagatagacccacaccccccttcccattgcccacgacctgtcatcccctgcacccagggccgagaagtccctggccgtcgtccgctccctcctggccgacagccccgaagcctccctggagctgtatgccttccacgcccggccggcccagaaacacctgagcatccggctcgacaagctgacaggtaagcatggagggggagcgaaaggggcatggcaacgaatgggtgtgtcactggctcccctgctggtctccagggggacaccctctgcctcaggccnnnnnnnnnncaagcatggagggggggcgaaaggggcatggcaatgaatgggagtgtcactggctcccctgctgatctccagggggacaccctctgcctcaggccctcacctccagcctttgcaccccgatccaccagacccccggggttcgccaaccctggacgacatctccgacttcacgcggggcctgacagcggggctggaggaggcccttggcgaggaggtggctgcctccctgcagtacgaggtgtcctcgccggtgaggcgggtggagagtgtgctggcgtgcgtgtgtgtcagcgggcccccactcgctcgcatctgatcagccagctgttccgactccctgagcatccgaccacccacgcagggcgcgctgcgagcgctggccgtcccgcgtgagctgcaccgcttccgggacgcgcccatgacggtggcggtgcgcgccggggacgccgggcggcagccgccgcccccccgcgtcatgctgttcctgggcgaggagggcgtcgacaccacctggcgcctgctggacgtcccagagaactgggcggcgctgggcaagaagaaggggcagcgcctgtcccgcgccgacctagaggcccccgtgcgcatccccctggccgacnnnnnnnnnncgagaactggtcggcgctaggcaagaagaaagggcagcgcttgtcccgcgccgacctggaggcccccgtgcgcatccccctggccgacttgggcgccgtccagttctacctcgacatccagggactgtgaggcggcctggagcggcggcatgccccgcggttttccttggcgccacaatgccacagtcacctccacgccgcagacctgtaccccccccctgtccttgaagtacccattctcctctggcctgccacctgatagtgctcggcatcaacttgcacagggggggtcaccagggggcacggcnnnnnnnnnnccagacctgaaccccccccccgttcttgaagtacccattctcctctagcctgccacctgatagtgctcggcatcaacctgcacagggggggtcaccagggggcacggccctcacgtcccaggacgcgtcgcggcagtgccaggtggcgtcgtcccccgccgccgccagctcggcggccaccgcggcgtcaggcacggcacgccaggtgtggcacgcgtcgcactgcacccaggcctgctccgccgcgggtcgccccgcgccctccgcgccagcggggctcggccccgccgggtcgggccccacccgccccagccgcgaccggctcnnnnnnnnnnatccgccgcgagtcgccccgcgccctctgcgccagcggggctcggccccgtcgggtcgggccccacccgccccagccgggaccggctcggacgggcggcggccgaccnnnnnnnnnngctgggcggctttccagagcccgggctggcgggcctgccctcgcccgtccgcgcgcgcttgcttgccggtggggtctccgcgtcggagcgcgcgtcctcggcgccggcggagcctgggccgctgccgtccggggcggccgaggcggcgggggcggcgcgtgaggtcccccccgtgccgccatcccccggcccctcctcgtcctcactgggcccgctgtcctcatccgccgcctcgctcatggtgtcgcgcagctgacgccttgcgagggcagggcgtggcatgggaggggccgctgagggcacattccaccccgggcgcggcacagcgctgtgctggggtggcacgcctggaacctcctccgacactccccgccctccccctttcccatgccaccccccccttgcacctgtacacgtccaggggcttgccctggtagagcacgctcttccagccgtcgtcgccctgcttgtccggcgtgatcaggcgtttgacatggatggagaaggccgaggcgctgccgtaggccttgccgtcgtagcggatggtgccgtctgccagcagggccgcgctgtgcgtgctgcccttgtacagcacgctgagagcgtcggggcccggggtcagcaggcctgcgcccaccaggtcggccagggagacgggccaggcgcgggaggcgctgccgctggcctcgctggccgccgcggggccgctgctgcgggtcttcaggcccgactttcgcgctgcaggggtcttggcctccgcgtcctcggcgtctgcgtgttgaattggcgaggattgggagtgctggcgcggtgggggcggtcctggtcagcgaggcgggctgctgtggcagctagcccctgatgcactccgcattcaacacaggaggaagcccagcaccaccgctgggtcgcacctgcggggttctgtcccaggacgaagacgcggtgggaggtgccgctgatgaaggggcccgtcaggttgtggcccttcagccactctgggatggggtgtgatggggcaggggcaggcgacactgcggccatccctgggcagaagatagttcaatagctacgtatccgtctgtgcggttgcatgcaccgagaggcaagcgacgcacggggtcaagcttggcagaaggtcccgggagaacactgtacgccttgcattgacggatcacactcgtgaaggcctgccagacacgattgaggtgacagggagagtgagaagctcgtgattgttggtgtagggaagtggcctccgcagcttcctgctaaaattcgacggtgtcgtggaacctgcagggaggtcccggtagcgggtggtttgcgcgcgcgtgctcgcacnnnnnnnnnntccgggagaacactgtacgccttgcattcaccgatcacactcgtgaaggcctgtcagacacgattgaggtgacagggagagtgagaagctcgcgatggttggtgtaggaaagtggtctccgcagcttcgtgctagaattcgacggtgtcatggaacctgcagggaggtcccggcagcgggtggtttgcgcgcgcgtgctcgcacactttgcgattcttgacccatgaaacatggaatccttccccaacctcgcaaaaatgaactcatctgccttccctgcaacatcgggcttgcatctgcgccggcagggcatgggcgacaggcagggcacaggtctgagagagcccttgctgccagctgtagatcacaggcatgccacgggtatcctgcaagtccttgctcgcattaggcgatatatcatagagctcttggcttacatactatatcgaatacaatgtgcgtctgttgttgggcgagctttgggnnnnnnnnnnnnnnnnnnnnnnnnnnnnnnnnnnnnnnnnnnnnnnnnnnnnnnnnnnnnnnnncccctggcctttgatcccttccttccaatacatattgcagcgctcctcttgctgggatcagacagcacgccgcaactgtcccccactcagtcttcgaggtggctggcgctgaagagaagggctagcatacaatatgatgccgccgacgctacccatttggtgcgagggtcgggatacagtcctccagctggcatcccggggcgcatgagtgtagtgctcagagcgtggccggcacatgtacacttattttatacaccctccaggcattgctcgggaggttgtggaccgcaggcttccaaacggaggaagccatgccnnnnnnnnnncagcatacagtatgatgccgccgacgctacccatgtggtgcgagggtcgggatgtggtcctccagctggcatcccggggcgcataagtgtagtggtcagagtgtggccggcacatatacacacttatttcatacatcctccaggcactgctcgggaggttgtggatcgcaggcttccaaacggaggaagccatgccgcggagggtcaaagctgagtgctggaaggatatgggctggcagagcgatgatccggggcgtgatttccggtgagatgaggtgtgcctgggtggcccatggcagctgcctgctgacaatcctgcgagtgtgcaggcactggtgaaaatctccaactccttactgctcggtggaccttgcnnnnnnnnnngatcctgcgagggtgcaggtactgattaaaatttccaactccttactgctcggtggaccttgcaccatagattccgctcatcgcctgtcctcgacaggggagggggcctcctgagcctcgagtgcctggtctatgctgccgaggagcacccagccacttttcagagcctgatgcagaagcgggacggcaagcgcagtgactgggaatacccctttgctgccgccggggtcaatctcacgttcatgctcgcgggtgaggcctggtgctgggcagcattgcttgttgcgggagacattttggaaattctgttccaggcttgcatgcaataccagcggatgggaatgtagcagcaaatctgcgtggcctgaggtgatnnnnnnnnnnaacattttgggaattctcttccgggcttgcatgcagtaccagcggatgagaatttagcagcaaatctgcgtggcctgaggtgatattgtgtgagtggcaagcacctcctgtgcatcccccaattcatgcaggactgctgggactctcgcgagcgtcacccaccacccctgcgggacgaatatttgcttccttcctcgaagatagcgatggtgagtcatagcaaccacttggcgactgcttccctgaccagcacggcatgagatggagttttactggagaattgaccaatggaatcacattgaattttgtaacagcttcctcattgcccaccatggacccannnnnnnnnnaactgcttccctgaccagcacggcatgggatggagttttactggaaaattgaccgatggaatcactttgagttttgtgacagcttcctcattgcccaccatggacccaacccctgcctccaacctcagggtttgaagcttttgcaagcctcgttgtagctgcacaggtgctgctcgacaggatctggctggaaaaaggagcctcttacatggagttccaggcagtgcttaggtgggctgccaacctcatctgagtaatgcttgcatctctggtgtgtgcaggctctagagggttgagcatgtgccacttcatcgcagaaatttccttcacctcttgttatgcagggagacccaggagcagctggaaggacagctaacccagctactgccgggtcaggggccagaagtgctgctgcttcgcttgaaagatgactcctgaattgaatacaagtttagggtagctatacagcataatccccattgcgcctaatccctcgcgcattccctcttgtacctatcccaggaacccgctcctgacctgactcttgccaaatgagttcattggcttnnnnnnnnnntcctcggacataccctctcgtacccatcccaagaaccctctcctgagctgactcttgccaaatgagttcattggcttccttgtcatcaataatttggtggatgtttcaacactgtcagtagcatggtggttgcggagtaccatgggccctactctgggccgttcataattaatagtctccagaagcaatatgagtagccgatatccactctccatcatggttcgttcataccatccagaacacannnnnnnnnncttggtggacgtttcaacactgtcagtatcatggtggttgcggagtaccatgggccccactctgggccgttcataaataatggtctccaaaagcagtatgagtagctgatatccactctccttcatggttcgttcataccatccagaacacatccgatcccattagacctcggcaattaagctggattgggcgggaatagtactgcggtgggtgaccacgtgggaagtccccgtgacgaactgtttttgatttttgctcaattttgtagagtttcgttcttgttattcatggaggagtgtgtcccaggatctttgcctcaagccttccaggccaagatcgcnnnnnnnnnngatttttgctcacttttgtagagtttcgttcttgtttttcacggaggagtgtgtcccaggatttttgcctcaagccttccaggccaagatcgccagcttttcagctggatagaagcatatcatctggttgacctggggtgaacgtgggttgaggacagtcctcaaatctttccggtggcaagtagaactgcgcttgagacgttcaccgcttcgacatgcatactcttgcatgtcggtcnnnnnnnnnngtccgatggcaagtagtactgcgcttgagatgttcaccacttcgacatgcatactcttgcatgtcggtcccactttccatccactcacctcatggctgatgctgtagcagaatgcctggcccataaccacctgccagttcccggccccaaaatgcttggcgagtccatcccgaatagcgtgagtacaccgctccacttcagccccgtgtttgtctacaatggcactgcagatctcaatggcctcctgttggtcggcctcggccatcgtcgactcccgaacgatcgggaaagcagaccccaccgattgactctgaccattgagaggcatgacactcgattgatgatgggggtcacaatgccttctgatagctttccttaagatcaatctacnnnnnnnnnnnnnnnnnnnnnnnnnnnaaaagaaaggctgagacatgatccaacgtgccgtggaggacggtctaatcccacgccgccacagaacnnnnnnnnnngtgccaaacgtcgctctcccgtcgccatgacagtcgagcttcctctggtgcacgcccatgcgatcacggcgataccattccatcaagtgcgatctcacaagaatgtaaattatcagataatctgtctagtggtaatggacgaaagaacggctgagaaatgatccaacgtgccgtgagggacggtctaatcccacgccgccacagaacnnnnnnnnnnnnnnnnnnnnnnnnnnnnnnnnnnnnnnnnnnnnnnnnnnnnnnnnnnnnnnnnnnnnnntatcgccgagtttggagttttaaatattctgggagcttcgtgcgagattgtttatnnnnnnnnnncatcgccgagtttggagttccaaacattctgggagcttcgtgcgagattgtttatnnnnnnnnnngactttgccttcccactggctacggccgtccagtaaggacaaggctacatttataaagtatgtccactgctagggattagggaaataatgcccaaggtacaatgtgccattgagcatgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcacgaaaaggttaatggagcctcccgacaagctatacctcacattcctcgcgcaggagtnnnnnnnnnncggcatcaccaaccagcgtctacctcgatgtggctctgtacacagtcaagcgcctcatgaactgctgccagagcctcaactttgccttcacactggctacggccgtccagtaaagacaaggctgcatttatagagtatgtccacggctagggattagggaagtaatacccaaggtacaatgtgccattgagcatggggcaaatgttgtcaagtcagtacctccttccaggcaggcatgtgcgacacttgccatccatcctcaccgctcattcccaagatgacatttgtgttgagagggctcgcgaacggaggctgatgagatgggacatttgcacgaaaaggttcatgaagcctcctgacgagctatacctcacattcctcgcgcaggagtagtcccttccaccatctcacgacgtatttagctttaaaatggggggaaagaatgtgcacaaagttgnnnnnnnnnntttctaccatctcgagacgtacttagctttgaaatggggggaaagaatgtgcacaaagttgaactttacgaattttgggtgggtgagccattcagtgggaagattccctcgcccacggtcccccaagcatgcacccccctcctacagcgcgcgagccccaacccagccgagaggcagccaacgacgccctgagtttgttcctgtgaccatcagcgctggggcatgggattcgcctgtgcagcacgatcctcnnnnnnnnnnatcagtgggaagattccctctcccacggtccccctacagggcgcgcgagcccaccccagctcgttgtgcgccaaggacgccccgagattattcctgtgaccatcagcgctgggacatgggattcgcctgtgcagcacgatcctcctgaggtgcagtcgtcacaccagaccagcggaatcgacgccggcgaggcgtgggatcgtgggccatgacgaacagggtttggctgaacgtggcctacctggctccgcgctgggccgtgtggaccctcctactggtcgtggccagcatagatgcgtgtcgtcaccgccatgttcggtcccggggctggcagctctatgcggcgctggtgcgctgggtcggaggggccagacacctgcgaggcacactgcagctgtcctgaggcctcacgnnnnnnnnnntgctggtgcgctgggacggaggggcgagacacctgcgtggcacactgcagctgtcctgaggcctcacgtcctcccctccgcccaccctacagctcggagccacgggcctgtttgtggtgcgggacaccttcctcttcgcctacgccgtgtcgggcgtgggtccggactgggcccggagtgcctggttcggggcctacatcttcttctccaacctggccgaggcctacttcatctggatcctcatcatcatcgccgctggatactggtgcggggacctgtgtgttttggatgcagcaggccctgggcatcccgcagcagggggaggggcggtggcgcgcctctgctgccctcctcccgtcttccacccccatcccccttaaccccctcccgcccgactccaccgcagcatcacgcgctcggacctnnnnnnnnnnatgtgtgtttttgatgcagcaagccctgggcatcccgcagcaggcagaggggcggtggcgctcctctgctgccctgctcccgtcttccacccccattccccccaaccccctcccgcccaactccaccgcagcatcacgcgctcggacctgggcccccaccgcgccgtggccatcagcatccccgccatcgtcttcgtcacctccctggtggtggactacgtgctgtacagcatgcgcggcttcgaggccttctcagaccagagcatcactgtggtgtgcgtggagggggtggaggacccggaaaatccctgcacccctggcgaggagctgggcgccgccacgggcctcgtcttcttcatctgcatcatggccaacatgatggcgttcctgctggtgcgtggttgcatgaggtcaaggggatgctcttgggtgggattgggtgtgtgcagggggttgcaagtgcgtgggagggaggggggtgcggatcgagtgggcctgcaggcacggctgcgnnnnnnnnnnttgctggtgcgtacttgcctgtgcgtgcgtgcatgagggcaagggggtgtttttgggcgggattgggtgtgtgcagggggctgcaagtgcgggggagggaggggggtgaggatcgagtgggcctgcaggcacggctgcgagtgggggcaggtgggggagtgctgagcctggcccgatctgcaaggacggtgggctggcgcagcagccagagaatgccagggttcttggggactgtttgcagggcaggtggcgccacggccgggcatgcgccggcgaccccgccccacacgacaaatccccgccccatctccctccgctcctccgtgcaggcctggttcttcgtgtttgagacggtgcagaaggagcgggaacggctcgagggcggcgacccctaccagcaggaggaagagagccccgccgccgcgccggggctgcccgtctcgcgtgcggggggcgggctcaccaacgggcacgcggcgggcgtggggcacgccgcggtgcccacccaggtgctgctggaggaagggcggaacgcgtcgcacctgtacggcgcgacggaggggcgcgatgccgacgagccccggacggtgcaggaccggatcgagacgcgggacaagctgcgcctcatccgcaccttcttctacggcgtgtccacctacgtcgtggccaacctcttcgtcatcttcctccccatcttcgtgcccaccgtcgttgaccgagtcatcctggcgctcatggtgggactcacaagggttgggtcagggtgggggnnnnnnnnnnnnnnnnnnnnnnnnnnnnnnnnnnnnnnnnnnnnnnntgggcacctgccgccccgccccactctgaacccggttccccgctgcatcgttctccccgaaccgcggcccgctgctcatccccccctcccccattgaaccccccctatcgttcacagaacggcctgcttctcatcttcgtgagcnnnnnnnnnnagagggtgtcattcccccaatgtgttacatagaaaggtgtctcacacatgtcccnnnnnnnnnngagaggggggtgtcattcccccaatgctttacatagaaaggtgtctcacacatgtcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactgctgatcccccccctcccccattgacccctccctatcgttcgcagaacggcctgcttctcatcttcgtgagcgtgctgctgtggaccttccgcatgcgggcgggcaacgcctacctggtgctgggcgaggcggtgggcatggagaccaccaccgaactgggcgtgctgagcgtgcctcccaagcgggtggggccctcgcagcccgtgggcggcggcgtgtacgacaccgccttcaccctggacgaggaggaggaggaggaggaggcgcggctggcgcgggggccctcctccagcgcgccgcgccaggccggcctgaaccgcagcgcggcgcggaagggggtggtggtcacggacctcccctccacgccgcactgaccgacgtggatgcggagtgggggagggaggggcgtgcagtgccccgcccctcttgagcccctgtgtcccctctgccccgtttcccccgcaagcgtgccttcacccccttcctgtccgcccctcggctgctcattcctgtacggtctcgattttggccacggcgctgggtgtgagaggaaaggggggagcgcagggtgtggggtggagcaggggcactcgggcggctgtacccttggnnnnnnnnnntgtgcagtgccccgccccctctcatgcccctgtgtcccctctaccccgtttcccccgcaagcgtgccttcgcccccttcctgtccgctcctcggctgctcattcctgtacggtcacgattttggccacggcgctgggtgtgtgaggaaaggggggagcgcggggtgtggcaggggcactcgggcggctgtacccttgggaggcagggcccagcaggggtgcgggtatggtcgggcggttggagtttcgccaccgcggcacatcaggccagtctgcgccagccagcgctggagggaggggtcgatcggaacaggccctgggcagcgtagggccctcctggcgccgcgtcctgcgcccagcacagcgagccgccgcctcannnnnnnnnncgcagggcccagcaggggtgcaggtgtggctgggcggttggagttttgccaccgctgcacaccaggccagtcagcgccagccagcgctggagggaggggtcggccggatcaggccctgggcagcgtagagccctcctggcgccgcatgctgcgcccagcacagcgagccgccgcctcactcgctcgacccggcgcggctgccccgggggccgtcccggctgtggacccttggccgcccgggcccgcggggaccgtccttgcgcacatacaccgccagcaggccgtcgtcgtgcgcgctggccacccaggtggcgcaggtggaaagcgcagcctgacgcaccagaggcaggccgcggccactggcgcgggggcgggggggcggggtcagtcgctccctgggcgacccctcatccacgccgccctccaggtcgtacagcagcgtgttgccctttcgcgtgccgatcgccagcctggcgcaccggccatcaaggccgaagcggagccaccacacgcggtcgcacacctccagcttcagggtcttaggcgttgattgtttgggggggaaggacatcggtacaagggttggagtcgaggactgggcgcatgtgatgctagggagacggcgagtccacgcgcctcgccaggtcacctgggcacccccggcaggcgccccaccccatccacccgcccacctggaccacagtgaagcgcccgtcctcgatgccgcgcgggttgtggctcgccaggtcggcacgccacagcagggccttgttgtccaccgacttggagagcaccaggtcccccacccaccgcacgcagtccacgtactgcaggccgccgtgcacctattggtccagggtgggggttttgggcagttgaggcggccgaggggcaagtctggccagcagggttggatcgatcagannnnnnnnnnggggagtcgaggcggcttctgggcgagtctggccagcagggttggatcgatcagacaggggcaaggtacacgaaggatgacggatgaggccctgagctgtcgctccccccgatccccacgttttgatgaacaaggcagcctgcgccccatggtgtgcgcctttgctccgcatccttacatggggcgggtgccagccatccccannnnnnnnnnttccgatcccctctttttgatgaacaaagcagcctgcgccccatggtgtgcgccttcgctccgcatgcttacatggggcgggtgccagccatccccaccgtccccagtcacacatcccctgcacctgggcggtgaagatggggaaggtgacgaggcggacggggtaggcagcctccgggtcggtccaatcctcgctgtccgtgatgagcgggaggtggggcgaaaagtccctgcatgggcgccaggggcgcccgagggttagggtgtgcgcatgtgtctcggacgggcgagcaggtggagggcctgcaggcgagcggccccgtgccgctcgacggattatactccccacgccgccccgctcacccctctcatctatcacagcgctgtaccatgcagccctcgggacacacactcctcctctccgctcaccatatcttcacgcagctgtccatgccggccgagaccaaggtccattcctcgcccaccaccctccagtccaggctcaggatctcgttgacgtggctcccgtcaccctggcagatgagcaccgggcggccgacgtgcaggttccagacccgaatggtgtggtccttgctggcagtggccacgatgtgggggtggaaagggtgcacggcgatgtcgttgatggcggagccgtggccgcacagggactgggtaggtgcgtgtcggggagtgggggtgggtagggtgggtgtcggggtgctgggggcgcagcactcaggttcaagtatgcttccccttcggtgaatgcccgagaacgcatggcctccctcgcacatacggcgcgggcattgcagcagccagccacctggactgtctcgtccggcaggagatgcaaagcacaggactgggcaccctcagcgtgtgggcagggcggttcgcacgtgggcggctgagttttttgcgcccaaaggagctcaccgcttcgagctggcccgacatgcagttgacgacgttcaggacgccatgctttccagccacgagcagccagggctcctttgtggccgggggctgcgaccactcgcagacataatactcctcgtcctcctgcgggcaggtgctgagcatcagagagggacggctggctgcggcaagggggcagacaccctgcgagcaccggagcatcacagtccatgggggaacccctgcaacacagtcnnnnnnnnnngcaggtgctgagcatcagagaggggcggccggctgcagcaagggggcagacgccctgcgtgcaccggagcatcaaagtccatgggggaacccctgcaacacagtcccggctcacatgctggtccttgaaggcttgcaggatgtgcacgatgtttcctggcccgcacctgtacacggtggcctgcggggtcagaggggttacggccagattggggacgtgatggcagaggtttcaggggggtcccatgagcagaagcccccagatcatcatgcgggcggccggggcccgctccccgcacccacccgtgcagctcccacggttgcgaagacgttggacaggtgagggtccaagtgattgaacctcacgcaaaaaagggaatgggtctgctgctcctggtacctgcgggcgtgcgccatggcagaaggagcgcgagtcatcgagcacgctgcacacagggagcacaggggcgcagtcaacagtcctagaatgcagggtgttttattgccactgacatgagcatcctgtgcacgaactattctatcacactagaactcaaaaacatcatggagcaacccagatcacaggcaaggcctcaccaggcgagattcttgtactcccaggtgtcgtcctgcgactcgacttcctccatggccgaacatgtattgaactctacatcgtcagcgagacatggaccagccctgaaggagttgggagcgcccccgggggagcacgatggcggggaagcactcgtcaaagcacgtcttcagcaaacagaaagcaatttgagacctcgaaatatactgcaaggatgcttttgggggatgcaatgagcaattctgctggtgttggtgtcgnnnnnnnnnntttcagcaaacagaaagcaatttcagacctctaaatatactgcaaggatgctttgggggggtacaatgagcaattctgctggtgttggtgtcgcaagggcccctcagcgcgccatgtgatgcgcccaggttgaagggagagatcttgtccgcacacatgcgcaccggatgaccccctttcacaagcaagtgcacggacgcagacgacggctaagacacaatcacatatcattgtacaaacaagcattaatttggccgacaaggatatgcggcggactcgcgcagcactgaatctgttgtgtcggagagcggcctagcctgggtgcgagtcctggccctcaccagcgactatgctcgcggcacacagcgttgtatacggaagttcaaggtctttcatttcaacatgcgggactggatccgcacggctccccgggtcacgaccttccatggggtgaggtttgggtggttggccccccctccgacatgctctggggccgccaatcccttcgataggagtaccgaagcggctccccacgtggacccacaggcataatgcatggagtaggctgcacagaagacgggcatggagtcgcatccggcccgcaagcgtgggtggcaccggccccctcgggtccccctgcccccctgccaggtccagcgacccgccccgggcggccagcctcctacaaacccagccagggctggaacccagcacccaggagcaggagccggcctcctccctcctcgacctgcacctcacggcagacagggacgtggccacagtggagggcggcgtcgtactcgccagcgccctcaccggccaggcccgcgtgacggggactcgacgcggcatgctcatcctgggcatggagatggcagacggcgccgccaccgccatcgaggacttcccactcgccaaggtggctgcaggacgagggagtggtgtgtcctgaggtccgcaacagcgtcgggtaccgtgccgggcccactgcatgtcgtgtggcatcctcnnnnnnnnnngggacgagggagtggtgtgttctgaggtccgcaacagcgccggttcccgggtcgggcccactgcatgtcgtgtggcatcctctcactccttctttgagggcaccactccccgctcatcagccccctccacttcacacacacaaacaaaatccagctgtgctgctcgcgctttgtcgctggcgccaggatgaagctctggtggcagatgccgcggtggggttccacctcccatgacatcacgcccgagactcaggtgcgcaggctgcggctttcttgactcactgcgtcgtgctggagtgccttagcacgtcgccatgtagtgatgtgccacatgctcctgcacgacaaatgttatctgctgatttcctgctggccattgacagacctctcacaacatcatgtttgtctccacccttcgtttgcccagtttctgttgttggagctggaagacggggtctacggcgtggtgcttcctctcatagaccgccggaccttccgaggcacgctgcggtatcccaggtgatgacaagatgagggggggggggtctcttggcagcagaggggattgcattggggatgatcttattcttacagaacttggtttgtgcatggagtgggagtggggtgcaggggacagatgtggctgcagcgcagggtgtgcgggcgctccatcgaacctcgacggcagtcggatgccagctccgccacgcctcttgtgcctcgcgacgggccgacggcgcacggctcgccatcatgccgcggcggcgcctcgcttcagcaagatgccttccgatggtcgccacagcgcgatgcggcgggcaccctcgaggaccgagacccagcccctccgcgtctggctgtgccctgggtcccaggcgctctgctgtacattgctggccctccccccctccttcgccctagctctgggtctggcgctggaagttctccagggtcaggttggcagtgaaggctgggatggacctgaagcggtccacgaaggtcgccgcctcctgcgccaggcggcccgtggtgagggccgtgggcaccagcgccaggaccccggatcgcagcaggtcgaacacgagctccgcgccctcgtcctcgtgctgtgggcgcagcacgaagcgcgccctgatctccctgcggcgcgggtgagtgagggggggagctgctgagtgtgtgtcgagcaggggtggttacgtcacctcctccagggaccagggcaggcctgggtgcctggcatgctcatggtgggacctatgctccgtgcattacttcagcgatccacagttcacagcccgaaaaacaatgcttcccccctctcatcacccccagacaacacatcccagccccacctggccgaggggtcggtcatcatctccacacgatatccgaagaggaggtacaccgcctctcggaactgggtgatctggcggcggaatacctgctgcaggcggtcgttagccttctgcagctcattggcacggcggcgcagcagcgacacctccccttccagctgcgcgaggcgcagcgcggcgcctggccgctgcggcgaggcggcgtcggcgtggctgggcgaggcatcggcgccgggcgcagcggggcgccttcccc

SEQ ID NO: 47875 - DNA, 105 bp, Chlorella protothecoides
ttttttgtgttttaagttctaatttaattttcatcaaatttgttggagaatgccacccaacgttaaaatcaggttgaattataaatagtttatttgaaacttctt

SEQ ID NO: 47876 - DNA, 67 bp, Chlorella protothecoides
ttttttattagcagcaagttttcaagaagtgagccgtattttagtacgaagcgcgtgtattaaaaaa

SEQ ID NO: 47877 - DNA, 61 bp, Chlorella protothecoides
cacctggacagaaagaccctatgaagcttgactgtagcctgaaattgaatttgggtttttt

SEQ ID NO: 47878 - DNA, 79 bp, Chlorella protothecoides
attcgatgctgaaggtgtgagaaaacatgccgtctatttcgtcttttgggtgtgtgtgtgggaaggcctgcaatctgtc

SEQ ID NO: 47879 - DNA, 162 bp, Chlorella protothecoides
gggggtgactgtgcggtccttgtgcccttaaatcataatatcagactccaacaactgtcgtagcatgctgtaggggcgatccttgatcttcatgggtgtcaagacaagattgcagtaaccgaatcgttcaccagtaccatactccctcctcccggaagtacc

SEQ ID NO: 47880 - DNA, 61 bp, Chlorella protothecoides
gcacgcccgcgatcgctgctatcaaaggcctccagctttcacagcaggaagcactccttcc

SEQ ID NO: 47881 - DNA, 61 bp, Chlorella protothecoides
gtgttgttattcagggtgctcagcgtcgaaccgagtctcgggggagcctgtcaccttgaga

SEQ ID NO: 47882 - DNA, 102 bp, Chlorella protothecoides
taaaacaatactcgatacaataaatcgaatttatttattttaccttgagtaaattatttcattatagaagttttttccacttgttcccaaggactatcaaaa

SEQ ID NO: 47883 - DNA, 73 bp, Chlorella protothecoides
aatacatctattttttatacgcacacgactactatttcttggtaactgattaagtttttgtgcacacaaaaac

SEQ ID NO: 47884 - DNA, 71 bp, Chlorella protothecoides
attgcacgagagacaggtgcgctgggaggctgagatagttcccaggctcctaggagctccactggaccatc

SEQ ID NO: 47885 - DNA, 74 bp, Chlorella protothecoides
ttgatgatgcgggcgtactcggcggggtcgtccggcttgtggtcctgggtcatggccagcgccacccccccccg

SEQ ID NO: 47886 - DNA, 68 bp, Chlorella protothecoides
tcctgagagcgatggcctggacagctgcttgtgtcagacagctctcccttgagcacccctcaactcag

SEQ ID NO: 47887 - DNA, 61 bp, Chlorella protothecoides
cacatcccctgtgtccctccattccccctcaccctgccgttggagatgaggatgacctcgt

SEQ ID NO: 47888 - DNA, 91 bp, Chlorella protothecoides
ttatatttttggtatattctgaaggatttactattctttgtttctgcctttgttatagcatcattcttttttctgaaatagaataataaat

SEQ ID NO: 47889 - DNA, 61 bp, Chlorella protothecoides
ttttagactcctttcttattgtttttataaatggattggtggtacgttaacaaattataaa

SEQ ID NO: 47890 - DNA, 63 bp, Chlorella protothecoides
tttttttctggggagggatgtctctatattaataaaaacacttttcaatgtacaatttcagta

SEQ ID NO: 47891 - DNA, 68 bp, Chlorella protothecoides
cactgtcgaccgttgtcagatacacatgggctcccagactgcaagggaatcgaaagtatgcgcgaatt

SEQ ID NO: 47892 - DNA, 74 bp, Chlorella protothecoides
ctgcaagggaatcgaaagtatgcgcgaattgttggcgtagggtcgggaagagacatgcgctagtggtccatctc

SEQ ID NO: 47893 - DNA, 69 bp, Chlorella protothecoides
ccagggagggaggctcgtcgcgggatgtgatgtccctacccatcactgtcctcgaatgagatacttata

SEQ ID NO: 47894 - DNA, 61 bp, Chlorella protothecoides
tttcaaagtgtttcatgtttctttactttctaaagaatcttgtggtgtgcttggtggtgta

SEQ ID NO: 47895 - DNA, 114 bp, Chlorella protothecoides
tctatgtgaaggtgaggctcgggtacactcatttgcaagagcatcacgaggagtagttgcagacatggttggtatatagatagtataaatcatccaatcatcgtggtcatgcag

SEQ ID NO: 47896 - DNA, 61 bp, Chlorella protothecoides
gcaacatggaggtggagcggttgcagggggtggtcacacagtgaattgctaaaaagaccgg

SEQ ID NO: 47897 - DNA, 75 bp, Chlorella protothecoides
ccccttcacgatgggaggcgcctcgtcagggaccagccgggccttgccatcgatcttgcgcaggagcctgtgatg

SEQ ID NO: 47898 - DNA, 18176 bp, Chlorella protothecoides
  modified_base (1462)..(1471): a, c, t, g, unknown or other
  modified_base (2166)..(2175): a, c, t, g, unknown or other
  modified_base (2793)..(2802): a, c, t, g, unknown or other
  modified_base (4929)..(4938): a, c, t, g, unknown or other
  modified_base (5415)..(5506): a, c, t, g, unknown or other
  modified_base (6477)..(6486): a, c, t, g, unknown or other
  modified_base (6657)..(6666): a, c, t, g, unknown or other
  modified_base (6965)..(6974): a, c, t, g, unknown or other
  modified_base (7674)..(7683): a, c, t, g, unknown or other
  modified_base (8553)..(8562): a, c, t, g, unknown or other
  modified_base (8764)..(8800): a, c, t, g, unknown or other
  modified_base (10041)..(10050): a, c, t, g, unknown or other
  modified_base (10169)..(10178): a, c, t, g, unknown or other
  modified_base (11519)..(11565): a, c, t, g, unknown or other
  modified_base (11707)..(11716): a, c, t, g, unknown or other
  modified_base (11802)..(11811): a, c, t, g, unknown or other
  modified_base (12094)..(12103): a, c, t, g, unknown or other
  modified_base (12253)..(12262): a, c, t, g, unknown or other
  modified_base (13691)..(13700): a, c, t, g, unknown or other
  modified_base (14985)..(14994): a, c, t, g, unknown or other
  modified_base (15053)..(15062): a, c, t, g, unknown or other
  modified_base (15516)..(15525): a, c, t, g, unknown or other
  modified_base (17013)..(17022): a, c, t, g, unknown or other
  modified_base (17104)..(17113): a, c, t, g, unknown or other
  modified_base (17691)..(17700): a, c, t, g, unknown or other
gccgcggagacgcgccgcaaggcacaggccgcgctgcgcgaccgggacagcgacgggctgagcgcgctgcgcgcgctgtgcgcctacctggcgcacggccgcgacgcgggctgggctgccggcgccgggctgcacgcgcggcacctggaggaggccgtggccctccgcgcccagctggcccgtgtgcttgccgcctgccccgtgggtggactggggggggaccatgcgttcagcctggctgccctggacggcgtgaagccgctgccggcgccggggccggcggtggccgacgccctgcgccgggccatgctggcgggctggcctgaccgcgtggccaggcgccagcgctccgcagagtacctggcagggcagagggagcaggtatggatcttgggtcggggggggagaccggatcaagtgggtgtgaaggggagggcagtgacgcttctcccacacttggttgtgtgggacgagaccccctggcaagcaggcaagcgcgatcgtcagccgcttcacgcctccatcctctcctcgttcaccaagccacctacccggcccaccccacagggctacagctcccgcgcggtgcggtaccaggccgcggagctggaggagccggtgttcctgcaccccctctccggcctgcaccgcgcgccccccgcattcctgctctacacagacctggtgcgcaccgccaagcgaccctatgtctccggggtcacggccctggacccggcctggctccccgccaccgccgccgcgctgtgcagcctgagcgcacccctccccgccccggcccccttctacagccccgcccgcgatgcggtgctggcctggcacgaggtgaccttcggccgccacggctgggccatgccgcgcaccgccgcgccccaccccgacccagctgagcgctgcgcgcgcttcgccgcggcgctgctggagggcagggtgctgccggcgctggagccgctggcggggggtctggccgccccgcccgccgccctggcgcggccggaggccaggggtggggccagggtctcgaacctcctgctggccctggagcgggcgggggtggactcgcggcggagcctgctggcggccctgcgggacgagccagggttcctcctccgagagctacgagcctggtaccccgcgccggccctgcccatactgcagcaggcctgggctgcgcttctgggaggggcgtgccgggaaggagtgcccgcttgatcctgtgacaaaccatgctgtggctcttgatgcgttgagtgtggtgtgcatcgtgtacaggaggagtcgtgaacgtaccacacatgggtttcaagttatgggtgatatgatggaggacagaacacaagcgtgtgacacatgggtcgagtcatgtatggggaaggttgctagccaaggccatgtatttgcctgaccctggcgatgacagcggagacctggtcagccagctcannnnnnnnnncgtgacacatgggtcgagtcatgtagggggaaggttgctagccaaggccatggatttgcctgaccctggcaatgacagcggagacctggtcagccagctcagcaggctcatcaataactccttcatccttgacgctgagcagtggagattccgggaccgcattcctcctcaggagcgcacagcagaccgcagtgacagacgcagccagggcctcggtgttgtagccgccctccagacaaaagaggatccttccctctgcgcatgggtgcggcggcatgcttgaatccattgcgcatcacccgcatcgctaaaccctggccaggaaccaaccgcagacatatgcagggtggcactcaccacacagacgggtcgccagggcgcagaggcgggaggccagctcgccgtaggtctcagtccggtagcacaggagctggaaagggtcgtcctcgtgcgcatcaaagccggccgacaccaggatgaggtcgggacggaagcgctcagcggcgggtgcgacgatgtcatcccacaccttgagtacgctggcatggccggcgccccctgggagaaggcacagggaaggggtggagtgtctgtggctggacatcagcggtgtagggaacgaacaatgccacatccaaagggtgcaaccaatgcctgtacgcagactgcgcaccgtgtgcactgcactgcacgcnnnnnnnnnnggaaggcacaggggaggggtggagtgtctgtggctggacatcaacggtgtagggaacgaacattgccacatcgaatgggtgcaagcaatacctgtacgcaaactgcgcaccgtgtgcactgcactgcacgcaccacagaagactgggagcatgcctgcatccctgccgaagcatggagcatgcgtcagggcccctctttaataccctcaatctgagttagagtacatcctttgccgcatcccaatcagacaccacgcacggggcaggggcacattgatggtgaagcccccgccctccccacgcccagcatcgtccacgcccgacccgtactccaggtagaccgcgctttcttcgtgcacatccagcaccagcaccgagggatccgtgtcgaagatctcgcacgtcccgttgccatggtgcacgtcaaaatccagaatcatgacctgtgaagaaggtgaacatgccagtcatgccgcacaggaggcggggttggctgacctttggggcccccctggaccttcgcctgccaaaacggagactggcgccaaaacgttccaccagcaccacacccatcatgcacacagatcacagccacacaccttgggcagggagaggtgnnnnnnnnnngcacccatcatgcacacagattacagccacacaccttgggcagggagaggtgcttctgcacatagcgggctgccgccgccacgttgttgaataggcaataccccatgggacccgctgttgtggcatggtgtcccgggggccgcaggaagcagaccccggggcagctgctcaacacgacttggctcagggtgctcagcgtcagactcacggcctgcccccagggtggtgattgtgcatgttgaggagtgtgaggagtactcaagggagtattgcaaccagcagaccatccgcacatgcctgcaatgccaggggcagtgatgcagaggtgaggaaggtctggccgtcgggatcgtcaaagtctgcaattgccagtgtgtcaccgatgtatggtccaggcgccgccgcccctctggacaggagggcgtcgcggtatgcatgcacgctgtcaatgacagcatctctaatctctccaggaatcgttctgtgaacctggagtgcagcaggggggctggtggtctgtcaagatgatggggcagttcctgagagctccctgcttccccccaatcctctccctgcatgcacctggttaaggttgtccaatagacccgacgactggagagcagcctggatggctgcaattctctctggtctctctacgtggcctggttgcttatgctctggagcttccgaaatggtgaaatagaccggcagcattgggcaggtgctagggttcgccacccccccccacgcgtgaatttaagatgaccccgatgctacctaaggagcatgtcgacaactcaatagtgttttattatggcatgcagggaatgaggtatatctttactcattgacaagggtgtttctggttctcggaaccttgatgtcggactgtccgcatcatgcatttcagggctggggttcccaacactcagcgatccctgcgaatgatcaatggcaaacgccacaggcataccaactggcccaaccatccctcatcaccgcaaacttatgattgcaaagatgcgagtccgtcccctttgaagctccttgctgatctcccgagtccgtcaagcgtgctgggcttggcagtacttgaaactcccgcgggctttgccgagggagctggctcaaaaggcacggccgtcccagcacatcatcatcatggatctcagatcatgcgcattggccatgacggtcattctcctgctggcagcagggcatgcggtggacgctgttaaggcttccgacttcaaggcaagccgatcttgcaggctcggttcgagcctaccgcggtccagaacagcacccaacttcacctcatacccaatatctcatccgatccatgcagacctgcgccgattctgccttctgcactcgcctgcgcaacgcccccggccccggctttgccatcgaccccaccagcgtgagcgtgagcggtgcccatgtggtggcccatctggcctcccccgccgcccccggcgccaccctcatcctgcgcctgatcagcatggggggcatcgtgcgcctgcacatcaacgagctggacgggacgcgcttcgaggtgccgggcatcctggtgccctcggcctccgcctcccaacaggttagtggtgtgtcgtccaccgggcgagcaatgctggggggcgggagggtgcatgcgcgggctccctacctggcatgggcgccaccacccctgacctgcgcatctcgtaaaataaagcctcgagcaaatgcttcaccctgcgcaggagtggaccatcgtgtcccagtccagctctgccctgcagctgaggacatccagtggcgccactgcatcgctgaacttctcaccagttgccctttctgtcaccgcatcggacggcacgcacgtgctgacctggaacgccgacggccactttgcctttgagcatacccgcaccaagcaggtgggaaccaggatgtctctcaaggccctgggattcttccggggtttgttctggcggtgggaaactcttttctgatcgaggaggcccgaggcttgcagctgagaagagctgtttcaacatcgcaccgtccttcaacgcctggacgcaagccatgcaaggcgttacgccctgctcccctcctctctccccctcctcacaggannnnnnnnnntttgggaaactctttttcaattgaggaggcccgaagcttgcagctgagaagagctgtttcaacatcgcaccgtcctttaacgcctggacgcaagtcatgcaatgcgttactccctactcccctcctctctccccctcctcacaggagaatgatccggccgggtggtgggaggagacttttaacggccacgtggactccaagccccgcggacccaatgccatcggctttgatgtcctgctgcacgacacgcagcacgtctttgggctgccagagcgcgcgacccagttctctctggcgcccaccattggtgaggcggcgtgggggggggtcagaatggcgacgttgcatgtgaggttggtcagctggattgcaacagggaggcagtttcagcgaatcccaaagtcatggggctggagctgggtgctccaagttgagcatcccttctcaatgcaacctcccttgggacttcattgtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagcgagccataccgcctctacaacctggacgtgtttgagcacctctccaactcgccctttggcctctacggctccatcccctacctgattggccaccgctctggccaaaccaccggtgtcttctggtgggccggatgggacagaggttgggattgggcggaaatggtgggaaaggtgatgctgtgggtgctttttggtgagcctgtggcctgcctcagcaatttgatatggatccacaccgcccctttcccgcccacaccccaggctgaacgcggcagagatgtatgtggacgtggtgaagagcgtcgccggcaccagcacccgatggatcgctgagagcggcgtgctggacctcttcctcctcctagggccctcccccccagaggtggcacggcaggggcgtgaagggaggaacccagcaagctgcttgagctcctgcgatctgatgcgccctgccttgctgcaaaattagagctgaaatggaggtgctgaggaggatgatctctgcgcccacctgtgaccgagaggggcgtgtgcgcccggcaacctggaccgcgcctgggactgcccattggcatgcactcatacgacccttcttcccctctttcctgccctcctagtaccatgtgctcacgggcggcaccgccatgcctcagctcttctccctggggcaccaccagtgccgctggaactacaaagatgaggcggacatcgcggcggtggatgctgggtttgaggagcatgccctgccctatgatgtgctgtggctagacatcgagcacaccgacggcaagaggtgggtggggcgaaggagctgcggcgattgcgcgtctcttagaaaggcggggtgctggccgagcaatctattgcttggtctggaatgctctctagggtttccaagaatcctcaggccctcgccaagtctcccaagagcatgccgggaaggatgctgctgtggctgggccactcnnnnnnnnnncactctctggggtttccaagagtcctcaggcccttgccaagtctcccaagagcatgctgggaaggatgctgctgtggctgggccactctatgcgcagactccttcctgaactgatctgtggcaacctcgaatctcgcccatagatacttcacctgggacaaggcctacttnnnnnnnnnnagactgagctgtggcaacctcgaatcccgcccgtagatacttcacctgggacaaggcctacttcccaaacccgattgcgatgcagagcgaccttgcgtcgcgggggcgcaaagtgcgtgggggtggccagtcaggggtgggggggccctcactctgggtttctgcccgccattggcatgcatctggatacctcaatttgcacaactctcccaccatcacctctcccccaaccatcacttctccaccaatcatcacctctcccccaaccatcacccctccaccaatcatcacccctcccnnnnnnnnnnaacccatcatcacctctccccccattatcacccctccaccaatcatcacccctcccccgatcatcacccctcccccattcatcacccctccaccgaccatgactcccctccccctcttccagatggtgaccatcgtggacccccatatcaagaccgacccaaactaccgtgtgttcaaggaggcggaggagaagcagctgtttgtcaagaccaaggatggcgcagacttcaaggggtgggtttggccctgagcacttttggcctttcaatggcatggtgcccaacaggggaccaggatgggaagagcagcatgcttttacctactatgcagtcctcccacactcagatccctatcgtgaagtggtctttaagaccgttgagagcccctttagcccttccatccactatctcttctccaggcactgctggcccggggagagtgcgtacctggatatgctcaaccctacagttcgcgattggtgggccgaccagttctcgacgtcggtgtacgaaggcagtacgactgacctgtacatctggaacgacatgaatgagccgtcggtgttcaatggccccgaggtgggatttggggcagggactttggggtgggggacacgggaccgggtgcgggtatggctgcatcttggggatactgcgcccaagcctgcgtgaccttggcgcctgggagccgaaattattnnnnnnnnnnaggggcatggggccgggtgtgggtatggctgcattttggagatactgcgcccaagcctcatgaccttggcgcctgggagccgaaattattgagcctcgtaggggcgctgggccaggcccctatgttcccggcgccctgcagcatccagacccctcctttctgtcccgggccgctccgtaaatctgctcccatgaacgacccaatacccaaggcctttctcataacccaatcgcctctcgcagatcaccatgcccaaggatgcgcggcatgtccagggggtggagcaccgggacctgcacaatgccaacggactcttctaccacatggccacggcctcggggctgaggtgggtgctgcagggtggttgttgtgcctagaatacggcatgaagcgattggatgcagcggccacgccgattgggcacaagtcatagatggtggagctactgcctgtggtctgacagcatgcgtcgtagcatgttctgcattgctgacatcaacgccgcgtatccctccttccaccaggcggcgcgggtacaaggaggtggacaccgtgtcgggggaccgccccttcgtcctgtcccgggccttcttctccggtacgcagcgcgtggggcccatctggaccggggacaatgcggcggagtgggcgcatctagaggtctccatccccatgctgctctccctcaacgtcgcggggctgcccttctctggtgaggaaacggggcaatcgctggtgtgtggatgtgccgcgctgcagtgaagctgcttctgtgcctgcccgctcgcagtgggctcacatctaaccaaggcaatcccctccccaaactgccaggtgcagatgtcggcggcttctttggcaaccccgagnnnnnnnnnnagtgccgcgctgcagtgcagctgctcctgtgcctgcccgctcgtcgtgggctcacagctaaccaaggcaattccctccccaaactgccaggtgcggatgtcggcggcttctttggcaaccccgagcctgagctcctcgtgcgctggtaccaggtggcggcgttttaccccttcttcaggtaccgcatgggtcctgtcactgnnnnnnnnnnnnnnnnnnnnnnnnnnnnnnnnnnnnngggtgcatgcatgcacagggccacgccactctgtcgcgcgcacaaggcttgcggattacccctgggttctggtagtagggagcaggcggagacacaccacccttgactccaatcgcagggcgcacgctcacatcgagaccaagcgccgagagccgtggctgtttggggaggaaaccacagggcgcattcgctccgccctgcagcagaggtgcggggctaggggaagcaggcccagtgcctcgcagcatgcgtcatctgtcggtgatgtattgaggtgttcctcgttcgtgcattcacttgtttgatcatgagcctgcaactcccagctggtggtgttcctcaaacccccccccgggataagcctctgggaggccttcaccatgccctgctgacatccgcaggccccccacccaaaggccttccatccccaccatcccccctcactcacatgtgcctcatgccgcaggtaccgcatcctgccgcagctgtacaccctcttcctgcacgccaatgccaccggcgcgcccatcatgcgcccgctctggtgggagttcccgggggacgccctgatctacgccgtgcacaatgccttcatgctcggcgactcccagctcgtggtgcccgtgctgcgccagggcgccaacgacaccgtggtggtcctgcccggcgacggtttgtggtacgacggcaccatggggctccagctggacgccgcggcgcccggccggaagctgttccgggtggccacctcgctggacgcgccggtgcagacctacctgcgcggcgggtccaccctggtcctccgggagcggtgaggggggggggagagatggtttttcttgttgaggggatcctcgcaggtccacgtcgtgctttgccaaaagcgcgaggagcctgtgggacacccgctggtccccagacggcacgtttatacccaatgaccccagcattctgccttggttctggcggtcagtgggcttcctgccatccagggcctccgttcacccgccctcctccacaccttccagcacactcaacccccaccctcgcaggccacgtcggtcaacccgggccatggccaaggatccgctgaccctggtcgtggccctggatcggagcggtggtgcgagcggggacctctacatggacgacggccgcagctacgcctaccaggtgtgcgaggcaggaggcaggggacaagcaggagggtaaaggcaatgcacaccagtctgaaacgtgannnnnnnnnnccagatggggctgcctcctcctgcacccggctatgacccagaggtaggtaggggtgtgagagcgtgagcagcggcaggggtgcttggaggaggctcacctgtccacctgggattggtgnnnnnnnnnnccacacagagcatgcatgcatgcgcccccaacaccccccacccacccgcatcgcaggccggcgagtttgtctatgcgcagatcaccatgaagggcggcgtgctggagtgggggcccggggaccatgctcagatggggctgcctcctccggcccccggctacgacccagaggtgggtaggggtgtgagagcatgagcagcggcaagggtgctcgagggaggctcacctgtccacctgggattggtggggacccagccccgacgcgagtgcagcagggtgctgagtgctgctcaggcaacctcccaccccagcacctggggagcacccgaccagccctgcgccccgccgaaggcagctgcagccggcttgccactgctgggtggtagcgtggtcgaaaacctccccgtcaccgactctccctcctgcaggtctacgtcgatcgcgtcgtggtgctgggacttgagggcggcccccaggactggtccgcagtggccgtggcgggggctgtgggcccgcgggtggcgctggacgccgccccgggtcccgtccaggtggcatcggaggggccagcgctggcgctggtggtgcggcggccgcacctgcccgtccgcggcacctggtccatagagttccgcagcgagcgggcaagctcctgaaacgggcgcggcgcatgtctcaccgcggtgctcgcacggtgtaccagggaggcagccctgccccctgtcccttccctgtcaactgtgagcagcttgttgtcaaacgaagaaggcagtctgtcctaatgaaagaatgcaaggtgggggtccacgtcaagggtttgcgccttccagggtccagaagaagcagcgcggtcttggccggggtacgaggggtgacggccccacataccccagcccgccgcctgcatcatcgttcggcacccactcggacacgctctgcctgtgccctgcgctgccgcgccatctgcgacagggccttggcctcccacttggggtccaccgcccggttgaagaagatggcgggctccaggatgggcagtgcgcccgtgggcgtcagcgcgggtcccccacaggcgggactggtgtgcagctcgcgcagctggaccgcggcgttgcacagcccggcgcaggaggggtagtcgtaggtggccaggctggcgggggaacagacaggggagcacatgcgccggtcgtcgtggtgcgtcaggttcagggccagcatccaggcgcccagggtcacgtcctcgttggccaggtggcgcagggacccggcggggagggaggtcagcagcgccgcggccttgcgggagacgacgtaggcggagcccctgcattgggatggnnnnnnnnnnnnnnnnnnnnnnnnnnnnnnnnnnnnnnnnnnnnnnntgtgagcgacggtgggtgaccagtcagagtcgtttggggtggtggtgattattgaaggcacgctgtcacgaaatgtggtgcccctcgccaggcaggcatcccacgcccctgtgatcacgcagggcccacccctgccagctcnnnnnnnnnncgtgagcgacggtgggtgaccagtccgagtcgttcggggtggtgatgattattgcaggcacgctgtcacgaaatgtggtgcccctnnnnnnnnnntctgcaccgtggtgcgagcctttccccctttcctcaccaggtgtgtgtaaaatactgggaccccagcagggcgtgacttggctcataccagcggtacctgggcgtctttatcacctgtccattcttcatgcagccaatgtagtctgtgcagggaggggtgagggtgggcatatcagcctgggtgccgacgttgaaaggcgcagtccgagaatggtacgacgccgttgccacttgccgctccccccggctcctcaccacgacaaatccgtgaggggcaccagcnnnnnnnnnnggaatggtacggcgccgtcgccacttgccgctccccaggctccccaccacgacaaatccgtgaggggcaccagcgacgccacacccccgcaaggctgtcccaacagtgccccacctgcaccgacgctggcccactgctccacggctgccnnnnnnnnnncagcctgtcccaacaacgccccacctgcgccgacgctggcccactgctccacggctgccgggaccctgtccagacgcaggtatacgtcgtcgtcgaccttgacgatgtactgcgggtcatactgccgcagcacggtctcgaagaagagcagcgtctttcgtggcaggtctgcatacccttcctgcgggggcatccaggtggcagcccagggtgagaggggcgcgctctgcagtcctcacaaggaggagaggactgggccctatcttcatgaaatattccaagtgcacctcgcctgcgctgtgcagagtactcctcctcccacaccttcccatggcccctcaccacgaggtccaggcgcatgaagcctccatgcttggcctcctcggcgttcagcgctgcctcggccccggagtcgggggagtggcccaccacaaacctggcgacaatcccggactcagtctcgagtttgctcctctctgactcgttggagggcgcccacgtggcgcgcagtgcctcccgtctgttttcataattgtacttcgggttgttgtggttggtcgtgaagcccgtctgcgggggaaagtggtgagactgagcagtaggaagctggtgctggagggttcgctcgcggtccccatgcggtgtcgaatcacgaacctgtatgccgacaaatgcggtgatccgcttcgccgaaacgtcctgggcaggctcgctcagggctcttaggttctcatacacctcggagggcagcacgggctgcgtctgaaggggccccacgagggtggtgaaaaatagagccgctgtgaacccacctaccaaccacgcgaggttggacaagcggatgttcacacccaggaacatattagaacaacatggtgtgcatgttgtgaggtttggaagaagaatgcgtgtcctgagcgagcactcaggcagtatgaggaaactccacgcgcccattttgcctcggcatccggatcttcaactgccagcatttgagatgacgcacgttaaaatgatcatacacaggatcatgcattctatgggctggtatctcgataagaatgttaggatgggcagaggatggcgtttactgtgcctcacagctgtccctgctgtgtccggtatgaaactgccaatacacctgtctgcaagccagagagtagctcatcggcctgcatacgacatcgcatcatataagagatgtgcaaagacctcagcactagtgtattacatccagggcttcaaaggtcataatatagggtcgaggcacattcgaggatcgggaagagatcttgtccagcctgcttgttcaccgtgagacataggcagtcacaagcactgcgatcgccttttcacagcatatcacatcattatattacattgggcgttatgttaccgggaatctacgcagccctcacccctgtaacgnnnnnnnnnnccaccgtgagacctaggcagtcacaagcactgcgatcgccatttcacatcatatcacatcattatataatattgggcgttatgttacctggaatctacgcagccctcacccctgtaacgcgccacaagattcggtgacgagggacagggggttgatttcttcgtcccagggcaaatccaggcgacagaaccagtcatggtcgcctcgccagataggagcgcccatgcgggagcgtggagaccctgtttagttgttcattcttttcagatcgctcatggaacctattatccggttgtcggaacgcgactgaccctctcaaaccctcaatgcaagtgcccgcggcgctttacggcagccagctccggacacacccctacctcctcgaccaccatgacatttcgctggagtcttacggaagcggttacaccagggagagccccgtcagctggacccactcccccacacacccgggatacgaagcgttggaaagtcagacgggatggcccgcccaggtgcacgtagacaagtttcctcccaggctgggcccggatggaggtcgcgccccggggttcaaggtgcagccctaccaggtgcaggtgatttcggtgtccagcccgaattcacatcgctggagggtgcggcgcatggtgacaatggatgccaggatgaagggaacgagcgtggggctgtcctgtgtgccagaatgacgccagcccggcaaacgggcacaagttctcaccccgcactccccctttgccccacccacagtacgcccaccccgggatggagtggtctgaggcggaggcgtacgctcaggcagcgctgctgtcgcgccagcagccccagctggggggcgggctgccgctgaccgccgacctgggcgcgctgctgggccaggcccagctcggcgcccagcagcagcagcagcagcgccagcaccagaaccttcgcccgcagcaggcgcagcaggcgcacatggggggccagcgcgggcccggtccccggcagggcagccagggcacgcaccgcggccgcagcaggaacggcgggcaggccaattctcaaggctaccgccgcatgtggcagcagctggcacgggtgaggcgatgggggatgtgggttcaaatggggaaagacagttggcaagcgggaaggtgctcttgagaagtaccttgggggtggcggcctgtgctgtggtgctttcctcctgtaagcacatgtgtgctgcatcgtcctttccgatgctggacaggaccccacgcacactccctccatcgacgtcccnnnnnnnnnntggcgtgcgcggacccgcacaccaaggctccggccccaacggcttctccgagctgacgnnnnnnnnnngggcatatgtgtgctgcattgtcctctctgaagctcgacagtccccccacgcacactccctccatcgacgtcccaaaactcacactccctgctccgtccctgcgcagtcggagtctgggagcgggcacggcgcgcgcggacccgcgcaccaagcttccggccccaacggcttctccgagctgacggtggagggcatggtgctggccgtccgccgcctgccccccggctcccccgtgctggacgcggtgcagcgggtgaggccctcgtcgcaactctgtgggggaaggacagcgtcagagggggtctgactgctgcggccctgcatgatcggctctgaatgcccgcggcgcgccgagtctccaatgtgtctcgcctcggctccggctcgctgtgactcgcacacatatcgacccctccctcccgcgacagcctgatcccacccccgcgcccatcnnnnnnnnnnttcagagagtgtctgagtgctgcggctctgcataatcggctttgaatgccctcgtcgcgttcagtctccgatgtgtcttgcctcagctccggctcgctgtgactcgcacacacatcgacccctccctccctcgacagcctgatcccacccccgcgcccatcaaaaccttgcagggcctgtacgcgctggacgccggcgcgctggcagccctgctgaaggagctgcacaagggcgggcagacccagcgcgcggccgagatcttcgactggctgcgcggactggagccggggcaccccctggcggggctgtgcaacacgatgacctacacgaccatgatcagccagtgcggcgcggcgcagcacatccggcgggcgctggagctggtgtcggagatgaagacgcggcgcgtgcccgccaacgtgcacacctactccgcgctgatgaacgtgtgcatcaagggcggggagctggagctggcgctggacgtgtactgccagatgctggcggaggggtgccggcccaacctggtgacctacaacacgctgatcgacgtgtacgggaagacgggggcgtgggaggacgcggtgcgcgtgctggacctgctggcgcggcagggcatcgagccggaggtgcggacctacaacaccgtcatcatcgcctgcaacatgagcgggcaggcgggggaggcgctgcgcgtgtacgaccgcatgctggcggcggggggtcggcccacggccaccaccttcaccgcgctcatctccgcgcacggcaagcgcgggcagctggaccgcgcgctggcggtgttcgacgagatggtggccgcggggtgcgagcgcaacgtcatcacctactcctccctcatctccgcctgcgagaaggcggggcgctgggagctggccctggacctgtttgcgcagatgcacgtggagggctgcgcgcccaacgtggtcacctacaactccctcatcgccgcctgctgccagggcgcgcagtggcagaaggcggaggagctgtttgagcagatgcaggcgcgcgggtgccccccggacaccgtcacctacggcggcctcatggcctgccacgagcgcggcgggcagtggcgccgcgtggtcaccacctacgagcagatgcggggcgggggcgggcgcccggactccgtcgtctacaacgtcgtggtcggcgcgctgtggagcaccggcgcggtctgggcgcaggcccgcgccgccgccatcttccggcaggcttgccggtcgggacacttccgcctcaccgtgcacaccaccgaggcgacgggcggcgagacggcgcagggcgccacgccgccggcgcacgcgctggcggcggcgctgcccggcctggagggggcgccgagctggtgcaccatcgagtcggccgactcggccgctgcgccgacggcctcgctcccgcagtcgcccctgcttgtcgtagaggagggggatggagtgaacgccggctcgccaggccccnnnnnnnnnncgagcgggtgaagatggagagggtggtgggcatgggaatgggaggggtttagcagttgtgcattccaatggacattggaagnnnnnnnnnngtcggccgctgcgtcgacagcctcgctcccgcaatcacccctgcttgtcctagaggagggtgatggagtgaacgccggctcgccaggccccgccggcgtgctcatcgagttcagcgtgcacgcattcagcctgggctcggccgtgctgtgcctgctgcgctgggtgggcgagctgcgggagcgcctgccccgcgacaggggccaagcctgtggggcggggacgcacgtggccctggtcatcaacaagggcaagccctgcagggagcatgcctacccgggaatgcgcagcgccctgcaccagtgtgtcgccgcctggaaggccccgtttacgtgagtttttgggagggtgaagatggagaggggggtgggcttgggaatgggaggggtttggcagttgtgcattccaatggacattggaagttgcagtgtctgtggcagtatggtgcgagattatgggaaggccgtcgtgggggtttttaaacatggtgtgtgtgtaggatttcggctcgctccatgctcacccacccgtcctcgcgaattcccctgaactctgcaccccatctcctctctgtcaccgnnnnnnnnnntcagtatggtgcgagattatgggaaggccgtagtggggggtttcgatcatggtgtgtgcgtaggatgtcggctcgctccatgtgcaatcacccgtcctcgcgaattcccctggactctgcaccccatctcctctctgtcaccgacccctgaccatcgtcgaccctgcaggctgagggacgtgacgcaggggtgccgcctggaggcccccgccgaggccatctccgcctggctgggctcagagactgcccaatcggtgctggctgcggccgccgacctctccagctccccgcccgagggcaaggcggtgtggaccgccgccctgatcgaggacctggcggtggaggtgcggtgcagcgaggctttcgtggccgtgcgtcgcttcgaggagggccccggcgacggcgcccgcgcggaagttggcccgctggacgcgcccgcgctcgcgatgcgcaccgccgcgctggcgaccgcgcgc

SEQ ID NO: 47899 - DNA, 68 bp, Chlorella protothecoides
ccctagaccgccgctgccagcgcgcatcacatgtcgatggccggggaatcaaagtcgtccacgtcgtc

SEQ ID NO: 47900 - DNA, 61 bp, Chlorella protothecoides
ctcacggccgagatggcgtgcatggcagggtcggcaatgtattttatttgcacgggaatgc

SEQ ID NO: 47901 - DNA, 72 bp, Chlorella protothecoides
taaatgaaatttttaaaatataagtatttttatgggtcttccttggtttcgtgtacatacagtagtattaaa

SEQ ID NO: 47902 - DNA, 104 bp, Chlorella protothecoides
aatttgtgatgtattaggtgttagtccagaaactcgattaggcatgttatcagcaggtcagcattctttattagcacaaattataactcaaaactatgatacag

SEQ ID NO: 47903 - DNA, 61 bp, Chlorella protothecoides
gaaaggatttggaaatgggcatggagctaaacctaccactctcgacatcttggagcgtgcc

SEQ ID NO: 47904 - DNA, 66 bp, Chlorella protothecoides
tggattgtaatgcgctaatattttttcaataacactaccacctgtttgaattggagatgattgaaa

SEQ ID NO: 47905 - DNA, 101 bp, Chlorella protothecoides
tgctcagccactccaacacctccactgcgtcccacatccctgcacccccggcccacccagcccaggcaccaacctgggcgaggaagcgttgctgggcccgc

SEQ ID NO: 47906 - DNA, 68 bp, Chlorella protothecoides
taaaaacgtaccataacaatggactctaatcaaataaaatataccaatttttatgcttgtaaaaaaaa

SEQ ID NO: 47907 - DNA, 71 bp, Chlorella protothecoides
cttcgaggtctggaccccggctggtgctaaaggaaagtttggcatctctacaccccagagatggggaaggt

SEQ ID NO: 47908 - DNA, 61 bp, Chlorella protothecoides
ggtggggtggggacagttcatcctgaaaccgcccttctgaatcacgcatctacccaccacg

SEQ ID NO: 47909 - DNA, 73 bp, Chlorella protothecoides
cacaaccagttccgagccatgtttgtcatgaactgcaggtgctcacaaccagttccgagccatgtttgtcatg

SEQ ID NO: 47910 - DNA, 61 bp, Chlorella protothecoides
cgaagagcggacacacaagatgaggacgagtgcccgtcgaccagtgcacccaagacaattg

SEQ ID NO: 47911 - DNA, 68 bp, Chlorella protothecoides
ctttgaggcccagcgttgggaaaaggtgaatgatatatgttccgggtagtaaagaaaggcgtcggggg

SEQ ID NO: 47912 - DNA, 260 bp, Chlorella protothecoides
cgtcagcaaggagggaatggcagtggtcgtcacactggatgtgcagatgacagatgaggacgtcagggtgtcgcacaccatgaagttgacgatgatcctgaatgcactgggtggtgggggagggcgactttgccttctggggcgggggcgagctggcctttgggggagggaaggaccgggtctttggggtgggggcgaactgttcttcttgggcggcggagacctggctttgggcggaggggacgacctcttcctgggtg

SEQ ID NO: 47913 - DNA, 64 bp, Chlorella protothecoides
cgcctgtcccgcgtctccgccatgtccacggccgcctcccagggcctgcagcgcctgtcccaga

SEQ ID NO: 47914 - DNA, 61 bp, Chlorella protothecoides
tcattctattcctgagcagcccgaggttgagcagccactgcaagcatgcctgtggacctca

SEQ ID NO: 47915 - DNA, 61 bp, Chlorella protothecoides
tccagtcccttgttcatcagcgtggctgggtcgacagggaagaaacagggggtaagttttc

SEQ ID NO: 47916 - DNA, 61 bp, Chlorella protothecoides
tgagtgggtgattgtctcagcgtggcagggtggtcgtgtgcatgcgtgcgcatgttggcat

SEQ ID NO: 47917 - DNA, 71 bp, Chlorella protothecoides
tctggccccgccgccaagtccgccaggcctgccacggggcgcgccagcctccacgtcctcgccagggaggc

SEQ ID NO: 47918 - DNA, 67 bp, Chlorella protothecoides
tgccatgcagccgccaaggactggagacgagatatcgacccggcgcgcagtctgcagctgaggatcg

SEQ ID NO: 47919 - DNA, 154 bp, Chlorella protothecoides
atatatataaatatatttatacaaaaaaagagtctatctttaatttttgtatattcaataaaataacacatatgatttctacacctttagaacaatttacaatatcaagtataatacctttacatattggtaaatattacttttcttttacaaa

SEQ ID NO: 47920 - DNA, 61 bp, Chlorella protothecoides
gcgccgccatgtgcaaatctcctatcatcaccctcctccgattcttgaaggatgccatgac

SEQ ID NO: 47921 - DNA, 68 bp, Chlorella protothecoides
gatggctattgctgagcgcgatgtgttccggtatcctctccaatccaacccaggggaggggcatttct

SEQ ID NO: 47922 - DNA, 61 bp, Chlorella protothecoides
tattgtcaagtggttgcagtgccgcatccgtgtctgcctggccagcctgcttccgccgctc

SEQ ID NO: 47923 - DNA, 61 bp, Chlorella protothecoides
tcagccgccaggcactgatgctagaaaccacgtcgcaaaccaagcacaatctgccccaaag

SEQ ID NO: 47924 - DNA, 62 bp, Chlorella protothecoides
gcggcggggcgccgtcgggggaggccaccaggtggggcggcgccagccgcggcggggcgccg

SEQ ID NO: 47925 - DNA, 122 bp, Chlorella protothecoides
cgagcagctggacctcgccggccacagaagctccggtcattacttgcccagcctcgccctgagacccgggcgcggcctcacaatgctttgagacatggcccatacagaagcacaaccgccat

SEQ ID NO: 47926 - DNA, 22443 bp, Chlorella protothecoides
  modified_base (174)..(229): a, c, t, g, unknown or other
  modified_base (851)..(862): a, c, t, g, unknown or other
  modified_base (1104)..(1113): a, c, t, g, unknown or other
  modified_base (1201)..(1408): a, c, t, g, unknown or other
  modified_base (1496)..(1505): a, c, t, g, unknown or other
  modified_base (1577)..(1651): a, c, t, g, unknown or other
  modified_base (1877)..(1886): a, c, t, g, unknown or other
  modified_base (2233)..(2242): a, c, t, g, unknown or other
  modified_base (3570)..(3579): a, c, t, g, unknown or other
  modified_base (5708)..(5717): a, c, t, g, unknown or other
  modified_base (7427)..(7436): a, c, t, g, unknown or other
  modified_base (9472)..(9481): a, c, t, g, unknown or other
  modified_base (10128)..(10137): a, c, t, g, unknown or other
  modified_base (10261)..(10270): a, c, t, g, unknown or other
  modified_base (13244)..(13253): a, c, t, g, unknown or other
  modified_base (13706)..(13715): a, c, t, g, unknown or other
  modified_base (14264)..(14277): a, c, t, g, unknown or other
  modified_base (14411)..(14420): a, c, t, g, unknown or other
  modified_base (15741)..(15750): a, c, t, g, unknown or other
  modified_base (16007)..(16016): a, c, t, g, unknown or other
  modified_base (17705)..(17714): a, c, t, g, unknown or other
  modified_base (17965)..(17974): a, c, t, g, unknown or other
  modified_base (18306)..(18315): a, c, t, g, unknown or other
  modified_base (19008)..(19017): a, c, t, g, unknown or other
  modified_base (19659)..(19744): a, c, t, g, unknown or other
  modified_base (19811)..(19820): a, c, t, g, unknown or other
  modified_base (20291)..(20300): a, c, t, g, unknown or other
  modified_base (20548)..(20557): a, c, t, g, unknown or other
  modified_base (20784)..(20793): a, c, t, g, unknown or other
  modified_base (22239)..(22248): a, c, t, g, unknown or other
  modified_base (22302)..(22361): a, c, t, g, unknown or other
agccccgccagcgcgcgcaggagtgtggacttgccagcgccgttggggccagccagcagcacgccgcggccgggggccaggcgcagggccaggtcgcgcgccgcccaccgcccgtcgggcgtgcgcaggctcaggccctccagctccagcagcggcggtggcgggggcgggggnnnnnnnnnnnnnnnnnnnnnnnnnnnnnnnnnnnnnnnnnnnnnnnnnnnnnnnngaagcggcgccgggcgccggcagcaggcgcagcgccggctccaactcggcccagggcgcgtcggtcagcagcgtggccgggaagaccttcgaccctgggggggggagccagggaatgagggttgcgggacgtcacatgggacgcgctcgtgagaccatgtgggcttgcgctttgccgccatgggcccctcttcatccgcccgcccaaccgggaggaggtgcagaacgcagccagggcccgctcctcctctgcacaaggacaagcccctgcctcccctctcccatggaccggaaagaaagaacaaaacacctctcacccaggcgcgggtgcaccagcagggcgcaggaggagacgccctgcgccacgccgtagcccagcaggtggcgcgcggcctccgcctcggcccacggcttcgaacccggtcgccccagcagggcgcggccggtggcggggtccaccgcgtccacccaccgtccccggggcaccagctcgacgtgcacggcgtggacccaggccaggaagcgcgccagggcggcgtccagctcggagccgtcctggtgtgaggtgcaggggaagggtattggcagagtgtgaggcttagcggcgggtgtcatggggcggnnnnnnnnnnnnagcggatggtgcccgcatccccatcctcgactctaccatcgtcaggccgggttccctccccgtgggctcccctgggaccccacctccgacccgcctccagcccccacctcaccctggactcgtgcgccatgggctgcagggtgaggcaggccagcagggccccggcgtcgggggcctgcgggaagacggcgcgcgcccgggtgtgcatggtgctgccgcgcggcaggcagtgcaccgacagnnnnnnnnnnggggtgggtgggcatgtggggatgggtatggaggagggtcttggagggcaagctgttagagtcaccaggcgggtacatggcagcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagggccccgacgtcgggggcctgcgggaagacggcgtgcgcccgggcatgcatggcgctgccgcgcggcaggcagtgcaccgacagnnnnnnnnnnaaagagagagagaggccggggcagggccgtagaccctccaagggctcggctggctgtgactgcctgccgtgnnnnnnnnnnnnnnnnnnnnnnnnnnnnnnnnnnnnnnnnnnnnnnnnnnnnnnnnnnnnnnnnnnnnnnnnnnnaagcaggcctgaggaaagcgcggcgacagggatggcagtgcatttgcctgccatggctgtacgcagcgaccacttctccagaccacgcgtagcacataggtgatggattggtgcacctcccgcccgcccgccagctgcccactcttcagcagttcccatggcagatgccaaacccctccactccatcaagagccacccctcgacgcctcttctcgccccccacccnnnnnnnnnngatccatcacctgtgtgaaacgcgtggtctggagaagtgatcggtgcatacagccatggcaggcaaatccactgccatccctgtcgccgttctttcctcaggcctgctcgcgcgtgtgggggagctgctggaggagctggagtctggcgctccgtcgattgagaggagtgacacggcaggcagtcacagccagccgagcccgtggagggtctacggcccggccccggcctctctctctctccctgcgtgggtaggggaggctcccgccagggatcccgctctgcgctttgcatcgagctcggagcccgaggccgagctgtcggtgcactgcctgccgcgcggcagcnnnnnnnnnncccctcacaaaacaaagtctcatccctcctcctcaccaggcaggcgcgcgtacgtgttaagcttgtccatcagctcggtgaaggtgtagaccagggccatggtggcaaaggcggcgttggacacgaagcgtgcggtgtcgccagggtccccaccacgcggccctgtgccagagaacacggccacggccacggcggtgtaggtcagcagcgcgccgccgtagtcgacggccttggtgctgacctccagcgcggcctggcgcggcaccagtcgcgcctgcgcgcccagcgcggcggccgccgcggcgcccagcgcctcggcctcggcgccgtagtggccggcgccaccgcggccggccagggccgcgtcgtggcgaagcgcgcgcaggcgggcgtgggcggtgcgcaggtcgccctccgcactttcctgcgcgtacaccagccgcgccagggggaccgccacagaccttcatttgtttttgatgcggggggggattgatgagatgatctgcagtcctaggggaatctgatcaccaaggctgggactggtgatcagcggatgatagccccctgtgacacagtgacgggcacctccacacagcccatttcccgacaacgggcctgctcagcctcgcacagccttcacaccatcacacgaccacccgacccatcaaccgccatcactttgcccccactccttccctcccaccactgcagcagggtggcgcagatgaagtaggcggcggccaccgccaggccgcgcaaacccaggtacccggcggtcagcgcggcgtagtaggcgccgcggaaggggatgctgaccgccacgcgcgcgacggcggccaggtcgtcacacagcgcgcgcgtgtcgcgcgtggcgcgctggtcggggttgtccaggcgcagccccgcgaaggcggcgcccgcgcagtaggcggcgtgcagcgtcgcagtgaggcgctggcgccagctcagcgccagccggcgctgcagcgcggtgcccacgccggagagcaccgcgcaggcggcgtacaggactgcagagtgcagcgtggtggccaggaaggcgccggggtcaaagtccaccaggatggcgtagtagctgccggccaccttgcccactgcggcaaaggggggaagggcaaggcacgtttcgaggtgccaggcactgctgggtcatcagggcatgcatggttgtacgtaagctccaggcctgatcaaggaccaagccttcgagtccagggtctgcccaaaatatcatccatttcggggctcaccctgcgcgaccacgagcgcctcggcgatggacagtccagccaggaagagggttnnnnnnnnnngtatcatgcatttcggggctcaccctgcgcaaccacgagcgcctcagcgatggacagtccagccaggaagagggtttgccagggtctgaacagcacgacgaggcgccagagtctcctgcacaggaacaggtctgagacggtgttgggcggcgtggctgcctgccatgcttctccgtgcgtgtggggtatctcctggctctcagcgcgaccctggtgggtgggacgcgggtcgagtgggcaaattgttggggagttgcgttccaggagcagtttgaagggcctcaacagcccatcgccagcctcatcggcccatctcggaaatcgcgctgccaggttctcaacccccaaccttgccaatcctgcgtaccgtgccgacaggcagcaggggttcgctcaatcctcttgcactcattagatgtcaggctgttgcgtttacatatcaggtgttctctccgccatgtgtgtgcagcaagggccgcgggctgactccctcaccgacacgccaagttacagtttggagggatcagcattgacgctgcatgcaatctaatagtatctgagttcaaaagtaacatctcctgagtcgttgctactccagccattctgcctctatgttcccatgcacttcgcgccctgcacgttgccgggtcaccccagcgacgggacgggcagccagggcgcgagaaggggtggtttcgggctcgagctgacccacccaccagcttgaagccttgtgcagagcaggcacaggtcaaagaagatcaggtccagctcacatacggctgttgaagtgcaccctgcggtgctggggcctgcttattgtattttgcgcgtgcggtatttcctggtcctggcggaagagtggcccctccgagtcacatcttccctcctgcagagccaaccagggattctctgtacatgtctatctccaaatcatgtgccacaaggctacagaaggagtacaaggccatcgtccgggtacgcgctgattgggcggggtggtgacctgctgcatctttcccagtcctacgacagcatgcctgggacgcgagcctgctcgtggctcctctcggccccatgttactgcagacacagcatgtttcacgtccgcaggaccccgtgccgtgcatagaggcgcaccctagtcccagtagcctcttggtgagaggtggcagtgccccgcctgttcatgacagacctgcaagtggctgtccttcatcaggttcatgccgggtgcgaccccccagctttgatcagccccacatcagcctctcgctcacctgcgtgcaggaatggcactttgtactgcaaggccaggatgagttcaagggcggagtgtaccatggaaagatcaccttcccctcttcctacccatacaagccgccctcgatcctgatgttcaccccaaacggcaggcacgctggtttggggattggtaatggtcatgggaagctgtgcaagcgttcatcggcctgctttggtgcaaatgtacatgggacaccttggctttcaaacatgtttaattgtatcagaatcatgctacctctcaagccaatccttgtcctgtgatttacatcccaataccaggtttgcgaccaacaccaagctgtgcatgagcatggtgagccagtggtgccacttgtatcctcctgtggggtatgatggggtcatcaatgcagcccacgttttctaggcgaaatccagcaatgagccgcagtgtgcgttctagctggcgacccccgggtggacgagaaacaaccactcagcagctcagattgtgacagtgtctggaccagtgcacagacctgtaccctccaaaactcctcccatccccgcagaccgacttccacccggagagctggaatccaatgtggtcggtaggcaccatcctgaccggcctgctctccttcatgtacgactccgccaacagcacaggcgtggtgacctccacgcccgcagagaaggcggccctggcggcccagtccctggcgttcaacgtgcgcagccccaccttccgcaagctcttcccccactgggtggcgaggcacgaggaggcccagcgcgctgccccccctccgggaatggaggggggttgcagacccccggaacaggatgcggcagaggggccnnnnnnnnnncgccccccccccggggatgggggggggttgcatacccccggaacaggatgcggcagaggggccgacggggcctgcgtcggcgccagcagccgcagcccccgcgcctccacccgcggctgccccagttctcacgagttggagcttcctggtagcagccctactggtggcggggggcgcagtcgcgctgggcatcctgcacctgagtcgggttgcggagcaatgaatgtgctgccttgtactctgcagtgtggagtgcctgtctcttgaataatttcttggtcgcagcggcgaaacagggcaccatgtcagaccctgaaaatccgtcagcacaaccagcacaaggccatgggctctgagatgcagtgggctgggacaccgcagggaggaagctccaggtgtggacccctggaggagtccggcgggcacaatgcgatgtcgcacgagacccctgccaccttaagaaggcgcgatgccgcccctcctcatcggtcggccgcgtccgccacagtctcctcgctgccgcgcagggccttttgccgaccctcacgcagaccctcgagcactgccgtatccaatggttctccctcaccccctgcagctccagtgattgcaccggcctcatgcccagaccggtccaggggtaccggcgacgcaccctcaggcccctcctgaggcaatgcctgcgaatcaggggtcaacagacttggcaataagaagacagggtgacgttcgatgaagccatcgcactgaccacggtggaagcttgcacagttcagatccccagcccaggcatactctcacctccccattccgactgcttgccgtcgcggcactcttcatggcttggttggccttggcgatggctgggaaccaggcagccctgttctcgaggagcacggtcgccccaaagagcgcggatgcaccgactatgagcacaaaccagattcggcccttgtcaataggctgctgcggcagcggcctcgctgcttgcagggccgtctctgggggaacagtggcgagctcggcccaggcgggcgccccagaatggatggagagcgccatgagcgtcgcggctaatgccgtgcgtgccgatccaccgatggatgcgcacaccgtctgcgggtagatgaaatggccaggccggatgtccatgcatggatgtgggcagaatctggaacatgcacgaccatgtcgtccgtgcccctccatttcacctgctgtctggggcatgatgaggcatgtctcaaggcggttcctgagtatatgggtggtctgatgctcgtgaatgcaccggattggagactcccgcacaggccttggttgcgagagcgcgacgttgtcgccgaaaggtcctggaaacaccgcatgatcactcttattgtagcagatggttcataaatggtgcattacagcttgtagataggttgagcccagcataatccacaattttctgcagtcgagaatcggtaggaactgggaatccgcaagaaccaaacccattgcggaggtggcgtggcgggaaggaggctacgcttgaagggacgctcgatcaggctggagggtgaagaccgctcttgaacattccatcgatactctgattactagggagaccactgggagtcgccacaggctaaagcaccccctcccgcacgccgagtcagcgcttgatcaccgcccctgcacgaggacccaccaagtttccgcaggccnnnnnnnnnntcccctcccgcacgcagagtcagcgcttgatcaccgcccccagcacgaggacccaccaagtttccgcaggccctcaagtcagcccgctacaccacacaccccggaactgcgtgccaaacacgggaagtgaggcgatcgcagcctcaagcccacgatgatgcaggcaccggtgaccgtgctgcagaccaacacacggcgcgacaccggcaagaaggcgcagtatggcaacatcttggccgccaaggtgatctcgtgggtgtaattattggtctctttggggtatgctaggcgatgtgattgtggaccagcttctggtgcccccgctcgcgccgcaccgtggaaggggaatggcttataccggccaatgtcattgcttgctcgaggcccgcaccgtggctgcccagcatccattgccgcatgacaggctgggtggggtgtctgtcatcattgaccccagatggctcacctgcgccatagttggtgtgactttggccgcaccagtgtgcaattcggctacccacccctttctgccttggatgttcctcccaaagaccaatccccccacacccacactcagtcgctcactcctcgaatgaatctccatccactccttctttcctactccacaggccgtggccgacatcgtgcgcacgacgcttggcccacgtgcgatgctgaagatgctgctggatgccaacggcggcatcgtgctgaccaacgacggcaacgccatcctgcgcgagattgacgtgtcccaccccgcggccaagtccatcatcgagctcagccggacgcaggacgaggcggtgggcgatggcaccacctccgtcatcatcctggcgggggagatgctggccgccgcggagcccttcctggagcgcaacctgcaccccaccgtgatcatccgcgcctacatgcgcgcgctggaggacgcgctgcgcctcgtagatgccgcggccttccccatcgacgtccaggaccgggaccagatgctgaagattgtcaactcctgcatcggcaccaaattcacacagcgcctgggcaatctggtggcggtgaggcgtggaaggggggaggagctctgcctctttttggttttggggagggagtgtgtgtgcgtgtgtctgtgacagggacgctatggaatgatgttctggactctgtgcaggcattgctcaccaatatactggtgtgtgcgtggaccgccaccatgcctgctgtcccagggtgaagggggctgttgaagcgatgccacggacctcttgacaccttaaaataggaccacatccttgcgtccaacttctcctccctttattccttcctccactccaaggacctggcgctggatgccgtgcagctggtcaaggtggacgtgcccggcggcacgcccgagatcgacctgaagaagtgggccaaggtgggtgcaactgtggaggggcgggaatccaggagggagggggttgagacacccacagggtggcagacagtgcgtaggcggctcgctcccatgcaggtgttttcagcttgtgctcatttgtgcgagtgggtgtcgatccctgccatagcaatcgcacccccccccccacacacacaccgccctcgatcacaccccccttacatactccaaggttgagaagatccccggcgcttccctggaggactcgcgcgttctgcgtggcgtcatgttcgagaaggacgtggtggtgcccgggcgcatgcgccgcaagatcgccaacccccgcatcctcctcctcgattgcccgctggagtacaagaagggcgagaaccagaccaacgtggagctggccaaggaggaggactggtacgagggggccgggagctgtgctgctgcggtccagcatggagcagggagaggggggagtggtgattgccgtggatcattctcagcctctctttggctgctgccccccttcgtgcctccctctttcggcttgcccaccgtgcccttcgtcccagccaaccccacgcacacgggacccccccctccaccctctccctttctcatccacagggcnnnnnnnnnntgtggatcattctcagcctctctttggctcctgccccccttcgtgcctcccccttccggcttgcccaccgttcccttcgtcccaaccaaccccacgcacacgggaccctccccatccaccctctccctttctcatccacagggccgccctactcaagctggaggaggactgggtggcgcgcacgtgcgcgcagatcgcggcgctgaagcccgacctggtgatcacggagaaggggctgtcagacctggcggcgcactacctgaccaaggccggcatctccgccatccgccgcctgcgcaagacggacaacaaccgcatcgcgcgagcggcgggggccaccatcgtgtcccgccccgacgaggccaccgagcgcgacatcggcacgggggccggcctgtttgaggtccgcaagatcggcgacgagttctggacattcattgtcgactgcgaggtgtgctggtgtctgagttctgtgctgggctggaggcgtgtacgttttggggtgaaggagtctgaccacggcctcgctgccacacaagtgcaaagcttcgggtagcggggaatgagcgccatgtactcgacgggaggggtgtacagaaagaggctctgctggcacgaccgcgctccgaggccgggcccctgagccnnnnnnnnnncacagggagaggctctgctggcatgaccgcgctccgaggccgggcccctgagccggccgctgcgccggtgcagcaggcgctgccccggccctttgccagaatccattgcacatggccgtgaccnnnnnnnnnnagtgcagcaggcgctgcacaggccctgtgccagaatccattgcacatggccgtgaccgcagcacacctgccctccccgtgtccacaggaccccaaggcctgctccatcgtcctacgcggcgcctccaaggacgtgctgaacgaggtggagcggaatctgcacgacgccatgggcgtcgccaggtctgcgatgggatccggtcttgatggggagggggttgccttgggggagcaagccggtcctctggccgcacatcgcgcagcgcccagcgtgcatcgcgcgatgtgcggctcgttccccaacaggaaaacaattcttgtccggccgctagctcggccttggcctgtgctgcgctggagatgccgtgtgctgcacctcccctgctcccccccccacccacacaccaagacgccttgctgtgacccccccaggaacgtggtgctggatccgcggctcgtccccggcggcggcgcggtggagatggcggtgagccacggcctggcggagctgtccaccgccggcggcgtgctgggtaacgagcaggcggcctaccgcgcggtgggcgcggcgctggaggtcatcccccggaccctggcctccaactgcggggccaacgtcatccgcaccatcagcaagctgcgcgccgcccacgccgagaagagcagcagctttggcatcaatggtgagggcggcggcttctccgaacaggggttgggttgaggattggtggggggtggccagggcctcaagctgccagcagatgagaatgaagcttgcccgtcacctgcattcctgcatacttgaaaacaccaacactttcgccctcaccccgacaggaaacaccggcaaggtggaggacatgcgggagctgggtgtctgggagccgtacgaggtcaaggcccagacgctgaagacggcagtggaggcggccaccctcctcctgcgcattgacgacatcgtgagcgggctgaagaagcgcggcggtggcggtggaaagggcggcggcgtgccccaggtggacagcggcgagaacgtggactccgagcacatgctccaggagtgagtgctgccggcagtccgatgcagtctgtgcctgtaagagaaacccccatggtgtgccaccgggctcaacacagcgctgggggcaacaggggcagggcgagcgcaggggggtggagatgcctgcagcagaggcccaccctgtggcaatccctgggccctgactcggaagcaaggtcagtaccagacactgcttactgacactttggtcagcaaggcggcggcaggtctggtgacaacaggacacgcaacaagggaaaggcagcagggggggataggagcaggaatgcccacgaacgcccgctataggggaactccgcctgctcagggtgcgagtagggtccgttgctctgcagagaagctgggcgtctggagtttggcaagtcgctcctggtgcctacgagctgaatctgagagcgcggcgggtcccccgccacccgctccgttgctgaagaccacctcacttcttcttgttgctaacgtccagctcagacatgttgagcagcagggactcggagctgaggtacacgcggttggcggaggaggccaccgtgccggcgatctcgcgcgcggcctcgatcttcctgcacgatgttacagggtgtggggatggatgggtgggtgctgggtaaggaacatttgatcactctggacgccgccactctactggcagccactgccctaaacccatcctgcacgtactcccccactctgccataacactcccctacacccacctcagagtgatgaaggaggggttgtccttgatggcctggccgatgagcgtggcggactgcgcctctccctgcgcccggatgatggccgactgcttgtcctgctgcgccttgtccacctggtgattggaaagggagaagagcggggtgggtggaagtagcaacgaccttgggagagtcggcagcagcggcaagctagggctggagattgccgatcagttcacgatgggcatagggcatgccggtcattccccctcctcccctcacgtgatgtcacgcagcgctactgctggccaggcccccactgcagatggccctggtgcagcaacttccccctctcaaacttcatcatcgaccccttaccctttaccccccaccccccatccccccaaggaaagactcacgatgaacttggccttctccgcgtcctgctgcgccacctgcttggcctccacggcggaggtgtactcgcgggagaaggtgaggttggtgatgctcacgtcgtccagcacgatgttgaagtagcgcgcgcgctgggtgaggatgcggcggatgtcgcgcgataccacctcgcgcatggtgagcagctgggaggcattgtactgcgcgatcaccgacttgagcgtctcctggatgatgctgggcagcacgcgctccgcgtagtcggtgcccagcgtgcggtagatctccggcagcttctcgggcatgggccgggtgagcacacgcaggccgatgttgacctgcagattgtgtgggttgcaggaaggggaacaggcttggggagttgcattctgctggcgactccctccggctgggccgcagcatgcggccgacaccaacagaagcatgctcagtgaaatgacacgatggcggacgcactcgcgcaccatctggaggtcgcgggagccggaggtggaggtgatgacgttgggtcgggcacgcacgtcgaagatgatggggcgctggaaccaggggagcatgagatgcgtcccttccggcttcacctcgtcactcagaccgccgatgcggttgaacacgatggccctgcgcattgggcgggagagagtgcttccggcatccagcagcagcaagccatggggttgggcctgggacacgccacggcccatgcatggttgatgaagcgccactgaaccatacctgtgaccaccctcgacgttgannnnnnnnnntcggcatccagcagcagcaagccatggggctgggcctgggacacgccacggccgatgcatggttggtgaaacgccactaaaccatacctgtgaccaccctcgacgttgaacaggctgttggcgatgccatagaccgccgcgccaccgaccaccagcagcgatgccaagcgggagccacccccacccgcaggcatctttatgttacggacgttctccattgaaatcgggtggtgggctgcaaggggctgcagggatagtcacggcggatggggccgaggtggtgaccatatgtccaatttcggcgattgccaggctggcgcgcttcccgaaggcaacaggtcatcgtgaccgacaaggagggcaatcagcgtgaaccccagccaacctggtatactctaggatatgtaagccctttaaagatttgaggagtggatatctgtgcgttctggtggnnnnnnnnnngatcagcgtgcaccccagccaacctggtatactgtaggatatataagccctttaaagatctgaggagtggatatctgtgcgttctggtggcctgactgctcacactgacgacgcctggcagcggaggtctgaggagccgttcagtccgttcaggtgctgagcccaccgtcgctggacttggagtgatggttgaaatgtcgcatatatacattaaaaatattgagttttcacatcctgtcgcaggcagtgcagatcccgggggaagcaccgggcaccctgtctagaccctgcgaaccgagagcatggggcttggggatgcgctcttcaaagccacctccacattactgggcctgacaacacttgctgcaggcacctggtttgtcgcgacctcaattagcacgataaaagcctcacaggtgatgatgtgcttgcctttgagggcaggtgtttgcacgagccaaagcatgagtgccgtgaaaagttctctacaggtgagttcaatttaagggctgttcatctcaggaggacgggcgttcagccgctccttcnnnnnnnnnnnnnncgaggaagaggcatcgccacattgatatgagctttatttgcacttggtaagtagtttcccttgatcagttgtgcgcatacacagcaactggaagatggatctagggaccccccccccccccccccccccccccnnnnnnnnnntgcaacttgaagatggatctagggaaccccccccccccgacccggtaatcagccaaggataacgaggcagcagagaggcccagcccctctggccgagggggtgtgcggaagtgatctggatccatgtacacctgggtgcatcaattatggtaattagataccttacgcgctgtaattgaaatctaaatgataccgttttggcgtcacattcgagctcgtcttgcttatacgatgtgcagtgcaaggaccggcaccttgaaaccctagccattttcgcgagagctcagcgagacgagaaacctatgttgaggtcaccggacatataagtcatcgttacctctacgaacaccatgtcagagatttcttgagctccatgggtggagctatgcggaaagtggtccgctgaccgaaagagaatcaggacaccgtcacgtcgtcgcgagttgcgtgaagcctacactcagccgcgcggagttcctcgcccatcctgctcccacgaacccatgttcctccagcaaaaattttcaggggtcccatgagaatgacgcaggtaaacgcatgatgcgtttgccgatgctcacgtatccggagccggtgccaagtcagcgtttttcattgtcagcttggaccattctccgtactttctttgagtaattcgggccgcgttgtactgatgtttgtcaacctcaacgaactcctacaaaggcgcgcacattgccgggtgcgaagcacatacatcgctcataccaatcactgcaacgtttgtatcccattttactccccatcgaccccgagatcggccctttggacatcgtgtgcgaaccttcctgatcagtcgacacttcgaaatggccgacgcatccaccgctcgtctcgagcgcaccatcgtcgctcttgaggcccgcctggcaaccctgactgatgatggcgtgaagaccatcccagccaccagcaaccccggtgagtccccgtgccaggcagtatctcggctttaaggtgcaacctccgtagatattatgacctgcacaatgtcgggacagttgcgctctcacttccagtcgaagatgggcatggataccattcgcatctttggttccattgaatttgccttcgcaccttcagattgcacatcttgaggagcatctttgtactgacgtgctgcacccatttcataatcctcgcaggtccccttggactgttcgctttcggcctcacagtgagcagtgggcatggtgttctgggcttaagctgctgttcttgagcatttttggtggacaattgactccatgcatactcctatcctcacacatccccccccccnnnnnnnnnncctgggcttaacctgctgttcttgagcatttttgatggacaattgactccatgcatactcttattctcacacatcccccccccctgcaatgctacagaccgccctcctgcaaggcatcaactccactgtggtcgacaagggctctgtgggcctcgtctactgtgagtgctggggtgaacgagctcgcagggcttgatactcaccaagctgtcaaccgcgtccgagtgtcttccgacccctcatcgccagtctctgcnnnnnnnnnnggagctcgcagggattgatactcgccaagctgtcaaccgcttccgagcgtcttccgacccctcatcgccagtctctgctcactcctcgtgcagcctttggcttcttcttcggtggcctgtgccagctgattgccggcgtgctggagtactctcgcaagaacacgtttgccaccgtcgccttcgtctcctatggcggcttctggatggccgtcgccctgaacggaaccctcgtcgcggctggtgtctaccccacctctgtaaagggagaagagatgatggtgagttgattgggtttgggggtgtgccgatgtggcagactgttggtggtcgggtgttttcgcacccatacatcctgtcggatgtggctggccccctcggcatccattgtcaatggtcctgctgcaccaacctctcgtcgcaacatcattctcacgatccccgtcctcaacctcccccccacagctgtctctctggggcatctacaccttcctcctgtggctgtgcaccttcagttccaacctggccctgtcctccctcttcctctccctggccctgctcttcttcttcctggccggcggacagaccaatcacaacctgatgaagtttgccggcgtctggggcttcatcgtctccgccatcgcctggtacctggccgtggccaccctgatggaggagctgtacggccgcgtcatcctgcccatcgtgcccttcgcgcccatcaacaagatcaaggctggcaccttcggaacccgccgccgcgtcgacgaccccgagctcggcagcaaggagtgaagcagcgtgctgcagagcgcccacgccgctcccggggcgacacaagctcaagccgcctccgcctcttcggcataggtgttagcggggctactgtgagggtcgacgccccggcccctccttcggacactcgttgagaacctcatgcttgtagctttcccaaaccagaaatcgtccctctaaacccccagatccctgctgtggagcttcacacccacagaagagtccttcccattttggccttgacatcaccgccccctcctgcgcaatccctccagaggtgtccctatttttatgatgacagtctgtgccccccgctcctccctcttgagtcgattcccacctgcgtggttcccacgcacgggcaatcctctgccagattcaaacccctttttgaagtgttgcggtacacgagcttgtccacgttttgccttcagagtacagcaagccttgtaaaaggaagaaggttcgaggttgcgggattgaaggcaagggcaattgggagatggtggcagcattatgttgcatgaatctgcacggcggtgagtttagactagggaatattgttgacgcattctgaagacaccttcctccctcccggaggtacgtgagctgtgtgtgacctgtccccagcgcttggtcgggttcaccatgcaattgcctctccttctgcagtgtgcatcttgatattctacgcagccctcacctggcatgagggccaactcctacgtccttggggtctttctgtattacacgtcttcagcacaggaagctgagtggatcagagggtgaggtgagcgccaaagacaaaaagactgtgcgaaggaggatatttatgtgttgccattgccatagggggcggtgtgcacatgggcacgagcgtgtcaacgtcatacaggnnnnnnnnnnttgtgtggagggggatattcatgtgttgccattgccacagggggcggtgtgcaaatgggcacgagcgtgtcaacgtcatacaggagtgtccgagtcattgctggcgggggttggactcggtttatcgccacccgccagccagtcagtcaggaccgccgacacaggcgccagatccttgtccacgcctgggtctgagtcgtcgtctgtttgcccattctcttcggtggtcgcggcccctccaccctcgccannnnnnnnnnagactgaaggcagggggcattgggagatggtggcagcatcatgttgcatgaatctgcatggcggtgaggttagagtagggaatattatcgacccattctgaatacaccttccttcctcccggagtcacgggagctgtgtgtgaactgtccccagcgcttggtcgggttcaccctgcaattgctcctccttctgcagtgtgcatctcgttgttctacgcagccctcacctggcgtgagggccgactcctacgtccttggggtctttttgtattacacgtcttcagcacaggatgctgagtaaatcagagggtgaggtgagcgccaaagacaannnnnnnnnnttcgtccacgcctgggtctgagtcgtcgtctggatgcccgttctcgtcggtggtcgcggcccctccaccctcgccacacccgtcccagccccagtgcgcacggcccagtgcgagcagcccctcccgcgccgcggcctccaggcccggcgtctgcagcagggacgtgctgggcgggccggggtggccgtgtgccgcgcgcagcagcgccctcaggccggccaggacgcggtcgcccagccggtcggcagactgcggggccagcaccgccggccacacgtccagggccgcagtgaggggcgggagcagggcacgggccctgcccccggccgggcccctgccgtccagcaggcagagcaggtccaggaccaggcagcgcagcgcctgtggggggatttcatgtggaggagagcctgttggtgagccttatgttggtgtgacgaggtgaggttcagcacagactgttgtgctacctttctggaccccaccgccccctcgtctcatgctgcccccaggcaagcacgcatggcccccctcccttccccgccccttccccctcttccacccacctgcacggagccctggcagcgggccagggcggccgtgcccgcggcgagcgcggcgtgctcgctgggggaaaggctctcctccccctcgccgcacgacagcgagcacagcaggcggcggtgcaggcgnnnnnnnnnnctctggaccccaccgccccctcgcctcatgctgcccccaggcaagcacacatggcccccctcccatccccgccccttccccctcttccacccacctgcacggagccctggcagcgggccagggcggccgtgcccgtggcaagcgcggcgtgctcgctgggggacaggccctcctccccctcgccgcacgccagcgagcacagcaggcggcggtgcaggcgttggcgcaggcgggcgagcaggctggcagcgcccgcatcctcggcgcccaatccgccagctcctgcggccgtcccatcacggggcgccgcccagacccccggcgccgcacgctccaggcgccgcgacagctcctgcgccgcgcgcagcagcttgggaaaggcgttgcacgtccgcgcctcggccgtcatccagcagacggagaaggtcggcccgcgcgccgcgctgtcgcccggcgccgcttcaaaccagggcgccgcggcggtggcggcgccgggcccaccccggcacaccgcggcggcgcagcccagcagcgccgtctcccagcccaccaggagcagggcgggcgggcagctgggctccagcgccgtgctttccagccgcgcgaccacgtccagggccgcgtcgggggcgcggcgcgccnnnnnnnnnnnnnnnnnnnnnnnnnnnnnnnnnnnnnnnnnnnnnnnnnnnnnnnnnnnnnnnnnnnnnnnnnnnnnnnnnnnnnncggcggagatggccagggacggctcgggcgcgggcgggggcggaggggggacggctgccgccccggnnnnnnnnnnggagatggccagggacggctcgggcacgggcaggggcggaggggggacggctgccgccccggcgtccagggccgccgacgcctgcccggcctgggcgcctttgggagctcgctgtgcggcggtcttcgccgcccccgcccccgcccccccctgagcctccgctcggcgcttgggcgaggacatggcatcgtgcaccagagccagggtgtcggtggcggcgggccggccacccagcggcctgccacgctttccgcgccgagagggcgcctgggccatggcagcaatggcccgcgcgcgcgggccctccggcggcgcgccttggcgcggctcgggcgtgagcttggcggggtggcactccggcccctgtcccgtcggcgaggggccgggctgcccgggcagcaggggctccggcgcgtcggggtgccccccggctgcgggacccgaccccgccaggctgccaaaggcggcccnnnnnnnnnngcccgtcggcgaggggccgggctgcccgggcggcaggggctccggcgcgtcggggtgcctcccggccacggacgccgaccccgccaggctgccaaaggcggcccgccacctcagcatctcggcctgcagcgccgcgcactgccgctggagcggggccagggcatccgactcgggtgcaggcgggccatcgccgtcccgggctgcagccgtcagggaacgcagcccctccacctggcgcgccaggtcgnnnnnnnnnncgcaggcaggccattgccgtcacgggctgcagccgtcagggagcgcagcccctccacctggcgcgccaggtcgaccagctggcgctgcacggcctcgcgctccgcgcgctgcgcgctcaccaggtcgtccaggcgccgccccagcgcctggatctgagcctgcgccgccgaccgctccgccgtcagcgcctgctccgccagcgcacgcgcctcctgctcgctggacnnnnnnnnnnggcctgcgccgccaaacgctccgccgtcagcgcctgctcggccagcgcacgcgcctcctgctcgctggacaccaatgccttcagggcgccgtgctgctgcaccagctccacggtgttgagggcccgctccttgaggagggcctggggggggggtggaggggaggaaggacgagggcgggtgagcagagggcatcgggtgcaagcagcaggcagaagtctttaccaagcatggacatcatcatgtagcacatgcccggacacgctcccgcggtgcagagagcctctgcctcgcactcacgaggctgtcccgcagcttctgcctgttccgctcgctcttggcgagcttggcctgcagggcctcgacctctgtggatgtcatgtgttcaggagcatccctgggaattcattggggtgccgaggtttacatggtgccaggtcgcggattgtcagaggccgacagcgctgtgcacccggcagcagtgcacccaagcaccgggcacttgggcctgctgtcgtgccatttggcctcagtggtaaagcatctttgactgctcagatcaagtgttctatgcttgagtgtgtcctcagcgccttggcctgcccgatcgctgttcgcacgaggagttgatcgttctccatcgcgcgctcgcgcaatggagaacgctctggggatccttgcccctccctcaccccaccccccactcctgtaaaacacgttacgtttgcagcaaatgtgcatggtatgccaaaggtggatgctttccagttcgagacagtgacgatggatgaggggggtcagcgaggggatgggccagtcacaagggagcgagggggcccattcggggccccatccacgagagtttggggcgcaaaggggttttggtacagggggggagtctgctcccttctacaggctggagcgcggcggcacgaccctgggcctgccggcgtcggtccctcccttccggctggggaacactgcgggggagggctcgttccccgtcaccagggtcagctccaccgtcgtctccaccaggtccgactgcacatggagtgtgagtttgatttgggggaggttgggggagccagtgcatacttggattctcgcggtgcagcctgcagccacatgacacccctggcagggcctcgcgtgtgtgccgggggcgcttggctgccgcgaccccagaccccacagccctcttcgtgccgcgcgattccccactccatccctccccacctccacacaacacacccacccacctggaggttcaaagccagcaccgggccggtgccagccacacaagcgcgcgcggcggccagcaacgccgcgatgtctgccgtagactgcagcgtgatggctgccaccagctccccgtcctccccgcccgtgccgatcgcggcgggcttggacaggatggccaggggcagcgcatccgcggcggcggnnnnnnnnnnccaggggcgcttggctgccgcatccccagaccccacagccctcttcgtgccgcnnnnnnnnnnnnnnnnnnnnnnnnnnnnnnnnnnnnnnnnnnnnnnnnnnnnnnnnnnnntccaccccgggcgcgccggggtcgcggggcaggcccaccaccgcggcgcgcacgacgtggcccaggcccaagcccgacgcgc

SEQ ID NO: 47927 - DNA, 61 bp, Chlorella protothecoides
cgggagggcaacttcaagtgggatgcccaatcccagccataagagggcagatgaactgaga

SEQ ID NO: 47928 - DNA, 61 bp, Chlorella protothecoides
tcgtgaaagagctcactcaaggggcaagttctgtctatggcatgcagaaaacgggagttgg

SEQ ID NO: 47929 - DNA, 63 bp, Chlorella protothecoides
tggcaatttctcgcctgcagtaacggcactttactttgttgccgctactgcaatcctcatcat

SEQ ID NO: 47930 - DNA, 61 bp, Chlorella protothecoides
gtacctctaatcattcgctttacccgatacaactgcatacatgagctccagctatcctggg

SEQ ID NO: 47931 - DNA, 286 bp, Chlorella protothecoides
gcaaagtgcttgtgagcaaccatctgagccgcaatgaattcacgtacaagctcataggcagtggcaccgcttgaccaatacgcccaatccaagacgctgctgtagtgcagtcaacaatgcttaatatctagggtgcactcagaatagggtttgaggatatgaggaagatatttgaaactagggcttgatctttaccagaccctgtggccgtttatggaatcacactctcacacacagggggcatgatgcgtagcacgtctccttatcacacccacagacatacaaa

SEQ ID NO: 47932 - DNA, 61 bp, Chlorella protothecoides
cagcgagcaaggcttgctgcaagccagaggtccagcacccgacgcagcacatgcctttatg

SEQ ID NO: 47933 - DNA, 68 bp, Chlorella protothecoides
ttaaaaacattcaaagcgccctcgtcgggaataataaattttccagaaaatataactggtagctttat

SEQ ID NO: 47934 - DNA, 62 bp, Chlorella protothecoides
gtatgaccacaccatccggtgcgccatgggggcgatctggaccttgcgattcattcacactc

SEQ ID NO: 47935 - DNA, 61 bp, Chlorella protothecoides
ctccgggctggtgacacactcctacggcggtctcccttgtgcctctgcaccaagtcgaggg

SEQ ID NO: 47936 - DNA, 102 bp, Chlorella protothecoides
gcggattagttgggagtggttgaccgtggcacgatctgccggggagaatgagtaatatcatccagtatctggatcgtgaggtcctccagctgactccctgcc

SEQ ID NO: 47937 - DNA, 79 bp, Chlorella protothecoides
atgactttctacttaccatgcagatactctaccaactgagttaaaaaggcattttatttagaataaagttacttattaa

SEQ ID NO: 47938 - DNA, 75 bp, Chlorella protothecoides
cggcccagtacccacaaggaagcgccggccacggcgagatccatcacgcagaactcgacggcgtggcgcgccgcc

SEQ ID NO: 47939 - DNA, 61 bp, Chlorella protothecoides
tccaccacgtgaccgtcgctgtacgtcgtcacaagccgcagctcattgccctcacagggac

SEQ ID NO: 47940 - DNA, 94 bp, Chlorella protothecoides
ccgactcggcatccgatccttcacaagattccccactgccacccagtggcagtccccgtcacccccccccatacctcgacatagctgcgtgccg

SEQ ID NO: 47941 - DNA, 65 bp, Chlorella protothecoides
gtgtgtcggaggaccaggtgtgtttatgcttgcacacatgtgtgtgtgtgtgtgtgtgtgtgtgt

SEQ ID NO: 47942 - DNA, 109 bp, Chlorella protothecoides
cagcgtgtgcacgaagacggggggccgtccggggccgggctgcaccgcagagtgcgcggcgtaggcctcccccgccaggcccgcctgctggaccaggccctgctcggcg

SEQ ID NO: 47943 - DNA, 64 bp, Chlorella protothecoides
cgcgttctgcgtcgtcgctgccatctgcagggtcgcaagacagcgtgcagggcacgccatggtg

SEQ ID NO: 47944 - DNA, 69 bp, Chlorella protothecoides
gttgcacaggcagcgcaacagttctaagacatcctacctggtggagagcatagttcgtatgggaccagg

SEQ ID NO: 47945 - DNA, 61 bp, Chlorella protothecoides
atatccctgcatcgcctacaggcagcggagcgccaccacccccagccagaggatcagcccc

SEQ ID NO: 47946 - DNA, 61 bp, Chlorella protothecoides
agttccgtccacgacaccccgcatcactcctactgtaccaaaccccctcctcaaactcccc

SEQ ID NO: 47947 - DNA, 68 bp, Chlorella protothecoides
gacctcagtgagtgcagacttgcccagcgcggagggttggagtcgttgctgagtggagctctgagcgc

SEQ ID NO: 47948 - DNA, 61 bp, Chlorella protothecoides
ctcgtacagcatccagctcatgcatgctgaaagctgctctccattgccatgcacgcgcagg

SEQ ID NO: 47949 - DNA, 61 bp, Chlorella protothecoides
atcgtgctacatgctgcgatgtggcagggggggaaaacgaaaagtgctgaggctctaaggg

SEQ ID NO: 47950 - DNA, 74 bp, Chlorella protothecoides
ggatgcctgctgcgcacttcatcaggcaagcacccatctgaaacaagctgcctgccccccaccacagacaaatg

SEQ ID NO: 47951 - DNA, 61 bp, Chlorella protothecoides
gaacatcggtgagcagattggaggaggcggtggggtgacaccggagatgcggtgttgcttg

SEQ ID NO: 47952 - DNA, 72 bp, Chlorella protothecoides
gtgtgtgtgtgtgtaaatatctgtacaacaaacattcgatggcgtgtaaatggtgcaggcggggtgacatcc

SEQ ID NO: 47953 - DNA, 72 bp, Chlorella protothecoides
cagacgcctcgcctccaaggagaagagcagcgaggcatgatagcccagacgcttctcccccaaggagacgac

SEQ ID NO: 47954 - DNA, 63 bp, Chlorella protothecoides
aaaaaaatcaaattatatcttcaacaatagcaaaacaaatttacgcaaatcaagataaaattt

SEQ ID NO: 47955 - DNA, 61 bp, Chlorella protothecoides
gcctgaataagggagccatcacttcagtgcaccctgcctgcctagatcatgttgtggcggc

SEQ ID NO: 47956 - DNA, 68 bp, Chlorella protothecoides
tattgggtatgcaggactccattataagctgcccatcacacggatgcgccggtgcctcagcagcagac

SEQ ID NO: 47957 - DNA, 63 bp, Chlorella protothecoides
tgagtgctgagaagggtcagttgcactctggccaatgcaccacctcagaggagacgtgaccga

SEQ ID NO: 47958 - DNA, 74 bp, Chlorella protothecoides
ctcggctcatcaccagccccggtggtggtgggaggtggatgtctacagtcgaatctgcttgctggttcgcgata

SEQ ID NO: 47959 - DNA, 75 bp, Chlorella protothecoides
acgccgttccgcagccacccggtgtcgttgcacctggacagcgatgcgggaatggccagaagaagagaaggggtg

SEQ ID NO: 47960 - DNA, 131 bp, Chlorella protothecoides
cccacaagtgttgccgcgacgatcgtcctcctcaccaaggctttcaatcattctgtgtaccagtccaagcctcctaattccatatatccggcaatgggttccatgatgaaaggtcgagaaacctgtctccc

SEQ ID NO: 47961 - DNA, 96 bp, Chlorella protothecoides
ggggggggggcaaagtcttgccacctgcacacagccaaatcgaactgtgaccaaatgagtaatgattgtacagccatgttgatgcctgtgaatgaa

SEQ ID NO: 47962 - DNA, 67 bp, Chlorella protothecoides
ctggccacctgcgccaggccagggcccgccgtacgcctgggtgccgggggcggccaggggcacgcag

SEQ ID NO: 47963 - DNA, 78 bp, Chlorella protothecoides
tcattgcttggatgagctccatcatcacatcccttgaatcgctgtcatacaacgaaaatatccccattgctagagcga

SEQ ID NO: 47964 - DNA, 103 bp, Chlorella protothecoides
ggagacgctgcaggcacaggtgggagaatgtttgagtgggggtttaggggggtgaccaggcgtgaggatatacggagagaagagggggagctgggggcggatg

SEQ ID NO: 47965 - DNA, 73 bp, Chlorella protothecoides
tgttcagagacccgtccagagggagaaacccaatacaagatttctgcacaccactctgcggagtgtggaacat

SEQ ID NO: 47966 - DNA, 74 bp, Chlorella protothecoides
tggggaagaaagggcgggcctgtaggatacgtttggagcagatctgattgcaggcaggcgactcgtcaaggtaa

SEQ ID NO: 47967 - DNA, 64 bp, Chlorella protothecoides
cccgaccactgccgtgaaactgcaggtgagagccagggaccctgatcctctttctcgcatcccc

SEQ ID NO: 47968 - DNA, 212 bp, Chlorella protothecoides
gcgggtctccaccaaggtaaatgcaagaacttaaacaaacggtattgcatcctcaaggcgaacggattttgcttttagcgcatgtgtgtgtgttcaacactgctgagtacgattgcggctgtccttctcaactcaacgagggcatcgcaatgagtagtcgttccacaaccaattgggcacccttacttgtgatgcatcacaaaattattctg

SEQ ID NO: 47969 - DNA, 69 bp, Chlorella protothecoides
cgagaaatggattggtggcggattggggtcgggggttgtccgcagcggtgaggtgggggggactccaac

SEQ ID NO: 47970 - DNA, 74 bp, Chlorella protothecoides
cccggcgatcgcggaggcccgaggggtgtgcacatttgaagagcggcagggtatcaataccctgcagtggcagg

SEQ ID NO: 47971 - DNA, 61 bp, Chlorella protothecoides
gccgccgtgggccattgtatggctgtgatctctggatcgccatgctggttgccatccagtt

SEQ ID NO: 47972 - DNA, 90 bp, Chlorella protothecoides
ccgccgccagccacccaactttccagaaattcataaagcagacgcagtatcgatgtgtccatggcccgcggaccacgtctgacaagggcg

SEQ ID NO: 47973 - DNA, 61 bp, Chlorella protothecoides
gccgaggtggcggcgctggagggtcgcacggagctcggcgcggccgaggccgagcagcgcg

SEQ ID NO: 47974 - DNA, 90 bp, Chlorella protothecoides
acgcgcgactctcctcagaagctcaagcaccaaagctttgatacctctgatgatgatttcgtccattcgctgtcaaatcatacagcggaa

SEQ ID NO: 47975 - DNA, 848 bp, Chlorella protothecoides
  modified_base (98)..(219): a, c, t, g, unknown or other
  modified_base (455)..(464): a, c, t, g, unknown or other
  modified_base (556)..(623): a, c, t, g, unknown or other
  modified_base (706)..(715): a, c, t, g, unknown or other
gacgttgatgaagtgcacctcctccacagtatctaaggagtagtcagcctgaataggaaatgatggctgaggcattgctggtaggtgagtcttgccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatggcggcaatgacgtcgggcctcgtgacaaccagcaggtcgttgttgcccttcagctccgctgtgtgggtcttgtacctggtttgccgatggcaagggagggcatgagcacttgtggcttttcccgcttccccgcctctccaagcgaacccagccaagcatgctctgcacgttgtatgcaaccctcaccccttcctctcaccggtcgcccttgaagtcgtcctccgtcagcttnnnnnnnnnnatctagagtgggtgttcctgtctccctagcaactatctcctaccaggaatgcccctcacctgtcgcccttgaagtcgtcctccgtcagcttnnnnnnnnnnnnnnnnnnnnnnnnnnnnnnnnnnnnnnnnnnnnnnnnnnnnnnnnnnnnnnnnnnnngctcgaccactctccattagttcaacgacacgtgcccaatctccctgagaacccgccttacccgtagatggcgcagcagaagnnnnnnnnnnttcataccgccatctgcggtgggtatgcaaaagtcgtgaagatgctccatccctcgaccactctccattgcgtcaacgacatgtgcccaatctccctgagaatccgccttacccgtagatggcgcagcagaag

SEQ ID NO: 47976 - DNA, 202 bp, Chlorella protothecoides
gtctttgtaactgcgtgcggaccggcgttaggctgaaatatgaatgcgatgggttcatgaagccagagcagggaggatcccggcgatcaactcgcatcccatcggaagtctactcaccgaatcgtgggcagggcgaagaagcctatgccgggatcacaggcggcctgacaggggcatgggtttatcgtgagtcatgtggcct

SEQ ID NO: 47977 - DNA, 179 bp, Chlorella protothecoides
cgcccatgtcgtaccaataactcaacacgaatagtagccttacccaaacaactcctcgctccttgtctctcaggtagtggatctcatcgtacaccaagagctggacctccctcaccacctgggagaaatgaggcactacgaaagctgagcacaccatttaccagatttctggctctcag

SEQ ID NO: 47978 - DNA, 265 bp, Chlorella protothecoides
aatgtaggtgatcggagctttcctgcgcactctgagcaagattgaaggagcggaagcggccaagactcgattgagcgacagcgggttgaagcttgcagactaccttcctgcttttgagcgggacaatgaggaggtgttgcagaaggccgtcgacaagttcgagttggccaacttgttgtgacaacatgtgcagcattgagcagtcgtttcatcgatggctctttgaggagacatggatgtctcacatcgtgctgctgcatgttgt

SEQ ID NO: 47979 - DNA, 112 bp, Chlorella protothecoides
gaataggcgtggggagggctatatagacagggagcgagcaggcaaaaacgacagctgactgaccatggtgcacgaagactggggacctcaaggacgagggtctgaggggaag

SEQ ID NO: 47980 - DNA, 69 bp, Chlorella protothecoides
agactccgcctgccccaaaacctcagccccctcctcccacccctcctccatagaatcttcgtccaagcc

SEQ ID NO: 47981 - DNA, 71 bp, Chlorella protothecoides
cgttttgaaaatataattaaaacgcgtttttcgcctgaacaaatcttaagattaaatcgaatatcattaaa

SEQ ID NO: 47982 - DNA, 76 bp, Chlorella protothecoides
tcatatacccggataggtatgcgttgagagttgactctctttcttctccagccccaactgcatgtgaactgggcac

SEQ ID NO: 47983 - DNA, 67 bp, Chlorella protothecoides
tcaccttgtgacttgagagatgggagtgttgtcaggagaccctgaccgtgcactatgattacctaca

SEQ ID NO: 47984 - DNA, 63 bp, Chlorella protothecoides
agactgaaagtccggctgcagacgcaagggcagagctgaagctgaccggctcattctcccaac

SEQ ID NO: 47985 - DNA, 61 bp, Chlorella protothecoides
agctgaagctgaccggctcattctcccaacaccctccccccgacacacagattcaagctcg

SEQ ID NO: 47986 - DNA, 73 bp, Chlorella protothecoides
cgcccctcacctcccgcggcagccagcagtaccgcgcactgagcgtgccggagctgacgcagcagatgtggga

SEQ ID NO: 47987 - DNA, 61 bp, Chlorella protothecoides
taggcagggttagccggcaggaatgtcggatgtgtatctcggcgtatcttccgacccgatc

SEQ ID NO: 47988 - DNA, 61 bp, Chlorella protothecoides
ctccccgtgacgggagtggtcccgatgatcaccgccgctgggtcgggcaggcaggtcgcgg

SEQ ID NO: 47989 - DNA, 29988 bp, Chlorella protothecoides
  modified_base (469)..(607): a, c, t, g, unknown or other
  modified_base (704)..(713): a, c, t, g, unknown or other
  modified_base (803)..(812): a, c, t, g, unknown or other
  modified_base (990)..(1057): a, c, t, g, unknown or other
  modified_base (1594)..(1603): a, c, t, g, unknown or other
  modified_base (2585)..(2594): a, c, t, g, unknown or other
  modified_base (4227)..(4236): a, c, t, g, unknown or other
  modified_base (4322)..(4331): a, c, t, g, unknown or other
  modified_base (4413)..(4671): a, c, t, g, unknown or other
  modified_base (4871)..(4880): a, c, t, g, unknown or other
  modified_base (6725)..(6734): a, c, t, g, unknown or other
  modified_base (6803)..(6812): a, c, t, g, unknown or other
  modified_base (8646)..(8655): a, c, t, g, unknown or other
  modified_base (9542)..(9551): a, c, t, g, unknown or other
  modified_base (9966)..(9975): a, c, t, g, unknown or other
  modified_base (10190)..(10199): a, c, t, g, unknown or other
  modified_base (10548)..(10557): a, c, t, g, unknown or other
  modified_base (10876)..(10885): a, c, t, g, unknown or other
  modified_base (11276)..(11285): a, c, t, g, unknown or other
  modified_base (11766)..(11775): a, c, t, g, unknown or other
  modified_base (13166)..(13175): a, c, t, g, unknown or other
  modified_base (13948)..(13957): a, c, t, g, unknown or other
  modified_base (14023)..(14032): a, c, t, g, unknown or other
  modified_base (14200)..(14209): a, c, t, g, unknown or other
  modified_base (14693)..(14702): a, c, t, g, unknown or other
  modified_base (14861)..(14870): a, c, t, g, unknown or other
  modified_base (15089)..(15098): a, c, t, g, unknown or other
  modified_base (15742)..(15751): a, c, t, g, unknown or other
  modified_base (15857)..(15866): a, c, t, g, unknown or other
  modified_base (15946)..(15955): a, c, t, g, unknown or other
  modified_base (16383)..(16392): a, c, t, g, unknown or other
  modified_base (16529)..(16600): a, c, t, g, unknown or other
  modified_base (17757)..(17766): a, c, t, g, unknown or other
  modified_base (18391)..(18400): a, c, t, g, unknown or other
  modified_base (18896)..(18905): a, c, t, g, unknown or other
  modified_base (18980)..(19123): a, c, t, g, unknown or other
  modified_base (19497)..(19506): a, c, t, g, unknown or other
  modified_base (20240)..(20249): a, c, t, g, unknown or other
  modified_base (20338)..(20347): a, c, t, g, unknown or other
  modified_base (20418)..(20427): a, c, t, g, unknown or other
  modified_base (20581)..(20590): a, c, t, g, unknown or other
  modified_base (21099)..(21108): a, c, t, g, unknown or other
  modified_base (21614)..(21643): a, c, t, g, unknown or other
  modified_base (21700)..(21709): a, c, t, g, unknown or other
  modified_base (22371)..(22380): a, c, t, g, unknown or other
  modified_base (22941)..(22950): a, c, t, g, unknown or other
  modified_base (23090)..(23099): a, c, t, g, unknown or other
  modified_base (23675)..(23684): a, c, t, g, unknown or other
  modified_base (24500)..(24509): a, c, t, g, unknown or other
  modified_base (25207)..(25216): a, c, t, g, unknown or other
  modified_base (26410)..(26419): a, c, t, g, unknown or other
  modified_base (27118)..(27127): a, c, t, g, unknown or other
  modified_base (27196)..(27409): a, c, t, g, unknown or other
  modified_base (28134)..(28143): a, c, t, g, unknown or other
caaaccccaaccccaagccccaaaccccaaacccaccccttcgaccacaggtgagcgccggtttctggggtgcctggaccatcccgggcgtcacagtctacgcgctgaccctcttcttcgccaagctggtggcctacaccttcctctactggctgccctactacatcaacgcccagaaggtgggcgaccgccacctcacccccaccgaggcgggccagctgtccatcctcttcgacgtcggcggcgtgctgggcggcgcgctggcgggccacctgtcggacgtgacgggggcctcggccgtggtgtcctcctcgttcgtctggctcaccatccccgtgctctggctctaccgccactacggctccgtcagcttcacgggtgcgctgaggggggtgggggtggggttagtggacatggtgacctagcttgggctgggggtgggccgtgcccgggcagggccaggtcgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccccacgaccccccgcccgccccccaccgtaccaccacgcaatacacacgcagtcaacatcactctgatgatggtggccggcttcttcgtcaacgnnnnnnnnnngccccatgaccccccccccaccctaccaccacacaatacacacgcagtcaacatcacgttgatgatggtggccggcttcttcgtcaacgnnnnnnnnnngtagtgaagatggtgacctagcttgggctgggggttgggccgtgcccgggcagggccaggtcgagggttcacgccggggtgccgcagctcaccagtggagggcggccggtgggtgcgccgggggtttgatgccgtgcagcaggacctcttccaccgtgccgactcccttgcccgcaannnnnnnnnnnnnnnnnnnnnnnnnnnnnnnnnnnnnnnnnnnnnnnnnnnnnnnnnnnnnnnnnnnngaccctatgccctcatcaccaccgcggtgtcggcagacctgggctcgtccttgactggtgagcccgggggcggagtgggggggctgcgagcgtgtgggcgccgagtttcctgcgcagcgaggggtgggcatgccgccacgcatgctgcacgtggatgctcagcgacgtgcccgccctcacaccccagactctgctgccacgcagagcccatgcacccacgcattccctcctttccaccctccaggcaacgagaaggtgctggccacggtgacggccatcatcgacggcatggggtcggtgggcgcggccatcgggcccatggtcacgggctacatctcggagctcccgggcggcttcgacaacgtcttcctcatgctctacggggcagccgcctgcgcgggtgggtgtgcaaaggggagggtggagggccccccccagtggtgggccctgtgcgtgcgactgcacccttgaggcatgccgaggcagtcgacagtgcctggctcaaggagagggaaggcggtcccgcccctcatttgnnnnnnnnnnaggtgtgcgaaggggagggtggagggcccccccagtggtgggccctgtgcgtgcaactgcacctttgaggcatgccgaggcagtcgacagtgactggcttgaagagagggaaggcggtcccgcccctcatttgtgcatgagggctgcaccccgacgccaggcctttgcttgtgggcaggactttgcgacctgcatcgaccgacttgcagcctcacaccatcgtatcagcttgcctgccctccccatactgattgtccactccccatttggctccttcatcctaacccccccccccacacacacacacacacacaaacacacacacaggtctcctgctgatgaagctgctgatcaaggagtccaaggatctgctgcgtgcacggcgagggaccaccaaggattcgatgccgggctccacccccgccgacttgctggactacacccagatctcctcagcggatgacttccggtacctgccgccgggcgtgtctgccgacgcacacgaggccaccatcgacaatgagacggggcgggtcctttgatgcggcggtgggggggaatggagcaggggagcatgcatcgacgtgcactcctttgctctgtgtctggcaggggagcctgctggccagggcccctttggccccgacgcgccaggctcaaggaaacaggtacccgggactggctttggacccctcagatgatctcaaacccctgcatcccgggctgctctttgaggccccgccgccacgacccgggccccggcttgcttgcttgcatgtcgaaatcgaaagcatggcgacagccaagtcgggcagtacgagtgttgggagcgagcggtacaagcagcatgaggaaggggtgtggcgcaatgtgtagcgaggcagcgttctcatgagagcgtgcgggggcctggggccggggcccttgcagcaacctcctcatgccttggctgagcccttgccccagggtttgggtgccgggnnnnnnnnnngagtacgagtgtcgggagcgagcggtgcaagcagcatgaggaaggggtgtggcacaatgtgtagcgaggcagcgttctcatgacagtgtgcggggcctggggccagggcccttgctgcaacctcctcaggccttggcagagcccttgccccagggtttgggtgccgggacggccggactgagattcgtcgggctgggtaccggggtcgtggtagtgacgaccgtggctttccgctttgacgcggtgctcgtccccggtcctgacgctgcacccgctgcgggctcagctgccggctcggccgtcggctcagacacttgcccgcctgccacgcccgccgccgaccccaacggtgtgcccgcccccctgcccactgccgcggctgctgccttgtcagcatccacggctgtgccagcctttgcagaggctcgccgcggcctgggccgcgtggagatggcctgcagcagatccgccgcggtctccagggcagacttgaacgaggtgttgacctcgttcagctgcgccatcagcacctggcaccaggaatgcacaggcgaccgtttgagaagaggcactgtggtgctgcccgagagtgggcctctgagcacacaccctgtgcatccctgcagcacacacgattgagaagtagcccatacgctgaacggactccctccccttgccctatcccagcgcaccttgttggtggtctcggcggcccgcaggtcggtcgccgccgcgatgcgcgccgcctcgctctccgccaggcgggcgtacatgcgcttgctttcttcccgcgccttgcgtgcatcctgcacacgcaagaagaggacactgaggacctgctgaggaccgccacgtcggggctgcagcccccctggcagccgataactcagcatcatcccagcaggcccgaacaagcactcccacctcctgggcggcaacgagctccatgcgcgcgcggcgcagctcctgccgctgccccaccatggaggcctccatctccgttgcccagctcagcagccgctgctccctggtaagcggcttggcaccatcggccaccagctgcgcgcccggctcccctcccctaggagggggatggtggcaggagggacaggggattcaaggaccttccagggtggcaaatttgacccagccttgcggcctgaggctgggtatgaagcgaggcagcagcacaggagtagggcaggccgccgctccaagtccttgcacgaacagcagcaccccgcctccacttcccacgcagtactgcctgaggagcagggatcccacccgacgtttcacccccacgacccctcaccagttgtcaaacacgtctacagatcggtcctcggggcgaagtgccagcactgagttgttcccggattgccaggccagggcatggccactggcgtggtccaccaccacaaacttgtactcgtagactgtgccggtggggagatccacctcagccacccagttgtcacccgtcgtccacttcatgttgtgcccatctgccagccgccagttgcctgcgagagtggtgggcgccgtaggctttatacagtcatgctgtgccacaatggaaccaggccttccccacccacgatgatgccccagcacccaacaaactctctcnnnnnnnnnncagatttcatacagtcatgctgtgccacaatggaaccatgccttccccacccacaatgatgccccagcacccaacaaactctctcnnnnnnnnnngccacccgacgttccacccccatgacccctcaccagttgtcaaacacgtcgacagatcggtcctcggggcgaagtgccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacatcgcaagcatccccccccacccgcctcccaacacagacagggactcacccagcccctcctgactgcccacgatgcggaggcgctggccccagtctgtgcgaaagcagagggtgaaatgaacgcgagcggtgccccccacaccctgcgagggtgcgcgcggctgcaggaccacgccctccatgcccgaggaaggcannnnnnnnnnaccctcctgactgcccacgatgcggagtcgctggccccagtctgtgcgaaagcggagggtgaaatgaacgcgagcagtgccccgcatcccctgcgagggtgcatgcggctgcgggaccacgccctccatgcccgaggaaggcacgaccatggcaagcgaggacgggggtggagcagactcgggggcagcacttgcactcccttcctgtggctcctcagggtcgtcaccctccttgagttgcagcttttgctgctgctcctggaatctctgtgcaggattcagtggagacattgtttgctctgggctgtgcctcggggttgcagcatgccagcgacactcatgccccggcgagcatcaagcccctgctcgaccacctacctgccgcctcctggcccgccgctctcggagatccagcaggatctggttggatggggtcgactgctgctcggctgccgccgtgggaacctggggctcgctgcgtcctggatgcctgccctgggcgttcagctgccacttccctgcttggaggtgaggaggagggctacttgtcggaccccagccactgtgcaaagggagacgccaggcttccagcgctgtgtgcttcccactcaccgtgttggcgaggggctccgaaagccggcagcctccgaggaagggtgcggagacccgagctgctgaattcgacgtgtctagtccatgaggcgaaaccttgcaacgccatcggtgagcttgtgctcgggcatcgatgtgccgcccgcatcttggcgagccaaccgagcttcgcccgtcaggaggggaagaccctcgacctaggctcctacactggtcgccctccggcgatgaaaacctgggcgtgctagatgctgggatgtagccgatgtccaaggctttcccaggatggtgggcgcactagggtcgtccctgatgacgatgacacgtcagttccttatgcgcaaaggattcagcgcccttcaccatggccgcaggttctgtctagggcgcgatccggaggtggcagtacttcacaagcctatttgcagctcaaggaccgagcttattattcctggcaacatggtgcaagtcaaagctcactggtcatgcacgagcatgcatggcaagagctcgagcggtgaaggaagcgctcacttcccttcattcttctccttggcagccgcgcgctcgagtctgtccttcaggaagagcgtgaccacggccaggatggacagcaggacggcagctgcaaatgcagcctctgcgaagaacagtcgtggggttggaggcttgtggtatgtgaccaagaggtgtttggcactcaccctgcatacatcctcctactcctggttcacacaagatcttgttggcaatgaaccccctctggacctcgcgatttgcagggccaggaaatgggcgaccctgaaaacctcactttggtgcactcccgccaatcaactcacccgagttgtactccttgtaagaagactccacaaagagggtcagggtctgggtctggccgatgatgttgccagagatgacgctgaccgccccaaactcccccatggcgcgctgaggaaggagagggaggatggatgggtgccttgcaggtgaatagcatgctttccaccgatccgcaatgggacagtgggcgttgcggcagggttttacctactcccatcactcacagcgttggtcaggatgatgccatacagcagaccccatcgaatattgggcagcgtgaccttccagaatgtctgccacccagatgcgcctgggattaaacagggaccttcatgtctgagcagcagggatatgcatgcgcaagcatagtctgccagaccaaacctgcannnnnnnnnnccaaagggacagtgggcgtttcggcagcgttttacctgctcccatcactcacagcgttggtcaggatgnnnnnnnnnntacagggaccttgatgtttgagcagcagtgatatgcatgagcaagcatagtctgccagaccaaacctgcaacccctggcagcattatgactgtgctcatctacacaaaaacagcagtcagctgtacaccttccctccaggcccccacggaacaactcgccaagggaggtggcagcctcctcctcctggatgtccatttcctccagcaccggcatcagctcacggaccacaaacggcatggtcacaaacatcgtggccaaagccattcctgcaaggcaaggggggagagggatggggtaggtcggggtgtttgaccggcatctatgcatgggaggcaggctggtgtgaggagccaagtaagatgttgaccagatgaaggctacttgcactgccacatgccttggtcatagagaatgaccattgaacactcccgcaccgccatctcatcaactctggtctccatgccaccctcactcccgggtccctccatacctgggaaggcaaagacgatgttgaacccgaacctagagatgaggggcgcaaagagtccagagcggccgtacagcagcacaaacatcatgcccgtgaccacgggcgagatggcaaagggcaggtccatgaaggagatgaggagctccttgcccctaaaccggttgcgggacaggaagagcgccgccagcacgccaaacacggtgttgatagggaccgcgacggcgctgaggagcagggtcatcttcaccgcctgccggaactctggctccgccaggacggccaggaaggggccgatgcccttgctgaaggcttgcacgaagacgttggcaaagggcaggatgacaatcagggccatgtacccgatcccgacaaaggccaggaggaaggcgccgggggtgtcgatctggagcgagcgaggtggcgtctgagctgggtgcgcttggtacctttgcgccgagccgtggggccggcggagagttctcacagctggcaagacggcagctcgccggggtgcacagggttccagtcagccaccactccaccccaacggcagcccagctcaatgcgcaccttgcgccctgtggacttgtttgcgagtttgctgccaatacccttgcctttggggccgcctgcccccatgatcacactccttctttgtccggggcggtcattgtgtgcgggcagggcgaaggggctccgcaggcacctctccccggcagagcagccggtatcagacctggtgggaagaagggccaggcgccgtcctggaggagcctgtgaggccaagagagtcgtctgaagcgccccgctccattcaagattatcgaatctcaaagttgagcagcgtcgtggcgtcaaggcgccgtgcgtcgatccctgacatagtccaggagtacgccccggccgcatccctggaccctcttcggtcagaggtctaattggatttgcattgtcgtgcacatgatattgagatacgtaagtggttgtctaggagggatcatcgccaggactcgcgtcgcacccaaccctatgagcaagccatgaaggtctatattcggcgacctgctggcactttttcgatagcgcgccctcagcccgaaggggaggcacttgtctgggatcgactcggtgcagtgcaacactcaacaccgtgcatgagttggtatataatatcaatccgaccattgctcaacgcatgcatgcagcttgcctttcacatacatcacaggccttgcttgccgtagcgtggtccggttgtgacgtcgaccactctcccgggcttgaccaagtgtacttcccacaagacactcggcagcccctttattatacaccactcgatccgnnnnnnnnnntggcttgaccaagtgtactccccacaagacactccacagcccctttattatacaccactcgatccgatccttatccaaacgtggctgttctccaaacctaggtgccgtcatgactgacgagccaggcgtgccggagcctgccagattttctggccaggtagaggacgggcaggcagtgcccagcacgaccttcctgacgcctgtgcctgtcccacgaatggcgagacgcgtgatagggcaccaggtgtggggacgttaggcatgcgaggtatatttgtccctgcctgctggctgtgtatgctggcgctggatgccagggcactaccctgcagggcccctcgcctgagcagtgctgctcccctcctggcactcccgcagatcccagatgacatcatgcaagaccctgggctgagggaagccatagcactgctcccggccaactacaatttcgagatccacaagacggtgtggcggctgcgccgcgccggggcccgtaccgtggcactccaattcccggagggcctcctcatgtacgcctgcgtgattgctgacatcctgcaggcccacgccggcgtggccagggcctacgtcatgggtgacgtgacctttggagcctgttgcgtggatgactactcagccgtcgcgctcggtaggcgtggctccatgctccacaccagagggaaatagggtggcaggcgcagacgcttctagtcctgataattcagacaccaagctcgaggagggcatgcgttgctcctgggatgggtgtaccctgttgttattcttgctcgaggcccctacccttgccaacccatcgccgcaacccatccctcacccatggatcaattcaggggccgacttcctggtgcactacggtcacagctgtnnnnnnnnnngcaccggagggaaatagagtggcaggcgcagacgcttctagtcctgacaattcagataccaagctcaagcagggcatgcgttgctcctgggatgggtgtaccctgttgttatccttgctcgaggcccctacccttgcccacccatcgccgcaacctatccctcacccatggatcaattcaggggctgacttcctggtgcactacggtcacagctgtctggtgccggtagacatcacctccatcccctgcatgtatgtctttgtggatatccagatggaccttcaacaccttgtggacagcgtcaggtgcggtctggcggtgggaagaagtaaagaggagggagagatgttggggtgaatggtcggatatgagtggcatggagccatgactcaaccaccctgtcggactctgggcnnnnnnnnnntggtctggcggtgggaagaagtgaagaggagggagagatgttggggtaaatggtcagatatgagtggcctggagcgatgactcaaccaccctgtcggactctgggcccaaggggggcggctgcacgccacagtttcgtaccctcctattcgcctatgctgtgctgacctccaccctcctccacacaccctcccctgcgcaggctcaccttttcgnnnnnnnnnngttcataccctcctatgcgccatgctgtgctgacctccaccctcctccacgcaccctcccctgcgcaggctcaccttttcgcgggggacaaacctgatcatggcggggaccatccagtttgcgtcgtccttgcagcaggcccgcgccgagctctccaccgacttcccctccctggccatcccccaggccgccccactctcccccggggaggtgctgggctgcaccgcaccgcgctttcctcccgggacggatgccctggtgttcctcgcggacggcaggttccacctggaggcggccatgatcgccaacccaggcgttccggcctaccgctatgacccctatgcccgcnnnnnnnnnntcacctggaggcagccatgatcgccaacccgggcgtcccggcctaccgctatgacccctatgcccgcagcctcacgcgggagggctacgaccacaagggcatgcaggccgcgcgacgggaagccatccggaagggtgcgcgcggcgaggtctggggcctcgtcctgggcacccttgggcggcaggtgggtggtgttgtcctccctggttacctgtgtctccgcttgggggggatgcgcactttggctgcgtaaagaatcgtagggttgaggtgtggctagggtgcagagtttagaacaacaagaagatgtaccagcgcnnnnnnnnnngcggggggggatgcgcactttggctgcgtcaagaatcgtagggttgaggtgtggctggggtgcagtgtttagaacaacaagaagatgtaccagcgccgcattgggccttgccactgagcgacaggcaggctgctgcgccttgggccgtgcccgggctggcaccagcccgtaaacctcttcccctgccggcggcatgcccgacccctcaaccctcctcctcccccacccacatccacacgtgcacagggcaaccctgccctactggccagcctgcagcgcctggtcagggccgcgggcaagcagtacatcgtggtgctcctgtccgaggtgtcccccgccaagctggcggcgctgtcccccggcgtggacacttgggtccaggtggcctgcnnnnnnnnnntgccaggctggcggctctgtccccaggcgtggacacttgggtccaggtggcctgcccccgcctgagcatcgactggggcgagggctttgcccagcccacgctcaacccctacgaggcctttgtggcgctgggcgaggtgcccggctggtgggagggcgacggcgatggggagggaggcgccgcgccctaccccatggactactacagcagcacgggcggggcgtgggcggggacctaccatcgccccaagcccaaggggagcggggcagcggccctggcgaggctgagggcatcccgggccggcaaggccagcgaatgagatgattgcgcggggttgctgcatctggggccggatgtttgtaccgaacgaagcgctggacggcgccacgctttgccctgcagggggcgtggccgacccctgtgcgccaactctaggcagactctcctcctaccccttgccacgcttgcttggcaatttctnnnnnnnnnnaggggcgtggccgacccctgtgtgccaactccaagcagactctcctgggaagctcccaccccttgccacgcttgcttggcaatttcttgtatcattacatctgtgtattccgctcctcacagcaggaccgcaaatgggggagaaatgatctggcgccactggaaaacaggttggggtgctgaatgcggaggggcggtgcggggtggcaggacactctcgatgggacagggatggcacatgtctggtgggccacaaggccttctggcggtcacagcacgaaaaaatttagccggacaagttatgatgtatgagaaattgcttgggtgcggggtgtggcggcgaatacaggagagcagtcaacacatcgggaactccaagaggtcgccatccatggagtgtgctggcgtcggtgcccgactggttggcaaactcccctgtgcctgcgagggtgtgggggatgggaggaggcattctatgaagaagagggagtacacgacatcatccagccgtgagccgtgctgtctcccatgtcggtatgcgccccgatgtgcatgaactccgacactggagctcaccccaatgggatcgtattcgtcatccaaggaggacgtcagcttcgtccatcccagtggcacatacttcttgtcccgctcaacagttacgtgaggcgttcggggcgcctccttctcgaaaacggggggcttgccgcttgatggtagtgcctccgggctcctgtccctgtgaggatcgcgggcccccggcaccggggtctgggtatttgtcgacatttgttgggatttaaagcgattacaagggtatgctgcgcaccgtcgaggtgtgcaacatgactaaatggacgccatctcgggttcccgcagatcttctaatggtttcggaacagcttcgacacccaaacagtacggatgtacctagaacaaaaacaactacgtcgctcccatacacaacatatcactcaggcatgtcaatggacatggtgatccggcacgcctttcccgtagacagggaacttgaaaatctcgaccacagccagcagggatgagaggatccagattccgagcatggcagctaccagctgcagtccccatgcacgaggggtccatggcaggctgtgtggctgtgtcatcgggacatggacatgaacatgcaagtatactgcacaacatgcaatgcggatgtgcatgcacgtcaagctttacctgcacccggaggcccagccgctgtatagctgatttcccaactgacatcgtcttcaagtagatgcgagatcgctcctgacacgagcaacagaggcatgtggagctatagacgtttgcacatcaaacgcagtatgtttcacaggatagagcatgcttgccgagtcctgcacccannnnnnnnnnaatgtggagctatagacgtttgcgcatcgaacgcagtatgtttcacagcatagagcatgcttgccgagtcctgcacccattgcccatacatcggccagccgcctaaaatccttcacagtagaatggaaaggaagcccatgcccacctcgattggtagattgagtggcgaccagggggagcgcgtctggaaccaggtgtacgagccagccatcctgcctcccttcatgggcccctccgtgtggtctgggagagctgtgggctcgagtgcacgagccacctcctgcattggcgcttggcaggagacgtgttggcatcagtgtggagtatttttgtttggttgctttggtggcatgtctctccatgctccagggcgatcatcctggtgagggatgggcctgacaatgcacgccaaggacgtgcccctcccagcacatgagagctgccttcccgtccccctcacagcttccttgccggccctgcagcactgcacggagtggaagaacatctccagctgcttaagtggtcccgctggcacaaaggcaaagacgaagtcggaggcggtgccaatccgcgggtttctgcccaggaaagcatagctgtgcaggtcatggaatcctggcatggggtgtgcgaagctgggatgaaagtctttccccccgaggctccattcacaatgcacagggcgaggcatgaagaggtggccgggttcccccagaggatgtcagttgatatcccacaaataaatccaaatagccagccatgccctggttggnnnnnnnnnngcccccagaggatgtcacttgatatcctacaaaataatccaaatagccagccatgccctggttggnnnnnnnnnntgtgaggcccatgacagcaggcaggggtcagtttgctcagttcctgaactagtactccacaatattttctttggacagtcttggtccccctgttcttatgacctccaccctgcttacttgctccctctgcatccagcttcacaactcggtccacaatgcaggtgaggnnnnnnnnnnaacaggggctactctcgaccaggccaccaatatctgcagacccagtcactcaccaagacccaggctcgcaaggaaagggggctgcaggttgtacttgcacccagcagccacgacgaataggtcgcagggcaggatcttcctggaggccaaccctgacgtgaggcccatgacagcaggcaggggtcaggttgctcagtttctgaactagtacaccacgatattctctttggacagtcttggttcccctgttctcttgacctccaccctacttacttgctccctctgcatccagtttcacaactcggtccacaatgcaggtgaggcgtccttcgtgggtcagcctgaagtacccatcattggattggcctgtcatgagggtagttgggtctccagcagtggcaacacgtgaatcggcatgtgcagcctgacacccatgagttttggcgccacattgatggacatgggcacaggcactcagcaccannnnnnnnnnaagcagtggcaacacgtgaatcgggatgtgcagcctgactcacatgagttttggcaccacatcgatggacatgggcacaggcactcagcaccaggcattaattccagaacaaggattgagcagaccatatcaaacactctttctgtacctgagtagtcnnnnnnnnnncaacttcagaacaaggcttgagcagaccacatcaaacactctttctgtacctgagtagtccatgtcggccggtgctcccctgggcagccagtggtcgatgccgcaggggccataaaagaacttgcggaggtaccactgcaatcaggatactgggggggggaatcttctcaggctgggagcaaaccttattggcccactgcagtggcccggatctagccnnnnnnnnnngcatcttctcaggctgggagcagacctggttggcccactgcagtggcccggatctagccaagtgcagcgtctacagttcgctggcaccaagccacagctcccacagcagacgagacattcacctccacggctctcatcttcaacctccagggcactaggggggcgaatgcaactgctgccagtgtaaactgcctggagaacggcagcacccatctttgcgacgggaatggggttgaggcagcaggcagggtgaggctgggcaccttcagggctgagaaggcaggatgcatgctggatggaaagccaacaccatctggagcctccacagcctgccatgggctggatcatctcgtctccaaccctcaccggtatcgaggtcttgagacgatggtgatgtgctgtgcgttctgccgagcagccgcttcagccgcctctatggcgaatgacccagagcccatcaccacgaccctctacagcatggagaccagtggggagggagaattttgcgagtgatcaagccaaacaaactccagagccaagactggtatgacctcacatgaattgtacgggcattctgcagctgcacccgcgactcaccttccctgccaggtccaccgtgccagccagtgaatccatcccgagannnnnnnnnnggactggtatgacctcacatgaactgtacgggcattctgcagctgcacctgcgactcaccttccctgccaagtcgaccgtgccagccagtgaatccatcccgagannnnnnnnnnatggtatttctgcaccggtttcacttgcatgtatcctacctggtcccctaagatgccgcatgtgacacacaggaaggccnnnnnnnnnntggcgccctgcctgggtcagtttgcccctgtagccctggcccacctccactcctcgctcctctgctgtccactgcgtgacgaggacaaagctgagggtaccttctggggatatcggtgcgtcaagactctgtgatgggacagaggtggtatttctgcaccagtttcccttgcatgcatcctacctggtcccccaagatgccgcatgtgacacacaggaaggccgtttccatgacagactcctcgcctgtgaccaggctcttgcagttgacgaggaacctgtgacccaggaaggaggtggtcaatgtactacctgccgcagggcagacgcaagtatgcaccgcatgacatgcttccccttccaagaagtgagcacactccacacctgtctgcagccacttgggttacatccacggcctccgtagacagnnnnnnnnnntgagttggtccatgtattacctgctgcagggcagacgcaagtatgcaccgcatgacatgcttccccttccaagaagttagcccactccacacctgtctgctgccatttgggttacatccacggcctccgtagacagnnnnnnnnnnnnnnnnnnnnnnnnnnnnnnnnnnnnnnnnnnnnnnnnnnnnnnnnnnnnnnnnnnnnnnnnttagtcagtcagtaggctcttttcagtgaccagactcaagtctctgcggtcaaccctgacaagttcaacttcagtcccaagcatgccttggatgcgggggccttgccaaagatggaaggatgtactttgtatttggggtcccatcggtacatgggctcgtatgcctgggcattgagagaagatctgctgagtcatgctggcaacgcagccttggtggcggagcagattgatcacagtcgctgtcccgacgacatcaagtgaagcaactgcagacaaacacactgcacctgcaggaaggagtgatcgttcgccttggtgtgccagttgcctcccaaccgcttctctcgctcgatcagtgtataggacagacccttgtcgcggcactgtcgagcagccagcagcccgcagatgccacccccaatgatgaccatgtcacactgcatggctttggctgagaccatcagacgcttggatttggtgtataatgatgtgcaagatcgggtccgtcagcttgatgtgacgacgtgcctccactcgcctgctcgatctccctgaagctggcgctcgtgactcttggccttcctcgccatgtccgcatccggccgccgatagctaggtcaacgcagggaaggcaatgccacatgtaatggatctctatctttctcaatgcggatggctttagtgagagtatcctagtgagcttacaaagagcatagagtgcagtacataggagtacatatttccgagaggctggctggaaggtgtgtataactgggcaagtgaattttatgacagtttgtaaacagcctcatgctgcggcctatgctgcaagaacatgggtgttactggaagcatttgctgtgcaaacagtcctgctattctatcagtgtatacatgacaccttcattcccccactccccctctgactcataacctgcagccgccaggtatcgggtcacggcggggaggagcttcggagcttgattggtcgagtgcttgcctttccccgtgatgatcttcaggaatacacctcctgggtggccctgacaatggaggagggtggtcgcttgctgagaggactaagcgcgagtctgagccacgggctttcattcccgagcatgacattacatgacaatacacagccatcctcccctgcnnnnnnnnnnaacgggcattcattcccgagcattacatgacatgacaatacacagccatcctcccctgcatcctgaggcactgaccagcttggagaatgtgtgcaggtgtcgcttgagcacctacagccgatggcgcacaggttggatatttgagcaaggctaccacttgccaacgaaacctgccacataacccatctcgagtgcccctgctcacctccagagcctcctccacatgcatgccgtgcaggtccagcgtgaactcatttcggtgtacagagttactgcacacagcaaacaagcgacaagctttacaagatgacagacaggatgaggattgcaagcagctccaggggctgccggcactccacgcactggtcgcagtgcagaaagggcagcactggcaatcggttcacggccctccccacccacctgccgatgtacgccagggcattggctcgttgccgggcggctcgcgccagagcggcatgcgactgcgccgccttctgcagccaggcagcatgctcttcctctccctcggcacagctggccgctgcctgcaaaaggcgacaggcaacctcggtcacccttccatggccttgccgactcggctgcccggcacacagccatctgcacnnnnnnnnnncccctcggcacagctggccgctgcctgcgaaaggcgacaggcaacttcggtcacccttccatggccttgccggctcggctgcccggcacacagccatctgcacaaggacctgtcctggcatgggcgacatgaggctcacctccctgtaggccgcccgcgcctgcacgtgggcggccatgacggcccgctctgcggccgccagctcggcatggccgcccacccccggctgggcggaacagtgcgcagccgggtcgcccccctcagcgctcggggcggcctggtcgcgggcttcggggtcctgctcctccgcaggtgcaccccggtccttggcggtgcgatccaggactcggaacacatggcgggaggggagcaccacggacgcaggcaccaggggccgagcggcacgacctgggatgggaattgaaaccccactgtcgcctgcggatgcagcctctgcaacggggccctcgcctgcctctggcacggcgcgagggtnnnnnnnnnnaccccgactgggcggaacactgcgcagccggatcggccccctcggcgctcggggcggcctggtcgcgggcttcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctgggatgggcattgaaacccccctgtcgcctgcgggtgcagcctctgcgaccaggtcctcgcctgcctctggcacggcgcgagggtcgccggctccgggcgcagcctccgaggcgggtggggtcgaaggcgcggagcgcggccatacccgcaagggcggcggcgcactccccacacaggctggcccctccgcacccctgagcacgctttccagctccgctggggctgtgatggtcctgccatctgtcatcctcaccccgacaagtcctgcacaaggacagggggcgggatgcaaggaacggggcggttgttgcagctggttgcggcggggtcgccagccttcagaatggcctactgatgctgtcagcatgnnnnnnnnnngacggggcggttgttgcagctggctgcggcggggtgggcagccatcagaatggcctactgatgctgtcagcatgcatagaccacgcctgatctcccagacgaggagtgcagaggcaatgccaggttaccccctggggacacaccgtggaggaagctggtgccggggagcggctgaagggctcgagcgcccagcgcggcacgcagcacttctcccgaccgggccgccgcgacgccttcggcgcaggagatggtgatgtgcggcgggctgggattcaagtaggggatgccagagggcctcgacacggccaccacctggggagggaaggggggaatagtggggacgagatcgccatgatgttgatcacatgtctttcacaagaatgtttaccgatggtccataccaccggctcccgactgctgcatccccgatcccagccgagaccacactcccatgccctgtacctgcgactcattgctaatcacacagcccagcaccctcagcagcacgctctgtccaagcggcagggcttgacaggtgccgtggtcagggcggaaggcgagggtcacatggtcaccggagcgcacggcgagggtagggggccaggcctcccccaggatgcgctggctggtgggggtgaggaacacacccgcatagtacaccggattgggattgggagtagggaccagatcctgctgcgctgttccaggggagtgacaggagagcgccgggaggnnnnnnnnnngcccgcatagtacaccggattagaattgggagtggggaccagatcctgctgcgctgtgccaggggagtgacaggagagcgccgggaggnnnnnnnnnnctttacaaagctgaagcgatgaattttggagcaacgcaaacgacatatgtggccagctcacccaccggccnnnnnnnnnngcgtcccaggggtcccaccaagctcggctggagggtgcgccgggtcggtcggaaggcatgaggggctgcgcgccagcagcctttccgcgcttccttcgggtggaggccctggtcatgacgcagctccttccagttatgttgtccacggagatgnnnnnnnnnncgaggggctgcgcgcaagcagcctttccgcgcttccctcgggtggcggccctggtcatgacgcaactccttccagttatgttgtccacggagatggcatgggtctgtggcatgaggcatgtcatggcgtgggtgcatggcaatgaagaccaccaggagaacctcgcatgaatccagttggagatggacaggtcaaacaacattacctcgctggcatcccggggaatgcaccggttttacaaagttgaagcgattaattttggagcaacgcaaccgacatatgtggccagctcacccaccggccatcggtgaacggtgtgagacagtgagaacaatcagcacgccctgcgtcgcccttgcaatctactctgcctcattcgaaaggcagaggaagttttccccgaacactgtgcatcaaacgtgatgtactctaccctgtaacacagcgtgttgttttgcgagatcgggaatgtgtgtcggggagccctccactcctcgcggcacgacgcnnnnnnnnnngaggcagaggaagtttccccgaacactgtgcatcaaacgcgatgtactctaccctgtatcacagcgtgttgttttgcgagatcggggaatgtgtgtcagggagccctccactcctcgcggcacgacgcgaagcgaagcatggcagcaattgaaatgcacgatgagcaggtgtgacaccgtcaccgtcacaagcccagctcgaatctcgacatgaatcagactcatcgtgctgtcatagatccacgactccaaccatgacggtgcgtgctggtgggtgctcaaagcctttgggctgtggacttgctctagtgctggaccatcataaactccgtatccccgcgcagactgccccgcggcgtagcactggcgacatgcaggagtacctggatagaatgaagaccgtgctggccgagatcgaggctgaacaggtgggtgaagtgtcccacctactcagtgccaccctgtgtccatggggctcgtaaagcatccagctcatgcatgctgannnnnnnnnnnnnnnnnnnnnnnnnnnnnntcccccagcaattgcctcgacctccggggccaccaaagtcctccccacagccacccnnnnnnnnnncctccatgataaggtcgaccccgacctctgctcggggccaggcgccctccccgactcgcctgccgccctccccccagccattgcctcgatctcccgggccaccaaagtcctccccacagccaccccacctctcgcccagcctgctgggcaacgccaacctttctgcctccctgtccactttgacctccgacctcgaggccctgagcgggcactgggcttccacgccgcgtggggacaggggcctcaaggcccagcgcctctcgcactaccaggtctgggtgaagtccccggacacccagcgagcccggcgcaggacttttccgggctcgctgggagagagcactccgcgtcacctacttgaggaggccgatccggcgagagcgggacatgccagcgaggctgacgggagggacggcctgcctggagggagcgggagcacaccctgcaaagcagcgccagcctcgatccaggaggctgcaggcatgcctgccgctacggcgaccagcggcttgcaggggacagctttgctggttgaggcagtagcgctctccacaatcacagaaactgaattgaccggcgaaacgcgattgcctcagacgggcactggagtgcatgaggtggagacgacgtcagcctgggaggctgccggatcaccagacgtnnnnnnnnnnaggcactggagggcatgaggtggagacgatgttagcctgggaggctgccggatcaccagacgtggggacagcgatcctggacgatctgggaggccatcgcgaccaggaaccagcccccgtggaccagcaagcagcggcctcaagagaagagtctccatcagccagcgcgtcgacggcacccgaggctgccttcacagatgcggacacggcttcatcgggggaggagtctgcgcctgggagcccagctgctggcatcgcagtgcttcaggagctgagccgtgatccggtggcaggagcaccagggcccgccgttgagccggagcctcgcgcggaactgccgtctggctgccccacacccgtggaccgcatcgacctgatcagtcccccggtgttcctgacctgcttgccccagcctgggccgacctcgaccccagtggaggctggccccgggcagaccggctcccccaaccagcacaaccccaatgtcacagcggcaggcagtacggagcgggacggtgtgctgtctgagagcagcagcggggggagctcgggggcagatgnnnnnnnnnnacgggccggacggggggtgcggtgcagtgtggcgagccaggaagggcttggaatgaatgctcagcgtgcctgaccaggggggcactgcccgggcacgtcgctccacactgccgtcattcaggccaaggggtgctcacgcnnnnnnnnnnatcacaggggcaggcagtacggagcgggacggcgtgctgtctgagggcagcagcggggggagctcgggggcagatggcgccgaggacgtggggccccgcccgtcgccgccatgctcgcagcagccgcccctccaagccccgccgcagcagcgcctgcaggcgctctcgcgtctcaagcagcgagcagccgcgcgccacacctccgtcctctcctccgcgcagcggtgggcggcgggccggactgggggtgcggtgcagcgtggcgagccaggaagggcttgcaatgaatgctcagcgtgcctgaccaagggggcactgcccgggcacgttgctccacacagccgtcattcaggccaaggggtgctcacgccatctttgcatgcaggagccgcagcgcctcccccgaggtggggcctccacccggcgacgcggccgcccacgcgccaggcagtgcggccctcccgcaccgggccacccgacttgcgcacagccccgtgctcctcacggacgctggcacccaggtcctcgacacccccgccgcctcctcgcccaccgtggccgccaaacccttcctgnnnnnnnnnnatcctcggcaccccctctgcctcgtcgcccaccgtggccgccaaacccttcctgaagcggcgcacgtccgccgtgcagagtcagcggctcgactggtcgggggtagggcccaggaccaccaccaagctggaccccaacctcatcctggaccgaacgccgggcaagtgaccgggtcatggccaatgccggggcttgcatcgggcggtggcggctggggtgtcgtgggtacggcgacggggtggggatcccgctgaccagcccggctccaccctcgttcccctgagccccacggcccgccctgcacgttctgtccatctgccacccgctcctcccaacccccccccagggtcgtctcgctccaacagcagcgctgacacacccacggcgcgggccctgcagggcggcggccggcgcggtggggtgctggagaagggccctacctcgctggccggcccctgtgaggcaccggccagcccgacgggcgaggcgctgcacgccctcctccctcccggccgccgcgcgtcgggggccgggccacgcaggccgcgtgcgtcccgggccggcctccccgctgcggacctctgggtggcgggcggcgcggtggcggaggccgggcccgccgcggcggaaaacccgctgggggacctgctgcagcaaatggacggcctgctctcggacgtccagcgccacatccggggctgaggggcctctgctggccgtccactgccctgtggtgtgaaggtatgaagctcgaagttcccggggccctggctgtcgtgtgtcattcttcaactggctgcttcacatccacgtccnnnnnnnnnnagggcccctgctggccgtccactgccctgtggtgtgacggcatgaagcttgaagtcaccgggcccctggctgtcgtgtgtcagtcttcaactggctgcttcacatccacgtccgggctcgtcttcccttgccgtgagaggcagggccggaggggtgcgtgcttacaccacagggaatatactttgagtcagggtcatgtagggtgagtgctgagcaagcgagaccgcagcgatgccacggatcagaggtcgtacagcacgttccagccgccgtggcggtccacattcagcgtccagcagttttcctgaagtggttggggttgggagggagcgtcagcaaatcgccaggcacgcaggggcatccaaggtgcacaccgcacacgccttgccactcggcctccttgcctggaccctcaggaacggctccggctggccgacgctgtgctgagtcagcggcgctcgcacacccgcggtgacacgcaggtcctgatcctccgtgaagcggagcactgcgtggctcaagcaggccgacgcctcgcccctccactgcatggaaggtagggggggtagagggttggtgcatgcagggttggaccttgtttcaggcctggataggatgcatcgacaggctgcaggccagcgaccacaccataccctccaaatcccctctctcccacgtccgcaccgtctcgctgcggnnnnnnnnnnaacaggctgcaggccagcgaccccaccataccctccaaatcccctctcccacgtccgcaccgtctcgctgcgggggttgaagtcgtagtgcacacgtgcgacggcgtgggtgtagctgtcgatcaccacacgattgcgcgtcagatgctgcacacggttgagcaccatcttcttcttggcattcagactgcaagggggaggggaagagggtcgcgccggtcaggcggggcaggtgctgtgtcctggcccctcaacagcagtgcagcatccttcccacacatggtacggagtcggaggtccagtctccggggccccgcacctaatggtgacgtcgtctgaggatgtcgatgccttggcccccagtcctaccctcagcctcgtgtccggctggtaggcctcattcggcttcacgacggaagagcccaggtaaaagtactgcggggagaggatggccagctggttaaactccagaaagcaagggttacggcaccccaaaccaatgggccgagacgtgggcgatcgaagatgtgctgtgtatactgcccccacccccgtgccgcacataaccagcccaccttgttgaggctggtgttgacggtggccgctgcattggtggtattcagacgaccttgaaccttgagctcggtgtcggtactgtgcacaaatttcttcttgaaggcgaggttcagctgcttggccttgctatccagcgccaggcgagtctccatattattgcccgtactccacggcccgatatgtagatgattggtcacggattattactattttaccaagttgaggtgaagggtgtggccctgcaccttgcacatacgcgcagtccgaccagcaaaggagcaaggattggcggcagcggcagttcgaagatttcctactcatttcgacgatccgttcgtctgcccaagtccggcgggttacagccaaggcactctctcccctatccatagcaccgaattggttccttgcaccccttggcagcactttgactcatgcggcatgaaccgcccttctccagatacctgccgtggaagagggtgggtctggctgacgagctgcatgcagctgccacaagaacggcatggtacgtttggaccaccctccaggtgctaccatcctcagcagagcctggtatcatacaagtccccgggtgttacctctggtggtactcttctgcgnnnnnnnnnntctaccatcctcagcagagcctggtatcataaaagttcccggggtgttacctctggtggtactcttctgcgggccagaagacggtgaatggctccacctcgaccgcacagccctcgacggaagccaccttctgcttggcggcctggggacacaaagtgccacacgccgtgcatgagatcaacagccacacatcagagggtgggcatgccgcctgggtgactgaactctagttcccttatttccgacacagcatgtggcccacctgcgcttgaacctggctgtgggtgtagatgccggtacggtactgcgatccgacatccgcgccctgaccttcgcgctggagagggtctatctctgcaggcagtggcgagacaatgcataggtgagattgctgggcttcatgtaccgagggactgcttgtaatctgatcaagcagagagccagatattgtggcatgccattccctttccatcacatgaacatactcactctcaaacagggcatccagcagttgggcgtaggtgatctgctctgggtcatacacgagctgaactgcctcggaatgcccggtcgttcccgtgcacacctacggtgtcgggaccggcacagaccgatctaagcctggagggagctggccgcaaaacattccctggccaccgtcttccccgtgcatgcagcgctccaatctttcgacacccnnnnnnnnnnatggcatgtcattccctttacatcacacaaacatacttactctcaaacagggcatccagcagttgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatacatatatacatcataatccttgagcgcacctctttgtaagtcggatgctgtttttggccctgcgcgtagcccacggagctggagagcacgccgtggagccggtcgaaggcaagctgcacactccagaagcaccctccagcaaaggttgccacctcatgccccgccaggcgaccttcgggcctccacgtagactgcatatggatgtgtatgacaatggatattatgcgtctattcgaagggattgtcaggtctcttgagtatgtgatcgctgctcaccatgtcctccgccattcctacttgtttgtacaccctgtgaggttagaatagatatcagagtaccgttgcgttgtaaaaatgcaatatggtctgtaagagcccgtcgtgatgtatgtgtgcggcgatttcgaaggcctcgcgcaatgattttgccggcactgcctctcggaaccggatggtcattcaagagttgccccagcacgcaggcttggaaaagaattggagagaagtactatttattccgaggcaagtatgctatgctggactttgagttttgagttgaggcatgtctcaaacctcctggtgatggactgtgttggtgcaatttctctgaagggagcttcagcaacctatccaagctggatagatttaacgattagtgatcttatttatcaaggacgaattaggtgtctgtgcttgaacatgtaaggtctctttgacatnnnnnnnnnntcgaggcaagtgtgctctgctgcactttgagttttgggttgaggcatgtctcaaatctcctggtgatggactgtgttggtgcaatctctttgaagggaccttcaggaacctatccaagcaggataggtttaccgattagtgattttatttatcaaggatgaataaggtgcccgtgcttgaacatgtaaggtctctttgacatatttttagaacgctgccgttttcgtacatgcaaagcaaagtggggtgtcgggaaatccccgcactgacgaatctcccgacaccatcatgacgctgatcgagccatcacctcgtgttgggccaggaggacacgatattttaatgtgtaatcctacccagtcactcgattgaaggcttgtgtctggcccacctgattcccgaggatcgggcacccggctccaaacatgggatccgggtggtcgtgtacgcatggcaagggcgccgaccctcccaacggggtcctatccccacggatcagtccgttcgggaagctgaagcgcagcctgtcctcccgcacctccgccacggcgcgcgccacgcttcccccccgggaccgcacgctgctggacctcgcgctcggccgcctgtgcgagtgcatagccgacctcccggcacatcgactggaccagctgcctcctgacctggcgcaggcgctcctggatcgcctggtggagtgtggggcccttgacgagggagtggccatccggctagggcgccttagtcatcaccggctggcgctcgactcctaccccggcccggtgacggacgagtggctcgtgcccctggtcaaccccggcatggaaatcatcaaactgggtcgcagcgcggtgagcgagatgggtgggggaatgggtgagggacatgagcagtatggagccgggacatgggatggggtcaacatgggtctgcacggtctctgcgccaggattggtcatccagcgatgcactctgcggcacgtgatcaccacgagaagccgtgcctcgcaggtgaccaaccatggaatgatgcagctcggcctgctgccccggctcaaggtcctgcacctgcagtattgccaggggctgacagacgcctcgctgtccgtgctgcaaggtgggaaacgcaggtggcggcctggcggggtgaggggggccgcatgcaaccgcatgtgatgcagaatatggcccatctctcgcttttgtcagggtgttttgaggccatgtggccggcatgaaagccgcacctgctggccgctgggtctcttctcgacccggctcctccggctgtggctggatcgtcctccaagactctgtgcctcgggtcacggtcctcctccccacccttgtcccccacccacccccttggaatccatcccccacaccccaccggtgcatcccggcaggcctgcccgcgctggaggagctgaacctggcgggcctggagcatctgacgtgccgggctctggaatggctgcgcgcctgcccgcgtctggcctggctcagcctggagttgtgcgcgggggtggggtgcctggacccgctgcgcgcgctgcccgcgctgcgccacctggacctgggctggtgcgggcgggtgggcgacgccgagctgggggcactggcgggcctgcgccgcctggcctgcctgcgcctggggcgcacgcgcgtgacggacgcagggctggcggcgctgccgcccctccccgacctccgcgtcctgggcctgccgcgcacggcagtgacgggcgcgggactggccggcctgctgccgcgcctgcccgcactgcgggagctcagcctggcacgctgccccggcgtccgcgacgacgcggcgcgcgcgctggccgc

SEQ ID NO: 47990 - DNA, 71 bp, Chlorella protothecoides
gctctaatttgtcccgcatccccaccattcgggggggggtcggacccaatggcggtgaatcagccagcgac

SEQ ID NO: 47991 - DNA, 61 bp, Chlorella protothecoides
cgtgcaggagacggggacacaggagccctcacccgccggcgccgtcccgggagactcctcc

SEQ ID NO: 47992 - DNA, 65 bp, Chlorella protothecoides
cgtcatggttgtagcacagcactgcacccagtctcacctgttcactccttcccacctgcaggtat

SEQ ID NO: 47993 - DNA, 76 bp, Chlorella protothecoides
gtacagcgccggcaagctgaagatcatcctagactcgcccgagcatgtgggcatcgaggctgtgcccgctgccgtc

SEQ ID NO: 47994 - DNA, 61 bp, Chlorella protothecoides
tcgaggccgaccagccagtgtctgccatctaaaggtagacaatgccagtcagccccttttc

SEQ ID NO: 47995 - DNA, 71 bp, Chlorella protothecoides
ataacggctcgtaaatatctgcataaaattatcaactgcatcatcggtggctcagaccctgccacccaacg

SEQ ID NO: 47996 - DNA, 232 bp, Chlorella protothecoides
gctcaccctggagcgactggcagagctgacagagcggggccagtttgggcgcactctgccctccaatgagcaggtgggtatggacaggcagggggagcttgtgatagatggagggtgtgagaatctagtgaggtagaatggagggcaccccccctcccaggaacacccacctgagcatgggtgacggtcatttccagcaccccagtttgaaagcggattgccttcaatgctt

SEQ ID NO: 47997 - DNA, 72 bp, Chlorella protothecoides
tgatgtgcgtttgacccccaaggttgggagtgtctcactctcgtcggcatgccgtgctgcactgtgagtatc

SEQ ID NO: 47998 - DNA, 62 bp, Chlorella protothecoides
gtagccacttgacatgaggtcgacatacgattgatagtgctcgaaatctcccaatgacatga

SEQ ID NO: 47999 - DNA, 65 bp, Chlorella protothecoides
ctgttgtcagcttggatccaggaaactggaagcttcccatgcacagggtgccccagtggacctct

SEQ ID NO: 48000 - DNA, 61 bp, Chlorella protothecoides
ctttgtgctggaaggagccaccctcgagaccgccaaagtgggcaagggctacgagctgctg

SEQ ID NO: 48001 - DNA, 91 bp, Chlorella protothecoides
atatgcttgcctgaggagatcgaatcagtccctctataattccatgagatacctcgagatgagactagcacttctgatgctgatgtcgtag

SEQ ID NO: 48002 - DNA, 61 bp, Chlorella protothecoides
tgtcgagtggtgaaggttgatggtggggagtgtgatgcaaaactccctttgtgccatgacc

SEQ ID NO: 48003 - DNA, 62 bp, Chlorella protothecoides
tcatgtcattgggagatttcgagcactatcgttcgtatgtcgacctcatgtcaagtggctac

SEQ ID NO: 48004 - DNA, 179 bp, Chlorella protothecoides
cacctccagcatggccaatgtgctgacaaatctcaaggtgaaagctgggaggcggcgtgggatgtgccagaggggaggaggagccgtttttgggggtaagatacacatgtctctctacaggcttgagaaccagccatcaggaaccctaagtctgccagtatggataccaccgcagttgg

SEQ ID NO: 48005 - DNA, 61 bp, Chlorella protothecoides
accgtccattgcaagcggccgacgctcgagtagtcaacactcctcgcatgtccggcactgc

SEQ ID NO: 48006 - DNA, 109 bp, Chlorella protothecoides
cctgggggagacaaaaaagcatctgtcctcatggcagagatattcttgatagcatggctgcatcaagcagcaagactgctgatggccttgagggcacactgtactgatg

SEQ ID NO: 48007 - DNA, 63 bp, Chlorella protothecoides
ccacttcttgcagttggccaagctgtcccgcaagaccggcttcaaggacggccaggagctagg

SEQ ID NO: 48008 - DNA, 61 bp, Chlorella protothecoides
cagttattgaggtgggcggcaccaaactgttgccgactggactcaacccggaccccaacac

SEQ ID NO: 48009 - DNA, 77 bp, Chlorella protothecoides
ctggcagcctgctctgacgatccagacggagcagatccctgacaacatcccatgtgccagcaggcgctggagatggc

SEQ ID NO: 48010 - DNA, 82 bp, Chlorella protothecoides
tttacgcttggccttcctccttccccagcatgctcgaaacagtgctatgcatcttgatcacgctgtcttcaagccgctgcag

SEQ ID NO: 48011 - DNA, 78 bp, Chlorella protothecoides
gggcgtcaagccttgtggttcgtcagtgtagaagatcaaatatatccgtaagagtcgtggcgatgagcaggcgttgtg

SEQ ID NO: 48012 - DNA, 87 bp, Chlorella protothecoides
cagcaaccagctgagcacggcagggtagggtagcaagtcccgcgcgcagcgttcccaattctgtgcatgcatcctttcctagcgatt

SEQ ID NO: 48013 - DNA, 65 bp, Chlorella protothecoides
cttccaaccacatccaacagtctgtcagaatcaagcatgatctttacccatgcatatatgtgtgt

SEQ ID NO: 48014 - DNA, 76 bp, Chlorella protothecoides
catataagagcgggtgcatggggtgggtttgccgtgctgtgtcctcacatgtgccaaatttggagaccctgctgaa

SEQ ID NO: 48015 - DNA, 71 bp, Chlorella protothecoides
tggtggtggcggtatgcgcaggggtgagccgtgtggaggtttgcttggaggactccagacagtggtagggg

SEQ ID NO: 48016 - DNA, 72 bp, Chlorella protothecoides
aaatttcgtgctgacatggcaggggcccctggggctggggccgccccccggggggggggggggggggggggg

SEQ ID NO: 48017 - DNA, 61 bp, Chlorella protothecoides
gcccaaccatcatcttcccaaagagctcccacccggccgcacccgcaggatgatggtgtat

SEQ ID NO: 48018 - DNA, 61 bp, Chlorella protothecoides
attcccacctcgtcgatgcggtcccacgagcctggcacctcagattcaatgtcgcagtgac

SEQ ID NO: 48019 - DNA, 62 bp, Chlorella protothecoides
ggcttcaggcactccacggccaccaggatcttcgtggcgccagacttcaggatctccaagtt

SEQ ID NO: 48020 - DNA, 163 bp, Chlorella protothecoides
gagggtggtgcaccgcaatgtcgcagaccattcgcagcgtccagttggctgcgagggcagcatttcgtgatagctggacaagacgatacggtggagcttcgggtttcagctccctgccggacgacattgcaaaggctgcctcgggtgccaggttcccagctcg

SEQ ID NO: 48021 - DNA, 71 bp, Chlorella protothecoides
ccagggctccttcacccccctccactactacaccacttaataactccccgctcaatcttgcctgcagaagc

SEQ ID NO: 48022 - DNA, 131 bp, Chlorella protothecoides
ggacgctttcagatctgccatcgaacgctttgagtatcaggtgcaagagtcttgggaggaagggggccggtctgcccatccagcactacgaagctggtttgcagcatccaggaggatgggtgaaggggatt

SEQ ID NO: 48023 - DNA, 76 bp, Chlorella protothecoides
aaactgcgcatcccaagggaatagttttagagtgtctggacacagggtatcatgtaacttgtgacagatttgctgg

SEQ ID NO: 48024 - DNA, 61 bp, Chlorella protothecoides
tcaggcaggtcgagcgacttgcggcgggggttctccgtggcgctcattcggtgaggagcgg

SEQ ID NO: 48025 - DNA, 77 bp, Chlorella protothecoides
gcctcccagcatcacggcctgcgacatgcaatggcagattttgatcgagtcgccgcaccgctgcatgcatgctgggt

SEQ ID NO: 48026 - DNA, 168 bp, Chlorella protothecoides
tcactgattatcctttgcgacaggatcatgcatcgctttccaatgcacgacacatagctttgctgaggaaggcacacaggtcacctcagcgacagcctgagacataccagtcggattaccttggcctgttactcgacttaagcgcgaatcatgcatgtactgcgaccg

SEQ ID NO: 48027 - DNA, 80 bp, Chlorella protothecoides
atctactaatatggcgcgtcgttctggaacgtccttcgacatgcgcgacgtcgaatacccattcacatgcagccgaacgt

SEQ ID NO: 48028 - DNA, 62 bp, Chlorella protothecoides
ctggtcaccaggcagtgccacatgtgccttccagcatgtcctgagcaccctccttgggctca

SEQ ID NO: 48029 - DNA, 61 bp, Chlorella protothecoides
ttggatggtcgccatgatggtggttattataccgtcaaggactgtgtgactattgacgtcc

SEQ ID NO: 48030 - DNA, 98 bp, Chlorella protothecoides
ctcgggcagaacttgaaaggtcatggtgacgttgcatgcgatcctttgattgaagtacgcttggcataggacggagtcaaacacaataggctcgggtg

SEQ ID NO: 48031 - DNA, 75 bp, Chlorella protothecoides
gctgttctggcaagtgtctcgcgctccctagctgctgccagagtcaggctcgaggaccctgtcgttcctccacaa

SEQ ID NO: 48032 - DNA, 71 bp, Chlorella protothecoides
aggcgaggaaacggggcggtgtgcatagaagcaacctctggagatgattaaacagggacgcagacagcgta

SEQ ID NO: 48033 - DNA, 88 bp, Chlorella protothecoides
gagtggccagggtggaggtgggttgggaagaaactgggtacttccaggtgtgtaacccggggacggctgctgcagtcccatgatggta

SEQ ID NO: 48034 - DNA, 65 bp, Chlorella protothecoides
ggtgcatgtttgttacaacgccatggtctacgctatttgcacagatgcgccatgcaagtggtgcc

SEQ ID NO: 48035 - DNA, 61 bp, Chlorella protothecoides
tcttccgcatctttcaaggtctgtcggtggagtgtggtggcgctatccatgtgacaaggtg

SEQ ID NO: 48036 - DNA, 61 bp, Chlorella protothecoides
ccccagcctccgtcttccacaatcggcaggggaataagcgccccccctaagggaggggggg

SEQ ID NO: 48037 - DNA, 70 bp, Chlorella protothecoides
gaaggggaagctggggttgcaagggacaaaaggcaaagcgtggagaaaggaggcccatgcccaacctcaa

SEQ ID NO: 48038 - DNA, 37699 bp, Chlorella protothecoides
  modified_base (124)..(244): a, c, t, g, unknown or other
  modified_base (942)..(951): a, c, t, g, unknown or other
  modified_base (1933)..(1942): a, c, t, g, unknown or other
  modified_base (2680)..(2689): a, c, t, g, unknown or other
  modified_base (2758)..(2767): a, c, t, g, unknown or other
  modified_base (3179)..(3232): a, c, t, g, unknown or other
  modified_base (3344)..(3353): a, c, t, g, unknown or other
  modified_base (3657)..(3666): a, c, t, g, unknown or other
  modified_base (4042)..(4051): a, c, t, g, unknown or other
  modified_base (4557)..(4566): a, c, t, g, unknown or other
  modified_base (5428)..(5437): a, c, t, g, unknown or other
  modified_base (6015)..(6024): a, c, t, g, unknown or other
  modified_base (6836)..(6845): a, c, t, g, unknown or other
  modified_base (6897)..(7123): a, c, t, g, unknown or other
  modified_base (7722)..(7731): a, c, t, g, unknown or other
  modified_base (7916)..(7925): a, c, t, g, unknown or other
  modified_base (8003)..(8012): a, c, t, g, unknown or other
  modified_base (8619)..(8628): a, c, t, g, unknown or other
  modified_base (8701)..(8710): a, c, t, g, unknown or other
  modified_base (9601)..(9610): a, c, t, g, unknown or other
  modified_base (9930)..(9939): a, c, t, g, unknown or other
  modified_base (10016)..(10025): a, c, t, g, unknown or other
  modified_base (10220)..(10262): a, c, t, g, unknown or other
  modified_base (10451)..(10460): a, c, t, g, unknown or other
  modified_base (10537)..(10546): a, c, t, g, unknown or other
  modified_base (10752)..(10761): a, c, t, g, unknown or other
  modified_base (11238)..(11247): a, c, t, g, unknown or other
  modified_base (11738)..(11747): a, c, t, g, unknown or other
  modified_base (12269)..(12278): a, c, t, g, unknown or other
  modified_base (12811)..(12820): a, c, t, g, unknown or other
  modified_base (13540)..(13549): a, c, t, g, unknown or other
  modified_base (13611)..(13620): a, c, t, g, unknown or other
  modified_base (13777)..(14005): a, c, t, g, unknown or other
  modified_base (14401)..(14588): a, c, t, g, unknown or other
  modified_base (14666)..(14675): a, c, t, g, unknown or other
  modified_base (15343)..(15352): a, c, t, g, unknown or other
  modified_base (16325)..(16334): a, c, t, g, unknown or other
  modified_base (17549)..(17558): a, c, t, g, unknown or other
  modified_base (17659)..(17668): a, c, t, g, unknown or other
  modified_base (18309)..(18318): a, c, t, g, unknown or other
  modified_base (18806)..(18815): a, c, t, g, unknown or other
  modified_base (18894)..(19057): a, c, t, g, unknown or other
  modified_base (19575)..(19584): a, c, t, g, unknown or other
  modified_base (20240)..(20249): a, c, t, g, unknown or other
  modified_base (20602)..(20611): a, c, t, g, unknown or other
  modified_base (20867)..(20876): a, c, t, g, unknown or other
  modified_base (21466)..(21475): a, c, t, g, unknown or other
  modified_base (21910)..(21919): a, c, t, g, unknown or other
  modified_base (22903)..(22912): a, c, t, g, unknown or other
  modified_base (24063)..(24072): a, c, t, g, unknown or other
  modified_base (24381)..(24390): a, c, t, g, unknown or other
  modified_base (25339)..(25348): a, c, t, g, unknown or other
  modified_base (25953)..(25962): a, c, t, g, unknown or other
  modified_base (26193)..(26202): a, c, t, g, unknown or other
  modified_base (27361)..(27370): a, c, t, g, unknown or other
  modified_base (27747)..(27756): a, c, t, g, unknown or other
  modified_base (28333)..(28342): a, c, t, g, unknown or other
  modified_base (28752)..(28761): a, c, t, g, unknown or other
  modified_base (30040)..(30049): a, c, t, g, unknown or other
  modified_base (30433)..(30442): a, c, t, g, unknown or other
  modified_base (30573)..(30582): a, c, t, g, unknown or other
  modified_base (30856)..(30865): a, c, t, g, unknown or other
  modified_base (31705)..(31714): a, c, t, g, unknown or other
  modified_base (31880)..(31938): a, c, t, g, unknown or other
  modified_base (32264)..(32273): a, c, t, g, unknown or other
  modified_base (32528)..(32537): a, c, t, g, unknown or other
  modified_base (36566)..(36575): a, c, t, g, unknown or other
  modified_base (36777)..(36786): a, c, t, g, unknown or other
  modified_base (37010)..(37019): a, c, t, g, unknown or other
  modified_base (37418)..(37614): a, c, t, g, unknown or other
ggggcagtacgccgggccgggtccgcaggccggcgcgcggcctgcgggccccaagcccgaggccggcgggcagtacggcgggcagggcgcgcagcagggcgcgcagcagggcgcgcagcagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttggattgtagggaggaaagcgcgaatgggtgtgtgtggacatctctggtgctcgtggagagggcgccgcgcgcatgggtgggtgccccagccccgtcgttcacgactgcttcgcgggtttgaggctcgccgcgccccgccatacggatgcaccatgcccggccgagcccctggcctgctcaccacgcgctgtccctcccctcaccccgtgctccccactcgcatgtggcccacacctcccccccctcctccccaccacaggttcccctttgtccctcagccctacggctaccccatgcccaacatgccctactacccgacccagggcggcgcctacacccccggccagggcgccacagcctacaagtacccgcccgcggccgccggctacggcggctacgaggagcagcccggcgcggcctacggcgcggcggccgggaagcaggagcggctgggggcccgcggcggcgaggcctcccaggccgcgctgtacggcaaccaggccgggtactcgcagtaccagggccagttcgggcagggccaccgctgaaggccctggcggagcgatgctccatcgtggcatgcgcatggccccatgcaggcatgcacgctgaaaccggttgtaatgcctcgtcccatcgagctgggctcaggatgggagcccgggggaaaaggggatggggaggagtgcgcccgnnnnnnnnnnacatggccccatgcaggcatgcatgctggaaccggttgtaatgcctcgtcctatcgagccgggctcaggatgggagccctagggaaaaggggatggggaggagtgcgcccggcgcgcgcccacctcctcgcccgcatcgtctcgttttgtcaagggttcgcgccagacagactgcccgcggcaggtcggaggacgccgctcgtgaagaccagcgccgggcctcgtgaatgcgttcaggaatactcagtcaagcatcatgagcctcgccactcgagcacctgggtactgcgccacgacgctggccactccgaaggaacagcttctgaatcccggggactcgcaaggtcccagaatatcctgtctgggactcgtgtgacccagggattgggttcaccagaatggattatgaaccgactctgccagcatcctggtatcaaatcaggaatataatcttttgaagttccagaacccgcagtcatcatgaagggcgccgtgtccctgctgccactgctgctgctcctgggctccatacctgccgtgctctgtgcagacgaacatgccgaccacgaccatgaccatgagcaccagcacaccacccaggctgacctgcagccccatgatcatggcaagtacgacgacttcaagttccgggcggaccttcaggtggtcgagcaatccccacccatagatactgtagctggcgggacagcctggttcaaccccgacgaggacgagcccgagtacgtctgggatatagatgtcatgggagtggagaatctcacggctgccgtcctccgcatggtgagctgggatcatgggtggcggagggcatgcctggtatgtggatgcgaggacgggattcccgtgcaccacgggggatggccgccaggacacctggcgtggatgtgatggtcgaacctagaccgtataaatagcaatgcatcatccctccctctcaatcccggtggcgcagggggttagnnnnnnnnnntggacacctggcgtgatggcgtagatgtgatggtcgaagctagtccgtataattagcaatgcatcatcccttcctctcaatcccggtggcgcagggggttagcggcgaggacgggcccctcatcttgggactcctaccccttaatgtgaacgcctcggccttcgatgcgatcgacggacccttgccgcagatcaccccgcccttcactggtgacacactcttccatgggcacagctccgcggaggatctgcttggacccctggccgggggaactcttgcggacctcgaggaggcgctcgcctctggagagacccaggtgcgtcaaggggaggctgggtccagcaaaggcggcagccagattaaaaaaggggaataggcgatgcctatctacagagactggccggttctcaaaggatcagagtctctttcatcccactctgccgttgtcaccgccacgtgcaggtggtcctctataccacacagaatccaggcggcatcctgcggggacaggtgatgccgcacagcgccaagaattaaccagcggcgttgcgcatgactacagaacgagattcctcgtccgcatgcgctaccaaagcctacatcctgctccattcacacgcctcaggggtcctggcaacaccttgggctaccttatctgtccctaaataccttctcgtgcttgtcaccctgcttttagagctgtgctggtggccacgatcacatgacaagatgtgttannnnnnnnnncaaaaaggggagtaggcgatgcctatctacaaagactagccggttctcaaaggatcagagtctctttcnnnnnnnnnnaccgcatgcgctaccaaagcctgcatcctgctccacgcacgcgcctcaggggtcctggcaatgccttgggcaacctcatctgtccctggataactcctcctgcttgtcaccctgcttttagagctgtgccagtggccacgatcacatgacaagatgtgttacggtgttgcgtcagaagcagacgcctgttagagatagaagggcaaggagcagcatcttgcacatccaactcgccgatcttgcttgggtcactgcttctcattgtttttctctgagtaccccgatcgggcatgacctcggtcggaaacacgtgaaggaccccggccccacaaccactttggggtcaggaaacgagacatccattataatgttatttcaaggtcgaagtgtgttggagggaagcgtctcattnnnnnnnnnnnnnnnnnnnnnnnnnnnnnnnnnnnnnnnnnnnnnnnnnnnnnnatacaaccgtgacacgaccgactgtgcagcggttcctgccgcaccacgcgcacctcaaggttacctaggtatcattatacgctcaattacacatttctaggccgaacgaggnnnnnnnnnnagtataatgatacctaggtaaccttgaggggcgcgtggtgcggcaggaagcgctgcacagtcggtcgtgtcacggttgtaggaaatgtcgcggagttggcacggcccgaggaaagcacccatggaattgaggtggaataagatccatggtccaaccggtgggactaacaaatcgtcgaaacccgatagacttatcaactagaacctggtcgttcacccatcctacgcttccgacccttgccaacatgaagggtgtcgctctcctcctctcaatcctgctgctcacctcgttcgtggtggtgcgnnnnnnnnnnacgggaatccctcggtaggcagaaattcaggctttctagctagtccgccggggggacggtgcaggtcaggcagctgcgtcagctaaaacgtgtacgagagaaaaccggaagcgtcgaatgagacgcttccctccaacacacttcgatctttaagtaatattgtaatgggtgtctcgtttcctgacctcaaagcggctgtggggccggggtccttcacgtggttccgaccgaggtcatgcccgatcggggtactcagagatacgtaacagcagtgaccgaagcaagatcggcgagtgggatgtgcaaaatgttgctcgttaccgttcaatctcttataggcatctacttctgacgcaacaccgtaacacatcttgtnnnnnnnnnnttgcgataacgatgacgacgacgacaacgacaacgacaacaacaggagcagtaacaataactacgatgatgacgagtactacgccattctctccgggtccaaccagagccctgccataaacacaccgacgagtggtcgcgcctactttgatctcgatgacgacgagaatgggtacgagtgggcgattcaggtcagcgacgtccagaacctcatcatggcccacattcatctggtaaggtggatgtggtggttgcatgcacggggaggggagccctgcgcccgtactgtcgggagttggggtgcgtgtgcagaagtggagcccggcagctcgtaggggaacgtttcctccctttcttccatcgcgaccattctctaagccctccatctcttttaaccattttcacagggcggagcgggcacgaacggtcccgtcatcgtcggcctgctgcccaaaggctacccagcctcagcctttggccccaacgccaccctgcccaccatcactnnnnnnnnnnctgcgatgacgatgacgacaacgacaacgacaacgacgacaggtacaacgacagcgacgataacaacgatgatgacgagtactacaccattctctccgggtccaatcagagccctgccataaacacaccgacgactggtcgcgcctactttgatctggatgacgacgaggatgagtacgagtggacgattcaggttagcaacgtccagaacctcatcatggcccacattcatctggtaaggtggctgtggtggttgtatggacgaggaggggagcccctgcgcccatgctgtcgggagttcgggtgcgcatgaaggaatggagccgtcagctccaagaggaatatttcctccctttcttccttcacgagcatgagaaaattgtccacgtcgtccaatcttttccacagggcaaagcgggcacgaacggtcccgtcattgtcggcctgctgcccaagggctacccagcctcagccttcggccccaacgccaccctgcccaccatcactccgccattcagcggatccaacagatacagcggcaagttcactgccagggacctggcgggcccatacgctggaaggcccctgagcgccctcacccaagccttcaaggctgggggtacatatgtacgtggggatttacctcagcgtggcatcctgaaaaccctgcctgctgcgcttgcacagaccaaaccccatgatggaattctcaaagtgtcagatttccaaattggtctcaacctgcccctctccaccccctccctgcccctcgcaccaggtcaacctgcacaccacccagtaccctgctgggctggtgaggggccaagtcatcccgcagtcgtgaggcctgagctggcgccannnnnnnnnntttcactgggtcgaacagatacagtggcaggttcactgccaaggacctggccggcccatacgctggaaagcccctgagcgccctcacccaggccttcaagactgggggtacatatgtacgtggggattaacatcagcgtggcatattgcaacacttgtctgctgcagttgcacatacccaatcctgtgatgaaatcctcaaagggtgagatctccaaactggtctcaacttgcccctcccacccccctccctgccccttgcaccaggtcaacctgcatacgaccaagtaccctgctgggctcgtgaggggccaagtcaccccgcagtcgtgaggcctgagctggcgccaaggatgtgtctgccaacacccacctgtttcccccaagattgaatgtagtggccctcgttttttagtatttgcatgtgtttgtcaatgaactgcggatttgtagaatcttttgctggttttgcggtctcaggaggcaaggaagtcgtaccaaatgggactgcaggcctgtagcgtgcacagctgtctacgtattggtgggggggaggtggaggggatgcttccctggcgnnnnnnnnnnccatattatcggagcagagcgttgagcagatttgaggatgcgcctgcatggtgtgtagtttgagggcttgccttcatccccttcccttggcctacacccacctgttccacccaagattgaatgtagtggccctccgtttttagtatttgcatgtgtttgtcattgaactgtggatgtgtagattcttgtgctagttctgcagtctcaggaggcaaggaaatcgtatcaaatgggactgcaggcctgcagcgttcacagctgtctacgcactggtgtgggggaggtggaggggatgcttccctggcgggtgtcaatggaagctgtggtgacatgacactgcgctgttgcaagagagtgctgtgggcatgtgtctgacacatagccaggcaacctgccggttttgtggtcgaaaagcttgatttgttggaggaagactgtcccactcgtactactggataaaggctgattggaacgtccccatgctttctggcaacacgtaagtctcgcttgtgcactgatggggtccacagtcgacgtcatcagcttcccgctttcgactatacacctgtcgacgaggttaaacctcccaccttctcgtccaatacattgtcagccctgacagctggcactcccgctccagcgaagtgcagcccagagcaagtttggtccagacgctctaccacatccctcctcagcgaacaggaccaggcgcaccgtacactcaatccttaggtaaacttcaatcagggcggagtatacaatacaatattcagggcttgctaccttgccagcttcagggatgagaggaaacnnnnnnnnnnatctgtttgaggaagactttaccactcgtactactggataaaggctgattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaacaggaccaggcgcaccgtacactcaatgcttaggaaaacttcaatcagggcggagtatacaacacaatgttcagggcttgctgccctgaagcctcagaaatgacgattcgaccttgccagcttcagggatgagaggaaactgacatagcacctacacggctcaccgcgttcgaaattatatgctggaaccaccaaatcgggcgcagccacgttcgtgccatcaccgcgcgaaaccgacatcattatttgcttcacagctgtagctgtcctcaaaatgaatgatcgcccattgatacggacgtgggcgtccaagtccgggttgctattccgccggttctgggcatgctttccttgcagcaaaggtagctggaccggagtcgacgaaactgggctggcacctaagtttaaagcaaatactctcccgtgttcagtcaataacccaatcctgttcctattaaaaagttaaaaacgtacgtttaagactccaagccggtcatcatggtttccctgcgctcctccctgcttgccgtgctggtggtggtcgcccttgccaagcctgcgctctcgcacagcgacgactttgccacggacgacnnnnnnnnnngtccctgcgctcctccctgctcgccgtgctggtggtggtcgcccttgccatccctgcgctgtcgcacagcgacgactttgccacggacgacgacgcgcctttgtttgagttcaccgcgaatgtcacggcggcaaagtcggtgccccccatcaagagcaacacgaccgccttctttgctgccagcnnnnnnnnnnatctcccatgctcagtcaataccccaattctgttcctattgcaaaggtaaaaacgtacgtttaagactccaagccggnnnnnnnnnngtcgcaaacggcaccgtaacttgggagctggaggtgttccacgtgcagaatctgaccatggcacacattcacctggtgagtatatgcgaaagttatccatttgttgggcgatgatttcaaggtgggcgaggctaccaaggaaggtcctgcaccgccggctggctgccggatcagtgttgcatccgcggcaggggtttgaaagcatcaactcctccccaccctcttccgagctcgtagggcaactctgtgaccaacggaccgatcatcgtgggcctgcttcctctgggcgagcccgtggacgccttcgacgggagcatccctcccatgttcaaacaccccaggaccggccttcgcctcgctttcaatggaacattcaccgccgacgacttcgtgggcccattcgcagggctagagatggacgacctcatatattccttctacaccgaggaggtctacgtgagtggaatgagtgtggggggtccgagggtttgctccggacatgggcgagggtaattccagcggggcacgccccttcgtcggcttcgcgccggatgcgaggtgcttatagcagcggaatggcctctgccagagcatgcctttgcccgcnnnnnnnnnncgcctgcctcccctatacaggtaaacatccacaccgtgcgccaccccgctggcgctgcacgcggacaggtgannnnnnnnnntgtcggcttcgcgccggatgcgaggtgctgatagcagtggagtggcctctgccagagcatgcctttgcccgcccacgactttcaaacattgtacaagtcgacctgccatggtctgatggtttggccccagtctgttcacagaagcaccccttcccagacgctgaatgccttaaatccagcacacaaagaacactcaccttggatgcctgcctcccctgtacaggtgaacatccacaccgtgcgctaccccgctggcgctgcacgcggacaggtgaatgccgacccggacgtgtagggtcttggcattgcccacgctgcttcaatccaccatgccttagcctagcagaagctgtatatgcagtgaacttgccactgaatccatgaacgtagatgccccgcccctgccttatgcccctcgcccagccgcggtcacattgtatgattggccaagggcgctgatggcctgccacatagtatccttgccttgtaagccttccatcatcaaaaatcccaggggtgtgtcagtgcctgtgcatgcctgttcatcagcagcttgcacattgggacccatcaatcaggaggaggatacaagggcccagccgatgtgcacggcttaacaccgcttgcctggtggcagcatgcattgtggcatactcaagccaccctctgggtgctcctgctccagcaatctacacacgcggcatgcacatacatctaaaacagggcaggagcaggcatgcttgcttcggctcagctccagctttgagggctgtatgtcaagggggagagaatcagcgaccatgcatgttctgactcaaactacctgcccgtcttgagggggccggcaccgcagctgtgcaaaaaccaacagcaaagcaatcgccaggagcnnnnnnnnnnactacacacgcggcatgcacatatatctggaacagggcaggagcaggcatgcttgcttccgctcagctccagcttcgagggctgtatgtcaagggggagagattcagcgaccaagcacgttctgactcaacctaccagcccgtcttgaggaggccggcactgcagctgtgccaaaaccaacagcaaagcaatcgccaggagcacacaggcttggtgagggcaagagggcggcaagcgactgcatgatacacatagatcagcagtcgccgggagcgatcaaggcaagtgcgttcctgcggtcaccccaggcagaggtgcannnnnnnnnngcctgcatgtgtgggacccagggactgcgtgcgtgaccgcctgcgagacgactccagggaccctgcatgccgcctgnnnnnnnnnngtgatccacatgcatcagcagtcgccgggagcgagcgaggcaggtgggttcctgcggtcaccccaggcagaggtgcacagctggtgtcgccctgaacacgatctgcgcctcgccaggcttcccggagctgcagccagggatccgcctcacgccgccccctccacgcccagcagattcccgatgccgtacaccacnnnnnnnnnnnnnnnnnnnnnnnnnnnnnnnnnnnnnnnnnnncacggctgcatgcacatgcgccggtcattgcccaggccccgtgcccgggcacccgccactcgccatgaacccccccccgcctcgccatacccccaggctgcagtgtccagaaaaccactcacgctctcacccccacacccccccctcccactccaagggtacccctcctcacccagcgcgagccagccnnnnnnnnnnacctgcatgtgtgggaccgagggactgtgtgcgtgagcgcctgcgtgacgactccagggaccctgcatgccgcctgnnnnnnnnnnacacccacaccacttcccactccaagagtacccctcctcacccagcgcgagccagccgccgagcacgacgcgggccgcgccgcggatcttgtgcgcgccgcccaaaaaggcaccgagcacgccgaagagcaccaggcccagcgtggtggcccccgcgatggcgatcagccgcacagtctggtcgtgcacgaaggcggcggcgagcnnnnnnnnnnacttgtgcgcgccgcccaagaaggcaccgagcacgccgaagagcagcaggcccagcgtggtggcccccgcaatggcgatcagccgcacggtctggtcgtgcacgaaggcggcggcgagcaggggcatgagcccgccggaggtgaagcacagggccgacaccacggcagcctggagcgggcgcgccagctcgtccacatcgatgcccagctcgtcgcgggcgtgagtccgcaccacgtcctccaggtggtggttggacaggacctgcgccacctgggccgccaggttgggcggcagcccgcgatccacgtagatctgggccagctcggtctgctccttggcctgggtaggaggggggagggggttgtgaaggtgcggtacacttgcctttgtgatgagggggagggggtgaagggatgcgcaagggagaagaggggcaggagggcctcaaactcgtctcagggagatggacgcctctnnnnnnnnnngaagggacgggcaagggagaagaggggcaggagggccccaaactcgtctcagggagatggacgcctctttgagtccagggagggcccccgatcctgtgcaacgcaggatcacggcgccgcctgcttgctgagatgctgcacagattctttctcctcatcctctctgaggacttcaccactgcacgatcctcacccttgcgtcggggcccttgagctgctccagccgctcctgcatgatgtctgcctcctcggcatcgcgctgagaggacacggagatgtactcgcccaccgccatggacagggcgccgcccacgatgcccgcgatgccagacaggcgcatggcagccagattggaggagccagccgtcacgccgatgagcagggcggcgaccgacaccaggccgtcgttggctggcaagagtgaggtggggaggggaaatggggaagttctccagcgagagacactgggcgtggcagggcaaggggctccnnnnnnnnnnagcgaccgacaccaggccgtcgttggctggcgagagtgaggtggggaggggaagtgaggaagttctccagcgagcgacactgggcgtggcagggcaaggggctcctgagcatggtaggccctgccccagtcctcacggaggtttccatgccattggaaagagaggcacatccgaggccccccaccccccctccatctgagtctcacctcccagcaccagggcccggagccagggagcgcgattgctgtggtgtctgcagcagggaggggggaggaaagacatcactgtctgtcccaccagagcgtgggaccagggcaacaggcaggcagttcgactcacacatgctcgcacagctcctcgacggtggtgtcgtccaggacttgggcctctgcgtccgccaagccgtcgggtgtaggggcggggagacgctcgtaacccgctgcattcactgcactttcgtgattgctgacgccttggccagccatccttgacgaggcgggcgggatgtgtgtgaggctgggnnnnnnnnnnaagggggaaggaaagacatcactgtctgtcctaccagagcgcaggaccagggcaacaggcaggcagttcgactcacacatgctcgcacagctcctcgacggtggtgtcgtccaggagttgggcttcggcgtccgccaagccgtcgggcgtaggggcgggaaggcgctcgtaacccgctgcattcactgtactttcgtgattgctgacgccctggccagccatccttggcgaggcgggcgggatgtgtgtgaggctggggcgcaccctcgaacaatccctccccggcaggaagtagcctgaacagacgaagtctgccgcaaggcaacaagggacgcgggagggttgctttcagcacaacaaacctgatcaagctgcctatgaacccgaagatcctgcaaggttgaggatcgtactcctcctgggcgcgtgcacgtgctcctcccttgacgacgagatggatctcctcacgagaaagaaagtcacatcagatcatgcattcatgggctacaaggtaacacgatgacatccacagnnnnnnnnnngggttgaggatcgtacttctcctgggcgcgtgcatgtgctcctccctggacgacgggatggatctcctcacgagagaggaagtcacgtcagatcatgtattcataggctacaaggtaacacgatgacatccacagatgctcagcttcgcactgatttcttttttgaagtatacggtgagggaggacatgaggccaccaaggtgaggtgccacatgccttggcatgggcccccatgaagggcttgcacctaacccagcgtcttggctggaagacctatcgccaactatcgcgaaagccactcgtgtctttctttgggatttgcacaataagccattgccgtgctgcagctatgacctcggtgccattgtgccttcgtactgtattttcaagtattatcgtcctcttacagtctctcccggggtttcaaggggcaggaagaaccatgtagcgatgcatacattatgagagctgtatgtttttctacaacagatccgggttgcgtgcttgggcagtcaatgagctgatggtgaccgcattacaaaatggtggacaggaaacgcatttcataatctgccagcaatcccagtcagtctcaaaatcatttcatttgatgaggactcgatttcggtgcaggtccacatgcagctttccacagtgaaataagggctccggccatgtccctgcgcgcgacaccgctccgaccgggggaagaatcctggnnnnnnnnnnctacatcatgagcgttgtaatgtttctcgtaaacagatccgggttgcgtgcttgggcagtcnnnnnnnnnnctggctggaagacctatctccaactctcgcgaaggccacccatgtctttctttgggatttgcataatgagccattgccgtgctgcagctatgacctcagtgcccgtgtgccttcgcactgtattgacaagtattatcgtcctcttacagtctctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcagctgtccacagagaaagaagggctccggccatgtccctgcgtgctacacaccgctccgaccgggggaagaatcctggaggagacctccatgtgccagcaaaagacgcgagtctctcattgtgccagcgatggcagcgagtcacgatgtaattcgaagtcagtccaccaaacatccagactgtaaccccaatctactttgcgtccgattgacccagtccatcaccggacatggcgacctgctgcaacggctccggccccggctatgccactccattggtaagaggggggcctggcgcttcctgagcgggcatccaataggctgtatatcccattgattcctctttccagaattgaggggtgccttctcccctgggacaccttgcaggaggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccatgtcggactggcatgtgcggtcgcagggtgcagatcaaggtcggagatcaaggtcgggccctccattctcccacnnnnnnnnnnccccattaattcctctttccagaatctaggggtgccttcttctcccctgggacaccttgcaggaggccaaggagaaggggccgcgggagacgctcctgtatgttccggcaatcattcccgaccagtccaggcccgactacctggccaccgtggacgccgatcccaaaagcaagacatattcaaaggtagctgggagtcggggagtcgatcgacgatgggattcatgtcggactggcatgtgcggtcgtagggtgcggatcaaggtcgcagatcaaggtcgggccctccattctcccaccttcctctccaggtcatccaccgcctgcccgtgacccacctgggggatgagcttcaccactctggctggaatgcctgcagcagctgccacggcaactcctccaagtccaggtccctcctcatcctgccctccctcaagtccgggcgcatctacggcaagtggccatggtttggggatgggaattggctggcgggccttcctcttgcttgtgcgcaaagccttgcaccgggcacatgcatgcgcgtgtcatcccctccaaccgcctcgtgatcccgtctgtctgccgacgggtacgtggatgcccttgatcctgacaccccctttgattcagcaattacacccccccttctcccacctccctcctgcagcnnnnnnnnnntatcccgtctgtctgccggcggggacgtggataccccggatcgtgacaccccctttgattcagcaatcccccccccccccttctcccacctccctcctgcagccgtggacaccgtgtcggacccccgcgcgccgcgcctgcacaaggtggtggagcccgccgccatccaggagaagacggggctgggcttcctgcacacctcccactgcctgggcaacggcgacatcgtggtctccgccctgggcacccccgacggcaaggccaagggcgggttcgtcgtgctggatgagaacctggaggtcaagggcacctggtccggaagtgaggtggagtacggctacgacttctggtaccagccggcccacgacctgctggccagcacctcctggggggcccccgccgcgctgttcaagggcttcaacccggccgaggtgcccacagagtacggcgacgcggtgtacatctggagctgggaggggcgggacctgaagcagaccatccacctgggccaggacgggttgatcccactggagatccggttcaagcacgaccccgcctcgcgccacggcttcatcggcgcggccctgtcctccaacgtcatccacctgaccaagccgccgggcggagaggagtgggtggccaagcccgtcatcaagcagccctggaccaaggtggagggctgggcgctgcccgagcagcccccgctcatcaccgacattctgatttccctggatgacaagtaggattgaagtctgagggggtggtgtcggagctgtgggtagggagctggggatgatgctatctgggaaggtaccttttgagaccgaatgagggagcgccggtcgtcgcccctgggaccttcatgggcgacttttctgggagaaccccctgcatccctgcccgacacccctcccacccccaccccaacacacccacaggtacctgtacttctccaactggctgcggggggacnnnnnnnnnnttggggatgatgctatctgggaaggtgccttgagagaccgaacgagggagcgccggtcgtcgcccctgggacctttatgggtgacttttctgggagatcccctgcatccctgctcaacaccccatcccacccccaccccaacacccccacaggtatctgtacttctccaactggctgcggggtgacatcgtgcagtacgacatcaccgacccagagcaccccaggctggcggggagggtgtgggtgggcggcagcatccgccgcgacggacccgtcaaggcgagcacttcagtgtgcttgaagaggagatgcatggtggggggtggccggcctgggccagcgaatagttaccttctgactgccttcattacctcaccccccgcaggtgacggagggtctggaggagctggggctgaccgagcagccggagattccaaccgtgcagggtcacaagctgctgggagggccccagatgatccagctcaggtacatggaaactcacaccttccgtccaccttatcactgacccacccgccctttcttcccaacctaacccatccctcccccttgcccatcgtgcagcctggacggcaagcgcctgtacgtgaccaactccctgttctctccctgggacaagcagttttacccggacctggtggagaaggggtcctacctcctgcagatcgacgtggacgacgtgaacggcgggctgtccatcaaccacgacttctacgtggacttcggggccgagcccggggggccggtgctggcgcacgaggtgcgctaccccggcggcgactgcagcagcgacatctggctgtgaggcgagagcctcactgtgctgctgggggcaatagactgtcaagccggcccctagagacctgtgtgaattcggtcaaaggccagcgcgtgcggtctgctggcacctttcctcccctcccttgtcaaggatccctgggatgtagagtccttggagcatgcagtgcgcagtttgatgaagacgttccaggctccctgcgcctcccatgcattgtacggtacccctttcatgccccgccaacacttgcctgccaatgatggctgtaacgcctcctggagctgtgagtctgttttatgacaagagatgcaaggagtagagtccctgtcctcgccctacgtgcacatggccgacttgctttccggcaagtaacattcctgcacgtcttctgttggatnnnnnnnnnntctcacatcctctggatctcaggccacccagctctggggttcctgcacacctctcccctgtgtcacgccatgggtgtggaaggcttacaggggcatgaatnnnnnnnnnnatcctcgccctgcgtgcacatggccgacttgctttccagcgagtaacattcctgcacgtcttctgttggatgcccttccatccccccacctgcttggctctgatttcaccccaaccaccagctgtcctggacctcccacccccccggtccttgaatagaccgagtcacgcccccagagcctcacatcctctggatctcaagtcacccagctctggggttcctgcacccctctcccctgtgtcacgccgtgggtgtggaaggcttacaggggcatgaatcctacgcaaccagctccacggcaccgccggccgccttgatcttcttctccgccagcttggagatgaacttggcgcgcaccagcagcggctgctctgggagctggcccttgccgagcaccttgaagtagccgtgctgcgtgacatcaatcacggcggcggaggaggtgtccttggcggcctcgacgcgcgcggactcgcccaccaggctccagatcttgtccaggttgatgatgggctggaagtacttgttcttgttcaggtggaagtaccgcatgccaacctgggggggggggggggggggggaggagggcatggccgatgccaagatccccgagcacttggggccattggaggggagactgnnnnnnnnnnatggccgatgccgagatcccagagcacttggggccattggaggggagactgggcatggtgcaccagagcatcgaggaacatgcagcaacgtgcatggcacgccagggggagcattcccatgcctggtgctgctcccgagaggacgatgagaggctcgccgtcgatgcgcccctcctctggttcccaatcaacccacgcccaactcaaccccccgaacccccattcccccgcgctcctcaccctgaagagcaagagattcagcccgaacttgaagttgcccttgatgaccgccgcctgcaggtagaaggcccacagggcaaagagcagcgtgccaaagagggggaacactgcatccgccctggaccgcggtttgggaggggcggatgatgcggtgtgtatgtcggggggaaaggggcggttcaacgggggttgggattgcaagcagctgccccaggcaggcaggactgagtcaggccgcgccgcggagnnnnnnnnnntcaatcaagccgcgccaaactcaaccccccgaacccccattcccccgtgctcctcaccctgaagagcaagagattcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaggggggttgggattgcaagcagctgccccacgctggcaggactgagtcaggccgcgccgcggagttccacggcaggcctcgtcaccaccccccgaaactgtattcctgctttcccacaccacacccctacggcgcacttggtgaaggcggtgttcaggagcggggagacgggtggggagatgaggatgtacaggatgatctgcagaatccaggagatagtgacgccgatgctcaggatgccaaccaccagcttcagccagtacttcatgatcatccacacccacttgtactccgggtcctccccctgtgaggtgcgggatggcacaggatgttgattgctgggggagatcagggctcttggaagggagacggggcagcgtgtgcctgatgcgccgcctcctgtgcaagaagttgctggcctcccgggcaacagcatgccttgtgctttaggggtcgctgcacaccatccctgtccagagtcgcagctctgggcatcccagcatcaacacatcccnnnnnnnnnnaggcaacagcagcagcgtgccttgtgctttaggggtcgctgcacacgatccctgtccagagtcgcggctctgggcatcccagcatcaacacatccccccacccccccacggcacctgggggtagaccagctccagctgcaccgcgtcctcctccagcacgatcatctggttgcccagggcacgcgtgttgcgccgccatttccagctgcggccccgttcccgctcttccttctgcagcacctccgcgatcagcctgcggaaggatggcggggaggcgcaggggttgtcaagagggcgctgatgtctcgcatctggggcaagagcattccaggggggctgggcagtggggcgacaccgtccaccaaacatcatgggcctccgagaccatgctcccacatggccatgcgtggacacatctacctcaacaaaatgcctggttcaaacgcccaggagccactcatcaactactggggtgccgccattcccccgccacccctaggagtgtctgcacagcacattccagacctacttgatctcctgggcgcgccggcccaggtcggctgcgcgctcgatgtactgagagcgcgtgatgaccttcctgggtcggcccaggaactcgcgaatgaagtccagaggcaggctgaccaggcccaccnnnnnnnnnnggcgcgctcgatgtactgggagcgcgtgatgaccttcctgggccggcccaggaactcgcgaataaagtccagaggcaggctgaccaggcccaccgcgccaaagaccatgaagaggaaccagccgatggtggagaccatggccatcacgtacatgatgaacgaggttcggagcgtccacacctcggacaggccgttggacagcgtgttgcactggggtgggtggattggtaggagaaggggtggccgagagtctggagggcgaggagggaaccccctggagtgtgtgggtgagagaagagatctgcaagggataggaggggttgagccggcagggccaaacgtgaccgggaggnnnnnnnnnncgagtgtgtgggtggggggagagatctgcaagggataggaggggtcgagccggcagggccaaacgtgaccgggagggcgacagagtccacaagtgtgtgagggcgcaagctcataacgcctttgcaaaagcatgcgacgggcacacatgcacagaagcaaaacatctgacttgagctagcattctgtgccttcgttgcagaaacacgggctgctgaatagtggagatgcaacaccactggatatgtgtcatatgannnnnnnnnncacgggcacacatgcacagaagcaagacacctgacttgagcaagcattctgtgccttcattgcagaaacacgggctgctgaatagtgcatatgcaacaccactggatatgtgtcatatgagtcagggtgcatgtgatggtcgaggtaagagctgaagttgggcaagaacagtgatgctgatgtgcacagctgctttggggccatgccctcactccatggccactgtcaactgccccaaaccttgcggaccacccagggtccatgcatgtcgtgcactcacattgatgccgacaaaggcgatggtgttgttgacagcaggcggacccgagggagcgttcacattgtagtcagcaaagaggccgatgcaggtgttcatggttgcgctcgacgtgtagctgacgggcagcatgccagaccacgcagattgtacaggatacttgacatacccgatcgtgactgtgtgaggggtggcatgtggaatgagggatagaccatggctgctggccacaggtcattgccgtccccgtcgacagaatgctttgtcccaggcgcaacccacatgcacccctggacctgcccacctcttgggnnnnnnnnnntgtcgacagaatgcttcgtcccaggcgcaacccaaatgcacccctggacctgcccacctcttgggttcccatgacagatgcacacactcactctgtagaagaacaacccccctttccccacctctccatcagaatatagccactttggcgaccacctcaccatagggaatgacgatgatgaggacgatacagatgaatgtgccgatcgaccacaggacggcactcaagatccggcggcccatggacctggtgatgaggatgcagactctcaaggtgagacgcgtttacgatgcagttttgttggatgttttgaggttgggagccccaaagcaggcagcaacccgtagccctcaaatttcagcccctccagcattcccggatctcaccactcgctgtctccttcgtagtagaagagggcaaaggggatgacggcgnnnnnnnnnnggatccggcggcccatggacctggtgatggggatgcagtctctcaaggtgagacacaattacgatgcagttttgttagatgttttgaggttgggagccccaaagcaggcagcaacccgtaaccctcaaaattaagcccctccagcatccccggatctcaccactcgctgtctccttcatagtagaagagggcaaaggggatgacggcgaatgccatgacgacgatggcaacgtatatcgcataccacaggatgtccatcggcagcgtggtgctgcagtccgccagcggcaggtccgcagaacaggcgtggacattcgctacatccaaggggaaaaggagcacggtccatatggccaagcaaatgcccaggcagaccacgatcttggggaaccaagcctggttccggtcctccgggtgttggaaggctatgaggaggtagacggaggatgccatggtgagcagccctaccaccaccatgatgatgatcaagaaccagttctccatggcgtggggcggagcgcgggtctcgcccagccaggggaggggccacgggagtcagtgccgggagggggtttgagtcgcactcgagatctgtgccatccttatttagtataggcggggacaccgcggtccgaggtcgttaagagtatggcagggtgcgggggaagcctcgctgccccaatgttatgcccggcgaatccggtgcagagtacgaaatggtggggacgaagcgcgcccgatcaccagctgtgtgtgttcgccacagttctcggccagccgagacactcttactcgcacatgatatcatgttgcctcctttgtggtcagcgtcgctcgacaagggcatgccaacactattggggcgcctctgaacgaccaccagaatggcgtcctgctcagctggaggtgatcagggacactaatggaatactgggtatgttatccagcccccttgacaaatcttaccgcgcggatttcggcttnnnnnnnnnnccagggacactaatggaatactgggattgttatccagtccccatgacaaatcttaccgcgcggatttcggcttgacaattcctgcaatgctgcacgttctcatgaccagcaccagccgtcgagctgggcaagggctcgttcggctgacttcctcacactgtgcctcattctcctctgcaagcaacgagggcgtcaaggtgggcgagtccttggagctccctttgggattctcgtgccatgaagtacccaggattcagcatattcctccccttaccctccttcacctgttacccgcccgccagcaggagctccgaagagcccgcagggcatccaatcgtcgtctgagagagctctgcaagggcttggatcgaggggcaaacaccgtgtggagcaaccccgtgcaaggctcggatccgaggttgtctggggaggatgcctggctgcagctgctcctccggcagtgccgctccaagaggaaggcccggcgcatggcagccagctggcgagcggatacgggggaagcacgtggcgccggccattctttcaacacaacgggtcctgacagggacgagggccagggaacagggagtgcccactggtggtggcgtcgggagtctcgcggcgaggccccaggtggtcagtggcgctcccagcgaggtcagacctcgcagacgcagggagatcctggagcagctgacaatttttgtggccaaggaccccaccacccacatgcgcgggaactggctgtgctgggtatgtcccctgcacatagcctcacacgcaaggctctgcggctgtccttcctggaggtcgccaggcggtggcacccagacttacaccctccagaccgccgagccgctgccgaggctcaattcaaaagtgcacaggcggcatacgacaagctcgtgtcgttgctgccgtcctcgtgacatcatgtaagacctgtgtatactctgtatatctacgtgcatcaacgtttgctattgttagttcatgatggcaacatcaacaatcagggccagaacactcaaggtagtcgctcattgacagtcttctttttcagcctcgacacgaaacacggcaagacatagatgcccatgacatcaaactcgtttgtgtaatacagagatgacatgtgcccatggtgtctnnnnnnnnnntcacggcaagacaaagatgcctgtgacatcaacctcgtttgtgtgatacagagatgacatgtgcccatggtgtctcggcatgctctttgtgttgttttgtggattgagccgggtgaaggccatctcacactcacccaccgatgaccacaattttgggtgtaggaaagtgtggaggggaaagctccatgcacggttgtggccggcacgaagctgatgtcgtcaccatgttcatgttcacatcctccccaattcctcgcttcccctatttaaggcatgaatacattgcacctttcgtcttccgggccgttnnnnnnnnnncttgggtctaggaaagtgtggaaaagctccatgcacggttgtggccgggacgagctgatgtcgtgaccatgttcatgttcacatccttcccagttccccgcttcccctatttaaggcatgattacattgcacctttcgtcttccgggccgttgcccccgctgaggcaaagggccccgctgcatgagcgtccgggcgccctccggaacctggttgccagtcatgggcagcaggctcccatgaagcgggccctccatcgccggccgctcctgctcctccccttgctcactcctttactcctcgcggtgccaaatgaggcgagagccgcacagtcccccaatggtgggtccatgtgctggttattatggagaccctgatattcatctggccgaatgggctgggcagcgccccaccgatgagcccctcacccatatgcctgccccacccccccgtcttgcaacaccaggccccctctctacccttacgtccctgcagaggcaccgccggcccagtactacgacctggcggaccgcctagtcagcgcgctgggcgccgcgctagacacggaggagagcggcgccagcgagtcggcgttgcgccgcagcgccgaccccgcgcgcgccgccatccgcgagttcaccgccgactgggcgagcgcggcgggggacgccagccacgtggcgctgtccgccgccatccgggagctggcggagcactaccggcgggaggggcagcgagcccgcctgccccgccaggtggtgcagagcatacggcagaagctggagcaggcgcggcaggcagtgcagagcgcaccctcccgtcagctgctcgtggatggcggggtcaaggcctgagctgaataggagtgagggattgagggccagccagcgtgcatcgcaaggggtccaaggacgatgcccgggggcagcagcgagtgtctttgcgaggctnnnnnnnnnngtaggagtgagggattgggggccagccggcgtgcattgcaaggggtccaaggacgttgccggggggcagcagcgagtgtctttgcgaggctggcacgtgccgcgcatgccgctgagagtaccccaaagcagaccagggcacggtcctgcttcagacgggtgaggactttggtgtcactatccgagtagacccaaccctcccgaatgatcgtgctgcaattatgccaggttggacccctgcccctgtccatgactccctctctcaaaccagtgagactctgggagcagcgttgaactaagataccgtgacaaaatgggaatggaacagaggggcgcagcgcagcgctcagagtggcaaagacacagcaagcatgcgtcgttggcagggcccatcatcgccctcgcatgcgcaggtccctctccgcctcgtactgccgcacgtctgcttcttgcaggaaggcctgcttctccaaatactgcacgaaggcgtgaggggtgcgttggggggttgaacagacgccgactgttgccaatttcttacgaggggggctcgcatgggtagcgtacagcaaaaagtccaaaagcagagggaatcccaaggaagannnnnnnnnnagcctgcttctccaaatactgcacgaaggcgcgaggggtgggttggggggttgaacagacgccaactattgccaatttcttacgaggggggctctcatgggtagcgtaacgtacaaggtccaaaagcagagggaatcccaaggaagagtagtccaggaacatgtggcctgcacaccgcgttcctgttgctgccacgcaagttaccccccatccttcccactcccttccacnnnnnnnnnnttgcgttcctgttgctaccacgcaacttaccccccatccttcccactcccttccacatacctggctgcccgaccgcttgtgcgcctccagctccgcatcgatggcctcgtccccagccttaaactccgtccagtctgaccgggtcttgtccaacacattcaccttcttgggacctgccagggaggccagcatagcatccaggccccccttcttctctggcgccgcatggcctgcggcgcccgaggtgctggcggctgctccgccgctcggcaccgacctgctcaccgtcacgtcctttcccgcaaacctacgcgtctcaatcaccctttcctcgccgtaaagctgggaggccgaggccgcggcggcggcgcgggccgccgcgatcgctgcggccgccaggctgcgccgccgctccttggcatcgtcggtggcacctgccgcagcagaggtgggtggggcgcagaccagtgcagccactgggcagggagtcggcgccgcggagactggcggcgatggctgggcctgctgagttccacgggagaaggcaaaataagagggaatcatggttgcgttgtcgaggcagtctgtgctgcattggacccagccatacaccggtgatgggctcagccatttggccggcctggtgcaggtcggagcatcccactgcgcaccgtatcaggctggacttttgcagtggcaccatctaatttagccttcttgccgttgccagcattcagctgctgccacagggcgtccactcgctctcggcgggcagccttcccgtgggcagactcgcccttctttccgagacctaatcgcccagccttggcatcctcgacgtcccgagaagcctgtgaatttccctcctctgggttgaaatcctcgtctgcctcatcgtcagaaggcaggtccgcttgcaggaagctcgccatcgagctgacgtgagcagcagacttggggtgataacctgtcaagcgaataccttcatgttcatagtaattggccgtagaattgaatataccaaagtgaaagttgatattctgcaatgtctgttgtctgttgcagtaaaacttccaactttgagatactgaagtttcgtcgttggcagtgctgcgccaggtcagtacgtgaaacagcggcaagcaggcaaggggtgtcnnnnnnnnnncttgcagtaaaacttccaacattgcgatactgaagtttcgtcgttggcagtgttgcgccaggtcagcacctgaaacagcggcaagcaggcaaggggtgtcatgccggcacctgggcgatgatttcgctgcaagggcaggtgtgtttgagaagacttattctgcaagaccattcgctcttggtcaatatgatcgtcagacctgcaggcaatacgagtatggtgtccaggaaatctgttgctcaggatgccacccttttcctttcacacggtagattgtagcctacataagaggagcaatgaatatgccaatgaggcccatgactctcctcatgtcattcatgcaagaatgtagggaagagataggcaatagcgtttgnnnnnnnnnngtatgccgatgaggcccatgactctcctcatgtcggtcatgcaagcatgtagggaagagataggcaatagcgtttgcaccaggtcatgcttcacatcacgcttcttgacaagagtcgaagggaacggtgaggagagtgaaggtaacattgcgatgagacatcctgtcaactgtacctgtgaggcacatgattgcatgggggacggcaggagcttcagatcagttctccgtcactgcgcgcgcgcagagttgaggcctcactctcaaacgcaccagcgtcttctggtgtgtctcccggtctatctctcggacattcatcgcctgtagaatgtctcagctgtgcagtgtgacctcgacggcatcccccagggggtgcagggtggagaccgaggcctgcagcacctcgagccgcacccacgccctgtcgcaccggccatgccgatcgtctgctgccggactatactctaccacgaggaaaatcaaacatggggtgcgaagagaggctgagcgggggggcatcgagccccaccgcccagcaggcgccggtcttgccccggactgcgtcccgatccaggcgnnnnnnnnnntcccatcgagccccaccgcctagcaggcgccgagcttgccccggactgcgtcccgatccaggcgcccactccctgcgcccgatccgggaggtggctggcgcaaggtgcagtcgcggggatggcctccctgatcattccctctgggcaggccctagccgcgggcgcgggcttcgtcccctctggcctgctggagagcgtcctggtgagctccctgggggcggttgcgtgtgctcgaggcgcctgggaatccccttgcagctccatgcaggggccagggaagagcaggtttcctcaggacatgcccgccgcgtcctgctgggtccccccccgtcttcctggatcagacacgcaccccacgcccgccagcccctgcacaccgccctccgcagcacacgacggagtcgctgggnnnnnnnnnnttgctgggtcccccccccccgtcttcccggatcagacacgccctccccacccccgccagcccctgcacacccccctccgcagcacacgacggagtcgctgggcccgctgggcccgctggcctttgtcacggtcatgtcgtgcgcggagtgcatccccctgttccccacccagcccctgctcctggcctccggcctgctcttcggcacgcgcaccggagcgctgtgcatcctggccgccaacttcctggcgggcaccgccaccttcttcatcgcgcgcggcgtgggccggccctgggcggagcgcctgatgggcgccgacaccacgtccccgctggcgcagcgcgcgcagcagctgcgcgcggtcatcgagcggggcaggttctggcagcaggccgggaccatcctcctcctgcgcatgacgcccatcgtccccttcaggtagggtcatggggggctggggaggggtatgcaggaagggagggggccgatgctgggggtcgatgcgctcctgaacaggaagggagcaggcgggagctcgagctcaatggaaggtccagtaaggtgccgcctggcgccatgggcagggtaccactcgagctcctgagcgtggacatgtccaggatcgatggtctgccttgcatccctggcaaccgcctcgcaccctctccttcccactctcttccactgtctcaccagcaacccctgctcccatcccctcggcccccagcgcttcgaactacatgctgggcctgacccccctgccctatacgccctacgcgctgggctccgcccctgccctcgtcttctgggccttcttctacgcgtcgctgggcggcgcctcccgctccctcctgcgccgcggcgtgtcccccgatgtgctcttcgccgacctgctggagcgggcggcgggattctctggggacgcggggcgtgttgccctggggctcggcctggcgggcggcgtcttcctgctcgtggcctccgtgcgtcgcaaggccgcagccagcaagggcagtctggggccgggccagcaggcggcgccccctgaggccgtggcgagcgccatgcggtccagcgacgaggccctttaggagcgactggtgatctcggaccatgctgccacgcagcaagcaccccgaacacgctcagttccaggggggcgccaaactgtcgctcatggcacgcatcatggtataccctgtgggcagacatggtgcgtgcatgtaagaattctttgtaggaagaaagcttgtgcctggtagcaggacgctggggcgcnnnnnnnnnngtatcctgtgggcagacatggtgcatgcatgtaagaattctttgtaggaagaaaccttgtgcctggtagcaggacgctggggcgctggacttggcatgtgccaggtggcacagcctccacgcactcctgcccggccatgttcgtacaacgctcagtcccggattatgacgacagttctcaatgccaggaggcagcgaccatgctcaacgaggccgaggagtgttctgcacatcccacaccgccatgcagacatgcatgcgctgcgagacgaacgagcctccacattctcggttagcaagggagctgaagtacacaacaatcactctaatctcctggaaatattcgtgccggccgcggtcagcaacggcatcgatgtgcgcattnnnnnnnnnngatctcttgaaaatattcgtgccggctgcggtcagcaacggcatcgatgtgcgcattcctgtcggggcatgccgtcgaaactcttggaatgccttccccaacaccacaggacggcgccaaatccgctcagnnnnnnnnnnatcgaaacgcttgggatgccgttcccgacaccacaggacggcgccaaatccgctcagattggcaagccgatctcgctgaataagggatctcgatgtctcagtcattgcaccattgcgcgcagctttgcctgccgtggccctgacgtgtcatgaaggtggaccccgtcacgtcgccccgacacccgacagtgtgtcatggacggtatgaaaaaggcttcataacgcaccagacccaaactaagacacactcattccctccatatagacattcgannnnnnnnnnaaaaaaggctttatagcgcaccagacccaaactcaggcacactcattccctccatatagacattcgaaacccagatcgcaatggttcgcaagctggtcgtcgccgtagacgactcggcggtcagcaagagcaccctccagtgggcggcagaaaagctgctgcgacccgatgacgagctgcacatcatctccgtgctggagcctgccagtggcggaaacttcgcctcaaccgccgagacggcatacccagtgtccatgcaggaggtgaggcgagctcggggccaatggattgcgaatctggcctggggaggagatgtcgcattcatgactgtcgaacttcttccattgggagtgacacattgctcaccccatgggggtcttgtgtgtgctgttccattgctttacctcatccaacttcttcactgttgcatacagtgcaagcccgatcccttggcactggagagggcacaagccttcctgaagaagtgtagagaggaagcccagaagcagggggtgagtggcggggatgcatcatcctggcacatgtcgcagcttcctttcctacgctctatgttggctggcggcagggctgcagctgaggggctgccagccctgtcagcgcccttgccatggggaccgtgcctcctcaacccccatcccctatccttgctcaagctgacccattcacccatgcaggttgcggacgtgaagctggccacccttgtgacgtgtgtgggcggcgctgcggacactgggcgccacatcgtcgactactcgcggcggcaggatgccgatgtggtgctcatgggttcccgcggcatgggcagcctgagacgtgccnnnnnnnnnntgacaccgggcgccacatcgtcgactactcgcgacggcaggatgccgatgtggtgctcatggggtcccgcggcatgggcagcctgagacgtgccatgctgggcctgctgggcttgggcagcgtgtcaagctatggtgagggtgcggtgtcctgcggttcgtggggnnnnnnnnnnnnnnnnnnnnnnnnnnnnnnnnnnnnnnnnnnnnnnnnnnnnnnnnnnncagacctgctgcttgcacctctttgccattaccattggacagtgtgtgccaggcatgctccagccgacctttcagcatatccttccctctcaactgtgcagtggttaagcatgccaactgcaatgtcatggtgcacaaagtgcccatgcctcatgaatgaaccgctcctcgagcccacggcacatgaattgacacataactttgttgaaatacacattttagtgatagcgtcccttgagtgccatgttcttccccgtcctctgtgatgattgacgatgcatccgacccaagagattctgattcggggcccatgcatgcaggaagcnnnnnnnnnnatgacacatagctttgttgaagtacaccttttagtgatagcgtcccttgagtgccctgttcttccccgttctctgtgatgattgacaatgcatccgacccaagagagtctgattcggggcccatgcatgcaggaagcatatttcggagcacaaccatcgcacctgaattgtttaacatttctccctggcttaaatagaaacagttctgcacgatccttcatcgaaagcatacccgctgcatgcacacctccgtgnnnnnnnnnncgatagaaccagttttgcacgagccttcatcggaagcatacccgctgcatgcacacctccgtgcattgctcggagggcacgtcgcgccattcgggtggtgtcggaaggcaggtcggcgacaggcgatcattctcccacgtgagtggctggacagctagacaacactgccctcatgtccatcgacggaaagaggggtgcgactccggcttcgtcttgagagcgcgtcgggggcgggttgaacaggctccctcatgcacggtgctcaacatccagccggatggctcggatacctggcgcctgcagacagccatagaagacctcctggcgtccaaggtgggaagatgtgatctcttgagggcaggtagcgatgcagtaatgtattctagttatgaaatcagacagtgccctgctgtgggactgtttgtcggacctacagctatgaggcacccaccccgtccttccctggccctgcagattggcatcattcccacggacaccagccccgccttcgtgtgctgcctccatgaccgtgtggccgtgcaggccatgtttgacatcgccggcctctcggtcagcaagaagttgagtgtcatggtgcggggtatcgcagagttggagtccctcacgacgggcctcccagctgccaacgggccagggcagccggcactcttcagaattctaagaagcaccctgcctggccctgtgagtgggcgggctttgtgtgttttctctttggggctggggaggggaatgaactgggggcagctatgccttgtcaattcatgagggtgcaatgtgcataggtgctgagaaacactgccagtctttttcttgagcaagaatcatggtggtgttggacgggtttatgaattgagatctctggtgtgagtcagcaccatggctaacccccgcgtagtacaccctgatcctgacggcgagcaagggcatgccgaaacaagtggttgcagcagcatctggaaagaggaaatccaccatccgcaagacggtgggcattcgctggcccgacaaccccgtgtgccaggtgggcggctgaggccggggtggcagtgtgagcaggggggggtgtcatgggaagagcagccagggtgtcatgggtatggatccttgtcaaggcagcctgccaaccgccctcctgcccctgctctgaggtctggaccattgcaccttcccctaaggccctgatggctggcgtggatgggcccctgctctgcactacggtgcctgggcgggatgacccaggcggcgaggagcaggctcccgacctcgcggaactggccgaccgctactgcgctgcaggggtggggtttgtggtggccgaggagggtcagcgctggggtgcgtcgaccgtcatcgacttctcgggggcacggccgactgtcgtcagggtcggggacggagacctggacccttttttgccatacctccctgacgtgtgagtgggagggacatgcggcatagtgtaaggctgatattcaggataggcattgccaggaatcgctctcttgacagggtgagtgttgggtcattgttggtggccagccggccatggctgacctgggcatgagggggggttacattgttaacagcgggagcacacacccacctgccattagggcgccgaggacatgtgtcgagagattgaattgagtggaccatgcgtttgacatctttttaccatgtgtcgagagattgaaacgagtggaccatgcgtttgacatcttttccccaggcgtggtgacttcgcggctgcaatgcgcatgttctaatccgagcagctccgcccacgcatgcaggactcccatttcaaacatcccgggtcgaaggaaactgcaccttcgcgcgtgggtgctgctgcacaaccctggtcgagatgttggtaatcggtttcaagttgcatcgcgcgggccatgctgtaacactatatacatgcgaatcatctaagaagcatatccttcaatcccgatcactttctgtcatccaatcctacatcacaatgacctccgtcgaggcccctccccgccccaccagcctgaagaagctgggcttcgtgcccgaggccagcgcccgcagctacgagatcgccaccaacatctacagcacagcgaaaagctacgtgccagccagcctgcagccccgcatcgagaaggtcgaggagactgtgacgaacgtgagcagagtgtggcgggggagacttcgggaagtgccccggccccggcgccgatgcaggctgccaccccctgatccccctcacctccccgatcgccgaccctcgcaggccagcgccccgtacgtgaccaaggcccaggacaagggcgccgagctgctcaaggccgcggacgagcgggtgcggaaggtgttgcgaacctgctcccgccagcttgtgccggtctcaggaaggccccaccgtggtccttatacccttgtgattgtccactaatgccgtccctgactcggagctggccgagcgcttgcctcagcgccactcacacccatccccccaccccaggttgacaaggccatcggccaggccagccaggtgtacgccaacaactctgcctttgtggccgccaccgtggaccgccagaaggcctaccacgcccagaacctggagtcgtacaaggccgcacgcgagcactacctcaaggtagtggagcagggcgtggactacctgaagcgcgagggcctgggcggcgccacgcgcgccgcagtggacgaggtgtcggcgcggctggccgacgcgcgtgccgtccccggcctggttctcacccggctgcaggagtcggtggaccgcctgctgcgcctcgcccccgtgcaccgcgcagtggagggcctcaagcccggcgtggacgcagcctactcgcgctacgcggccctgcacgacggcgtcgtctcctccccccagtacaagcgcgcactggccgcggggcagaacgtgctggcacgggcccaggccacgcagctgtacgcgcggtcgcgctccgcgctctacccctacgtcgcgccctacgcggagcccgccgcgcagcgcctgcagccctactacctgcgcgtcgtggagcacctcgcgcccaaggacgcctgaacagcaggggagcgagcgggggagcgagcggagggagggggctgttggcagcgtgctcggtgtgagccagagttggggcacccaagtgggcggccggctggcaggcgtgggcagacgcagtcgatatgatggggcccttcctacacgagggccttgctccatccctgagaaccccccagacccaccaacccctcagtgtcaagctcattttcgctgcccaagacaatagatatccctgattcgtccatagacgttggcccgggtcatgccctggcagtgtaccctggcccctagcgacccgtcccctatttttgtgccctagagccgtcacccgctgtttccctgcattccctgcacaccccatgccccgtgcccttagctggctgtgctggggcccctattccccgcccagcccccgtgggccggccctgaaccgctcgagatcaaaacctttcggagaacctgtgcaccgcgtgtgtaattgcctagccccacgcatgccatcatgcaagaacggaatgggaaaagagactggattcacagcggcgcggccagggactccaggctgggccgcgccgactccacgggctggtattttggggtctggcgctggaggatggaataggtgagccagtagtagaagagtagcacgcggccctgacccaccaggctctgcccgatgctggtgccggcaaaggacagccgcttcagcgcctggagcatgtttgggtcgggcggggggattggggggtcacgatacagaggaggaggggaagagtgcatggacgaagcaagcgacctggcttctggaacacaaatcttcctcccgaacgcctctcactgtaagcccacctgggtccccgtgaggccggggcccgcgccgttactcgtgaagttgaggccggtgaactcgttaacacacagcnnnnnnnnnntgtgaaaattcgaatatgttgccggggggccctgggcagggcagggcccacccgatcgctttcttggcggcgctcgcccgcaaccacgccaccatttcaggcgtcaatggaattgttcggctcctcctcctgccctctcccacgacctccagtttccccacttctgccctcaggttttcacgctttcttgccgtgttgacgnnnnnnnnnntaggcctctcactgaaagcccacctgggtccctgtgaggccggggcccgcgccattgctcgtgaacttgaggccggtgaactcgttaacacacagcccggcaaaggcctgcatgttacatgtttggggagggaggcagcgcgtgtggaggtcttgagattctcttttgaggggctaacgccagccctttctcacttgccagacccatgtgccgaagcacagccnnnnnnnnnnctggagtccttcagcgcccaggccctgggcctggccgtgggagctgccgcgccttccaccgaggccgcgctggccatcggccccgccgccatgctcatctccatcgtgtttggcggcctatttgtgaacgaggccaatgtgccgcgcgtcctgtcctggctccccaagaccagcatcatcaaatatgtgagcatgaggctggcttgctgtgaatggaaagggtgggtgcgttgaaggcgtgcggttacagggcgatcatgtagatgcccgacttcccaaggctggagatcctttcaagaggctgtgcttcggcacatgggtctggcaagggacaaagggcttgcgttagcccctcaaagaaaatctccagacctccacacgcgctgcctccctccccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccctcctcctctgtatcgtgacctcccactccccccgcccgacctgaatttgatccaggcgctgaagcggctgtcctttgccg

SEQ ID NO: 48039 - DNA, 104 bp, Chlorella protothecoides
gccgtggtctgtggcaggggccatgggggggtggttgaacgtgtggtagcgtgggagaggacgaggggaggccatcctgaggctgccgggcgaaaccaagggga

SEQ ID NO: 48040 - DNA, 61 bp, Chlorella protothecoides
tcggcggtggacctggaggagatgggcttcttgcccggttggggcaacaccgtggggcgag

SEQ ID NO: 48041 - DNA, 76 bp, Chlorella protothecoides
atcggtgcatacaccgccggacgggtataaaaaactctccgggcatgccgagacacctattggtactgttgcaatg

SEQ ID NO: 48042 - DNA, 61 bp, Chlorella protothecoides
actgcaccgggctctggaccttgtctttgctccctggaaagcagcaagccacaggcagggc

SEQ ID NO: 48043 - DNA, 77 bp, Chlorella protothecoides
ccgagcagatccaccgcgaaacccgtgagttctggggctgctcctgagtagggtatgggaggtttgtttggtttgcc

SEQ ID NO: 48044 - DNA, 61 bp, Chlorella protothecoides
ctcgaggtacgtacagcacacatgtatacacaccgtatcatgtgtacatcacttggagtaa

SEQ ID NO: 48045 - DNA, 61 bp, Chlorella protothecoides
ttacaagtcacactgagactgtgcagaaaagtgtccctgctggggcgtccgagaagacggg

SEQ ID NO: 48046 - DNA, 91 bp, Chlorella protothecoides
caccgacacccggtttctccccttcctcacaaacacaagaacaaagaggcatgcgctccaccccccccaccttgagcttgttgtagctgtt

SEQ ID NO: 48047 - DNA, 61 bp, Chlorella protothecoides
aagaatctcggtacgtacaagtttgtcaaccatcacatgggcaagacaattggcatctttg

SEQ ID NO: 48048 - DNA, 78 bp, Chlorella protothecoides
gacgccgcgcccgcccagctgcccccagcctcggtcgccgacagccgcgcagcaccaccacccccctcgggcagggcg

SEQ ID NO: 48049 - DNA, 61 bp, Chlorella protothecoides
tgggatgcagtccatggctgcaggggggggtgatgggcacttcaggcctgggatgaatata

SEQ ID NO: 48050 - DNA, 61 bp, Chlorella protothecoides
cgaaccttacacgacacctccccctcctccaccccctgccacagacgcatctcaagggctg

SEQ ID NO: 48051 - DNA, 61 bp, Chlorella protothecoides
gccatgactgccacagcaacctaccatacgtcgctcttttgtacctcacaatgcaaaatgc

SEQ ID NO: 48052 - DNA, 61 bp, Chlorella protothecoides
cggcgcggccaccgtggagtacctgtaccttgtggagagcggggagtacgccttcctggag

SEQ ID NO: 48053 - DNA, 61 bp, Chlorella protothecoides
caacgaggcatatcccgagtgcctggtgtgtgggagccacaacaccaaggagcaccacttc

SEQ ID NO: 48054 - DNA, 61 bp, Chlorella protothecoides
aggaggagttcgtggccaaggtgcttttgtacctgccgtggattccacctggatcaacgac

SEQ ID NO: 48055 - DNA, 61 bp, Chlorella protothecoides
tcaggcgggtgcccgccgcgtggagggggtggcggctcagggcgtccgccacgacgttgct

SEQ ID NO: 48056 - DNA, 61 bp, Chlorella protothecoides
ttgagtccaagtgagctgagcagcggctggcgccgactctgggactcaaatgctcctggtc

SEQ ID NO: 48057 - DNA, 80 bp, Chlorella protothecoides
aatgcaacctcccttgggacttcattgtacttagcaccccccttcccctgatcaacacccgaccgccgcagacgacaatg

SEQ ID NO: 48058 - DNA, 61 bp, Chlorella protothecoides
cgtctaccagaaggcactgaagcttgcatatgttgatgagctgctggggaaggtgaacgcc

SEQ ID NO: 48059 - DNA, 63 bp, Chlorella protothecoides
ctgatcaaaatttgaggttatggatgtacaccaaggacctcccgaggcactcggggggattgt

SEQ ID NO: 48060 - DNA, 61 bp, Chlorella protothecoides
gcggtctgggccatcgtggcgaacaatttcaccttccactacgccttctacgtgctcatga

SEQ ID NO: 48061 - DNA, 64 bp, Chlorella protothecoides
gatgtgcaagcacatgctctggtacaaacaaccaaccatgcgttacttgcttgcagatggcatc

SEQ ID NO: 48062 - DNA, 76 bp, Chlorella protothecoides
ctatctacaattcccatccagcaacttgttaaagtaataaatagccttttacatatactcgtcagctccccccccc

SEQ ID NO: 48063 - DNA, 64 bp, Chlorella protothecoides
gaggggaagggggttgatgaggaatgatgtaccgttgcacattgaaaggatggagtccaaagtt

SEQ ID NO: 48064 - DNA, 37851 bp, Chlorella protothecoides
  modified_base (173)..(182): a, c, t, g, unknown or other
  modified_base (1631)..(1640): a, c, t, g, unknown or other
  modified_base (2068)..(2077): a, c, t, g, unknown or other
  modified_base (2158)..(2167): a, c, t, g, unknown or other
  modified_base (2250)..(2259): a, c, t, g, unknown or other
  modified_base (4347)..(4356): a, c, t, g, unknown or other
  modified_base (4661)..(4670): a, c, t, g, unknown or other
  modified_base (6128)..(6137): a, c, t, g, unknown or other
  modified_base (8788)..(8797): a, c, t, g, unknown or other
  modified_base (8887)..(8896): a, c, t, g, unknown or other
  modified_base (9157)..(9166): a, c, t, g, unknown or other
  modified_base (9739)..(9796): a, c, t, g, unknown or other
  modified_base (9898)..(9907): a, c, t, g, unknown or other
  modified_base (10009)..(10018): a, c, t, g, unknown or other
  modified_base (10193)..(10313): a, c, t, g, unknown or other
  modified_base (10559)..(10568): a, c, t, g, unknown or other
  modified_base (10818)..(10827): a, c, t, g, unknown or other
  modified_base (11032)..(11041): a, c, t, g, unknown or other
  modified_base (12152)..(12161): a, c, t, g, unknown or other
  modified_base (12571)..(12580): a, c, t, g, unknown or other
  modified_base (13015)..(13024): a, c, t, g, unknown or other
  modified_base (13938)..(13947): a, c, t, g, unknown or other
  modified_base (14186)..(14195): a, c, t, g, unknown or other
  modified_base (14344)..(14353): a, c, t, g, unknown or other
  modified_base (15429)..(15438): a, c, t, g, unknown or other
  modified_base (15741)..(15750): a, c, t, g, unknown or other
  modified_base (15819)..(15828): a, c, t, g, unknown or other
  modified_base (16550)..(16559): a, c, t, g, unknown or other
  modified_base (17313)..(17322): a, c, t, g, unknown or other
  modified_base (17454)..(17463): a, c, t, g, unknown or other
  modified_base (17547)..(17556): a, c, t, g, unknown or other
  modified_base (17726)..(17735): a, c, t, g, unknown or other
  modified_base (18194)..(18203): a, c, t, g, unknown or other
  modified_base (19196)..(19205): a, c, t, g, unknown or other
  modified_base (19387)..(19396): a, c, t, g, unknown or other
  modified_base (20409)..(20418): a, c, t, g, unknown or other
  modified_base (21094)..(21103): a, c, t, g, unknown or other
  modified_base (21626)..(21635): a, c, t, g, unknown or other
  modified_base (22249)..(22258): a, c, t, g, unknown or other
  modified_base (22318)..(22327): a, c, t, g, unknown or other
  modified_base (22924)..(22933): a, c, t, g, unknown or other
  modified_base (23023)..(23032): a, c, t, g, unknown or other
  modified_base (24588)..(24641): a, c, t, g, unknown or other
  modified_base (26062)..(26071): a, c, t, g, unknown or other
  modified_base (26621)..(26630): a, c, t, g, unknown or other
  modified_base (29460)..(29469): a, c, t, g, unknown or other
  modified_base (29583)..(29693): a, c, t, g, unknown or other
  modified_base (29902)..(29911): a, c, t, g, unknown or other
  modified_base (30355)..(30364): a, c, t, g, unknown or other
  modified_base (30755)..(30764): a, c, t, g, unknown or other
  modified_base (31110)..(31119): a, c, t, g, unknown or other
  modified_base (31204)..(31213): a, c, t, g, unknown or other
  modified_base (31306)..(31526): a, c, t, g, unknown or other
  modified_base (31597)..(31606): a, c, t, g, unknown or other
  modified_base (32242)..(32251): a, c, t, g, unknown or other
  modified_base (33124)..(33194): a, c, t, g, unknown or other
  modified_base (34272)..(34281): a, c, t, g, unknown or other
  modified_base (34610)..(34619): a, c, t, g, unknown or other
  modified_base (34860)..(34869): a, c, t, g, unknown or other
  modified_base (35062)..(35071): a, c, t, g, unknown or other
  modified_base (36570)..(36579): a, c, t, g, unknown or other
  modified_base (37191)..(37200): a, c, t, g, unknown or other
  modified_base (37675)..(37684): a, c, t, g, unknown or other
tggtgttattaaacaccacctgattggaatcttgccacaaaacaaacaccaacgataatcaagcaacaccctagagacaatatgcggtgatgtatatcctggcaagtgtcaagcaataattatcaacatgatggaacgtacaggtgttttatgacgcgattctcttccttgcnnnnnnnnnnacggtgatgtatatcctgccaagtgtcaagcaatatttaccaacatgatggaacgtgctggtgttttatgacgcgattctcttccttgcgtctagctgttgccggtggggtacgttgccttgctccccctcacgctgactgtgcatcccacacggcagttgactcgacatgatgcagactgcatgcgctcgttaagcgagtttgtcgagactggtaatgctgatgttcgacctcagccccagatcagcgttcaaggcacgcgcaattgcgtcggcgttttgcaggggatctcgggcccatgctgggcatgcccggcgagggtggagcacgcactcggatcttacgacgcagcacattccatcccctctaaagcctttggaagccacccatcatgcaaaatctcttaaaagctgctgggcatggtgtctcgccacttcgtgagcatcacggccttgttggcctgcggtctagtccctgcgctcgcgctccagacctggtcactgggggacagcgcgacgtggagcctgaacaacagcgctggctccgcaaacataagtgatgtgcccgtgaccctcccttcatgcgcccttggctccctgctggaggacggacgactggccggcgacccgctgtacaggtgccgctcgctccggagggcggtggttccctcaagaccctcgttgcatggcgcgggtcaagcccggtctggtaaacaaagccgcctgtaatgtcctctcccatgcgtatgcgcaggtacaatgagctggactaccggtgggtggcggatgacacatggacgtggacggccagcttcccctccccgcagccggccgagaacgccacgcactggctcctgaccatcggcgccgtggacggcgtgggtcaggtggccctgaacggcaaggtcctggcctttccccgcaactcccaccggccggttgaggcagacgtgagtggcctgctggcggaagatggcaacaacaccctcaccgtgacaatcgaatccgcggccgccgtcgctgcggccgctgcggccgtctacccctaccaggtgcccgccgtgcgtcaggtgggcggcctcccccactacaacttcatccggaaggcggcgtctgactttggctgggactggggccccgcctttgcccctgcctgcatcctgggcgacgtcacgttgacggcctacagcggcccctacctcaccggtgcgctgtggtcagcttccctgtggctttgggatggcaaggcagggaaaggatggggttctgaaggggaactcctcagccctgacatccagcatctcgagaacgggcgtcacatggagttggggcagtagacggcgagcaggtcgcagcccagagaccatccgatcttcctcacatgtccccttcaccccctctctcttcctctgtccctcgtcaggcctggcgctggcacaggaggagcagnnnnnnnnnnagggaactcctcctcagccctgacacccagcatgtcaagaacgggcgtcgcatggagttggggcagtaaatggcgggcaggtcgcagtccagagaccatccgatcttcctaacatgcccccttcaccccctctcccttcctctgtccctcttcaggcctggcgctggcacaggaggagcagagcaatggcagcttcctgatcacggccacggcattctttcaggccccgcccggcgagcatggcggcctactcatcctggacatgggcaaccagaccttgtctggggcctggagcacggagcaggaggtgctgctgtcctgtggtggggctaaggaaagcgcggcggtgggagcctcagcatcgtcgggccccgcctgcgcagctgcggccgccctcccggccagctgcagcgccgtcatctctctgnnnnnnnnnncggggcctggagcgcggagcaggaggtgctgctgtcctgtggcggggctgaggaaagcgcggcggtgggagcctcagcatnnnnnnnnnngccatcgacccgcccttccggcgctggtggccctgggagctgggggcacccgcgctgtacgacctggaggtgcgcttcgagcnnnnnnnnnnaccgtcgacccgcccttccagcgctggtggccctgggagctggggtcgcccacgctgtacgacctggaggtgcgcttcgagccggaaggggcgggcggcgcgctttcttccctcacccgcgccgtgggcctgcgctccgtggagctggtcaccgaggccctggtggagggcgggcgcgcggtgggggagaccttcttcctgcgcgtcaatggcgtgcccatgttcgcgcgcggcgccaacgtcatccccgacgacgtgctggagagcgcggtgacgcccgccaggctggcgcgccaggtggcggacgcgcgcgcggtgggcatgaacatgctgcgcgtgtggggcggggggaggtacgccggcgacgcattttacgccgcggcggacgaggcggggttgctggtctggcaggaggttatggccgcctgcgccgcctacccccgcgacgcacccttcctggaggaggtaagggtggtcggggtgggaagtgggtcgtgtgtattgggacacgcggcgtgctggtctgggctcggtgcccctgctcaccgcgtcccttgcggcctttaatacaactcgagcgggtacagcggcggggcctgcagggcctgcttggtgcatgacttgagcagcagtgatgcgagagcagccggcttgtctcttgatgtggctcccacaggcattactacaagcctcatctgcgagcccctcaggccaccgccctggagaccacatcaaaccgctgcctctgtactcaatttccccctatccaggtggcgctggaggtcaggcaccagttcacacggctcagcgcccaccccagcgtcgtgctgtggggcgggaacaacgaggtggaggcctccttcggctggagcccggtcacccgcgccgccccgcagctctttgccgtggactttgccgccctgtttgtggacgtggtcaggcccgtgctccaggaacttgaccccggtgtcgtctatgtggacacctcccccagcaatggcctgctgtcctccaacccctacgtcaagaggtgggtggggtgttactgcttgttgtatattgactggcagggggtcctcgtgtagcgtcgtgagggtttctgaccatgcgaaagtggcgcacggatgcagcatcaccgaggagtgtgccaggcatggtgcagcgatgcgggcgtgccactgcagtgcctcaatctactgccccgccaggcaggaccaccagtccttgtttaccctgcaactcgcatgatgacccactcatgctgctccatctgcatctcacacatccaacctcacaggtggggggacgtctctgaccccgcatatggggacgtgcacttctacgactacacctctgacgcctttgaccccgcgacataccccccggccaagtttgtctccgagtttggcttcatgtcctttccctccttctccggtgagccagggatgcaaaccatgcccacaggcgacgctgcccccttggctgtctgacaggcatgtgcccgagcccccctgcccgcctgcaccaaactctcctcccacgacacgccgcagtctaccagaccgtgacggagctgggagactgggacctgtccagcgcgatgaccgacttcaggttgcgccacgcgggcggggtgcaggagctgcagcggcagatgggccgccacttcctgcacgcctcgggcgagacccccccggtcagcgcctttgacggccccgtcggcgcctccgacggccccgccgtgaccatcggcggccccgacgtcatcgttgcggggcccaacaccaccaactcctcggagagccccgtggccctgcagtacaaggccttcacccacctttcccaggtgcagcaggcgctggcgtacgagacggcggctggggtgtggcggcgcgggcgggacgaccccgccacccgcaccatgggcatgctctactggcagctcaacgacatctggcaggtagtatgtgcatgtggagggggggagcatcggatagtgtagctgattacaggggcgcaaggggagggagaggggggggtgcgctcaatggtaagtccccagctgttcttctggctgtgtgaaacccnnnnnnnnnnccatgtggaggggggggtatcggacaatgaagcttattacaggggtgcaaggggtgggagaggggggggggccgcacaatggtaagtcccagctgttcttctggctgtgtgaaacccatgccacatcacggtacgggaggggcagtgcaggtgctcctccatggagctctgtgtgctgcaccaggctactcgtatgtgatctctctgcacatgcttgtagaactctcccacaaacacccacttgcccatacaccctccccccaaaataactcccagggcccctcctggtcgagcatcaaccacgnnnnnnnnnncgtgtgctgcaccaggctactcgtacgtgatctctctgcacatgcttgtggaactctcccacaaacacccactcgcccaaacaccctccccccaaaatacctcttagggcccctcctggtcgagcatcaaccacggcgggcagtggaagctgctgcaccatgccgcgcgccgcttcttcgcccccgtctacctctccgcctggcgcgacggcgacaccctgcgcgcctctctggtcaacgacctccccttgcacgtgcgcggtctgctgtcggtcgacgccgtgctgtatgcggcacggtccgaggccgacgtggtgacgctgctgccgcccacggctacgcacgcggccgcgctgaccgccgcgccggcctggtccggaggcttggcctcgctggcggacgctgtgacgcggcaggcgcaacccacgcagctgacttacacctccgactacgtgctgcgcctccgtttctgccccacagccgtgcaggcggccgtggggctgcccaatcccttcgaggtggagacggcggggaccggggcgggcggcaacgacacgcaggtggccgccgcctcctcggccggtctgacagggagttcggccaatgagtcgtgcatgagcagcatcgccggcctgggcgcggcgcccggctcggccgcctgcgctgcggcgtcgtcggcgctggtgtgcggcgaggccctctttcacccgaccgagttcgtggacgcctcgctctggggcccgccgccggtgctatcggcgcgcgcgcttcccggtgcgcagacgggggactctggagccctggtgctggagatcagcagcgacgtcgtggcgctgtgggtggcggtggagccgccgccggggctggctgggaatttcaacgcctcggggttcatgctcctgccctggcagccgcaggtcgtggtcttcacccccgacccggtggaggagggcgccaccggcgcagcgcccatgaccgccgaggagctggcgtccaaggtgaccctgcgctccctgcagcagagcatgcaggagtacgaggcggggaaccccagctcctcggcgctggggctcttgaatggcgtgtcgctgcggctcagcgtcctgggcctgaccatcttcatcttgacaatgctatgatatatggtgcaggaatgcctgctactcgtatgtataccaatagcgacccaagggtacaggttgaaagggaccagtgggggccggatgggttggtgtcaacttgtccgcgccggtgtaacgagctccggatgttgccggacagggtgggcgcctctttccgcgcagtgtgcctgggtcatgcggaagatcgcatgtgcctccaagggtatgcaatgccaatttaatgaggaactgtgctaaaatacgctgctcgaggcgcacagggttcaaaattggcaaactgaatttcgcgaagtcgtcacatcagcaagcctgcctnnnnnnnnnnatccgagggtatacaatgccagtttaatgaggaaatgtgctgaaatactctgctcgaggcgcacagggtgcaaaattggcaaactgaatcccgcgaagtcgtcacatcagcaagcctgcctcgggggatccgccggtttcgacaccattcggagcatgggctgcgcgagccttgtgcatccgaacacccgatgcattgtccccgcacgcctggacgggcggcaaccgatatgcatgggatccaccggcctgtgacatgtaactaactaccgtcaaggcgcgcttacttttacgctttcattcgaaacactaactcgccacccgcgccgaccatgtcgtccacgaaacttcgactcttcaacacggtgccggacggcaatagcgccgcgagggaaacccagtcctctaaatctaagttcatccctcatgcaaacggaagcagccgctggggcgccctgcacgccctcaccgcctcctggccgctggagttgtcgaacctggtcttgcaggccagcaacccagactgcacggacctcatcctcctccgcttccgggaccacctggtgccctcctggcggtacctctcctggacagtgccctactttgcgtggcactaccagaactttctggagtacggtctgcagggcggggtgccaggcatctgtgcctacaccgcggccaggtgccggtggctggacgaccagatccgggcgggcgtcgaggagggcgcggagcaagtagtcatcctgcgccccggctatgacacgaggccataccgcatgaggttcccccatgtcaaggtgactgagcttcgtggtctgaagtgggtctgcctgccttggggacggtggagggtgggagggctgtgacgttgttgtgtccttctacaagccgggcagctggcgatttttcaacagacttgactcctccatctcacataaaaacacccacaccatcccccccatgctcagttctacgaggtggatgatgtagaggcacaccaggccaagaagcagctcctagaagcaggtgtgggggtaggggagctttacaaaactggctgaggtcctgattctgcccatgtggtgtcctaacatgcgccctttccattctcccacccacacaccacacctctccgctccctcccatcaccctcccagtgctccctaatcggaacctgcacccccgccccgcctttgtgagcgtggactggggcaacctggctaccttcatccccgccctcaccggcgccggcttcaaccctggcaagagggcggtgttcgtggctgagggcctcctctgccagctggactcagaggcggcggacaccctgctcagcgacgtctcggccctgtcggcgcccgggtcccgccttgccttcgacttcctgcatgaggatgtgctggaggggctggtgcagccggctgggtacgccagcctggcgcagagcctggccaacaaggggcgacccttcctcaacggaatgcgccccgtgtactctggtgagtgggaatgctgggtgtgaaggtgaatgctgtggccattctgcccagtgcctgagtcttcttgggcgcttgcatgaattgtcaggcaccgcaaggtgcacagctgacagaatacttgcccaacccctcttcaccccacaatccacaacaattcgcagctgccgtgcggaggttccaggcgtacaatatgagggtgggggcaatgctcagccccccggacatcgcggcgtggtaccatgcctcgcctggcgccgcccccgccgccgcccagaatccctccccctcccgctgctccctcgtggcgggtctggcgggcggcatgccgcgctacctctctttcctcctcgtgatcaaggcgggggcgcggcagagcctgcgcgacgccccccagccccagggcaaggccgcgcacggcgccgcccttggcgtcggcgaggacggcagccccgacacggtggagggcggcgccagctgcttcgtggccagcctgctgaccctcatctgtggcggcgggggcccggcgccggcgcccggctctgcgcgcgcagcgcgcagagcgcggacgggcacggcaggcgaggagaagtcgggtgcggcgccgctgcgcgcgccctccaaggaaacctccctcgctggcagccggcgcggacccagcgaacacccccccgcccagctggcggccgagccgtcctcggactggtatctgcgcgccgacacgcccggcgccgcggcgcgccgcgatagcgaccccggcgagcgcctggtcctgcgcggcgcctcggggccggcgccggcgccagaacgcgaggcgctgcccctctcctcgggtggccagctgccggacctggaccgcgcgcagtctatcctgccccagagcagcgcgtcctccctcgcttccgcagcggcggccgccgttgagacgctggagggcgaggggacgacggcggcgacagccaggcgcacatcagattcgcagagccagggcagggtccaggacctgaggcagatgttcaactccctggccatggggtaggtgggcaggcactgccggctcgtcattgtctgaggtcgtgttttgagttgtgtgagcgatccttgtgtagaggaagaggagcccacacaagtgcacctgatcctgctctcaccnnnnnnnnnnatagtgacatgaatctgcctcatgagtcccttcttcccccaaacaaggatccccgtctgttcaatctttccagcctgccacgctcactgnnnnnnnnnnttgccttaggtcgtgttttgagttgtgtgtgcgaaccttgtgtagaggaagaggagcacacacaagtgcacctgatcctgctctcacccaacatggcctcgaccgtccaagttgcccctggcatgcatggctctgcatccattgtgtctgaaacgcactcgtgacaaggcatgcagtgttacagcaaacacacaaaagatatgagggttttgcacatattgtggggcacgggaagcgagggcacagctcattattctagannnnnnnnnnggagcagacacacaaaaaatatgagggttttgcacatactgtggggcataggaagcgagggcacagctcattattctagaccagcacgttgtgtagtgacataaatctgcctcatgagttcctcctccccccaaacaaggatccccatcttttcaatctttccagcctgccacgctcactgggcgatgacctccttaggttcctggaggtcgacatttcggggaggggcctgggaaggggccgaggccccgctcccagactcaatgtccaccggagtctcagaggcgggggtgaccgacccgtcgtcctcatcgtcggtcgtgtcctccagtcccagcagcttatcgtcactgccgccgtccaggaccgccttcatccgcagcgcgtctccgaccaggtgctcgtggtttgaggtgctacaaataaggagggggagcatgagaggggggacggaatgtggcagggtgtgctggtgtgcagaagcatcacagtgtgccagatatgtcaatcaggcaacctgtcatgatgcacgagggcagttaggcacagccctttgagcgactgctccccgtnnnnnnnnnnnnnnnnnnnnnnnnnnnnnnnnnnnnnnnnnnnnnnnnnnnnnnnnnncgatcaggagcgggtggtccttatcgatgtctgctgcgatcacagccccgatcctcatcttaatgcacatcgcagggaggggcttgcaggcaaccagtctgnnnnnnnnnnagatcaggagcgggtgctcgttgttggtgtctgctgcaatcacagcaccgattctaaatctaatgcacattgcagggaggggcttgcaggcaaccagtctgnnnnnnnnnntgatatgacaatcaggcaacctgtcatgatgcacgtgggcagtttggcacagccctttgagcgactgctccccgtgcactccagcttactcaaacttgaaggagggggacaggtatcgctcttcaatctccttgtctgcagggggctgcagcgtgccattctcctgtgatgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccactggacctgaagcacctgttcccgacacacctctacacctcttgcaatcctcactcacccaggcatccttctccctcttgtccagcaagccggccgacaggagtgacaacccctcgaagggcctccagaagcgagcatgcgcagcaaaactgcggtagggacggcaggcgttgctgagtcaaggttgcagtctgcaccagaacatcgatgaatgcagaagatcttgaccggcggcaacatcnnnnnnnnnnggacaacccctcaaagggtctccagaatcgagcatgcgcagcaaaactgcggtggggacggcaggggttgctgagtcagccttgtggtctgcaccagaacatcgatgcatgcagaagatcttgaccggcggcaacatcggaaaactcagacaatcctggagggaagcattgacaccacaaagccccacacccaaatccgagcctgcccaatgccaacatcaccatcaactcactacagggagagggtcannnnnnnnnngtaacaccacaaagccccacacccaaaatcgagcctgcccaatgccaaagacaccatcaactcactacagggagagggtcaggaagggcagggggacgatgaagatggggggaccaatcacctttttgatgcctgtgcaatggagagtgcgtggggaatgatgacaggactgtaagcaaggcagacagagaccctgcatgtcacnnnnnnnnnngtggggaatgatgacaggactgtgagcaaggcagacagagaccctgcatgtcactacatcgatcagaataccagacccagaatcatcaacagcaccacagcatgcctgtgctgtccccttctctcctccatatggcagatcacagcctgccatcagcccgggacattcaacccctcagcttcaacccacccagcaggccaatcatgacaagctggaagatgacgaggcccacgatgcactgatcaaaggcagactgccagaactgcatgcggtggggaaaggacatgtgggtctgtgggctgggagtgggactgggtacgcagcacccaaactcatcagcaatgaggaggtccagcatgcatgcaaggcactcttgtgcaccctcaccttgccgcccgtctggtagggctgcttgtacacgtagaccaaggagtacttgctgttgaggtggaaagacattgagaaacagtgaggctcctgcatacaggcatgcatcacagcgctcccctcattaatgtaggacccagctttcccaatgcgattgccactccagctcactggaccaggtaggcggcgacaaagtagaggaaggcgatggggaggatgagggggcagatggtgctgaatgtctgtgcgcattgccaatgagtgggtggcaggtgagatgcgagtgctgggaggatggtgtgaagtgatgagaatgtctccttggcccgcgctccatcgccctcacggcatgcacaagccggcatttttgtgcaagccaccagatgttgcgccagcataccagtcccaggaggatggcgatggtgtcgttgggcagcacagtgccgtaccggaactcctggtcctcccacaagcggcgctgcaaggggaagagggatgtccggtcgaggctctacgagggtcatggaatctcgaaagcatgactcccctccacctgcccaaatccatgcccaccttggcacgtgccgtggccgccagcttcgatttgacccagaagatcaccagcgagacgacgcgaacgatgcccaggggctgcgtcagcagggcctgtacaggtacaggggaacgggggttggaatgagacagggcacaggcgtgcaatggnnnnnnnnnncataggtacaggggaacggggtccggaatgagacagggcacaggcgtgcaatggggtaccaagccagggcttgctgtaatgtacagggtttgataccggggatgtatgccttgtacctctgcatgatctggaaagtgacacaaacaccccctccccacacacctggaccagaaggtaagtcatgaagaagatggcggtctggggcgcggacgtccctagaacggtgacgatactggaaagtgggaacggagcacgggaagtgaggcctggtcgctgcgcaggcaagtgtgatcggtgctttcttcacaggcagatgagccattgagagtgcatgatcagactttcccaccagtgttccccagatcatggtactgtagtgaacagtccctcccctccaccctccgcccagnnnnnnnnnntggtactttcttcacaggccgatgagccatcgagagtgtatgatcagactttcccatcagtgttccccagatcatggtactgtagcaaacagtccctcccctccaccctccgcccagtatcacctgccagggtcgtcgatgaactgcttgaactggttgaagaatgacccggcaatgaaggacccgaagaacactgtgatgacctgtgacagtggggcagggatggaggaacgtgcaaggatgagggtgcagggtgatagagtccgaagggcaagatcatgggtccctccagatgcactgaggaaagcgttgtggcaaccttctgggcacctgccccacccctctccccctcactgacacgcaccatacgaggggggtcacacctcccaaaacccaccaccacacccccacctggaagacgaagaagcggctggnnnnnnnnnngcgagggggctcacacctccccaaacccaccaccccacccccacctggaagacaaagaagcggctggggagggccaggtccatctggctcagggacaccatgcccgcaaagcggttcatggccatgatgatggcgggcaccagggcgatgaagatcttcagggccagccccggcaggatggaggtcagcacggcgttcaggatggcgatgcgctggagggccctgcggatcgttgagttttgggggggagttgaaatttggagatgaggaagtgaggaggtaggtttgggcaaacgagtgcacaaaggaaagcgaaggaggcagggtcgccgcatggctgcctcgccccataaccctttcccctcgaacccagcaccccgatcactcacccgaccagggagttggtggtgagcaggccctgcaccgccgccacggggatcatgaagaagaaggcgagcgcgatgaaggccgccagcatgagcaggtgccgccccgcgcgctcccagatgcgccaccccaggttgccccacacgatctcggaggggcggggtgccgcctgacagcgccaggtggacaggtcctcattcatcagcgagcgcacggcgcccacctgggccagcctggcgttgaaggtgacgaaggcggaggggaagagcttgccccgcgccttcacctgctgctcctcgatctccaccttgagctgctccaggcgatcgctgggggtggaggggagggggcacgggggtggtgtggggtgatttgctgagggaagctgttcgggatcacactggaagtgggctgtccatgccaggtcaggtgggatggagtggcacaccctggaaccccccacgcccatgcaaccccacccctcccggcatccctggactcactgcaggaactgcagagcctccacnnnnnnnnnnagatggagtggcacaccctggaatcccccacgcccatgcaaccccacccctcctggcatccctagactcactgcaggaactgcagagcctccaccttgactggcttcaggccatacttctcgcggccccatgcccccatagtggggcccaccacggtcatctgcggtgcacgtgcatgctctggcacgactttgggcggggacgctggcatgcagcagcaccaaagagaacccacacannnnnnnnnnggtacgctctggcacgactttggatggggacgctgacatgcagcagcaccaaagagaacccacacacacgaggaagagctggacccggcgtggttggaagcatgcgtgtccccctctcccagacgccaggatcacctcggggtcgaatnnnnnnnnnngcgaggacgagctggaccctgcgtggctggaggcatgcgtgtccccctcttccagacgccaggatcacctcggggtcgaatcaacccagcctgaaccccccaactgcgcctccctgatcctgacgcaccttttttatcttcagcttggcgctgcgtcgcttcttggagatgtagtcgtccaggaggtcctccagcacccgagctctcttctcgtactcggccaccagtgggtccagctcgctggtgttgtacaccatgtgggcctggggtaggaaagggtgaaagagcatgggggggattgcatggtggaggaaagggacactgaaccctgaatgggttcaggaggctgaggtgtctgctgcggcatgacatcccacaggcacaatggcttggggccagcaagggttggcacgcatgcggcaatggtcggtcaaccccttactctcctccccctttcctgcacagccatgctcccagcgcgtcaactcaccactctgaagtcatcgcgatggacggctcgaaactcattctccacaatctccgaaacggtcttaccatcacgcagctggataagggaggaccaagggtcttgaaggcagtcttgagctcagatatccccttaacatgcgacacgggtgaagtctcatgcacggaccatgcatcacgaccaaccactgccctgccagcagcccacctgatctgcagcctggcgccagggatcgggcatctcccacctcccggtctcaggatcaatctgacgtgaaggaacaggaatgcttggctgggttgcactgaaaggtgggcctggaggcatgatctccacatgagcatgacctggcattgtgcactcaaagacgcaggaatcccctgctacatggggtgccaccccgagcggcccacctcggtggcaaagttggacatcttggatgctgctgccaggtcagccttgctggccacacgcttgccactgcggaagtcgggtgtggggcaggatgatgctcagcgccgcacagcgccaaccctggatcatgaaattcctgctcaaattcacggtgaccctggccgtcaactgggcnnnnnnnnnncaagtcgggtgtgaggcaggatgatgctcagtgccgcacagcaccgaccctggatcatgagattcctgctcagattcacggtgaccctggccgtcaactgggctgccatgccgcctgcagggcgcatggtagcgacgtgacagccccgccacccacctttcccaccccatccagtggccctctcacatgggcacatcggcgtgcttggccacctgggaacccacagcctccttgatgtcgtgaacatgcttgaaggccgtctccttcatccctgtggcattggcatgttttgcaccggcaggnnnnnnnnnngtgctgccagactgcccaggccgctgcatatcgtgtcatcgagatgcccagaacagccaagcgtgctannnnnnnnnntgcatgaagggcaaatcacacttgatgcatggcaacccaccacatgggttccatggagagaggtgctgccagactgcacaggccgctgcatatcgtgtcgtcgagatgcccagaacagccaagcgtgctacttgttgtcctgcatctgcctgcaacaccctggtcaggacatgggtttcccctccctcctttcccatgcagcccatggctcctcacctttggggacgaacttgagcagcgtcccgtccaggcgctgtgggatggtgccgaacaggacgcctgggatgtctgtgacgagcacggtgtgcgactccgcccccggcggctggttcaggaggtagaaggtacgcaggcgcagcgcctccttgctgtaggaccagagcacgtagaaggtgaagaaggtgaccatccagaccaccacagcatgcgcccagaggcgtggggagcggtccgagatgttggccattgtggtctgcaccagacgggtgttggggggaggggaggtgggtgcttcagtgagtactccgcatgctgaagggctcgtagaggggtgaacccagtccagctcgaggaggggcagcgctgtgcctgctaacatcaacatgacgtgtggctgggccgggctgctaagagtggggggaggatgcactcccacatacacaatcgatactccaccgtcccgaccttgtcaaggttggtgaagctgtagctgacagaggtgnnnnnnnnnncggcgtgtgactgggctgggctgctaagagtggggggaaaggatgcactcccacatacacaatcggtactccaccgtcccgaccttgtcgaggttggtgaagctgtagctgacagaggtgaagtcggagtcatacctccacccatacctgcccatggaaggctcggcgggagctcgagtgatacagcccagtaggcagacgggtacttgagactgccccaacgtttattgtctgccacactgagcgccccacaatgttgtacatcaatcaatcgtccattcgtctgcttcccaggagggtgaggcccccagcaaacctttgatccccctcacctgctgtaatttgcgccaaggagaacctccgggtcgggcaagtctggtacacctggcaagtactcccaccagaccaggcccggaggtgccggcgggatgtcggtgttgtaaaattctggggcctggaggtccgggaaagagggagcaggggcgttggataatgacatggaatgtctggtggaggcactgtcaacttggctgcatgtctgatgccgggcagtgcgcccaggcccacccagcgacattcgtccttgccggtaccggttgggagacgtggtgtgagcaccccaatacttcctgccttccctcgcaccgcagtggtggtggtgtcggtggtctgctggccagagctgctctgtgctggggagggcgatggcgatggcgagttaagccagtaggtgaactcacttgtggcctcaggnnnnnnnnnnccagtgcgcccaggccaacccagcgacatccgtccttgccggtattggttgggagacgtggtgtgaccaccccaattcttcccgctttccctcgcaccgcggtggtggtggtgtcggtggtctgctggccannnnnnnnnncgtggacccaagctgtgggattggggggaaggagagtaattggaaggtggtcatttacagttacaagcaagactgaccattatnnnnnnnnnnggtggacccgagctgtgggattgggggaaggagagtagttggaagatggtcgtttacagttacaagcaagactgaccattatctctcatccacgtagcagcccggtatggatgtcttcgggacaagtaacaatggttactgggctcatgacaacagtccagcctgctctnnnnnnnnnnttggcagcccggtatggatgtctccgggacaagtaacaatggatattgggctcatgacaacagtccagcctgctctggaatagtctgtgccaggatttcccattggtattccatgccggcatgttactacttgatgggaattgcaatccctacctccatgagtttgtcaacctccgtgcccgtgatgttgatgggcaggatgatgactaagactatgatgctgacaaagaagaagagcttcatccctgcagggaggacagaggcgggatgtggtgcttcttgggaaatcttcagggtccaaggaaaggtgaggaccattttctggctgtgcctgctcatgcatccaccctgggcactcgagtcattgcggctgccaaactggggttctgaagacacgcctgctggacaatgcagcgctgccacccgcatgccttgtgctcacccatctcgaggatcttnnnnnnnnnntgtggtgcttggaaaatcttcagggtccaagaacaggtgaggaccttttctggctgtgcctgctcatgtatccaccctgggcactagatttattgcggctgccaaactagtgttctgaagacacgcctgctggacaatgtagcgctgccacccatctgccttgtgctcacccatctcgaggatcttcacatacatggcagcatccatcccgccacagcggatcacctcagcctcgctcatcttgaacacctgcgaccgagcaaggagatttgtatgcgctagagtaatgatttctggcgcagattgccaacgcatacatacggttctccacctacagaaagcgtgtctcctgttcgccatcccaccacacccaagcgggtggggacacacagcagcacagatcacttgcctgcactgcccatgcgccccacttattccgcaaacgaggaggtttctggtgtcctgggtacttgacaaacctgcatggggttgcatgtgaagaccatgcacatgcatcctctcatggaagtatgcaggcattgcggcaggcatcggcgcccggcgcagcatctgtggccttcagacagctgcccaaactgcatgcaattcggccaccatctggacagttggccccacacccaccttttcggtgcataaaacttcctcgtcagattcctctgacgccaccaggagaagaggacgaagatggcgatgcatatggcggagtaaatggcaatggagatgccaaaggccttcccgcttgtagccatgtcaggagctcacacccagcacctgcagatggagatgaaagtgtttcactcccttcgcctgtgtacagcgacgcacatcgctgctgaactctcgccgcgtgtactaccactcatgagggtgaggacggctattcatcgtcggccgcctgcgcctggatacaggacgcagtctcatgagaagccatgtccgaatacaatgcgtaccctacctcgggtgcacaannnnnnnnnnagcagtctcatgcgaggccatgtccaagtacaatgcgtaccctacctcgggtgcacaatgcgcacctcagcgctgctagctgtcaatctcagtgctgcctggaagggaacccacggctagccctcggacacggcgcgggtggtgatacacttagaaacgatgtgcaggatgcccgtggagcnnnnnnnnnnaacccacggctcgccctcggacacggcgcggatggtgatacacgtagaaacgatgtgcaggatgcccgtggagccagaacgatgactgggtctgcgtttttttgccgagtaaggaccgttatccggtgtgagcgacgccgctgaccgagttcaaagaacccggggaagcagcagggaaggtacgcatgcggggtgttccatccacccgcgctacagttctcgctccatgtcttgatgtgcagcccgacctgcatgttggcatgcgccacctcgacatccttcattacttctcgatcgagggacatcgtgttgacgagaagcctcccacttgattgcagcgtcctcgttggcattggagccgaagggcgggtatggcagctcgcgacaatggcgcggggcgtccgctggtcaccgtggaccgcgtgcctggagatcaaacccaggccccatcgcttgacacggagcgtcgtgcatcgcatgcagcctcgcatgtggagagccccgacgacatggacgaccgcacatcgagggagccggggcctgcaggtgcaccagcatcaccccggcccagcagggccaaggctcctgaaaccaccgccgtggatggcgagagcgtgacctaccagctgcaaaaactggcgaccatggccttcctgggctggctgggcctcctggcatgcctgattcccctgctctggctgtggagctgggagctggtccgcgccctcgccctgggcctcctcgtgggactcggggcctccctcctgcaccgcttcaacctgaagcgcaaggcagccatggcgcagcgggtggggctggggtggtgaaggttgcatgctggtgtccgcgggtgtaggaggatgcctaggcactccctgcgtgggatgggaggccgtgtgcagtgccccatcatgcgcagaatgctgccgctttgccccagcactggacatcacatccactccaacatactcctttcgcctggcttcgcatcctgcagctccgcattactcctnnnnnnnnnntgtgtgcagtgcaccattttgcgcagaatgctgccgctttgccccagtactggacatcatgtccactccaacatactcctctcgcctgacttcgcatcctgcagctccgcattactcctggccggaaggggatgcaacagctcctgcacaagatccccacatggctggactttgccgacacagagaagctggaggtgaagcgggtggattggtggggcgagtctggctgtgtgtcgaggttgcaagaacgcctttggcacaataccaccctcccatgcatgacacggcaccaatgccaccctcaacctctgtgttgcagtggctgaacgacatcatcctcaagtcctggccctactacgatctggccatatcgacgatggtcaaggtgtgcctctgggctgtgtgcggtggggctggtgcctggccactgtttaggcggcatgtggtgtaacatgggcctctggctggcacgaccccatgaagtgacaggtgccctccttgatccctggccatgcagtcgcaagtggagcccttgatggcccagtacaagccatcgggcctgatcaagcgcatctacttccagaaactgacctttgggaatagtcctgtcaggtgtgtttcacgggggggagaccacgatcactcccgcctgtgctgctggcctcagcaccctgannnnnnnnnncgggagcagtcccgtcaggtgtgttccatgggggggaggccacgatcacttccgcctgtgctgctggcctcagcaccctgaggcgtgcatggcaagcccccagccacatggaaacgggtaccaagcttcccctggccgtcttgcaggctggaggggatccgagtagacaaagacgatccctcggaagttgcagtggaggtgcgatcctggcggtgtgcagtggcagggctgcactgttccattgaatggtatcgaggtgacacacatgcaccattctgggtgtccatgcacggaacggtactcaccacccaattcacccctcgctcatccaaggtcgacttccgctggtctggggacgccaacatcgtcatgggcatcgacctgccggtgggcgggaccttgacccgcctggcgcccaaggtctccgacctggcggtcagcgggacggcgcgagtggtgcttcgccccctgctggacaccatccccgggtttggggccgccctggtctccctgcgcaagcccnnnnnnnnnncgtggtgctccgcccgctgctggacaccatccccgggttcggggccgccctggtctccctgcgcaagccccccatcgtcaggtgggctgccttcaggaggggccgattgtgtgggcagggaactttgttgggcgtcgaaacttgcagctttggtgcaagcgactagctggccctggagagaacctgccagccagggtttagacctgtcgcaatagtacactgcggctcgactgccctgagcgccgtgctccccctgacgctccctcctctcctgtatggcaccacctcccccacctaagattccacctggactttggcaaggcgtttggcggcgcagcctccgcgggcgctatccggctgtggctggacgactttctcaggacgcagatcgcggaaatgctgctctggccgtcgcggatcgtcattcccctgctggacgagtccgtgacggggccgctggacgacctgtacctcaggtgggtggtggagctgtgcgggaggaccagcttcctgcgggggaaggttgcgaacaatgggagtgggaacatgtccaccgctgctgaccatgtggtgggaccaggtatgctgcctgtaaccacagcgacggcgacaannnnnnnnnngacccaaacacccagcctctcattccctcctttcaccaggcacaagggtgtcctgcgcgnnnnnnnnnntgttgtgcgggaggaccagcttcctgcaggggatggttgcgaacggcgggagtgggtacatgtccactgctgctgaccatgtggtgggaccaggtgtgctgcctgtaaccacagcgacggcgacaaacctgcccagccctggggctgcgcaggtatctgcaccccaagggtccttgcacccatccaccctctcgcctctgccccgccccaagcacccagcctcccattccctactttcaccaggcacaagggtgtcctgcgcgtcgatgtcatcgaggcgcgagacctgcccaaggtcgatgcgataggctccgccgactccttcgtcaccgtctacaccaccgcgcatgttgtgagttggcgagggggggcagggaagaccgatcggggagggagggttgctgcatgtttgtctcctgcttggcccaagtagtgtctggtgttggggataccagccggcgagaggtccggagctttggacaagcaagcctttacgctgggggacccgtgtcggtcaaacttcaccaacatacaatcttgcgcgaaccctcagaaagagaagacctcggtcaagaagaactcgctgcacccaaagtnnnnnnnnnntgacgaaaggcatggcattgtccgtgtacgcaagccatgccatcatcacacaccaccagcatgatccccaatccacccctgcttgagcannnnnnnnnnagcccatgtagtatctggtgctggggataccagccggtgagaggtccggagctttggacgagcaagccctcacgccgggggactcgtgtgggtcaaacatcaccaacatacaatcttgcgcaaaccctcagaaagagaagaccacggtcaagaagaactcgctgcacccaaagtttggtgagaagctgtggctgatgtgccaggagcccgcctcacagttgctgtacatcgtcgtcaaggacatcgacctcgtgaacgtcaaggtgggggagggagtgggggcgatgtggttgctggtggtgccagctctggctagatgtccctgtgataagaggagttcctcgacgaaaggcatggcactgtccgtgtacgcaaaccatgccattatcacacaccaccaccatgatccccaatccacccctgcttgagcaacagagcctgctgcagctgaatgtgctgaagggcgcctccaacgtggtcaagaactcgacgctgcttggtcgggctgcgctgcccatcaaggagttcacccaggtggggttttgggagtgcggcaggcgggacttccctctccacgattgtgtttctggcacgtcagtatgcttacaagcgcctgacctgcctctgttgtccccttgaccaccaacagaggcctggagagccccacgagatgtgggtccccctgggcacgggagactttgcggctgcggcgggctgtgtgagtacactttcgagaggggaacggggaggaaggggtgtgctggtcagccgcagcccttgcacctgcgatggtgtgcctgtgcatgacgctgcgagacacctgggccgagtctcggtgtggggtttctgtaggtgactgctatgaagtctgactttggctcccagcctctcccgctcagatcactctcacatcccatcctccaacctccgcagggctctgggaggggcgaggtgcacctcaacatcaccttctggccctttgatcagctgaaggggcacaaatcttctgctcgaggcgccgtgattgtcaccctattcaggtggctgccgtggcctggcctggccctgagagcagggtttgagggtgtgtcaagaccagtgcaccaagttggcggatggatgtcgactggttggaggctgggtcaggccagagacacccatctgcaccaaggtagccgctcatcccctggtgcttacattcgttgcacatccagcaactgtgacccacacacctccccgtgcaggtgcaacaaccttgtacccatggaccgccccgtgaaccagtcggaccccatggtggtgttcaagctgaacaaagaaagcaagaagagcagcgtggtgtggaagaacctcaatccccgttggattggggagcactttgactggttccatgtgaggctggcctgggggtcttagtccatgccttggcgtcggttgggaggaagcatgttacttgcactgtcatcagtgcatgtggctgacctggctgcctgacgatcaatccgattcctactccaaccatcatcagactatttatgtatcagcccccccccccnnnnnnnnnnnnnnnnnnnnnnnnnnnnnnnnnnnnnnnnnnnnnnnnnnnnnnggtgcccatggactcggtgctggaagccacggtgtatgatttcgaccgctggtccggcaatgaggtggagggctcccttgagattgacatcacagaagagattgccagggtgcggcggcgagtggtaatggtgttgtttctggggtgctgaagatggctgtccttcaagtactatggtagagatctcaaactgtatttctggagggtatcagatgcacggggagttccacatgctcccacccctgcacattcaggctcccaagggcgatgtcacaaagacctgggagctggaggatgttcccacggattgggtcgatccctcgggtgggtggaggaggggagtggctgcaggggaagcgtgtgtggggggattggaaggtcattgccacatcagtcagccagcattatagcaatctagaaagtttgcctctctcgaggccatccaggagccggcacttgcagctggccatttatgcactggcatgtgggattgataggtgttcggacatggcgatttctcctgccccaagccacagaactcattgctgcatgctcttcccgctgcaggcaagaaggagaagtcaaccatcaccctacgcatccagtggataccctaccaggagctgagcagataaacacagagtatctcgctctatgggttgctggactgacctggttgataccaagcaatgaagtcagcgtatcatgctctttttgccccatgtacctctaccccggagcactcctgacaccccaagttattgttacagtgagcacaagtgcgcaaagcgtttcatatatttctcgtcagcatggggcatgtcatagaagggtgcaatgcctcttgttgagtcgtttcggccccctacactcatgccatgttgtgacatggcagatcaagcaccatcggtacatcaggtgagcttactgcgtccagctgggatgcggggaggtgccagcagcggcattcagagttcgaagacgaggttgtagtgatcaatgtgcaccgtcagcgcctggcctgattcagcctgcagaccgtacggctgctcaaaggcgttgtccccatccaggctctgcagcgtcgttagggatggcagcttcacattggtgtaggcctgcggggtgtgaggaagtttggggggggtgaatgtatggctctcaaaccacccatgctcagaattctggcaatttcgctggatgctatcaccacctggcatgccctcccaggcgctctcgagtgtgatcccttcccaggcaatggaatgcactcagaccttgcataggtctcacgtcgcaccagccccccttccctccagcccttgcggccccagactcgtggccctctggcgccacccctcacctccacggcagcccgcgggccccgaacccccgccagcttcatgggcacgggtattctnnnnnnnnnnttggcgccgcccctcacctccacggcagcccgcggggcccgaagccccgccagcttcatgggcacgggtattctctgtttccaggacaggccgccagccccgccgaacacgacgtcgtcgttgctggcgctcccgcccagttgcaggtgggcccccaggaaagggcgaaactgctcccgcaccgactgccgcaggctggtgcccacatgctgcacacccgcgttggcggacaggtacaggccgtttgggaggccgatgcgcttcctgacatgggtggggcaggggaatgcagtgacgggggcagaggggcgtctcgtgtaagggctcggtcaaagggccctcccagcggctctcccaacatggcatcacacctgtactccaacgccttggccggaatgttgacgctgaactggccgttgaaaatggtgtcctgcagatgtgggaggtgcatttctcatcatgtccatgctgtgaatggcacaaggcccctcctggcgggggcggtaccaaacccccatacacaaccatgccgctcagaaacaaaccaccnnnnnnnnnngacttctcatcatgggcatgctgtgaatggcacaaggcccctactggcggaggcggtaccaaccccccatgcacaaccatgccgctcagaaacaaaccaccactgcttgcacgtgtctcaccttgcatgaaaaaccatagatgaaccgaccatcggggagggtgaggtctgccttggctctcatcctgacggcagggggagtgcgcatgattggttgacacacccccctccagggctcactcaccgagccccgccttctgcccagccatcagtcccacccacctgatcaggtccaggagcaccacgtccttgcggattcccacgcgcgatggcagcaaggcgtcgcgggccagggtcaggcggatggggaacaagttctgtatgttgaaatcgatcagcgtgaagggcgggggcttgttcggcccaaaccatgaccgggcagacccgaacacgccatgagtgccctgaggagcggagtcggtcctgggcatgactataagattcgaaatgagcacgtgcagtcgcagtgcaggcctctcaaatgcatcccctggtgggtgtatagttgtgaagccctaacgtgaatccttgcagggcgcgagtatcaaggtagccagcttctgtgcaattgcaatcttggcccatcaacctgtcgatttctggtttgtgaagctgtcctccttttgatacatccatatttggtaaaatagcacagaggagaatataagagacaacgcagtcgactcgaggcagcccgcgttattttcgtcgacctccttgctgtgtgccatcctctacccgcccctcttcctgtccagcagtcgattgtcatgtcatcacaccacccaccgcgtaaagtaattgtcagcagggaacgggtcgtcgcccctcccgatcgcttcatcgccatcgatgacaagacactggttcatgcactcggaggtgagccccatggtgttcatggcacgctctgcatggcgaggcctgccacctcgacgagcttattaccttaaaaccgtgcagaggtggtcgggagctccggggccggtggcatgtcgtccctgcaggagctcatgtctggcatcgtctctcatgagctgtccaagctgcgcaggtaggtcgcgacttcggtcatccgtgggaaaagccctggcacacctgtgcaggaagcaaattccgccttgggttggaatgcgcccctccttgtcttttgaacagcgggtgattgaatttgaacaatatatctcccatgtaggcgcatcgaccatggcctgcagaggtttggctccacaggacgtaatgttggcggtgccgacctcaagtcaagtacgtgtgtggagggactgcgagcaggtctgagctttgcgatgggagcttttaccttttgttgtcttgattggtgacagtgggactgtagaagggcagccatgacgcactcctgctcacacagactccaagcctgcatggattacctatcgttaccacactcccatgccgctgaccaacacaatgccccacaaaccccagaaacggaagcgcagctcaactctctggagcagggcaccctggaggatgtggttggtctgctgcagtcctgccagtaccgcctgctggatcgctcggagtgggaggctgccaagagcgaggacttcctggtgggtgatcttggtgatgttcgttggtgatgttggtgatggttgaggatgaaggttgatgaaggattcaaaccgctgtgtggaggaaatggtgcatgggattgtgcagagcatggtattatgaagccacctatgacatcgtggccttggaagaagggaggactggttactgacactcagactattctcccccgctcctgcacacacgtatgggctccaacttagttcacaaacacactctcacttcaccattcccatccagctcacgctgccggtgatcatcaactgggcggcgatggacacccagctgctgcgctgctactggcaggcccatccgcaggcgcgggcggaggtgccggatgacctggcagaccacgtgctcatctttcaccggggcgttcaggtggcgcgcatgcagggcctgtactatgacctcaagatcgatgcgctgctgtccttctacatcctgcaacccctgtgggccctcctcgtcctcgtcgctggctgggtgaggtcgagcggtgtgggtgaggattgcaagaggcagagcaagcgggggtgtcggggcgtgatgagtggatcacctgcgtgtaaaggccactggctgccccgtgctggcccttgcttctgatttggttcgtctccaccctgtgacagctggggctgtccaagcacctcggcgaggccccgccaggcatggagcagatgccggcagacatcacccccacctcggccgcgtcggcggacgccgcagaggcctccctgaagcaggggcagctgcacccaaacaccatttcggtggaacgcaagacatttgccaggtggggcccagtgaatggctgagcgtcgtgctcttgctgttgatcacagctgaagcattctgtgctgatccctgctgatcccatgacccccacctcccccacctgcacctgcagggtgttcaaggaccccaagaccatctggcagggcctgttcaagaaggtgcggctgcaggaggcctgcttcaaggatgtggtggtgctctacaggaaggcccaccctgggccggcccccagcgagctggacatcatcaatgacgaggagaccgtgagcagagcatgcggattggatggtttggtgtgagtgggattgcatgaggtttgaagacttggctggacttcagcctacttgaagcnnnnnnnnnntgcgtcgtgcttttgctgttgatcacaactgaaggattctgtgctgatccctgctgatcccacaacccccacctcctccacccgcacctgcagggtgttcaaggaccccaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgagcagagcatgcggattcgatggtgtggtgtgagtgggattgcatgaggtttgatgacttggctggacttcagcctacttgaagccatctctgatgcagcatacaacggcagagcttcatcgcactctcctgaactatatgacatcatcttgctcggccacaagatcgtgttctgactctaccgcccttctaaaccctatgccannnnnnnnnnttctcctgaactatatgacatcatctcactcggccacaagattgtgttccgactctaccgcccttctaaaccctatgccaggacctggagcgcaacatcgtgatcaggcacttttcccagattcccttggctgatctggagatggtcatcccagacaagaccgtattcgttccacccatggtctttgtacaggtggggcaggcacagggatgggaaagctatgctggagaggggggagctgtactggccaaccattggaaggccaatgggatgagccctctctccatcgtatccttgagttcgtaaggagctgtactcgggagggcatagtctcgccccaccgccggcttgcttttgtattttatatgctggaacaacatccattaccacctatgccaccgttcgatctgctaccaatcacgttaatcctcatcgcacccttcnnnnnnnnnntgggagggcatagtctcgacccaccgccggcttgctattgtattctaatgctggaacaacatccattgccacctatgccaccgttcgatctgctgccaatcacgttaatcctcatcgcacccttcccgcagctcatggtcactgccatcactggtctcgtcactgcactctccatgctggctggatcggtgagaaagggaagtttgtgccctggggagggtatgcagggaatgccatgcaagtgagggccaaaggaaatccatggtttgcaaccccaccatttcaagtccatgctccctggcacttatttctcacctatcccctcctccttctcaggataagctcaccggggcagtggcctactcagctctcgctctgctagcctctcgtnnnnnnnnnncgttttgcaaccccattcatttcacgtccatgctccctggcactcatttctcacctatccccttttctccttctcaggataagctcactggggcagtggcgtactcagctctcgctctgctagcctctcgtgcatatcagatgtacagtgccgctctgttcaggaagactgccatagagaggcagatacaaaaggtatggataaggacctcaagtttacgcactcgagatccaaacgtggggctgcatgctgatcggcagctgcacatggctggctgtctcaacttgacggatgcttgatccgggctacattcaatttttgcagatcctgtttgagaggagcaccnnnnnnnnnnagcacacggctggctgtctctgcttgatggatacttgatccgggctacattcattttttgcagatcctgtttgagaggagcaccnnnnnnnnnntgtgggattgctggtgataaggcggggggagaatgtcaatgaggtcttcgatacggagctcaagcgttttggactgtctgacctgacctggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgcaccttgctgctacactacggcacagagagtgaccggcactcacccatactccccttgcccctccccnnnnnnnnnngcagctcaggagaaggtggttgccgctctggtagatgagatgaacaagtgagcgtgggattgttggtgataaggcgggaggagaaagtcaatgaggtcatcgatacggagctcgagcgttttggactgtctgacctgacctggtcatcgtcacctgtcccaatggtgcacctgttttggtatgcccactcctcattccgttgttcatcctgccaggcaacacacgcgggagctcctgatctgctactgcgtcttgctggagagcagcaagctcatgacaggtgctcctgaatatgtaatcaatcaaagcctgtgttcatgagttgcgtgcaccttgctgctacactacggcacattgcatgccagagtgtgaccgacactcacccatactccccttgcccctcccctctccagccgatgagctggatagtcaatgtgagcagtacttgagcagggagtttgggctcaaggtggacttcacatgcgagagcgccctgccaaccctgttggaggtgggtagaaggtggaggggtgatcgagatcaggggcatttctcattagtggttgagtcttgattgggacatgaatctcgagtggtaactgagggctggaccacaatcgccatgcctcctaaaannnnnnnnnntgtggaggggtgatcgagatcaggggcagttctcataagtggttgagtctggattgggatatgaatctcgagtggtaactgagtgctggaccacaatcgccatgcctcctaaaacacctgtacatcctcttctgcattcggcagtggggtatcattacggagggcagcaccaacggagccctccaggctgtgcccctcagccaggccctgcactcgctggatgccgtctgggatggcctctttgagttcaaggtgtggaggcaaggaggcaaggaggctggtgtaatttttgcatctcagaaatgcggacccccctgtgtgatggaagtcttgcttggaatcacgacgcacaccaccctccgctacatgcctggcagatgtgcccgcaccgaatgctccatcagtcatgattcacaaagcttgcccgtttcccccagggtggcaaggtggagaatcaggctgcgggcttggtgggcttgtcagcgcgcctcatcggccagcagaccgggggagctagtgctgggcctggcgcagatgctgagcaggccactgaaaagcagggcgctgaggggtcgggtgagacccggcaccctgttgctgtgaagcaacatccaaaagccatctttcccacacccccgcacccggcggtggagctgagcaccaccgcgtcctcctcctcacctgcgcaaggatcggcccggaagggcggcctcctccatcgcatcggcaggaagctgactggctgatgtgtgagggcactgtatccgccggcaaggccacgtttgtgctgcttgaggcgctgtttatcacctttcaaatggtcgaggtatgtgtatgtggatggcaagatgcaatgacaacaacggaagctgnnnnnnnnnnnnnnnnnnnnnnnnnnnnnnnnnnnnnnnnnnnnnnnnnnnnnnnnnnnnnnnnnnnnnnncacgtgttcagcagggccccaaattcaagtcggatctcgcgccttgcccacaatgtcacacccaaaccacctccatcacagcattgcgcaccttcagctcgatcctaccagcttacatctcacaccatggcccacctcgtgctgcgcctcgtcctggtgggcctcctcgtgaccaccgcctcgtgttggcgccaggatcgcaaaccgacgctacgaaggcatctgctcgctccattgacggtgaatggggcccgatgaccatgtaatgctgccccagatgcgtgaatgggtccgaggccgcgtctcctgtccagattcttatggcaccgcgacgttgttgacaccccggggcaagccgccatcacggccctcacaccgcctcgtgacggcccctccccctcttcgggtctcgatgcctcaggagctgacctcggtgtcctgcccctgcaccaccgatggccagagcaacggcgtggacacgggccgggtggggtgcgggcagtggctgggctcccagggcagcgccgagttcgtgtgctacatcgcctcctccagcctctgcctgggcgcggacccccggcagtccacgctcttcgtcggcgccgcgctgcgcgcctgcgatgtcgccacggccagcctgccgtcactggccggcctgctggcggggacgccgcaggccctgctcttcgtccaggcgttgcgtgcggcggacatcgccagcttcccgggctcccagatcacggtgtttgcgcccaccaacgccgccatggccacctacgtcccagccgccgacctgaccgacggtccagccatgcgcgtgctggtcctgcagtccctggcctcgggggcgctcggccgtagcgagctgctggaggcggggcaggtgcgaatggccagcggggacaccttccccgtgacccaggttgcggggccagatggtgaggcgccgggaactggcttgggccagagtggctggatgtggaaggctggcatcgggtgtcacgggagtgggcaagccttttatgtggccttatcataatcataaaaggggcacttcaggagggcaagattcccgggnnnnnnnnnncactggcttgggccagggtggctggatgtggaaggctggcattaggtgtcacgggaatgggcaagccttttatttgttcttatcgtaagcatgaatggggcacttcaggagggcaagattcccgggcgtctcccgattcaccccaaaacctcacctgcaggcaacagcacgctggaagttgggggtggggaggtggtgctggcagacttgtacgcatcagacggggtgctgcacctggtggcggcgccgctgagcacggcccccgtgctgccccccagtcccgcgattggggccggcgagggccccgccccggcccccctgccggagannnnnnnnnntcccccagccccgccactggggccggcaagggccccgccccggcccccctgccggagacgaccccgctctccgacctcgggcctcagcccgaggccgagacgtccagtctcggcccgctggccgagggtgtgaccgacagactgccaggccagcaggttgggtctggcgtcgtgccggccatacagtctggcaaccaggacaccgagccacccgagccggagcccgccgcgcccggggcannnnnnnnnntgagggtgtgaccggcagcctgccaggccagcaggttgggtctggcggcgtgccggccatgcagtctggcaccccggacaccgagccgcccgagccggagcccgccgcgcccggggcaggagcaaacgccggcgcggcggcgggggcagggcccgtggcgccgggccctcccgagcccgagcctgaggatgannnnnnnnnngcgccggcgctatggcgggggcagggcccgtggtgctgggccctcccgagcccgagcctgaggatgagggggcgccaggggaggggcaggccctcgtgtaccccaccctgctgccccagggcccgaggcctgcgccagaggcagaggccgactcggcggccgctggtgctgacctggcgatggatgcccctggcctgccgccgctaggggaacctgggctggagccatttgaacccatcctcaccgagcagccagccgccgcgctcatagcaccattgccccggagttcagagccacagagcgagccggctgtccccactccctcgctggagccagcggctgagggggcctcgagcgccacactggtggtcctcccgccagttgttacaagccggattgcaggacctgatgcagagccagtctccgagcctactcccgaacctgtctcagagcctgtctcagagcaagccccggagccagttcctgaaccctctccagagcctgtctcagagccacccttggagccagttcctgagccctctccagagcctgtctcggagccacccttggagccagttcctgagccctctccagagcctgtctcagagccacccttggagccagttcctgagccttctccagagcctcttcccacgcctgtcctggagccagtcccagagctggtccctgcatcaacacagcctctcctggcgcctgttttgaacccaacccctcagccagccttggaaccgggctctcagccaagctccgcacctgccccagagctggctccgctgcgccctcaggaagcagtttcacctgcagtcgcacctattgctgagatgaccccgagctcaccgagccaagaacctaatccgttcctgcctccctctgctgatgcctccagggagacacctgcgcccagtcccaaacgggtcacatcacccccaccgggccccattccgccagcggaagtcgagattccgaccccagaggaggtgcccgccccaccaagccctcctgttgtctttggcggatccaggtgaggctgtgcactttgacgcatgactcctgatcgctctggggtatggggaggccccctagtgcctgcaaggccgtcccgcccgctcagcttcttcctagccaacccccttcacctcaagcaccgttctatctgcagtgtcctcccgacggacgtgggctgccccgagtgccagccggacccagatacatacgccccgctccctgtcacccaagtgagcgccaacgcgctgctggccaccaactgggctggtgaggcggggcctgggtgctggcagcagggatggtttgggggtcgtgggtgcgctgccatgccaaaaggcgaggagtgtggattcttcctctttgctggatctggcgtccttccctgctttgtcgccgggagggagtacaccacacctgggtgtgtccgccaccagttcagccccctcagctcctaggcagcgcaccgcctggcnnnnnnnnnnatccttgcctgcttcgtcgccgggagggcgtataccacaactgggtgtgttcgccaccagttcagcctcctcagctcctaggcagcgcaccgcctggccattcctgcgctcaaccctgccgcggtcccctcctccggcgtaaggatcactctagttctgccccttccccgctttccactctcaccagaccaatgccaggtgctggccaacgtggagctccgcgcgccggtggtggcgaccagcacgtccgacgagatcgcggggtgctgcgccgcctgccaggccctggcgcagtgcgctgtgttcacctactgcccaagcgtgtcggggtgaggaaagcggggcgagatgttcggattgtgcaggaagcagggccaggaggatgccaggggttttgaggatgacctccatgctgaggggcagcagggtgtgatgggtccagcaatatcaagtcaggaccagaaagacatgcagctgggctgagcgaggggaggggccggcatgcacgggcgtgtacttcttgaagctcattgtttgaaaccctttaccacactggacacgagctcatgcgaccctatcctggcccccaggtgcaccagcaatggccaggannnnnnnnnngcattgtttgaaacccttaaccacactggacacgagctcaagcaaccctatcccggcccccaggtgcaccagcaatggccaggactatccccaccggctgtgcatcctgaagggcatccagtacgatgtgaatggactgtccatctggcagtcaggcagcagtgtgtcatgggtatctggacgtgttcagggcaggggctgagcctgtccggcaccgccctggaataaacccctttgccccttgactcatgcacgacacatccagacttggagcggatcagcatatacagtgccatggcctgatactgctccctttgacccacactatgaggctgaattgcactttcatccatctcaaggaacccggtctgcttggttacctgcacgttcgcagatgcaacagaccaccgggaggaaagcgtgacgcccaatcacgcgtcgaaaaatgatgcatcccagaccacctttgtcagcnnnnnnnnnntacactatgaggctgaattgcactttcttccatctcaaggaacccggtctgcttggttgcctgcacgttcgcagatgcgacataccaccatcaccgggaggaaagcatgacgcaacgcgccctcccaaacacgtcgaatgatgcatcccagaccacctttgtcagca

SEQ ID NO: 48065 - DNA, 68 bp, Chlorella protothecoides
aaactggctgtgatcttcgcatgtgatgatagaagtttgagcgaccagggacaggtgtgcaagatttg

SEQ ID NO: 48066 - DNA, 64 bp, Chlorella protothecoides
gccgcagccggccacggccacagacacgccagcgtccatgcagatctggcagccctcgacggcg

SEQ ID NO: 48067 - DNA, 758 bp, Chlorella protothecoides
  modified_base (364)..(373): a, c, t, g, unknown or other
ggggtggaggggggggcctgtatgaagggggtttggagagggagcaggatcgcgtgggaggcagttgcaggcacaggcgcgatcctgatgcaggagagcagtatggcgtcgcctgccaccggtcatgcacccgctgcaatgcatttccggcggggttgggcacccatgcacatgcccgagatgccacgctgtccgtcgagagtctggccccgacgccatgcccacgaccccgcaaccaccccctgccaaccctgtgcagggtcgcccggtcgcggtcccacgccgggcatgcggtaccacatcgacaccccggggtcggggcacctggcccccacgccggggtcatacctgcccacgccgggcnnnnnnnnnngtgcacccgctgcaatgcatttcgggtcgggttgggcacccatgcacatgcccgagatgccacgctgtccatcgagagtctggcctcgacgccatgcccacgacaccgcaaccaccccacgccaaccctgcacagggtcgcccggtcgcggtcccacgccgggcatgcggtaccacatcgacacccccgggtcggggcacctggccccaacgccggggtcatacctgcccacgccgggcatggcgcccagccccttctcgcccgccccggccctcaccccgggcctggcggccacgcccgggctgagctacgaggcggtgccggcggccgactacggcgccgcgccgcgcgccctcggcggcgccgccgtcgccgccgagggcgc

SEQ ID NO: 48068 - DNA, 61 bp, Chlorella protothecoides
aggcagggaaaggggctcggtgatggctcctatgtgtaaacgtctctgtgagcttcctgag

SEQ ID NO: 48069 - DNA, 9814 bp, Chlorella protothecoides
  modified_base (710)..(719): a, c, t, g, unknown or other
  modified_base (957)..(966): a, c, t, g, unknown or other
  modified_base (1512)..(1521): a, c, t, g, unknown or other
  modified_base (2394)..(2403): a, c, t, g, unknown or other
  modified_base (2916)..(2925): a, c, t, g, unknown or other
  modified_base (2980)..(2989): a, c, t, g, unknown or other
  modified_base (3084)..(3093): a, c, t, g, unknown or other
  modified_base (3578)..(3587): a, c, t, g, unknown or other
  modified_base (4056)..(4065): a, c, t, g, unknown or other
  modified_base (4356)..(4365): a, c, t, g, unknown or other
  modified_base (4509)..(4561): a, c, t, g, unknown or other
  modified_base (4946)..(4955): a, c, t, g, unknown or other
  modified_base (6703)..(6712): a, c, t, g, unknown or other
  modified_base (7004)..(7144): a, c, t, g, unknown or other
  modified_base (7223)..(7232): a, c, t, g, unknown or other
  modified_base (7310)..(7319): a, c, t, g, unknown or other
  modified_base (7510)..(7542): a, c, t, g, unknown or other
  modified_base (7931)..(7940): a, c, t, g, unknown or other
cgggcgggcgggggccccgcccgcgcggccccgaggccgaggaggccggtgcgggcggcgcgctcacggccgctgcgctggcctcggccgcaccggaggagcagaagcagctgttgggcgagggcctgttcccgctggtcgcgcgcctgcagcccgacctggcgggcaagatcacgggcatgctgctggagatggacaactccgagctggtgctgctgctggagaacgccgaggcgctggccgacaaggtggacgaggccgtggccgtgctgcgccagcacaacgccatccccgagggcgccgaggtgcgcgagcgcgagcccgtcgccgcctgaggaccggcgccggcatgcccatcggggcgggcggcggcgatggaggtgcaggcggtgggggatgctgtgggggagggggggtaacagccccccgccccggcaaccggccctggacctgccccgaggccggcatggcagtgcgccacgccggccccgtaacgccctgttgaggccaaaggcatgcttgcgacccaaaccggggcccacacggggcacccgagacacgctactgtgtgagaatgtgatcgagggaaggttttggcgatcaggagggttgagagaggggggggggtggggccctgagagattcagagtggaaaggggggtgcagggaaaggaacaatcatcagaaggagaaacttgggcaaagtgggnnnnnnnnnnttgaggccctgagagattcagagtggaaaggagaggggggagggttgcagggaaaggaacaaccatcagaaggagaaacttgggcaaagtgggggtctctgcggcctgcaggaaagtgcccggtctcgtagtcctggctgtgcggcaaaagcccagcgacaagccttcggtatgccagtagatctggtcggcacccgcgatgggtgtcccggcactgcacctgctgcccgcggctgcnnnnnnnnnnagtctggtagtcctggctgtgcggcaaaaacccagcgacgagccttcggtatgccagtagatctggttggcacccgcgataggtggcccggcactgcacctgctgcccgcggctgcacccattgggtaagatgccgcagcaaccagatggccaaaaactgaccctctgtgcagctgcagcggggtgccagcccgtgccttccccacccctcatcccaccaaccctgctgtccgtatgagttgagtgcagttgcttccgtagtacacacctgaatgcccccacaaaagcccagcatggccgagcagtctcaggtggtgccgggctgcggggcatccccttcctcctcgctctccccgcccgactcctctgtcccatactcgtcgctgtcgtactctccctcctggaatgaaaagaaagcggggcgggttgtcagacggggccaaggagcaccctcattgcaacggctcccctccgctcccgtacgggaacccctctgccccaccctcttaccaattggattccaccgcacgcatgcagatctggacnnnnnnnnnnactcatggcaacggctcccctccgctctcataagacaactcctctgccccaccctcttaccaatcggattccaccgcacgcatgcagatctggaccccctccaaatcccctccccccccccgccaatcagcacctcctcctcgcgctcagatccggactcggagccctcctcggcgtcagatgccccgacctgctcccagctgccctcgccgtcctcgcccgccgccacggcggcggcgaggcgttgggcgcggccctcgcgctcggcgcgcgtggcctccaccaccctgaccttgatgggcacggcccggtcgcagcccaggcaggagtccgggaggcaggccaaggtcaagacgtggcgccccgccttgagcggggcgcggaacgccgcgctcacctcctggtaccgcggcgcggcgccgtcctccgctgcgtcggcctcctccgccagggggtccacggccgcggggtccgtcccggcggccaccgcgcgcacgacggcgcgcgcgccggcggcctcggcggctaccagggacgcccggatcaggcacatggcggcgttggccgatgtgtcccccaggatgaagtaccaggcctcctccttggggaaggggtactgcggcgcgtacgcctgcagtggtgggggaagagacaggcattggctggtgagcgccctttcacaaggtgagtcagcgcttgcagaggccgaaccggggcacgagccggggtgccgttgaggcatggctcctcctgctcagcccttacttgcacgggaccctctctcattctcctccacgcccttcccagatcctcaggagcaccaactttggggggcccccttccccctctccgccaactgacgctcaccagggnnnnnnnnnnactaaggagcaccaactttggggccccccttcccctctccgccaactgacgctcaccagggaggacgccccgcgaatggtgtcggggtcaaagcctggcaccgcatgcgcggcacgggtcagcgccaggcgcaccctcagcgtcagcacctcgcccgccagcacgctggcgtcgccgtcggccgcctcgcccgcctcgtccgtcacctccgcgcggacccacagcgtgggcagcgccgccagcgcggtctccacgctttccacctggtcctccgactccaggccggcgtcgcgcagcgcggccgcccgctcctccggcgcgagggcccgcaggtctggcgtgggtgtggatggggggggggtgggcttgttgggttgaggatgagaaatagctagaggcatcgaaacgtttgcaaggtacaaattctgcaccacgatccagggagggagggtggagcaggaggaccctggcaggggaggagtcctcaaaataacgctccagcgccacccagcnnnnnnnnnnggatagctagaggaatcgaaacgcttgcaaggtacaaattctgcaccacgatccnnnnnnnnnngatggctactgctccacagttgccccaaaggccatccccatccagccgcctgcaagtgcactatgatacccgccctcacggcaaccacacctgcnnnnnnnnnnaatggctaccgctccacagttgtcccaaaggccatccccatcctgccgcctgcaagtgcactacgatacccgccctcacggcaaccacacctgccagggtcttgaccttcttcttcaccaggcgccgaaggacgtcggagtcgaagcccggcagctgcagcaggttggcggccccctcgccgccctttcctcccttccgagcctggatcgggacggcctggaccaagtgctgcatcatctccacggaccccagcgccggcgccagccagccgtacccgggctgcattgggaaagaggtggcaggcacctaggtgagtcgcagcgcatgggagttggcggccgtgtcgacgagatattctacaaggagaactgaaacaaagggagctgtgtctcgctccagccaccccaagcccggccgtcctgctgccgtgcaggaaaggtagctgtcaccgctcccaaagcatccagccgcgctccctccagcnnnnnnnnnntgagttattgtacaaagagaaccgaaacacagggagctgtgtctcgctccagccaccccaagcccggccggtcctgctgccgtgcagggaaggtagctgtaactgtccccaaagcatccagccgcgctccctccagccagtcaacgaacctggacccgcgggacgcaggcgatgccgacgagctccttgagcagggccgggcacttttgcaggatgaagttcgcgtcctttgtcagcgcggcagggatgggttcgcgcgagaggtgggcgaggaccagcagatgtgcctgggtcgaattgagtgggggggagataaatatcagctggtgggtatgggtgggattgcagcagggctgaggcgccagggtggggtagcaaatcagcacacggagacaccccaccaccaagaagctcccaacaaaacctctgtgagaacatcgtggcaccttgacgatgctggcgcgccgcnnnnnnnnnntggctgaggcgccagggtgaggtagcaaatcagcacacggggacaccccaccactaccaagctcccaacaaaacctctgtgagaacaccgtggcaccttgacgatgctggcgcgccgcttccagaactggctcttctccttcaggtcggggtgcaggaagagcacgcggcggcgcaggtcatccagcgctgcgttctggccctgatttaagtgccatgggaggcgagttgagggcgtggccggcatccaagggcggttccggtgcgcaggggtgaatgccacggtgcagtnnnnnnnnnnaaagtgccatggaggcgagttgagggcgtggttgtcatccaagggcggtcctggtgcgcaggggtgaatgccacggtgcagtcttggggttcgcaagtgtagccccaggtgccccatccccaccagcagcaaaccgcccactcnnnnnnnnnnnnnnnnnnnnnnnnnnnnnnnnnnnnnnnnnnnnnnnnnnnnntgaattccatggcgcacacgagcgtgtcgggaattcgggccagggcctgtgactccttgaccccgtaccgggggtcctgcgcatacagcatgatggtctcgtgcagcagctggttgggcccagtgtacctgacatgaaggggtggggtttcttggtgtttattcgagtcaagaagggtgtctgggtgggtgggtgggttgcacatgccagtgggaggtaaggaggcgctcacgccgcagtccacgcacgcactcacgccgcggcagaggggggttctcaaaggtggctggaggggcacccgctataccccgtccccgtgaacccccttttaaacactatgcaatgaacaccctttgtgccgtaaacccggcctcacttgttggannnnnnnnnnaaaggaggcgctcacgccgcaatccatgtatgcactcacgccgcggcagggggggggtcaaaggaggctggaggggcacccgctatgccccgtccccgtgaaccccctttgaaacactatgcaatgaacaccctgtgtgccgtaaacccggcctcacttgttggagcgggtgaggtaccaggcggccagtccgaggggaagcacgatcccgccaaacagcagcaccaggaggatgatgggggcagtgttcttgtcctgtgcaccaaagtcagggagcgtagggggggtggagctttactcagcgcttgcaggaaccgacggcaggctgccggcaagcacaccaactttcgctggatgcttctccacgctccacgcctttccctgcatccgacatcgcagtcctacacagcatgccgcccacatcagcacccgtgcacctttgagaagaaccactcaggcagagccacgctgcagaggggggagagggtcacttggcatcggcagagccgaccacctgcgacaggcaggccagcctttccctgcatgccatgcggtcccccactgagcaagtacacaccctccccctgcgcacctgacgctgtaggcctgaggaccatccggatggccatacttttggtagttctcacgagaagtctcgtcagtgagggcttggtatgcctgcaagggtgggcaggctgccatgggttgggttctctgcctgcgccgccgcggctctgcggtctgggcatggcctgccaggccctctccagatcgcccaccacgccaatctgtcgccatgtcaagatctcctgagcccatgcccagccctcccataccataccttggagatgtagttggcaaagtagtccgcggcggaagggtccgggttcttgtccggatggtacaggagggagagcctgcgatatgccttcttgatgtctgcgtcgccggcagtgatgggcagctccaggatctggaaggggtcgaactgctgcacagcattcgctcgggacgacgtatacctgcacaacataccgttgtcagagtagagaagctgagagccaagctcacagacgacaagattctctggatgttatgtttcagcgaatacactgccgctccagaaagacgcaccagaagagagcaaggtacacaacccactggatggccagagggttggtggctagcgacctaacacgctccccaagactctgtccggcctttttggtgctccaggactttgtgacctgggcgtagcgtgggtgtcggggtttggtagccgcccgtacccacaacccgaggcaggaccagccggtgaggacccgcactaccataccttgtcgtctggtccgctcccatacagcttgtacaaggtatatggaatcaggtataaggagtacagagacaggacgaagatcgcaaacatgggtgtagaccctgtgtgatcgcttccctcccccatactgccgagtcctcgtggaaacccgcctcttggcaattttgaaaggccacgacagtttgacactcagttcagcgaccagtacgctacaggcagggagtttggccaggaatctctaccgcggttcgcccctcgcgcgccaatgctgctgagctggatccggaaacgcgatactgattttgagcctagtgtctgacgaggagacaagatgcataatcacacttcagttgtcgaatacaatctgtatcttcagtagattgataggatctcgacggttctcccaggatcnnnnnnnnnnaagtctgatgaggagacaaaatgtataatcacacttaagctgtcgaatataatctgtatcttcagtagagtgataggatctcgacggttctcccaggatctcaccttattgccgcccatcaccacaacatggaccgtgctaacgccctccaacgggagcttcgagaagaggcagatgcctttcaagccatacagcaaggtgagcgggcaggtagtgcatcgaccagttaacctccactcggcacatgctgatgttgacccactcaccccttcgctgccaaccttgggcagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgctaagcattccccttgccgggcgcaccaccgaacccaccactgaccccatgttcctcaaacgtcttgcgaccccannnnnnnnnnatgctaagcattccccttgctgggcgcaccacgaaacctaccactgacccatgttcctcaaacgtcttgcgaccccannnnnnnnnntcagataacctcgattgggcacatgctgatgttgacccgctcaccccttcgctgccaaccttgggcagacgtcaataagaaccataacgccaggcagcagttcctccaacagcagaacgagaacgagatggtgtttaaggtgcgtccaaagagcgctgcgtcgccagctgcgaaggcaacaaacgtggacnnnnnnnnnnnnnnnnnnnnnnnnnnnnnnnnnggagctggagatatctggcgaggagggtgccgtgtacaagcttataggccctgcactggtgcgacaggacgctctggaggccagggccaatgtgaaaaagaggctggagttcattgcatccgagctggcccgcctggattcgcagctcaaggctctcgaggagaagcaaaccaggaaacatagccaggcaagcattgtctgggcgctgggaggggaatgggccatgatgcgctggtctggggcccctacagccggtcgtcatgtacattctggtgcccttggatggcaggtgcgtcccgtgtgtggcccaccatgccctccatcccttctccctgggtcccaacccctccggcagatgatcaagctgcagcaagaggcacagcggttgnnnnnnnnnnttcccgtgtgtggcccaccatgccctccatcacttctccctgggtcccaacccctccgacaggtcatcaagctgcagcaagaggcacagcggttgcagcagcaggctgtgcagacggcttagagtgtgcctagcggaggggcatcatcgaagcagcctctcctcgccatctggattgagctggctcccctgtattcaatcttcacctccgcctccactgtgctctctcgatttggagtgtggtcctgattgtacgcagcagggcatgacacagagcgatggattgacccttgcatcacccagaccaggagcaagcaatcaattcgccccgggccgcagcgattcatcgtcgtcccttgcccttcttcttgcctcccgcgggaggcttgggaggcggccccttgcttgcttccgcgggcgcggggactgcatggggaagggagggtctgggcgtcggaaatggaaagcactgcttgccagcattgtgggtgcccatgagacctcctctatggcgaatgcattcccccaattccaaaccccgcacccccacctgcggccctgtccagggtttcgtccacctttccggctccctgactgcccttgatggcattctagagtggcatgcgggtgaggggggcagtgggcgacgaatcaacaaactcacgctctgctcgacaggggtgtcagatgcagcgaccatgcccagccatctccttttcgtcagcacatccccacagggagtgatgaccatgtcctccaaccctgcactcattcgcggctgcccgctgctcgaccccagccgagcggctaccttgacgccgcaaccaaacagcctgcttgtcacgtctgacccaccccccccacaactcctcagcacgcaccttgtccctcctcttcttccgtcctttcctcgcctcggcgcgctgccacttgggcagccagcgctccggatccggcatgggcccgggatgctccgggtcgaacctgggcatgcgtggggagagggtggccgagtgctcagatgagccggcgcagaacatggtgcagctctgtgcactcccaaagcagagcgcggtgcctgcacgcatgatgcctcaggcctgtcggcgtgcgctccctcctctggcagcgcagaccttcttttatccccccctcttcctaccacccgctcgactcaccccttgggcaggcgcacacgcttcttgcgcgcgcgccgcttcctctccaccgccgcgccctcctcctcgtcggcggcgcccttgcgcggagcggcggcggcggccaggctcgcccctgccgcgctctcctcctcgccgggggccaggcggggcatcgcctgcgccaggcgccccaggtcggcgggcaggcgggaggggtcggccagggccaccgtccaggccacctgccgctgcgtcccggggtctaaggcgggggcagaggggcgacgtgggtgaggaccggggccggcgatgacggtcgtcgcgatgcccggaccccggcaggcacggcagtgggtgggtggtgcaggtcgcctcccttccaacaacggctcatgctgtgtctgccacctggaatccaagccctcagtgccgccgcctgtccacgggatggcccaataaatcatctcggagccccctaaccccgcacccccctttcttttccagcccactcacccgcccacagcgcagagtccagaccctccagcgccgcccagtgacccagcgccagctccggctcgccacgctcttgcgccgcgccggccaggcgggccaggacccaggccagcgaggccagcgcgccggggtcgcgggcaccaggcccctcggtccagtgcgagcgcgcggcctcaagcagcgcgccgccgccgccaccgcc

SEQ ID NO: 48070 - DNA, 61 bp, Chlorella protothecoides
tctggaaagggatcaggacctcagaacagattccctcctctcctcttcagacctaggggac

SEQ ID NO: 48071 - DNA, 79 bp, Chlorella protothecoides
cccctcccgccgccaacagcggcgcgctcaccgcgcggtacgagctgtgcggggtgctgacgcacaaggggcgcagcgc

SEQ ID NO: 48072 - DNA, 82 bp, Chlorella protothecoides
agcataaagggtgcgcccgtagtccgggcaattcctacattatcaagaatcaggccattacagtgtcatgtggagggtatct

SEQ ID NO: 48073 - DNA, 65 bp, Chlorella protothecoides
ggataacattgcaccactattacacccccccccttccctctcacctgggtgcagccggatggaga

SEQ ID NO: 48074 - DNA, 102 bp, Chlorella protothecoides
tgccatgcatcagcctggcagcagtgggtgaaacactatgtcccccccacacacacccaacctcccaaccacgctgcgcacgctgtgaccccgcagtgcccc

SEQ ID NO: 48075 - DNA, 125 bp, Chlorella protothecoides
ccacatgcagctccactttcgtggcgcttcccagtgcaatgtgaggcttctgctttgttcgttggggggaggagagagcgggggggttaggtgcgtcacccttgccgtcactgttcacacaaagc

SEQ ID NO: 48076 - DNA, 61 bp, Chlorella protothecoides
ctcgtagcgaccgccgtcgttctcgccgtcatagcgggtggtggcgctggagccgtaccgg

SEQ ID NO: 48077 - DNA, 80 bp, Chlorella protothecoides
tctgacgtcatcctggacatcaccttgctttgcaaatctggccatgtgtacagagtgggggcaggtaaagccggaggagg

SEQ ID NO: 48078 - DNA, 61 bp, Chlorella protothecoides
tccgctccacgtgggctacctgcatgaagtaccctgccagcatagccttccggatgttggt

SEQ ID NO: 48079 - DNA, 78 bp, Chlorella protothecoides
tgccaagtacttcttgccaagcaaatggttgcctctaccctgtacagaggtagtgccgcgccaggcccatggcaaggg

SEQ ID NO: 48080 - DNA, 106 bp, Chlorella protothecoides
gtctttgccaaatttggagggccagtgcgtgatatacatgccagggtgaggcacagctggtcaccaccgccagagcacatcttggtgacaaagcccgtggctgcca

SEQ ID NO: 48081 - DNA, 77 bp, Chlorella protothecoides
aagggccactagatgctgccaacccccccccaagccgcatgtaaccatgcacggcagggccaggggcatcagaaggg

SEQ ID NO: 48082 - DNA, 66 bp, Chlorella protothecoides
tcacccccacccatcaagacatcttcacccccacctatcaagacatcttcaccctgactcagtagg

SEQ ID NO: 48083 - DNA, 61 bp, Chlorella protothecoides
cgcctgttgcattcatgatcagaacgggacactcagtacccgctccttgcaccccactctg

SEQ ID NO: 48084 - DNA, 70 bp, Chlorella protothecoides
ggtagatagactctggtctggccctgatctctctcattttccggtccactatctcctggttccatctctg

SEQ ID NO: 48085 - DNA, 80 bp, Chlorella protothecoides
gagaacgtgaggtggcccccccctcgcccctcagcagcgcgaattgcgcggccatgaacctgccctgaggaatgatgctc

SEQ ID NO: 48086 - DNA, 50527 bp, Chlorella protothecoides
  modified_base (975)..(984): a, c, t, g, unknown or other
  modified_base (3450)..(3459): a, c, t, g, unknown or other
  modified_base (3706)..(3715): a, c, t, g, unknown or other
  modified_base (4937)..(4946): a, c, t, g, unknown or other
  modified_base (5708)..(5717): a, c, t, g, unknown or other
  modified_base (5892)..(5901): a, c, t, g, unknown or other
  modified_base (6424)..(6433): a, c, t, g, unknown or other
  modified_base (7052)..(7061): a, c, t, g, unknown or other
  modified_base (7824)..(7833): a, c, t, g, unknown or other
  modified_base (10006)..(10015): a, c, t, g, unknown or other
  modified_base (10403)..(10412): a, c, t, g, unknown or other
  modified_base (14507)..(14516): a, c, t, g, unknown or other
  modified_base (15923)..(15932): a, c, t, g, unknown or other
  modified_base (16154)..(16163): a, c, t, g, unknown or other
  modified_base (16456)..(16465): a, c, t, g, unknown or other
  modified_base (17186)..(17195): a, c, t, g, unknown or other
  modified_base (17692)..(17701): a, c, t, g, unknown or other
  modified_base (17916)..(18081): a, c, t, g, unknown or other
  modified_base (18149)..(18158): a, c, t, g, unknown or other
  modified_base (18229)..(18238): a, c, t, g, unknown or other
  modified_base (19187)..(19196): a, c, t, g, unknown or other
  modified_base (20225)..(20234): a, c, t, g, unknown or other
  modified_base (21063)..(21072): a, c, t, g, unknown or other
  modified_base (22038)..(22047): a, c, t, g, unknown or other
  modified_base (22715)..(22786): a, c, t, g, unknown or other
  modified_base (23150)..(23159): a, c, t, g, unknown or other
  modified_base (24058)..(24067): a, c, t, g, unknown or other
  modified_base (24403)..(24412): a, c, t, g, unknown or other
  modified_base (24999)..(25008): a, c, t, g, unknown or other
  modified_base (26269)..(26278): a, c, t, g, unknown or other
  modified_base (26494)..(26503): a, c, t, g, unknown or other
  modified_base (27351)..(27360): a, c, t, g, unknown or other
  modified_base (27596)..(27605): a, c, t, g, unknown or other
  modified_base (28385)..(28394): a, c, t, g, unknown or other
  modified_base (29190)..(29199): a, c, t, g, unknown or other
  modified_base (29652)..(29661): a, c, t, g, unknown or other
  modified_base (30537)..(30546): a, c, t, g, unknown or other
  modified_base (30950)..(30959): a, c, t, g, unknown or other
  modified_base (32466)..(32475): a, c, t, g, unknown or other
  modified_base (33568)..(33577): a, c, t, g, unknown or other
  modified_base (34290)..(34299): a, c, t, g, unknown or other
  modified_base (34788)..(34797): a, c, t, g, unknown or other
  modified_base (35345)..(35354): a, c, t, g, unknown or other
  modified_base (40533)..(40542): a, c, t, g, unknown or other
  modified_base (41014)..(41023): a, c, t, g, unknown or other
  modified_base (41443)..(41452): a, c, t, g, unknown or other
  modified_base (41940)..(41949): a, c, t, g, unknown or other
  modified_base (43014)..(43023): a, c, t, g, unknown or other
  modified_base (43428)..(43437): a, c, t, g, unknown or other
  modified_base (43630)..(43639): a, c, t, g, unknown or other
  modified_base (44127)..(44136): a, c, t, g, unknown or other
  modified_base (44428)..(44437): a, c, t, g, unknown or other
  modified_base (44877)..(44886): a, c, t, g, unknown or other
  modified_base (45879)..(45888): a, c, t, g, unknown or other
  modified_base (46082)..(46141): a, c, t, g, unknown or other
  modified_base (46407)..(46416): a, c, t, g, unknown or other
  modified_base (46485)..(46494): a, c, t, g, unknown or other
  modified_base (47388)..(47397): a, c, t, g, unknown or other
  modified_base (48038)..(48047): a, c, t, g, unknown or other
  modified_base (49971)..(49980): a, c, t, g, unknown or other
accccctcccccggtgccgcctcctccttcccatgcgccaccccccctcgcgccgcctccaaccatgccggccgacctgccccgcccgcctccccccgccccaccaaaaattcccgcggggatggcgccccccatccccgcagcccacccgagctactctgcggagccgtacaccgcgcccaagggcatggccccccccctggcagcgccacccagggcggcgccctccttctacggcgccgcggccgcggccgggatgccggcagtggaggtcccgggcgagaccaagaaggagaagccggccctgctgcgcgaggcggcaggcaagaggtgggtggacacgaccctgctggaatggcccgagaacgacttcaggatatttgtcggcaacctcgggaacgaggtgcgttggcgtggtgggtggagggaggcgcggcgctgcagagcctggctgcttggctggaccagggcatgcaggactgtgcatgagaactccacacccgggcggcgtgaaaggtatggggacccttgatcggggcctgttcggccacgacgcggctgagccattctttcataatccctctgcgcatgttggaccgcagaaccatcacccccgcccacctgtgacccctgcctccaggtgaacgacacggtcctgatggctgccttccagaactacacgtccttcaacaaggctaaagtcgcgcggaatggatacaacaaaaagtccaaggggtacggcttcgtcagcttccaggaccccattgagggtgcgcgcgtgctcaaggagatgcagggggcctacataggtaagcgggcggtgatccagggcgggggtttaagcgtgggtgtttgaggacgtgacagccttgcggacaggtggagtgcatgggctgtggggtgcatcgagcagggcagcacgtgttgcctcctgcgcatggtggatgcctggcacgggggaggctctctgccttnnnnnnnnnngagcgggcggtgatccagggtgggggtttaagcgcgggtgttcaaggaggtggcagccttgcgcacaggtggagtgcatgggccgttggatgcatcgagcagggcagcacgtgttcccccctgcgcatggtgcatgcctggcacgggggaggctctctgccttgtggtgcaggctccacaacatggcccctccgctcacacccgccgccgcacaacccccccaggcaaccggccggtgcaactgaagaagagcacgtgggatgaccgccaggtaaaggacaagacgggcaagcccatcaagcggctggtggaggagaaggccaagaagccggacaagagggcacgggcaggggcctcgtttgaggctggggtggggcccccggtgcagcaagcattctacacccggcggtagtccacggcctgcagcgagggctaaccttgagcgccagcccggcagggtgtgcttctccttatactctggctttccacgtatctgggaacaaatacctaactacagaacagcccagacaccagatgatggctgggctctggacagtgcattttatcggggagaggaagggcacgatggtggacaggccaataggtgcagcccttgccactgtgcggggcagtgctggacaggggggaaaccaagatgaaacagagctgcgcgcagccccgctggtcagacggaactgtcactggtcatgacgatgccggcgtggagcaggccgaagcaggtggccccgaagaagagggcgtgctgggtcttgggcgcaaccctccccttcagcacgtgccgcatggtgtacatgatgggagcccacacgatggggctcagcattgcgtagtttggggtcctcctccgatgctctgcggccaggggcttgacgttgaagagctcgtcctccgccacccccatgcctgctctatgtagaccgtgtgccaaaggcgactgccaacgggatcgtgctgcccaatgtaaatccgtttgtgacaggaattggagtgtattgtcgttggtctaaaggagcatcttcgatttcgctgactacactagtaacaccacgtgcgacgagggcgcgccctgggcgacgagcacgactttcggcaagatctgatacaccgcgtgctcgaccattaagcagggcacatggcagacccctgcgaatgtaacttttactatagcaactcataagaagctgtcctcaatcgtgcgggcatccggacccttgcgttccaagaccatgtcggcacagaccctcacctgcggggtgcgccccgccccccggtgcaacggtcgcaggcaggcaccgcgtgcctcgccccgcgccttccgctgccatgccgctgcagctcccgcggtgggtacgagcctgcgtgatcggcaggctagggcttttgccccatggtgtgctcaggggagcaggcgcaccccgatctgtcgccctcctacctacagccgaccgtcgaccctggcgcaggtatcccctgccccttcctcctccaaggccacggagcaggtccgcgtggccgtgctgggcgccagtgggtacaccggggaggaggtggtccggctgctgtcccagcacccccacttcaccatcaccgccatgacggggaaccgtgaggccggcaaggtgggcgtgcggcgtgtggaggggtatcaggggaacacaggatggccgacgggaggcctgcgcagctgtcactgtcccggggggggctcttgtttggctgcgctgggcccgcctttcctgtggcctgtgctgccccagtgcaccccttcccccttcccaccccccacacaggagttcagtgaggtgttcccccatctgcgcaccgcgcccgccgtcccgcgcctgaccaagatcgaggacgtggcgtgggagggcgtggacgcggtcttctgctgcctgcctcacggcacgacacaggaggtggtggcgggcctgcctcgccacgtcaaggtggtggacctgtcggccgacttccgcttgcgcgaccctgccctctacgccgagtggtacggcggcgagcaccgcgcggtggcgctgcagggcgaggtggcctatggcctgaccgagctgcaccgggaggcggtgcgcagcgcgcgcgtcgtggccaacccaggctgctacccgacctccgtgcagctgccgctggtgccgctgctggacgcggggctcatcctgcccagggacatcatcatcgacgccaagtcgggcgtgagcggcgcggggcgcagcgccaaggtcaacctgctctataccgaggccacggagggcatgaacgcctatggcgtcggcaagcaccgccacatgcccgagattgagcaggtggggggaggtggagggggagggtgcagagcagggggtgtgaaggcaagtacctctcaaaagggccgtgtcagccaaagcctcatgggtgcaatcttcaagggccaggatgttggagacatctcgnnnnnnnnnntgtgtcagccaaagactcgtgggtgcaatgttcaagggccaggatgttggagacatctcggtaccaggatgcctagctgagcacagctgtgatgcacaatcgcgcgcgcatgcctgccggcatgcatggatggtgaccgcgcagttcggtcaacctgtctgcagaaagtatcgccccatgcagcccatcatccccgctccatttcccgactcccacccacctttccaaaggggctgactgacgcggnnnnnnnnnnaatcgcccacacagcccatgatccccgccccatttcccggtttccaccacctttccaaaggggctgactgacgcggcaggggagcaggtcacggtatccttcaccccccacctcatccccatgacacgcggcatggagagcgactgctacgtgcgcctcgccgacggcgtgtcggtggaggacctccgcgccgccctggaggtgaggggggagggggaagaagggcagggcaaaagagacgagtggctgccaatgcgtgctgtgcagtggctgccagccccaactcgtccttgcttaccatgagatgttggtgttctgagttcaactccagcgcatgtctgcaacccttgttgcaagtgtgctcacaagcagcagctcctgtggcggaggatggccgtcacatccctccccaacaaccagtgccacacctccccactgccacaccacaaccctaccctcccaaatcccggcgacgcagaccaagtacgccaacgagccgttcgtgcatgtgctgccggcgggcatcgtgccacagacgcatcacgtgcgggggaccaactacaaccacatccaggtgttcaaggacaggcagagcggccgcgccatcgtcatctcgggtgagggagaagtggtggcttctggggaggtgaggatgttcctctggcatggcaccttcagtttacatctcttgaaatcctttggacacctgttgcctgcggtggaggtgcgagatctggcaaatcccagtagtagggcatgtgtttggtgctgatgtgtccattctcccctcggccaacctcgcagtgatcgacaacctggtcaagggcgcgtcgggccaggccatccagaacctgaacatcatgtgtgggatgcccgagacgacggggctgctgcagcaggcactcttcccttgaacattgttcatgtgcattgagctgtgtaccctcgactgaattgcacgatgtgagcctggctgccaacctggtgctgaggttccacaggtagaagggcaaggcgtgtgcttgtgattgcttgggccgagggggcaggccagggaggggcagcacgacaagtcgggggccaaggatgcagggcaaggggggagattctgcacaccttcctgctgcagcaccgcgcaacgcaacgtcaggctcaatgcaaggctgtttgacaaacgagaaaccgcaaccggagtttgggggagaacggactcgccggcttnnnnnnnnnncgacagacgagaaaccgcaatcagagtttgggggagaacggactcgccggcttgttgtccagtcatccaagtggaagaggttcagagctcgtcgtgcgcagcagcggtcgccgcgctcgctgcatcggcgcttggcttgcagcccagggcctcggcggcgcgccagacctcgatggacttggcctccagcagggccaggtggtcgtcccgcccctcggtcagcgtgcgcagcacgcccagcgtggcctcggcatgctgctgcaggtcgcacagcgtcttgcggctgtacccggcgcggatcatgagggcggtcatgtctgacagcgcggaggtcatggcggagagcgcggcggcgggctccagggagcccccgtccctgcccaggggcagggggccggcctcgccctcagcgtcggcgtcggccgccgccgcctcccccgccagcagccgcgcggcggcgtcctggaagatgatgagcgccgcgcgcgcgtgcgccacgccctcttttcctcggtcctgggcctccagggcctgcgcccaggccgcctggagccaggggtcgtgggcgtccaccttctgcacgctgtacagcggagggggggcgattgctgtgctcatagcgtgacgacagggcccggggattgcatggatcacacacatgcaacccatgagcacccagctcttcgccacaggcagcccgacccacgcacgcacgcgttgagcagcttggcgtggaatggctgtacattggaggcaaagggnnnnnnnnnncccgccacaggcagcccgaccctacgcacgcgttgagcagcttggtgtggaatggctgtacattggaggcaaagggctccccaaacaccttcttgagggggaggtggcactgcagcggcgcggcctggggtccatgagagtggtggaaagggtgacgaggagcgtgtgtgacatnnnnnnnnnnagtggcactgcagcggcgcggcctggggtcgatgagaggggaggaaagggtgacgaggagcgtgtgtgacatggagcgcatcgatgcagtccctgggcaaagtgccacgatgcaggttgaagatgagtcgttcctcctgccacaagagaccacaccttgtcgaggtacttgtacatggccgccttgacggtgggggaggtgagattgcccccctctgcggcgatggcctccatgactgggaagcgtgtgcccatgcactccaccagcctctccagcccctcctctgaggcgggctggcggatgcggtgggtctcgtcgggcgcggcagacaccacctccagttggtccagcttcatcatggccctgaagggggttatgagggttttcataagcgcagctggggagtagatgctcaggagtagcctggagatatggacatgacaggcaggtttcctgacacgctgcagatccttccaacccccccctcgacctcatgtacacagagctccacgcacttcatgannnnnnnnnnaaaggaggttatgagggttttcaaaagcgcaactggggaatagatgctcaggagtggcctggagatatggacatgaaaggcaggtttgctgacgcgctgcagatccttaccaccccccctcgaccgcatgtacacagagctccacgcacttcatgatcagacgctcggcgcgcttcccactctcgtccagctggttggtggccaccagggtcaaggcggccgactcccacgccaccgccgcctgtgcagagggttttagcgaggcatgctccaggtgggaaagtcctccagccaggcctgcccatcccctcactcgtcatgcttttcacacacaaccacccgcagacttgcctcctcaatgcgctggacctcgggatggaccaggacctgggcccactggtccatggactgcacccagtcgcgctgagtcagcgactcgtccatccagttcacgtacacctgagtgtgtgttggggggggtgggcaaaaggaggttttgaaacgatgagaaatcacaagctgcgaggccatggacatagtgagcagtgttgacccaggtgagcaactatgtaacacagcatgattctcgacactggcagcggcgagtgacaatcagttnnnnnnnnnngagttttgacccaggtgagctactatgtaatacagcatgattcttgacactggcagcggcgagtgacaatcaggtccgcaccttgttgaggtcgctgagggcgtcgacggcggtgtcggggcaggacagcgcggcggtgagctcctggatgccctcgctcatctgcatcttcctgcatcgaggcatgcggaggggatatgcttttctgtgccctcctgcgactgtgcctgagtggctgcttggggtcaaccccaagaaaatcatggggagagggcagtcagagcactgcaatgctccctgcctgcaagtcccttgggaccatgagtgagactgtgagccgaccagccatacttcattccaagccccatacaaccgacccccattgaacctcgtgtccttcgctcataacccctgcagccatcctctcaccccatcagcgcgatgccgcggtggtagtgagggtcgcagtactgcggcaccacatccagtgcccggtccaggagcaccagggagacgtcccaggcctcggagcggcgggaaaggatggccgtgttcaggaggaccttggcactgttggggcagacctgcgcaggatggtggcagcgcaagggccaagggaggggctggtttgcaagttggctggcactgtgaggtaggcacaccggcagtcctcttctgtagtgcatgggcctcccggcaccctcaagccgccctaccttaagcgccgagccgaagagggaggcgtctgactcccagtcgcgannnnnnnnnnaccctgcaccctcaagccgccccaccttgagcgccgagccaaagagggaggcgtctgactcccagtcgcgattgcgctgcagggtccttcgcccgcccagggccaggatggaggccagaatgagggctgagaaggccctgcggacgcggttggaccgcggcccagagagcccggccgtgagctgctcagcgacgaggaaggccaggcccactgcaagtactggggtgatggattggtcaaggcccgtcctcaatagctgcagggtgctccatggcatacagtctggttgaccctcccccccttgccacctggccttgcctgagggcatgaggaggagccgctccgcgaggaaggtgccgacgtagaagaacaggtttgcggctggcagcatgggccccacgatcagcccggccgtcacaaacaggcgccagcgcgctgtgtacagggccgagccgggggccgcgcccggcgccacgatcagctggatcttggcgtccacgcctgcctcctcggcggttgaagtgctgctgggtgtcgcggggagccgcgcccctgtgccgctcgccagcacccgcctccagtccgacatgaggctccatggtttggcggccagggcggtggccaggagccaggcgtagaggaggagggagagggcgttgcgcgggtcccacattgacttcacgatggcgacgcaggagaaggaccagtccgccgacatcttatgagaagggggggggggagtggcagaagggtgatgttttggagcacacaaagcaatcgaaaatgcatgattggatggacaccgacgtgccttctgcatcatctgttacacttgccaccaagcgtgcaaagggaggatgtgctgctgccataccccgccaaatttcatctgaacaaggcctgccctgcgtcgcgtcacctggacaggcagtatgagctggcgagcatagagggcgtgcaggtacagcgtggtcaggacccttgccaggcgactggggatgaaggggatggggttctccacctgttgagcgttggtgatcgggtggccattagagatgtggtgagggtgggcagggactaccgatttcatccctcaaacaggcagcctggcgtcgcatgagatcccccgatgatcccctgatctgtgcagcaagccgaaattggtccgagggcatgccccccgccctcaacatccacgtctacacgactcacaatgcggtagttgcggaccaggtggtcacctgccagggctgccctcagcccaacgtaggcggccacggcgagggcaaggactcccaggagggcacccctgtgcattcgggggtccgaaggggagcgtggagggagcagcagctccaggcaagcgatcgcaccgaactgggtatttaggggaggacagggatactttagtattgaggagcgagcaagggcgctcatggtggcagctcaacagcgacatgtatgtgggccagcaactgcagagcggacggatggcggcccactcttttgtccatctgtgtgcaccacccaggattgggagcaatgcgactgataccccaacgactcaccacggtgacgcccgtctccttggacagcgctgccagccagcccagccccatcacgccggccagcgcggtccagcgcacgatgccccgcccggcgcgggcggcggagaggtacagggcgagtgccgccagcgccagggaggcggcaagcagttcggcggcgcccaccacgcccgccaccgcctcggtgtggatggggtgggccgcgaacagcgccgctgcgacgccggcgaatacggtgggggatccctggagggggctgggggtcagctgtcgcgccagcctgggacgttgggtggtggaggctttggacgaggagacaggggcgcatgctgctcatgtaatacctggcagacgacagcccaatactgtactttgagaacgaatccaggtcaagcgcacacgcaccagtagacttgggcggtgagcaccccatgcagtgccgcgtttgcagcgtggaagggtcgtgggtcgggcccagtgcctgggtctgccacaagttcatggtggagcacgggaggagtggtgggagcaaggttgatgcgttgaggggccagactctcactggagcgctgaacgatgtcagcctggatgccaatcgtgtcgannnnnnnnnnggccaggttgaggcgttgaggggctagactctcactggagcgctgagcgatgtcagcctggatgccaatcgtgtcgacaagcagcggggtgacatgttccaccacagcaaccagacctcatcaagccccctttcaatcaggcaggcagcaccagaagcgtccaaactccacgccactcaccgtcctcttcagtctcccagggcagccactcgcccccgaggatattcagggcccggaagaagagggtggtgacggggcggtacgacttgtgactcgtagacgaccgcaagtcctggcccctgaagaggtgtgaggaaaggaatgacccgtgtcgaggcaatgccactgtgcacataggaccggaagcatgccgcattcctctacagannnnnnnnnngagaggtgtgaggaaacgaatgacctgtgtcgaggcaatgccactgtgcacatatgaccggaagcatgccgcattcctctacagacaggatttaaggcacacaatgcaccccggcagatagggcttacacactacggctcctctttgtgcaatgccataatcaatgtaccagaaatcgtggatgaatactgcggatagcggccctccccctgtgacatcgttgtttttcacctgtgcggtgtgggtgggagggtgccggtgagcttcatgaacgaccggctgcatgaacagctccggatcccaagactcctctcagggtccacccctcatgcactcaccaccgcaaagtcatcgtcatacacgaatccaaactgcagggtgttggcatacagcaggccggccgcgattgccagagtcagaggcaccacgaggctggggacgaggccggcacacatctggctgtgagcagtaccaggactcgcagggccgttccggggtttatcagtcgcactcacgggctccgacattgggctatgggatcagtggtatcggctcatgggtggggaccggcgaccatggcttgcttcgagtgaggcgatgcattggcagctttggcgtcttcaaactcgaggcctcagctcttgggcctttcgtgctttctagaacacatattctcttcctgggcctaccggaccaattggctgcggccaccactccacgccaaataaattgtttatttcgatctcaagctacagccatgcggttggtcgcgagcttgttgtgcctggccgtggtggccagcgcctaccacgagaagtttgatggagggtgggagagccgctgggtgcacagcgatgacgccaagtacgccggcaacaagctggtggtcgaaacacccgaaggtggcagcgaccccgctctgaaggtgggcctgggctgagggctctcctggtgatcgcggccagtactcgaaacttctggtcggcaccggcccattcccgattgcctggcgcggccgcgatccacggtgctggactgtcacccttgatgtgagacatcattgctcctccctccccccgcccctccccagatccccgagaaggcccggcactacgggatcagcgtggccctgcccgagccggtcgacccagccaagggcctcgtgctccagtacgagctgaagctgccctccgcgggtcttacctgcggcggcgcctacctcaagttcgtgaccgccgacccgggcttctccccctcgggcctggtggactccaccccctacaccatcatgtttgggccggacaagtgcggcagcaccaacaaggtgcacctcatcctgcgccacaagagccccaagacgggagatattgaggagaagcacctgaagacgccccccgtcttccccaacgacgacctgacccacgtctacaccgtggagctcagcccctctgacaacacctaccgcatgctgatcgacggcgtggagaagaaggccggcgcgctggcggacgacttcctgccccccttcaacccgccggagaccatcgccgaccccgaggacgtcaagcctgaggactgggtggatgaggccacgtgagtgtgtgcgtgtgtgtgtgtgtagatttgcccaaagcaccggggattcgttcaatggtcgtgccaggttgtgcgtcgtggatgcaacgctctcattcaacgcttggggacgattgccctggcatatggcacccctccgctctttcaaagacccagtcgcatcccgcatccaacacgtgttgcactgggcccctgccttccagacatagtggtagccctgtccctcgcaccactctgtgctccaccacccccaccgcagcatccccgaccccgacgcggtcaagcccgaggactgggacgaggacgcgccgctgcagatccccgacgaggacgcggtgaagcccgagggctggctggactccgagccggccgagatcgaggacccggccgcgcgccagcccgaggactgggacgcagaggaggatggcgactgggaggcgccgctcatccccaaccctgcctgctccgtcggctgtggcgagtggaagcgtcccaccaagcccaacccggcctacaagggcaagtggacccggcctcaggtggccaacccggcgtacaagggcccctggaagccgcgcgacatccccaaccccgcccactttgtggacgccgcgccgctgtcccacgtcggctccatcggcggcgtggccctggaggtgtggaccatggactccgactactacttcagcaacgtggtggtgagcaacgacgcggcggaggcggcggcagtgcgtgatgcgacctgggcgcccaagcacgccgcggaggcggcggccgcggaggccaagttcaaggccgaggcggccaagaagaaggcggcaggcgacgacgaggacgaggacgacgagggcccggtggagcgcctgctcgccgcggtgttcgactccccgctcctcgcgccgcatgctgcgcgcctggcccccgtgcggcggtacacggaggagaacccgcagctggtgctgggcggtgtggctggcctgacccttgccctcctggcgcccctgctcaaggcactggtgggcggcggcggcggccgcaagcctgccgcgcccagcgtggcccaggtgaagaaggcggacctccccaccaaggacgacgacgaggaggaggaggaggaggaggaggccaaggaggtggtggaggagatcgaggaggaggaggaggaggaggaggagaagaccaccacccggcggcgcgctcgccgcgactgacccgggcccggttgctccgcatcagacgcaccccgaccgtatacatgtttttgtcttgcatcctttcgcactgaactcacgccctgtttaaatgacgggatctctccatggactgggcggttggagcgatggggggtccgtgtttgagtggcacaagcaggcacgggccaggctgggtcgcgggggtttctgcactgcatcgaacaaggggacgggcaacagccagggtcagagaggcacagggaatggcgacagggtgcaggtaccaccagcgtgcctccgtggggccggccaggagccggacctcgtccatagcatcccaggcgcatccctctctagctcagcgcatgggcgcggccaggccctggagctgggccagggccgccttcttcacccaggaccgggtgtggggtgtgtaggcgtccaggctggggtcgtagatgagcatggacacctcggggagcctgtccaggtaggcaaagaggtcgtcgagctcgtacgtcatctccgcgaggtgggggttcagctcccgcagcagcttctcgtacatggagcagatgcctgcagggaaaggggaggagagggggaggagggaggtgggcctggtgatggacagtcttcggagctgagcggggtgtttggggtgggccgcagtgcagttggaggttacagctcaaggtgccgaccggttgcgcgacgtggatctcctacaaccgaggcccacctgttagggcatccgcggtggagtcaaagtccgaaaaggtgcgtgaactcttgtcccgcccagtctggagcaggacgatggtgtgccgcttgtcctcctgcgcagtggtctcgcagcgagatgtgtgctacaggagggtacaggggagcttccccagcgcaatcttatgcgccgcaacatattgcaagcttaccaggctcatcggatagtgctatcccctagaatccttgtcgacacagcgccgaacgggggccgtggagtacttgcgacaaccttgccggctagctcttgagctctttgcctgagggcctctgctcgatacaattggggtgatgattcgacggtgaatgcgtcgaaaatcacatccactgtgtttgagccgcatgaggcaggcactgcgtagaacatcctgcacggacccccactcgagatgatgtgtcgcaccgggtggaatcgagctggcgatgagaaacaggggcgatctcccgcatgaataagtgcaaatcaccgactccacagaatggctgaatttcccactatatcaagacatatatcctcatgcannnnnnnnnngcgggtggaagcgagctggcgaagagagaaaggggcgatctcccgcaccaattagtgcaaatcaccggctccacagaatgactgaattttccactatatcaagacatatatcctcatgcagctgccattgtagagcataaggaacgcccgcccttgtcgatcagtttctctaggaccatgttcggaggcttcttcgggggctatgcgcccacaggtcgctttgaagcgagctacagatgctacccagtatcattcatcgacaggatggatgcagagaagggagacaaggttttcctgcccccctctgccctggacagactctgtgagcgcaagaagccgagggtgaccactacgccactgcccatattgctgcgccacgccagagccacccgcattgagctgatctccccctctcaccgcagcccagcttcagatcgactaccccatgctcttcaaggtggagaaccgacagtcgggccaggccacgcactgcggcgttctggagttcatcgcagatgaaggcatgatctacatgccgtactgggtgagaggttgtgcgagatgagccttgatcgggtggggtgcatcaccaggtgtccgtgcgacatgcggtaccactccgagcctgaagcaggggcgcatggagtgtcttgtcacagccgattgtgaaggcagattcccaccagcttcagtttttcgaggggagccagccccccactctatgcgcaacagatgatgcaaaaccttgtgttggaggagggcacggtgatcaggctgagcagcgccacgctgcccaagggcagcttcgtgaagctgcagccccactccaaggactttctggacatcaccaacccccgtgccgtgctggaaaccacgctgagaaacttcacttgcctcacgggtggggctggagcggtggtggttgtctttgtggggctggaggatgggcaggctttcccccctgtcagttgtgaagcgggcgtgcaggaggcctgacatcctgactgttagcatattcgtgtgtcaatgtctccatcacaaccggggagcatggactccgcatggcagagatttggatgccctgggggcacacgcctcgcacacatccctggcacccatgccaaccggctggtccctcccttgccatgtgccttgatgccctccaagcacacccaccgcgtgcttggcaaatatcaccgctagactcccgtcatggcccacattccttgcagttggcgacacggtgcccatcaactacaacaacaagaggtacttcatcgacatcatcgaggccaaacccagcgatgcgatctcggtcgtagaaacagactgcaacgtgaggggcgtggggaaggggggactctagcgccaggcttgcacgcttgcctggcagggcacctggggtgnnnnnnnnnngacagactgcaacgtgaggggcgtggggagggggggactctagcttgaggctcgcacgcttgcctggcagggcacctggggtgctgggtgcagggctgcgtgatttgggtgcctcagcaacccccgtctgcgacagagcctgcccttgccgagcccgtgcttttggtctatccctgacagctcccaccaactccactctcaaggtggattttgccccgcccnnnnnnnnnngcccccgtcggcgactgagcctgcccttgccgagcccatgcttttggtcgatccctgacagctcccaccaattccactctcaaggtggattttgccccgcccttggattatgtggagccggaatacacgccagccgccccagccgccgaacaggcctccaccacccgccccgacggtgagtctgcaggagggtcaaccctgccgggcgggccaccctgtgtgcacggccaaatgtgttggactgcgcgggccagtctggccatcctcacacccaggctcgcagttccctgccnnnnnnnnnngccctgccgggcgggccaccctgtgtgcatggccaaccgtgttggactgcgcaggccagtctggccgtcctcacacccaggctcgcagttccctgccgtttgtaatcatcctcaccctgatcctcgaccccgcagctggcagcgggagcagcaccacggaagacaacggcgaccccgcctctcgcgcggctgcaccggcggagccgcagttcctggcttttgcagggacggccaagaggctggatggaaggcccgcagccgacccccggcccgtgcccgtgccccggcccgggggcaacagcgcctcgtcggcagggcccagcaccaaggacggcagctcagacgctcaggcgagctctggcgcgttgaagaaagcgggaaagctgatgtacagggaccgcctggcagctaagtttgcggccgccaaggacggcaggggtgccgctgcgcctccccccccgccgcccacgaaggcatcggatgccgagggcggcgcagagaaaaaggaggacggcttccagcccttcaagggccaaggacgttccctgaggggctgactgagccattggcccctggcctgtaagcaggttgcagtgtccacggccgtaaacccaggacctgccccgctatggtcgccattgctgcccagttgccattctcttcacacagctacagcccgcctgtgaggcttgcccggccctgcaccaccttacagcaatgnnnnnnnnnngtccctgaggggctgactgaggcgttggcccctggcctgtcaccaggttgcaatgtccacagccttaaatccaggacctgcctcgctatggtggccattgctgcccagttgccattctcttcacccagctacacccctcctgtgaggcatgcccggccctgcaccaccttacagcaatgctctgtgccagagcagggcctggcaggtatgcagaagcggaaccctggagcgtaagaccaaccagcttactccgtgagggcgttgcgccctggcgcccctgcccagctggtccggggctggccgcgctttctcaatccgtccagaccacgctgccaaccacccatctctggaagtcgttgctgagccgcatggcgatcttgtggaagatggtgtcggcagcgttgtaaatctgggcaggatgcacgaatagagggggggggtggggggtgctattgcacaacgaacccgagcagggcagggagtctgagggacccgannnnnnnnnngatagagggtggggtggggggtgctattgcacaatgaactcgagcagggcagggagtctgagggacccgatagccaggagaaggcatgcagagacaaaggtgcagcaaaaatgagcgcacaaacacccccgaactacttcctaaaaccaccccggcccggcgagtgcccaccttggcattgttaaacatgcgtaggacatctgcggcaaagatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtagtattgcccctcggctggcgtcccgcaaaataagcacagctctccgtacatgcctgcatcggannnnnnnnnnggaagcggagccctggagcgtaagaccaaccggcttacttcgtgagggcgttgcgccctggcgcccctgcnnnnnnnnnnggaactaattcctgaaaccaccccggcccggcgagtgtccaccttggcattgttgaacatgcgtaggacatctgcggcaaagatgtcgagggtctggtaaaacgcccggctggccagcctctcttggatggtcgttaggtcgatgggatcctggggttgggagtttgagtctcgggttgtggagtggcgttcatgcaaactccagaaagcatggggtgggacaaatacttgttcacagtgggcgctgtgctgccatccagggtgtcaagcggtagtattgccctcggctcgcgtcctgcaaaacaggcacagctctccgtacatgcctgcatcggactccacccctcgcaccttgatcacgtcatagtagtcagggacctcctccttggatacgggggtcaggaacggccaggaatcgggctcggcctgagggtcgtggtttacaatacagacgttgatgctgtgagatagattcaggctcatctccactggcatgtaggaaatcagcgaactcaacaatcttgtcaagattggctttggtcctcccactatctgcccatgctgctcagcatgccatcacacactcattcctctcaaaccccacctttatcctcttcacgaggaaggtcatgcacttgtgcagggcttcgggcgtgggctccagcctggccccatccaccaccagctggaagccgcggctcccagcggctgcagacgcctcggtccagccggattctcgcacgcctgccgggaaaaggggtttggggttcacacacaaaatgcttgggatgccactgaaattgactgccgtcagcatccagccaggagcagggggcactcacgagcaccagtcttaagaccgccggacagcagggtgtacccaacaagaagagctcctcagagcccggggacagcttccatgccgagctgccctccccttgcacacccnnnnnnnnnngaagggtttggggctcacacacagaatgctggggatgcttttgaaaatgactgccgtcggcatccagccaggagcatggcgcactcacgagcaccaggcttaagaccgcctgacagcagggtgtacccaacaggaagagctcctcagagcccggagacagctttcatgccgagctgccctccccttgcacaccccaggcccccccgcgcagcagcacacctgggatgtcggagatggggaggaccgcaggtcccgacctccagaagtccagcccagggtattgcacgtggcccttggtgtactttcggacctgggggccgggtggatagggcgcaggtggggggtgctgcatgccgagtcgaggagaggggaggggggcaggggccccagccagcacagaacccctccgacggccaccagagagtcatggcgtgcacacctgggcctccagcgcggctttgtgatgcagcaccatgccggcaaagtctgtgaagggcagggtggggtggatgtggcactccatcagcgtcccgccgtcgtagtccttgatgaagccgtgccactgttattgggagagggggtggtgagggtgagggcagaccaggagcggtgcatggggtgcactgcacgaggcttcacgcagcgatgcctccagcccaccagaaggcccacccaggagcgctgcgcaccctctccttctccatgctgatggtcttggagaagccctgcttggagaagtagcccaccgcattgttgtcggcgtatgtgagaaaatactggcacccatcctggtcccgtgcatgcagctgccagcaggggatggaaggaaggggggggaggatagcaattgcatgtggctgcccagggggaatgaggacatggaaactcgggtccgcaaccccaacaagtatttgcatggcactcggccctgcccagcggcaggcaggcgtggcgatggagacgcgccggtcgcgcaggctcatgacccagcccacccccccaccttggtccagctcatgaggcgtgtgnnnnnnnnnntgcgccgatcgcgcaggcccacgacccatcccacccacccaccttggtccagctcatgaggcgtgtgccaaagcccgacacctgcaggctctgggccacggcgcagaaggcgatctcggcaaacctttggctgtgaaaggggcggtaggtgatgccagcaatgattgaagtgttgttccgggtgatgacgacggacctggagtgaggagcagggtggcagatcttggtggtcggtggaaggaggatctcggctcaggactgggcccgggaagcctacgtgccctgcagcaatgccatggctcaacacggagacaacaagtcttccaaagcaggtcggtaggagggcaggaaggcatggcatggccctctcgaacccctccatccctggagccactcgcctgtgcctccgatcaaacacgaggcgggtgatgtactccttgggcatgtttgggaggcacttggagaacacattcttcaacccgatgagcagcctgcccgacagggggctgccgtcgttgatgacatagtgcgcctgcacctcgcccgacctctcgcgctccaggtgcttcagctcccggttggtgtaggtgtccagcaccggggcggcgggaggggcagcgggtgctggtttgccggcatcctcctcctccttcacttccgccttctgaagtttagacgggaacgaagaatgaactcatgtaagaagaccaggtcggcatgcaaagcccaagggtgtcgggctgggcagggagctgggcacccttgcactggccaggtcacccctgccatcattggagctgcacgccatcgtaccgggggagtgccggcnnnnnnnnnnacaccgttgcactggccaggtcacccctgcgatcattggagatgcacgccatcgtaccgggggagtgccggccacctcggcttcagatggaggttgggggtcctctgcatctaccattacgatgttttatcgggatgctctgcccgaaaaggagtcacgtagggagggcgcatgctcccatgctgaagatgggggccttccccctccgagggacagctttcccaacagacagggcgtagtgcgatagggaagcaatcacagcggcagctcagccctgattccttgagtttgtgaccggggcgatgtcgtctgtcccactgaaccatcagatgcgtcgagtgtcatgtgtgtcctagagcgactctgcgcccggggcccccaacttcccgcgcctggagtgtgcacaggatatataagcggaatatcccgtgccagctagtggtagggcttttcactcgcacatccaagtccaataaattactcaacgtgaccagattgtattcttctctccgcctgggcgctccaaacgaggcctcaacgggtttgctggggtgtcgtctcgcccccagtccgatacgcgcgactcgagcggcacgaccccctcaagccccaccctcgagctatcgccaagacgttggactcaaagcattgacacaaggccgggatggtggacatggtgaatgtcctgcggccgtgcctgcaccaggtgggtgcgggcccgatggccgtcgatgggtcccggccagggtcaccccagcgggcctgctcgagcggcgaggtggctgtacagcgatgcacgtctgtgggtcgtcttcttccctcgctgcagcatcaacccgcaccctcctccctccatcctttcaggtcgctggccacatgtttgaaggtcggctggctgggtgatgacctcctgccatttccctgagctggcccgcggcctgcccacagagccgtgccggtccttgnnnnnnnnnngtgaccctctgccattcccctgagctggcccggggcctgcccacagagccgtgccggtccttggatcccacgcaccatgcgcttcagtgcagccagcacgcccggttttatggccaggccccacccattccccatgtcacccgctccctagcctcccacaccctcccatgcacccgtactggccccctcgcccattctcccatcacgccccccacacaacatgccccccctccccgtcatcattgtgcagagggcaaagcgggcagtttcgtcgacgacgtcggccacttctacaaacccctgcagcagggcccccgtggagaccgcgagcgcgccttctacgaggacatcgcctccgagctggcggcggagcacctctggcgccgcacttcctcggcgcgccgcccctccctgcgccccccgcccttcttccccgacctgcgggagctggagcggcggggcgacatcgcgcagcgcgacgagtggggccttgtgggcagcccctccctgcaccggcacagcgccggcgctggcgccggcagcgacggcggcgccagcccgcacggcgccagtgacgaggacgagggcacggccgcggcgctcatggtggacgcctgggtggcgcgacgtgggcggggcgcgggaagcgccgctgactcctccactcnnnnnnnnnnnnnnnnnnnnnnnnnnnnnnnnnnnnnnnnnnnnnnnnnnnnnnnnnnnnnnnnnnnnnnnngccagcccagagcgcgctcggggctgctcgccctttgccagcagcaatgggcgcggcgccgtgggggggtccccattgcgcatcgacagcaccagctccagctccaacggcaaggcctctgatgtggggcgggagccggacgcagagcctgagccgcagttttcggtgctgcactcccccctactccgcgtcatcccgcgattctgtgagtgggaatagctgtgcccggggcagggcttgcgttatctgctctgttaatggggtggggaggggaaagcagggccacacttggtagggtcaagaacctggccaggccctttcggagatttttacgtgttcttcagtgtcgtggctcagcagggannnnnnnnnntctgctctgttaatggggtggggaggggaaggcagggccacacttggtaggggtcgagaacctggccaggccttttcggagatttttatgtgttcttcagtgtcgtggctcagcagggagcctgctccttcctactcatcccccttttgcgcggactgcccgtcaactaccaccacaaccatcgcagacggcgtggtgacggtgggccagcggacgctgctggagctggaggacctggcgcgagggtaccgccacccctgcatcgtagacatcaagatagggtaccgcacatggtacccggaggcgggcgacgaagcatacatagcacgctgcaagtgcgtgagcgcggggccccaggggggctgcagacattattgggcatgccagccgtggcagtgcttggcccgggaaaccctcgtctgctcgtccaatcctgccccactgctgcccctttcaacggccaatccccccccacgtgttgcaggcaaaaggatgcggcgaccacgcaggcccgcctgggctttaagatctgtggcatgcaggtctggcgctcatgccagggcgggtactggcgggcgagcaagcgctggtgcaagacgctgcctgaggccctggttgacaaggcgctgatgagcttcacaaacaacggtgaggagttgggaagtgccactgttgccaatgggcactgatcttgtctttcatggggttttcaaggtgctgagcgtgggcaaccttggggagggatgcaatggaaggctgatgccacagcagggagggaagggaagggacattttaggatgagccaggcaatgtcggcaacaaaacttggcccatgccccttagatgaaggcatgttgcggcatgcaatactccctgcatccacccgccccccgcactcnnnnnnnnnnattgggaagtggcactgttgccaatgggcactgatcttgtgtttcatggggtttcaaggtgctgagtgtgggcaaccttggggaggggtgcaatggaaggctgatgccacagcagagagggaagggaagggacattttaggatgagccaggcaatgtcggcaacaaaacttggcccatgccccttggatgaaggcatgttgcggcatgccttcactccctgcatccacccgccccccgcactcatcctcctcgactccactcccctcatcctgagcttgcagaaaaagggctgcacccccaacatgtgtttgggggcccacatggtgcggtggccnnnnnnnnnncgcagagaaagggctgcacccccaacacgtgtttgggggcccacatggtgcagtggcccagctccagaccctgctctcatgggtggatgtacagcgcagcttccgcttttactcctcctcgatcctcctcttgtatgaaggcgacgcacagggtgagcgggatgggaagagcggtggaccatggtgcaggaccctgccttgccttagccctggcgtgctgtccggccgcccaccatcatggtgggatcttgccccaacacaccgatccctccctcctcaccattgacagacgcagagggcgcggccgtgcgcgtcaggctggtggattttgcgcacagcttccgcacgaattcctccgctcgtgacgacaacttcctgctgggcctcacttcgctgatgcagcgcatgcgacgggtacaaggggaagacctggacatcgcctttgtttgaacctttgctggtggacacgtggggcactggcaccctcagcggatgtatgtagcccatttattgccttccctccttgtccctgtctcatcttgccctactttttcacgttgactttgctgcggtgacttcgcctacannnnnnnnnncatgtagccccattattgcctcccctccttgtccctgtctcatctagccctactttttcatgttgactttgctgcggtgacttcgcctacatttgtaaatccagattagcagggttccccgccccgaaagcgccgatttcaaaagtttgggtcgatgggacactagcaatgtgcattgaagagccaaagcatgcttagcgcattgtgcccatgcctccctcacgcttgattagattggaactcaacgcgaatctctcttgaagactccctcgtctcggccccgttctcgaaatggcgggggccatgagccacgacgccgcgtcatgcctgcaagcaatacagccgactgagaccacgttcacaacagtctgtaccgtcgtgggtgagtgaagtcgacatgcaactacctagagtcgttgagatcatgtaagcgacccattcacctcctggttactctccaaccctgcagggctggcagccctcataccccttgcaagatacattctcagtcacttgctattcaaggtaggcaggatgagcaactcccctgaaagatgctttctgcgagccagctagagtctaaagtgtcattacagtgggaacaccctccccagccatccccaaacagagtatcaaccatacctcccccctccattgccgcagccgctcagcatcaaacatgtcgcgccaccacccaaaggatctgacccatccttactacccctccaacggagcaagttccgagagagctgctggaagctcacagtgtatggcgtgctgtcactggcgggcgcgagtctcatctggcaagggggttgggtcagcgacacctccaccctgtggaagggctggcccgaacacgatcccaggtgggactcgtgggtacggggacaaaggagtgcagtacctatggacaggagtgcgtgctagtgcatctgtacggcacatgatcagccatgccgatggctgtgctggtgccggtacagacaatccaccctccctgaacaccccccctctctccagccctggcttgctcgcactgtactactttgagctgtcattttacctggccagcaccttcatgctggtttggtgggaagcacggcgcaaggacttccctgtcatgatgacccaccactttgtgacaggggccctcatagcactctccctccgtttaaagtgagcgttggtgtggctgttcagcaatgtgatgctgggaagaacgggaatttcaactggcatgtgcagcttgcatcgtagnnnnnnnnnnccgatgctgggaaggacgggaaattcaactggcatgtgcagcttgcatcgtagtccacggcaatgagtgtgggagtttttcaagttccagcacctgacggcattgatgccagcttgctgccagatgtatgccgtccttgtgtgcctgggatgcttaggatcagcccctgtgaaccacatgccaccctcggccctcaacatgcttccgccctgcacnnnnnnnnnnttgggatgcttaggatcagcccctgtgcaccatatgcctcgctcggccctcaacatgcttccgccctgcacatccttcccaccagcttcctgagggtgggcgccatcatcatgacgctgcatgatgcgtgtgacgtcctgctggaggcctccaagctggccaagtacacggggcatgatgcaggggccaccgcgctcttcaccgcctttgcgctgtcgtgggcgggcctgcgtctcgctttcttcccgttcgtggtcatccacagcaccaggtggccgctggtatccgggattcacgggtttgcaggggccgttcctcgtggtattgcggtgaggggtgatgtgacgtcagaccctctcgctgctggcacacaaattgtgtgatgttttgggggctggcaccgcagcatggcccgggattacctgtgtgggcctgctacaccctggcttagcaactctcattccaggatgcctctgctcagtgacattcacaagtccatcaccctgccacacctccatgctgcaggtttgagattgtggaggttctgtcctatcgcccaccctgcctcactgctttcaacaccttcctcctctccttggtggtcatgcatgtctactggttcgccctgatcctgctggtagcataccgacgggtggccctgggggaaattgaggacagccgggaggattgatgacatacggctgggggaaccagccttgaaggagcctccctctggcccctgcagctcagtctgacctgcgtttcgaatttttggatgtttccctcgtccccccttttccggccaacaccgatccccttccccaccccgttctcgccaacctccagcnnnnnnnnnnggggggaagcagccttgaaggagcctccctctggcccctacagctcagtctgacctgcgtttcgattttttggatgtttctcttgtcccccattttccggccaacaccgatccctttccccaccccgttctcgccaacctccagccttttcccgcttctttccctctgcgcactgatcatgagagtagcgtcggcgctctgcgttcgaccaggtgacgcatctctgccctgctgtnnnnnnnnnntatgggagtggcgtcggcgctctgcgtccgaccaggtgacgcatctctgccctgctgtgtgtaaataaaatgggccatatccacgcaaggtgcctggttgggtccctagggagcacacgagcctgcccttggcaggcattcgccggtaagggagaaaagggaatgggaaggatggggagggggaaggggttgcacaccgcaatctcccgctcttgcggcctcagggacagcgagctgggaagatcaatcggcccagcaggcactggctccaaggcgagtccaggttcaggacctctgagcgtttcctattgcgaaaacggcaggatgacatcgcgcgccggccccagggttataatgcctgagcccccgggcaggtgcagcacgccgtgctccagcagggaggaggcccccgccgcgccccgcagctccagcgccgcctggccggccaggtgggcacgcagcttctgcgtggcttccgccatgccccggcaggtgtcgtctgagtcccggccgtgcacctcgtccaaccaggcccccgcccactccagctggtggaccagcatggagtcgccgggcgccgaggtggtggaaagcatggcgcgagcgaggatgccgggggggagcgaggtgaccgcctgcgttccaatgcagggtaggtgagtggcagggagggcaggtgtttctggctgcacacagcatcccatgcaccacgcggtgtatggtggaggtcgggaattttactatagcacaggtaaactttgcagtacccctgcagtaccnnnnnnnnnntcaatgcagtgtaggtgagtagcagggagggcaggtgtttctgggtgcacacagcatcccatgtaccatgcggtgtatggtggaggtcagtaattttactatagcataggtaaactttgcagtacccctgcagtacctgggcgacggcgaggaccgccgcgcgccggacatagggctccgcatgcgcatgcactgcctcgcagcgcacaagctccagcgtggcggccgtgagtcccgcactttccacgtgcccggccgttgcctccaggaaggtgcctgtgcaacggggggccagggatgggataaggggtggccggcggcagcgcttgagcatggaggaggctaggagcgggggtgcctcaggctgccaagggcacgggatggtctcgggagcccttggctgcgatggattgtcaggcacaacacctgatttccctaccaggacagggcacccgtgcaacgcacccagggtggtgagcaggcggcccagcaggaaagcgtctcgcccaaagaggtcgatgccgtggtgctgcttgtccacgcctcccagcaacacagacgcccactgcagcgcgaccaccgtgaacctgcgcagaggattgcaggtatgggggtgaggggtggtgggtggggaccccccagcggcggatgcagggatcatgccctgaagcggcggcactactggtgagtgctcacagagtgcttcacgcggcatctcccgtcctcacaggcatgacccaaacctgaggtctacctgttggtgtggccctccgagtcccctccactccccagggannnnnnnnnngttgtggggtggtgggtggggacccaccagcggcggatgcacggatcatgccctgaagcggcggcactattggtgagtgctcacagagtgcttcacgcaagcatctcccgtcctcccaggcatgacccgaacctgagatctacctgttggtgtagccctccgagtcccctccactccccagggactgcagactcctgtcggcgcgccacgtcaccctccccaccctcccaccgccatccgggcccagcgcaggcaacggcggccgagcgcgagcacccggcccccgcccgcctcccagcccggcacgccccggcaccctgcccgccagctccagcgccgcggaggaaagcgcgtccaggatgagcacccgctggtgggtgtccaggctcggggagtacagctcactggccagagcaatgccaccacgctgcggctccgcccccagcgtggctnnnnnnnnnnaaggctcggggagtacagctcggtggccagagcaatgccgccacgctgcggctccgcccccagcgtggctacgatggccctggcacggcacagatggggggaggctgggcggaaggcgtgcgacaagcgccgactggtactccgcgacatgaaattacagagtgcaggccaccccgcaccatgccaggacaccagctctcatctcgcgggagccaccgactcaccccatacgctgctctaggataggcggggcgcccgatgcggtctcttcgtcgccccaggagggcaggcgggcgtgcagcagcgctcgtgcgaggcgatctggcgatgcaacgcagggatcgacatgcgacgctttgagtggggaacaggtgcggcgctgcgtatttcatgcgcccaggacgggcacgatgcgccgcatgctacttgctcctgccatctgaggcctgtggggaccccacctcactcttatccccaccccacccccaccaatgcacctgcttggtggggtagctcgtctggcgccgccctcaccagcatctcagcggcctgcaccgcctgcagcgcccccttccagtcagactccgcctttgagagcccggagattacttcccgcagcgacagccgccgcctcgcagactctatggtggtcaacagagacaatgggcaggtgaggaaggaggtaaatttgcgacggacaaacaactgagcttgagataggagacaggctgacagtgtggtgaaccgtcactggcgtcccccgcaaagcgatgctaaagggaatgcacaggatgcgacttctgtgcagccacaggagccctcccgcccctcaacaaatcccagcaccacccaggccccaccatcctcgtcagactnnnnnnnnnngtgcgacaaacaaacatctgagcttgagataggagacaggctgatagtgtggtgaaccgtcactggcgttccccgcaaagcgatgctacaggggatgcacaggatgcgacttctgtgcagccacaggggccctcccgcccctcgacaaatcccagccccacccaggccccaccatcctcgtcagactccgccaggtcgtaggccggcagtcctgccgtgtcatcaagctcgtcatcgtcgtcggagtccgtcccggtcagcggacccagctcctcttcgctatcgctttcggcccggggtctctcgcgtgccatgccttcaccgctcggcgccacgccggaaccatcagcgggcgagcggtcactgctgccgtgcggggcctccaagcatcgccccgccacctnnnnnnnnnntccctcagcgggcgaccggtcactgctgccgcgcggggcctccaagcatcgccccgccacctgcccagccccgcactcgttcccctccccaccgccctcgccctcgtcttcactggcttcccagtagccctcctccaactcccccagggccaactcgtccgcgaagagggcgggcgaggccgggtccagcgtcagggacagctgtcgcgcgacgcgcatgccccgccgccgcacctctggctgtgggctgtccaggtgggcagacacgccaccgaggatggccggcagcagcgggccctgatccagcgcgccgacgtcgattgccaccagcgcggcgcagaggcccagcgtcagcgcggcctggcgcggtgctggcagcgtacacgaccccgcccaggcctgcgccagggggagcaggcgaccagcgctgccgccagggtctggccctgcggctccgagcagctccgtgaccgccgctcggaccgcggcggggggcagcatccgatcgccgagcaggcgctgcagcgtctcgggcgaacgcgcgggcgaggccgcgcccagcgccgccagcacggccccggcatgcgcgccgcgccgggaggaaagcgctgcctgcagcgcggccagccccgcccgcgcgtcctccagctgccccagccaggccagcggaggggtgggagcgaggaagggaaccagggggtcctggtgagggcaaggctctgcagaggctcccttaagcatccccctgtctgattcggcagggtcatcggctcctgcatcaccttttgagcgagcgacgtccaccgccggcgacattccatccacctcggctgccagctgcgccagcgccgcgccgacgggctgggcgtggccccgcctcaccaggcgctgggtggtggcggccgccaggcgggtcgcctgtgcgcccagcggccccgttgatgccgctgcccacgacagcgcgggcagcagggcggcgcagtaggctggcgcggccaggcaggcatgttcccaggagggcgccaggtctggcagcgcggccagcgcgccggcgatccgctcttggtcggcttcggtggcctccgagcagcctgcagcgcatgaggtctccgggcggtcagccatctgccgccccaccgcacccacaccagccagatcctcgactaatcgtgccaccgacgcgacgcaggactggggggatccaaagcgtgcgctcagtagctctgctgcgacgatgccggaggcggccgccacagatgtgtgccgccgtgagcggccggatgccgactccacgaggacgggctggaccgctgcgaggtggctgcatggttgcaaagggggaaaggaaggcattgatggggatactcgccttggaaaaggctccaagtacttgggccaagccaagtaggggcggggcatcaacgtcagggccataccctcattgcatgaaggtccgcctccacgcccgcacgagcgcccctcctggctgctcccctccaccaccacnnnnnnnnnngaatgggggaaaggaaggcgttggttgggatactcgccttggaaaaggctccaagtgctcggggcaagtcaagtaagggcggggcaacaacgtcagggccgtaccctcattgcatgaagttccacctccacacacgcacgagcacccctcctggctgctcccctccaccaccacccaaatgcctcactccacggcagtcagcagggcgtccctcacgctcagcctcccaaaccaggaccagaaatgccgctgcacgaagccaggcgctcccctctcctccagctgggccagccagcgaggagctacgctggacaggagcgcgtggctgtatgccttcacggcagggctgctgggtaatgggaagtcactcgtccttgttgtggcctccgtgggggcgcgagcctgcacgctctgcagctgcgcatccaggtcatgcatgatgccttggagcactgcggccttcgccagcatctccggagcgatcgcatctccacccaggacaacaggtcccagctccaggagtgctatgacctgctccagggtcttgcaccggggtaaggcccccgcgatggcaagtcccagctccctggacgcctcgtccatgcctcactcaggttcccaagtaatgcatgatctgcgaggcacgatcacgttgaaatatatcttgattcatgcatgaattatctcaaatgcacatgtcctacataagtattattatgtgcgtttttggttctcttgcgcccagatcagggtgacgttcgaagtagttttagcgcgcgccccattgcttacgtcaccatttcaccacaagctggactttccccataactcttgatctatggcatctcttgagaagcaaatcctcatcaagcattacgatatcagtggctgtatggttgggcaggccctgattgggcgtggtggcacctaacacatgtcctcggcgagagcacgccccagcttcggcacccttttcagtttactccgtacgcctgagcttggagggtgggactgactacgacttcgagttacccaggacatttccccaaactctgtgtgcatacatcctccttgcaggtgctgtgacgatgannnnnnnnnnggagcttggagggtgggactgactatgacttcgagttacccaggacattaacccaaactctgtgtgcacacatcctccttgcaggtgctgtgacgatgacctcaggagcgaccactctgaaggagcccctgacgctgcctgcgcatcacagtaccagcggcatattctggaagaccagaacatttgagaacatttgggacacatggaaggtgtgcaggattgctctggaggttatgtgggcatgaagtgggtttgagatggtgcagaatgccgacagggactacacctgtcccagctggaatgtcttggacggcccactctggacgagcctgagtgtacttcggcttgcgtcatctataacaccattcctcatccacgtggacaggacatcactttcaaggatgtttataagtgggcgagtacacgcaagtcgcactgcgtgaagggctacctgatgtccaccaccacccccacggccgcagactttgcggaagcctttcctccataccctgtggactggaaggctcttgccaaccctcccagtgagtttctggctacagctctgctggtgggagaactctactgggccatgcagtgtagcgctctcaagtggcaggtcgcggtatgggctcaaatggcggagcacctacccgatcttcgctttccatctcccttgtcatcagaccgtcgggcctgacatttccaaccacctnnnnnnnnnnttacctgaccttcgctttccatctcccttgtcatccgaccgtcgggcctgacatttccaaccacctgccccatcttcacctgcaggtgatgccatccaggctgtctgggtgggtcactccactgtgcttacccagatgcaggggctcacctggatcacagacccggtgttctccgagagggcttccccagtgcagtgggcgggacccaagcgcgtcacgccgcctgccttcacccttgaagcgcctgccctcccccgcctcgactttgtcctcatctcgcataaccactatggtgcgctgtgttggggggcagccggccaggggctcctggtgtggtgtgtgtggctctgagatgagggaagcgaggatgttggatgcagcacatctggctgccgggcaacagcaggggaagggatgcaggtctgtggtacctcaatacacagaactggtcatgccagtgttggactgtggttctgtggctcaagtttnnnnnnnnnngctgtggtacctcgatacacagaaatggtcatgccaatgttggactgtggttctgtggctcaagtttgtgaggtcagatgatccatacagcttcacaggggagttgtaaatgctgggaacctgcatctcaccaaaatcatctcccctccccacgccacacagaccacctggaccgggccagcgtcaagtctctgcatgcgcgattcggcgaggccttgagctggtacgtcccgctcggcctcgccacctggttcagggccgagggcatctcgaacgtgcgggagctggactggtgggaggaggcgcggcacccctcgcccgacggctccagcgtccgcctggtgttgaccccggcgcagcacgccacgatgagggggttgtgggggcccaacgccgggcgccggcagacgctgtggggcggctgggccgtgctcggctcccagcggtgagaccattgagtggagatggggcatggctggcaatccaacggttggattgtaacaataccagaccccgcgcatcctcccggggggcgccccccgcctgannnnnnnnnncggctggcaatgcaatggttggagggtaacaataccaggccccgggcatcctcccggggggcgccccccgcctgagggtggcacccttttgcaccggccgcgtcgccccatgtcgccacgatgcgagtgtgagccctgtctctccccccattcccctcactcaaacacacgcaggcggttctggttcgccggcgacaccggctactgcaccgtgttccgggagatcggcgagcggctgggccccttcgacctggccgccatccccaccgccgcctacctcccccgcgacttcatgcgcgcgcagcacgtgaatccagccgaggcggtccggatccaccgcgacgtgcgcagcaggcgcagcatggccatccacctggctacctttcccctgaccgacgagcccatggacgagcctgtgggggagctgcggcgccaggcggcggccgctggtctgggggacgaggagtttgtcagcctgcgccacggcgcctccatcgtgacgagcggtggggtcgatctggtggcccccgtcacgctctcttgttgagcttttggggggatgcagtgggggccttgctggtcgcatgacccctgagcagtgtcgaaccgaggctgtgagcctggagcagcacgtctctgaatgaccccgcctcgttgctcccctgggtctcatgcctctctgccaccttttgttctactctcactccctgtgccgcctcgccccgtttccatgttctcattgttcttttggacactttctcacgtgacctccatggtcagtcatcagcatgttaacgaagagagcattgctgtcatgggaaacctgagaacagtggcgacaaccagcctgcgtcggacctgcgccgctcatgtgtccgcagctccgtccaggacggcagaaagcctggtcgctgccaccacgagggcctcggctgggacccaggcaaagcagactcggaagtagccgggctcggcggcatggcagctgtgcccggtggtgacgaccaccctggcctcatcgcagatgcgctgccagagggcggcttccccctcccagccctgcttcggcagccatttcctgcaagacggggggatccacatgagcaagcaggtggtgacatgtcgacgaatcagggcaccgaggaccttgaacaggcgtcccatgtcgctctcgtgccatccctgccagcgatcgacggcatctctgaagcaggggcacagatgcatgctctgaacccgatgagctcagatgccgcaaaggtcagcgctcacctgaggtccagccacacaaacatggcagaggtggcgggggtgaaagggatgcccgcctctgtcagcgcggctgtcgagaagaaataggtgccttgttcagggagcggcagaggtattgcaagggggtcctgctcaccatctgaagggtgcatgcgacgtcaaagcctgccatcagaatcgccacgcaagtcacagccccgccatgcacctgagaatgctgagtaggacagggccagctgcctctggttctctgccacccaggcatccacccagtcaaggtcagagagcacgaccgtcagggcatactgcagaagattgctcgcctgggagaagggtgagatggagccaaaaacctgccaggagggcatagtgtatggagcagcttggggagggcgattgagagaaggggtccggccgtgctgtgcagaagcatgcaggctctgtgtcatgcaggcacccggaggcgaggagctcagtggacggcgtcatccggccagctcactccagcgcccccaccttcttcaggctggcgctgcgggtgtgcaggacgccaaggcgcagccccgacccgccaaagtccttgctcattccccagagcaggtgcaggtgggtgtccacgccctcctgcgtcagcgccccctcctccaccaacccctgagccacgcgctgcatgctcacaaaggtcgcctcgccgtgcacactcagcgcatagatctcgtcgctgcgtgcggcgaggggtggcggggccttgggggcgcggcgattgccttgggggcgcggcgattgcagtggatccgcggcggcagcaggcctgcctggcacgacttgggcaggcacaggctcccggaggaccttcagcttttcggtggtgcagtggcggccaaaacagccctctccccctttccaaatcctgactccttgccaggcccctcacctgacgaggtggacgccattcttcacactccactcaagcatggatttgagcgtggcggttgagtacacgatgcccagcgggttgttagggttggtgatgaggagggcgcggatgggcgacccggcctcggctgccgcggccgccgcctgggccaactgggcagtcacgtcgccgtcttccacgaggtagaacggcactggaaccacatcgtccttggcctgaggggtggtgcaaaagaggggtgtttttaggatggtcttgcaggctactggctgaccattgccctccacccggcccctggaggctcacagagcccctggcgccccagggactcaccatgagatccatgtcgaaggaggggtagtaaggggcagggatgagcaccccctcgcccgcgtcggccagcgtaaagaagaggtggtccaggaggggggtgaccccgttgctgatcacgaggtcgcgtgcccgcacctcaaagcccttcaggaaggtgtggcgcagcagggcggccagcacctcctgcagccgggggtcgccggtcatcctgcgatgtgtttgaaggcgccggttgtatgatgcccaccggcatgcatgtgaacttcagatgggatggcaccttgccgagcaccggccaccacgacgatgcatgcattcctctcctgctcctgtccatccccacccctcaaaacccacatggtgtagttcatcacccagtccggcaggggtcgggcaagggcttcctgcatcctgtgcgcaaaggcgtcgctgtgcagcttgttctcggccacggcgatgaggacgtagccttccgggttgtcctggctcctgaaggggtgcaaaagcatgaccttcagtgacccgggcgggcgggcctgtcagggacccaggccccccggcctggcatcgcctcctcaccactggtccatgtagcccttcatgaaggcctcgaaatgaggcgcgggcttcagatccagcaggcgctgggaccgggaagccagggcgcccttctcgacaggcatttttggtggctctcctgtgcagacacggatgtgtgcagatcgcgagaacccgcagatcagctgtactctgcggtccgcccagggcaaaagctgtcggcgcccaggtgggagatggctcttgatcgaccagacagatcacttttcaatacgggttttggatttatttgtggctaggaagcatgcggggcttgatggttgcaggtttcgggttgttcagcgccccaaacaggacagtaagcttacgtaaccttgttcacctccctaacgattcatgtccttgcccagccggctctgaaacctcgaaaattctgcggactagttgacaaaccaatcacttcacatctcaccaagtcaacgtactttgaagtgagtttttgtttggcgccccacttgccataacagtgagatacccatgcaacagcccacacgccaatcaggtgtgggactactccttaacattgttgcatgctgcagccgtgtcacggatatccatgcgtgccagcctctgagctctgagttgtggtggctctggcacccgctggcagtgcctcaagggaatcaagaatgctcttgaaattcacatcactggacatgctccttctgtctttgtcattacggttctgtgagagatctcgcgcctgccctgccagtaacccgcccctcatctgctgggagtgctgccttgaagggctcataacaatcaacaacccagccacacctcatacacagcagccgccgggtctcgtgtcgccctgctcaggccctcaaagcggagccggggtccgagaaggtgcgccctggtgattgggacgtcgtccaggaaggcacggcgcagcgcctgccccgccgcgcccgccaggcccccctgctgcatcagcgccatgccctcctcccggtccatggtcgcatggtagaaagcgtgcaccaggcgcaggaggtgcagggccgaggtcccaccctctggcaggtcatgggtttggcaggtgtgggccagggttcccgtgttgtcgcgtgggaagactagggtcaaggaagggcagcgtagcaggacctgggcgtccccttgctcctgggtgggatcgggctggtggggcgagggtgggcccgtctcctcgtcctgactgtcctccacccagtctctgtgagcgggccgcggtgcgggtgttgtttcaaaggaggaggaaggtttgggtcaagggttgtggaggtgggcacggcgcctgcatgggctggccctcccagcacgaccaacattctggccactaggccatcgctggccctccctcacccaggatctgcgggagcggaggaaccttctccagcttcttccagctcctgcctgacttcccagcaagtggcagggtcctccagcagcgaccaggagacgcccatcagcagccgggtcggcagtgtgctgactgttgtgggtggctggcgttgaagttggaatccaatcgggaggatgtatttgctgctgcgcacagaccctcacgctgcaactcagcgaccaggctgtgtggagtctgccctgccctcctcacatcaaggtgccctgcaactggcctcccaccactcgtacagcgcccttggttgcattcccggccagacacaacatttccctcacactgaaagtgctgcggcgccgcgccagctctggactccagggcttccacaaatgccctccgacgctcttctcccatcctatccgccgaagcatggcacacttggggctctgccacaacagtggcaccccccagaatgtcatgctgccgtgcaagatcagcggagaccgacagctggcgctgcttgctccctgctttccagctttggtgcacccagtctggagataacacgcctcgccctggcacggggcatgtaatgatgcagtcagcaacaagattcgacagcttgttgacgttgattgcaagcttgctctcatgacctgtgcagccgnnnnnnnnnncaacacgcctcgccctggcacggggcatgtagtgatgcagtcagcaacaagactcgacagcttgttgacgttgatggcaagcttgctctcatgacctgtgcagccgtggtggaccattccggtgccaggaatccgattgcaaaaacagacagtaagtggccactgcagccctaagattggggaggagatcctctcacccgctcgcaaccagcagctggctttggcaaggaggcacacgacatgcgaggcttcatgcgctccgcacagggtggctccacctccctccagctccctcttgcacctaggagggcaggacgcaggatgagcggccgtgccttcttggatcggacaatgcacagaagttgccgcagctttgggtgaggagtccagtgacaagatgatttgacaaatctgcccctacagagccccctgtgcaattctccatcccactatactcctgcacctctgggannnnnnnnnncatctacccctacagggcccctgtgcaattccccatcccactatactcctgcacctctgggagacgtccctactcaatgctgggtccaggacaacacgcatgcccccaaaaagggcagctggcggctgcttcacggagtctcgtgccaagcaattctgatgtggtaagttggaagatgttctctcctgagcttgcccaagttcgacgggcagtactgccggcgcaggtaagcctgcagggaggcgcagcccatccatggcgtctgggggactgtctcctctgggcagggttgcagtctcttgcgctggaggcctgggcttcttgagctgtggacactgcagggaagcctgcagtgttacaagatgtgcatcaagtcagcgctgaaccaccaaaaggacagcagcgcttctctgctcgagnnnnnnnnnngttgagctgtgcacactgcagggaagcctgcagtgtcaccagatgtgcatcaagtcagcgccgaactatcaaaaggacagcagcgcttctctgctcgagcgtgccaggttggcaccaagcagactgtgcagatgctcctgtttgccacaacgaactgtgttccatttataacacagggccacccacctctgcttgtctctccctcagtgcagccaggaggcagctgtgggacatactcgaagtgcgagccgggggtgccgccggctgcaccgaggcataggtggccagaggtgagtctggcaggggtggcgcagccatgcatggcggctctggagggcaggcctgccggtgcgacctggcggttccagtgctcaactcaggctgacaaggtgcagttaagttttggccccagttggggcgccatacattctccttggcgtccagggaagacggaggcagcagcctcttactggcaacacatgcctccnnnnnnnnnncgggccgccatacattctccttggcgtccagagaagacggaggtagcagcctcttactggcaacacatgcctcccaccagctctcgtccgcgatgcagaggccccatctgctgtgcagtgccaatgcggcgtcgagtttcggggaggggcatcgtcccgcctgcccagcgacgagtagatgtgtgcaccgcctcgacagcgatcccgagtacctgagcagcatgtgcgatgggagtagtagtgtatcaggtgtctcatacatcaaatttctcatctcatgggtggatcgggagccatgctcaccgtcctcctgctgtctccaccacctcccgaatgcgggctctctgctcgcgatcgaatcccgtcaagcatagaagcacaccagcagcccactgccactccatcgcttggagcacggcttgttgggaaaccactgtcttgcctacatgaagtgcccgacgtgtccaagccctgcgtcgctgtccatgcagcgcgttcaaaaatcgtaaaccgggcgcgttgtcggcccaaaccatacttcccaccgattcaatcccgattcgagcatgccatgctagttctgaaaaatgaaggtgcacctcgcatgagcctcaattgacggggtggcgaggggccatgcggcaccggccccagcacctcgggccccgctccctggcgcgtcggcaccagcgggccctggcatggctccttggcggcgccatcgtcctgacgctcatgacgctccatggcgacaaccagctacatcgcagggccgaggcggtccaagcccacggccagtcgggtctcaacctgggcgcgttggacaacgagcccgacgtcctgaggacgcgccgggaccccaggcccctcctggacgccccggtacgtggcacaaagtcccccgtccccaccaacatggacgtggtcgtggagcgggtgcgggacagggcgggccggtcaccccgtgttgcaggcgcctctcctcccaggcggcatgacgaccggggtttgggcgcggggggatcggtcaagcgggggccgccctccagagccgcaccccgctcnnnnnnnnnncactcccaggcggtatgacgaccggggtttgggcgctgggggatcggtcaagctggggccgccctccagagccgcaccccgctccacacgcccgtcagcagctggtcatgcttccctgggcgcccgcagctggcgccccgctgcccccgaggccgctagcaactggacgcaagccggcatcaggctggctgtcctggtgccgctgtggcgatcgcagggcctggtggagccgctgctggagcacctgcactcccacatccaggcccagggtgcgggactggaatggagggtggagacactgctatgcccggctcacactgtgtcttttcgcggctgggctgttcgcttccgtagtcagcggcccctgctcagcgactacactttgtgacgcccttccctcagagnnnnnnnnnngcgcggctgggctgcgcgcttccgtaaccagcggcccctgctcagcaactacactttgtgacgcccttccctcagagttcatcactcgcccaaacccactctcatacctcccctcccgctcctcctggtgcagccggcatcgcagactaccgggtccacattgtggagcaggaccccgcgcaaaacttcaccnnnnnnnnnnatacctcccctccccctcctcctggtgcagccggcatcgcagattaccgggtccacatcgtggagcaggaccccgcgcaaaacttcacccccggcctgctcgtgaatgtgggcctggcggtggccgcagaggtccaggcccttcgcgaggaggacgtggtggtgtaccagcagcccacgctgctgcccgcaggcagcgtgccctactccctggcgccgggccagcggttcctgcacctcgccaccggccagtccttcttcggcgggcgcctgccatacccggggtactgcggcggggcctgggccatgcgggtgggcaccttccgggagctgcggggcatggccaaccagtacgtcggatttgagggcctggaggacgacctctgccacagggtggagcagctggtgagaaattggaggggaggggggggtcaaaggaaagggtggcggggtctgatgaagaggaaggctgccagggtttgggggagnnnnnnnnnnttcaaagggaagggtggcgggtcctgaagaagaggaaggctgccagggtttgggggaggtttggaaggtgtgcgcaccagaatgctctgataggtaccatgcagcagccctggctcggtgctctggaggcaccatgcctcttgattctgattggcctccagccacagccccctggcacgtcattgcacacatgaattcgctccccgcttcgcatagacgcggaacctcaccatccctgggctggaccccgcgcggggccgcttcacgaatcgcgacgaggcgatggttgccnnnnnnnnnnaaacctcaccatccctgggctggatcccgtgcggggtcgtttcacgaatcgcgacgaggcgatggttgccaaccacctggcggccctgcaccgccccgccaaccagcgcctgttccggtcccggtggcaggccggcaacggcacgcgtgagatcgccgacgcggtggcggggacggcgggggacggcctgcacgcgctgccggaggcgtggcgcgagcggctggccatccgagaggaggcggcgcaccacacctggtggctgctgggcaggccgccggacgccgacggctgggcgggggacggcgagccgggcgacgcggacgccaacgccgccacggttacgctgctcagccgagacgcacggtcggacgtggggcttggggacacgcgggccctactcagcctcgcacacgggcccatcgactatgacgacctcctannnnnnnnnncacgctgctcagccgagacgcgcggtcggacgtggggctcggtgacatgcgggccctgctcagcctcgcccacgggcccatcgactatgacgacctcctagcctgacgcacccgcgtcaggctgggaggcgaggaggccagcgtcgggtgaggaggctgcccgctgcgctgcgagccacacgcctcgcccttggccgactgcggcccatttccctcttttttccacacagagcccagatcgttacctctcgcgcctgttccctgctcctaaactcccagtctaaacccccctcgatctcagcacgccttgccccttgcatcgccaggaccttgccttcagcccctaggaatcccttgttgagaacccccctccttttcccacgcctggaacccttgatacgcttgccagcctctgctgtatctttccccagctttctgcggtgtcaacggccgagttgccatgggctcggcatgccagggcacagcgggaccatcaagagcgcttggggaagtaagcctccagcttctccacggccgcctgcagcttggcatccgtcttgcagatgacaaagcgcacgagctgcttcggcgccgtagtcctgcgaggaatttttggcatggactcacggatgtggagctggatcagcagcagtgggaaggtcctgcgcgatgcctgtgccgcattcaccacccatatacagcacgcaagaccccaggcattggtagccaggggggccagttctacgctcatggtggactgcacaggcccacctgtcctcgtagaaggcgctgactgggatcagtgtgatgccgccctctgtcgtgagcctcgaacagaactggggcgacaggttttgggattcaatgtgatgcagagcgaagcgtgccgcagaaggacagctccctgtatttgcggctaaaccaaacagggaggacgtatggatcccaccaccctcacctcaacgtcctcctcggtgctgttctcgggcaagnnnnnnnnnngtccccatatttgcggctaaaccaaacagggaggacctatggatcccaccaccctcacctcgacgtcctcctcggtgctgttctcgggcaagagaccggagaagtcggtggtcagaaagtaggtgccctgaccaggaagcacctggaagagagaggtgggaggggtgtgggtgaagcctgtcgacttctatgtnnnnnnnnnnnnnnnnnnnnnnnnnnnnnnnnnnnnnnnnnnnnnnnnnnnnnnnnnnnncaatgtggcctactgcatggcgcctaaccagccaggatttgtgccgtcaccatttcagcctccacataccttgaagccgatggcggtgagcttggctgccagccactccctcttcttgaggaacatcggccccaatctagaaggtttgcggtggggggatgcaggtggtgagcgggtgggagctgagagacggttgaagccacgaaatacgtccttgcagattatatcctgcctgatgattcctccctcgccagccgctgtgactnnnnnnnnnntgatgtggcttatagcatggcgtctaaacagccaggacttgtgccgtcaccatttcagcctccacatannnnnnnnnntgcgcacaccctcaccctcaagcagcccccactccccacccacccttcgtagaagctgcgctcctccctcagcccccgcgccaccgcccgctgcagcgccgccggcaccgtgaaggtcaggaactggtgggccttggccgcggcctggaccatgggcgctgggccggtgacccagcccaccttccaggccgtgaagctgaaggtcttgcccgcagacccaatgcggatactgcgctccgccatgccaggcagcgtccgcagcgacacgtgctcgtagcctgaggcaagtgtcagtggagtagaggaaaggatgtcaaatatgcggcaggtgttcaaaacaaggcaggattgaaccactgggcggcgaacctagttgcgctcaaggctgcgcccccagcaacttcagaatcgcacctgggtaaactaggtgctcatacacttcatccagggctgcataagcatcgtgctcctgcaccagggaagcaatggtctccagttcagcccgtgagaaaacctgtggtggtgggtaaggaaggcgccaggagttgtgaaggggcccggcagccatgcagtgttcgttcctgagggaaccctgtgccagatctcctgccgccgcacttgttgaggtttgctccgtatcatcatcacctacccatgagaaggtacaccatgttacctttccactggggttgtgtggcgtgttgacgacaatcagcttggtcttggcgttgaacgctgtggcaagctctgcagcgggtgggtgggcggggagggcagaagtgggctgctttgcaccagcccccctgacccacagcagccctgaaacagtccatgctgctgctgcaaaggggcagcatgcaccgtcacaccacccatcccctggcagcgccagtnnnnnnnnnncttgcaccagcccccctgacccacagcagtcctgaaacagtccatgatgctgctgcaaaggggcagcatgcaccatcacaccacccatcccctggcagcgccagtccgcacctgccgcgtcaaaggaccaatctggcgcccgcagttggaccacaaccggcaccgcaccagcccttcgcatgatagggatgtaggagtcgtagagcggcgcaaagaccacaacctcgtcccctggctccagtaggcccaggaaggcggctgccagggcctcggtggcgccgctggtgatcagcacctgggactgccagtccaaggggaggcccgtgtagcgctcgctatgttctgccagcgcctggcgcagctctggcacgccgaccatgggcgggtactggttgctgtcatgcagcatggacctgggtggcagcaccaaagggtaggagggcggtgcagtacactcaatgcaccgatcacccagatcaagggagccattcctcacccttccgcaacttgcacctcagctggctcctgcacccctcccgattgagagtccatgtccagaatgcatcccggaaaacgaatccccattctttccaaaataccaccggccatgccccaacgcactggtacgcggcctccttcannnnnnnnnncgtccagaatgcatccctgaaaacgaatccccattctgtccacaataccaccggccatgcccccaacgcactggtacgcggcctccttcatggacgcgggcccctccagctcgttgtccgggaatccctgccccaggttgatgctgccatgcctggcagccagctggctcatcagctcgaatattgtggtcggcaagccaccgaatgtcgaattgaagccccggctggacatggctggcccagcgcggcgcggaggcaggtatacttgtggcaggtgtgtcggaggtgactgggcagcagcgagtgagggcctgactacatttctgacatgggagttgagggtgcgcaacatgccatatgccgatccagtgccactgtttgaacagggcagcagtgaaggttgcatgacgtcggcagcgtgctcatttgtgtgcgatcaaaaacgaaactgctccacgtggccgcggcggtgccgttccggtgtacggagatgttgtaacctgagcctgtacatgatcactacaagagaccattgttgtagccggaatgcagcctgaatatggaggatgctttacatgaatgctttcagtgagggtggatcacgaactcagattgcattctggaccaaggggggagcccatggcgttcacatctgccaccacttgcgattggagtagctatcggcgagctgcttggccagagaggcaaagttgccggcgtcatcctccagctccgccgtcctgtcctccagcctggacagcttctcgccgcgctcccccaggcgctgcatgttctcggccatcaccccggccacgccgtcgaccctgggggcggggggcaaggggggggaggggttggcacatctctacacatcatggctggtaggggcccgagcatgcgcttggtggtgccttctgacacgccaaccccgcaagccggggctgacgataccacctccaccgctgccaccaggctgggccccgccgtgcccgcgcaccgcttgctggtggtcggccgaccataggtccgtttcaccatggagacggtgcggttcacagggcgggggccgccggcggccgggggcgtggcttccctcggagtcgtggacggcccggcgagcggtgggggcaccccccagccgtgccgggacgatggcagggcggcacccgctccagccagaggtctgcagcaaccgccagacggtggagggggaggggtgggagattgaccccggggcacaagaccctgactgccgagcagcaggggtgcgagcggaccgcatgcaccggggcatggccggcggccgacgcagacggcgcagctgggacgctggcactggtccagcctcgtgcgcccccatgtcccagtcagccgcggggtcgtgtggtcctactttctcccccccatcccgacacacactcacccgacctctgccaccggcttgagggctcccaggctgtgccctggtgccgatgccccgggctccacctcgtcgggcaggtagtccaggtcgatgctctcctcggactcggacttggactcggcgccaaacaggtcctggaggggtcagcaggcggggctgaggacctctggaagatgtgtgcatggatggttccaggcgtgctgatacagcagttggtaacggggatatccacacggcgggtaaaagggtcaggggcacggctgtgtggcggggggagttgggcatcttccccccctccccattcctctgcccgagaatttccttcgggccactcccaaccacagtcctgcacccacctccacgctgggcagcgtgctcgtggcgtcgggttgcgcgccgcttgaccccggcatggtcaggcgttggagcgaggacacgccggccacgcgcgcgcggtccagctcctgcgggaagtggtgatggggggctttcgggggcagnnnnnnnnnncgcccgagaatttccttcgggccactcccgaccacagtcctgcacccacctccacgctgggcagcgtgctcgcggcgtcggggcgcgcgccgcttgaccccggcatggccagccgttggagcgaggacacgctggccacgcgcgcgcggtccagctcctgcgagaagtggtgatggggggctttcgggggcaggaaagcatgccgcaggtgcctggagagatccttgttgtgccccgatctgtctggtcccaccatgggtccatgatctaggccacacccctggatccctcctcatcaaggtactccccgggccccaaacaggaacccctctccgccacgtccttcccctcgaaagactgaacacaccttgagaacgcccatgggcaggcgggaggcgccctccaccacgtccagcgcagtgcccctgaccccttcgaacaggcgcgcgcccagggccaggggcgcggaccccgagtccggcctcgcaggcggcgggaggggcgcggcgcgcggcgccgcgcccctcccggctgcctcggccccgcc

SEQ ID NO: 48087 - DNA, 61 bp, Chlorella protothecoides
acaaacatgagacgacacagcaccaagacgcacgccgaccgcgcgccatgccccagagagc

SEQ ID NO: 48088 - DNA, 61 bp, Chlorella protothecoides
ggtccaggagggacggcactgggcttgtattggaggggtgacttccttgcgtgatcacatg

SEQ ID NO: 48089 - DNA, 70 bp, Chlorella protothecoides
taggaggtcaatctgcagatgcgatgtgtgagcgcgcccggggcttctcatagcaattcgcattggcagg

SEQ ID NO: 48090 - DNA, 95 bp, Chlorella protothecoides
ccgagggcaaagtcggaggcgtcgcaccagatgacaaagtccttggtgaagtccgggcaggcgacgatgggcgcggacagcaggcggtcgcgcag

SEQ ID NO: 48091 - DNA, 146 bp, Chlorella protothecoides
tatggaacaatttggacttatttaggttgcatccagtctatggggtcattgacttacttggcgcggactgagcttgggtcggtccggccgagactcacttgtcgacgtcacatgaccgcgggccactgtacagctgcaggacggga

SEQ ID NO: 48092 - DNA, 135 bp, Chlorella protothecoides
agggtatgcacgagaggcagaatgagttgaacgtaggagtgggtggccagtctgtcatagggacacttatctcggcacggtgctttgtccacgacttgatgccctaaccttcaattatctggttcatctgcagac

SEQ ID NO: 48093 - DNA, 61 bp, Chlorella protothecoides
gtcttcagggcagtccctgagcaattaccttataccccccccccccccccccccccccccc

SEQ ID NO: 48094 - DNA, 4237 bp, Chlorella protothecoides
  modified_base (900)..(909): a, c, t, g, unknown or other
  modified_base (1014)..(1023): a, c, t, g, unknown or other
  modified_base (1128)..(1137): a, c, t, g, unknown or other
  modified_base (1349)..(1389): a, c, t, g, unknown or other
  modified_base (2709)..(2718): a, c, t, g, unknown or other
  modified_base (2981)..(2990): a, c, t, g, unknown or other
  modified_base (3130)..(3139): a, c, t, g, unknown or other
  modified_base (3601)..(3610): a, c, t, g, unknown or other
  modified_base (4050)..(4137): a, c, t, g, unknown or other
cccccaccatgccaccccccgccccacccaccccccgaaattcgcggcagggcggagctgttttccctggtgaaccagcaccccacggtctacgaggtggtcaccggccgcgttccgcgcaccaagatcaacaagcgcaagcagccggtgtacggcaaggcgtacgccggggccatgcccgccccggcctcgcggggaaccggggcggggcccaccgggcgcctggcctcgcgaccccgggccgagcagcaggcccccgcggccgaccggcccctgcccaccgggcggaagctgacctacgatgacgtgtcccaggcgctggtgggccgccaggcggaggtgcgctgcgacggggcgccggggggcgggccgcacggtccccggggtggggacgggcgtcacggacggtgctgcggcgccgcgggtcgtggggaatccccggcagcaccacgcccggcactccccccctgcatctcggggaggacccccccctcgtcccctctgcccctccgcctgcctgtgctggagctcccccccccctttccccctgcgcagttgtactggcccgacgacggcaagtggtacctggtggagatccactccgtcgacccggacaccatggaggcgaagtgcgtgctgaacaggctgggcgctgggtgggacgcccgggcggggtgccgtgctcctccctcaacccctcctcccaacctccccatgccccacgtgcattgcagggtccagtacgcgacgggggagtttgaggcgctggactttgacgaggtcatacccagcggccacatgtcgctgctggcaggctagcgaccgcctgtcccggcggggcccgcaacctggggccctgcaagcatgggacccccgctctggtacgcacaatggcacagnnnnnnnnnnaaatgcaaccttgcactgcagtgtcccgggacagacaggcgcgcgagcgacagaagggacagtcagatcgttgctcgtgggacgcaggaatcgcgtcaccccccnnnnnnnnnngaatgcaaccttgcactgcagtatcccgggacagacaggcgcgagagcgacagaagggacagccagatcgttgttcgtgggacgcaggaatcgcgtcaccccccnnnnnnnnnncgctagcggccgcctgtcccggcggggcccgcaccctggggccctgcaagcatggaacccccgctctggtacgcacaatggcacagcgctgctacacacctcctgacatgagcaggcatgtctcctgcatgcgtgcagcccctgaccttgacgcgcttccccctctccgcgcccgggcccagttcccttgacgcgcgagggcgatcgggggnnnnnnnnnnnnnnnnnnnnnnnnnnnnnnnnnnnnnnnnntcaagtccgcctgaaggtgcgaggatcgcgagcgccgggtgtccgtcttgtcccgctcgccaccgccgctccgagccgacatctgcagagggatcgaggcccacccagaggatgacgggggtagagcctcccagtactgccgtcaccaccgtcgagagcctgaggccggacgcccagggactgcggctgctcgtcaaggtggttggccactcaggggcagtggggacccgaacctaagacatgcctgcatcaagattgacattttccctttgacgagcacacgttcaggttgtggatgtgaagaccgtgctggacaaggctccgaggccgaacggcaggacacagaaggtggctgagtgcttgattggggacgagacaggcaccatcctcttcaccgctcgcaatgagcaaggtaggggttgaatttggttcacaagctctggctcaggagagggcaaaggtgccagtcgttccccttccctgctggcacgacgccctgccaaccactgttgccccttcctgccatggaccagtggagatcgccaagcccgacacctacctcgaccttcgtggggccaagattgacatggtcaacaacagcatgaggctagccgtggccccaggcgggagcatggaggccgtgacagggcacactttcaacccccgggtacgagtggctgagggaggagccgagccgcctcccagtatgcacaggcgtggctgtccacccatgacgctcccggcaagtcctccaaccccttctccctgatgctgtgtagaccgacttcaacctgtccctcatcgagttcgagctggtcctggtgccacgggaagaggctggccccagccccgctacagtcgggggcatcgatccagctagagggccttccctgacaggcggagccgagggcacggaggagcccagccaggcgatcccagaagaggaaggttgaccggttccttgcagcggcccgatgggtcccaaacctgttgctccaggatcttgttattggcccctgtcgtgagcaggcacccgacatgcatgaggctgcccgtgaatcatgtaaccctggacaactttaccgggcggagcccaccattggagatcgggcagagcctgctgcggtccacacgctcaatcaacggtgtacggcggggatgatggtccggtggtgtggtgcaagcacagggcactgggctccttgttttcaccgtcaaggtgagatacgatcggtgttttgccaggacaagggggcccggcaaccccttcttgtcaaccatgctttgaggacggcgctgtatgcacatgtctgcacaacnnnnnnnnnngcagggcactgggctccttgttttcacggtcaaggtgagatatgatcggtgtttcaccaggacaagggggggcgacaaaccctccttgtcaaccatgctttgatgacggcgctgtatgcacatgtctgcacaactggtcagatattggcttgaggcagctttgcaaagacactccacacacatcaaggtggcattgtaaaagttgatactgggtgtgggttgtcacttgattgcatgcgcctgagtgggaggtcaggcctcgnnnnnnnnnnaagttaacaatgtgtgagggttaaagagggccctagagagatccccagcatgggatggaaactcaaatcagcatggtgcctcagccggctgtatctcagcggtcgcatgttacagcagtgcatgccaggtatactgaagnnnnnnnnnntttgaggcagctttgcaaagacactccccacacatcagggtggcattgtaagaagttgacactgggtgtgggttgtcacttgatggcatgcgcctgagtgggaggtcaggcctcgctctcgaccatgcccctcccctctcaagagggcgctgtggaggggatgacggccgctgcgccttcatgcccagttatctatgtgtggggggtaaagagggccctagagggatccccagcatgggatagaaactcaaaccagcatggcgcctaagccggctgtatctcggcagttttatattacagcagtgcatgccaggtatactgaaggtctgctacatcactactccctcggcaacaagccacacgcagtctagctgagtggttgtgcagggaccttcacgcctgctgcgtaggcacggtatccaatgcagggaggggtcacagagttatacaaacctcatttgnnnnnnnnnnggcgtaggcacggtctccaatgcagggggggggtcacagagttatacaaacctcatttgacagaattgaccagttcagcatggtgtcacgaactttaaccttgaagcagtactggtcacccgccgtgaagattatgtccggcgtggtagtgtacaccttgactgctgacccaggtctccaagccggcatttgagtaccattttcataccacaagacccctacaaatgagaatgtgtatgtcgtagtggtaaatgtcaatttgttcgatcccgcaggtgtaaccgtcagggttaagattggtggaggtggaggtgaaggggaagggggtggtggagagggtggaggagagaatggagggggaggggctggtggagagggcggagacggagagggcggaggcggagagggcggaggcggagagggtggaggagagggtggannnnnnnnnnnnnnnnnnnnnnnnnnnnnnnnnnnnnnnnnnnnnnnnnnnnnnnnnnnnnnnnnnnnnnnnnnnnnnnnnnnnnnnngagggtggagagggtggagggggagagggtggaggagaagggggtggtggtgtgggtggagagggcggaggggagggggttggaggagatgggggagggg

SEQ ID NO: 48095 - DNA, 66 bp, Chlorella protothecoides
ccctcaccaccgccaccaagcccctcacctccaaccccaccaagcccctcaccttcacccccatcg

SEQ ID NO: 48096 - DNA, 20154 bp, Chlorella protothecoides
  modified_base (1090)..(1200): a, c, t, g, unknown or other
  modified_base (2096)..(2177): a, c, t, g, unknown or other
  modified_base (2349)..(2358): a, c, t, g, unknown or other
  modified_base (2477)..(2486): a, c, t, g, unknown or other
  modified_base (2606)..(2745): a, c, t, g, unknown or other
  modified_base (3769)..(3778): a, c, t, g, unknown or other
  modified_base (6907)..(6916): a, c, t, g, unknown or other
  modified_base (8000)..(8009): a, c, t, g, unknown or other
  modified_base (9653)..(9662): a, c, t, g, unknown or other
  modified_base (10594)..(10603): a, c, t, g, unknown or other
  modified_base (10664)..(10673): a, c, t, g, unknown or other
  modified_base (11044)..(11053): a, c, t, g, unknown or other
  modified_base (11107)..(11116): a, c, t, g, unknown or other
  modified_base (11340)..(11349): a, c, t, g, unknown or other
  modified_base (11478)..(11487): a, c, t, g, unknown or other
  modified_base (11575)..(11584): a, c, t, g, unknown or other
  modified_base (12170)..(12179): a, c, t, g, unknown or other
  modified_base (12941)..(12950): a, c, t, g, unknown or other
  modified_base (13971)..(13980): a, c, t, g, unknown or other
  modified_base (14374)..(14383): a, c, t, g, unknown or other
  modified_base (14973)..(15014): a, c, t, g, unknown or other
  modified_base (15182)..(15191): a, c, t, g, unknown or other
  modified_base (15256)..(15265): a, c, t, g, unknown or other
  modified_base (15330)..(15419): a, c, t, g, unknown or other
  modified_base (16341)..(16350): a, c, t, g, unknown or other
  modified_base (16456)..(16465): a, c, t, g, unknown or other
  modified_base (16634)..(16643): a, c, t, g, unknown or other
  modified_base (17523)..(17532): a, c, t, g, unknown or other
  modified_base (17996)..(18005): a, c, t, g, unknown or other
  modified_base (19559)..(19568): a, c, t, g, unknown or other
  modified_base (20012)..(20021): a, c, t, g, unknown or other
gcccgacgggccggccgccagcgcggcggccagcgtgccgtccgggtcgcgctgcgacttggcctcgcgctgcgcctcgacgtgcgccgcctcgcgcacggccatgcccttctgcgccgcctgctcggccagcgcggcctgcatggaggcgcgggcgccgctgtgcgcgctggggctggcctggtgcacggggaggtcaggggcgcgacctgccggcgagtccggggacgggtcccgcggagggtggcgcagcacggcgccggctccggcggcggcggcggtgacccccttgccacccccctgtccctgggagtccatctggagcagggcgcctcccgtgccagaaaacagggtgtcctgctgccgcgcgcgggcccgctcgccgatcttcctgccgctgaacagggcgctgtccatgagcagggtccgggagtgggacagcgagcccctggctccgctggccaggcccaacagacaggccagcgccccgaccacgacgagtgacatcggggcgcggccgcgcgcattcgccatggccttgtgtctgctcagaggtgggctcatgccctgctcatgcacctcatcaaagtgtgtgacaggcacggggcccggagacggagatcacttccgagaccgttggtggcccgcggacgacaccgagggcctcggaacttgtgtttagattgatgaaacaccacgaggtaatcgttggtggatcagcagtccgttcgccgagacagcaaaggcccctgattcatcaccactcccgcaaaccccaccaacgaattcaacttgcagcgaggggggaatgggtaccgtgaacgtaccttgcgtcgaacctcgacgctcatccatcacccaaactgtaaaggcacatcaatctagcaagtataaaatatcttgctacatctccccatcactgtcacttgcgcgcttgctctccctcaaagttccagatggcgaagaacgtgttggtgacgggcggagcgggattcatcggtgggtcgcgatccccgggccgctaatgcacctttaatctaggatctggccgtggcgattgcctcgagcagctgggtcggtgtggtcgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggctctcctggagcatggctacaatgtgacggtgatcgacaacctggagaattccaaggaggaggcgttttaccgcatgaaggagctggctggggaccgcaaggacgccctcaccttcatcaaggtacagggtgtttgggggggtaatgtgcggggacgggtagggacctggccggccccatggctgcacaggtggtgtgcctgcatgggtgcatcgcggtgcgtcatgtgtgcagcggcttgtccccctaaccacgtggcgccatgcatccacccctgcagggcgacctgcgtgactttgccaccctggacaagatctttgccgagaccaagtgcgtctccggtggaggggtggttcttgcagagcggtggtttccagcgtgcccagcgacgtgcgccccgccgtgtcctctgggcgagcgctgggcctgttgagcatggcatccaccgcaggtccccaaccccatgccatggccccccgtcccgtgacctcctcatccacactcccctgcccccttcccacccccaaaatacccaggttcaccgcggtggtgcactttgcggctcgcaagtatgtgaacgagagcgtggaggacccgcttcgatactacgaccacaacgtttgcggcacggtgaacctggcccgcgccatgcagaagcacggcgtgaagaagctggtcttctcctcctcctgcaccgtgtacggtaacccccagcgcgtccccatcgacgagagccacccgctgtgcgccgtctccccctacggccgcaccaagatcatcaacgaggacatcttccgtgacctgcacgccagcgacaaggagtggcgcatcgtcctcttgcgctacttcaaccccgtcggcgcacacccctctggtgaggggggaaggggggnnnnnnnnnnnnnnnnnnnnnnnnnnnnnnnnnnnnnnnnnnnnnnnnnnnnnnnnnnnnnnnnnnnnnnnnnnnnnnnnnnggcacccgggacagtgcttgcgtcgcggctgctctcgcctgcggcatgatctccgggcgaggtcatccctgcctgccgcctgattcccacccagggtctgggcctggtcattgagacccgccatctgtccacgaacgccgtttgccccatcttttccccctggggaagcccnnnnnnnnnngccatgggggcgtgcagggagcgtggggcggtcatgcctgggctcaagaccatgggcggtggtgtcacgggtgtcctgtgcaccctgatgcgcacgtgtcgagctcgcggctgccgggnnnnnnnnnncccatgggggcgtgcagggagcgtggggcagtcatgcctgggctcaagaccatggacggtgggtgtcacgggtgtcccgtgcgcccctgtgcgcacgtgtcgagctcgcggctgccgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcctgattcccatccggggtctaggcctggtcatggagaccccccatctgtccacggacgccgcttgccccatcttttccccctggggaagccccttgcctccaccccccccaccccccaccaccccgtcttccattcctcaaggtcgcatcggggaggaccaggtgaagctgaacaacctgatgccctgggtacaggccgtggccctgggccaccgccccgagctggcggtgtacggcaccgactacgcgaccgaggacgggacctgcgtccgcgactacatccacgtcatggacctggcggagggtcacgtgggcgcggtgcgcaagaccgaggagaccgagggcctgggcaccgtggcctacaacctgggcacgggcaagggcaccaccgtcctccagatggtccacgtgagtgggagaggagtgatgcatgagggtgatttgggtggcacgagggggaggaaggcggtggggtgggcgcggaggggcggcatcgcgaggccacgctgtgggtgaggtgggagtgtgcgcctggggggcttccaggcacccacgcggggttgagcgtctgtcgaagcaggcatcccgagtggcagccctcaccgccgacccacgcgtatttaccccaccccctcctttcatccccttcaaccatctgctttgcagggttttgaggcggccagcgggctcaaggtgaagaccaagctggtggggcggcggccgggcgacgccgaggcggtgtgggccgccaccgacaccgccgagcgcgagctgggctggaaggccaagctgacggtcaaggatatgtgcgaggaccagtggcgctgggcctccaacaaccccgacggctacgacaccgccgccaccgctgcggcacgctgagcgcaggcgaggggcggagcgcccgtgcctgcgcctcctgtgcgtcaccctggacgaatgaactgctgagcctgtaaggcatgatccatttgaatggtgaatgaagaacgatgagcgcgctgagggtgttcgaatgatnnnnnnnnnncacgactcatttgaatggtgaatgaagagcgatgagcgcgctgagggtgttcgaatgatgcctgcgtgcgtccctcccccaccacaccaacacccgcagcaggcgccgcatcttcgggctccgccccgggcgcgcgcctgccggcatgaaataccccctctcgccctgcctgccccgcacagccactctgtggcgccctcctgttgagccccacaccctagtactgagacaccatggggcagaagaagaagctgggaaagacgcgcctggataagttctactacctcgccaaggagcaaggcgcgcagtggcgggggacggggcccggcgcgagggaggaagcgagatgcatgccattgcccttccatgtgtgaaactgcgcatttggtgcatggttgcatattgcggggcgcatgctgcagggtcttcctgccggctgaagccccagccttaacccacaccgccctcctcgctgcaggtttccggtcccgcgccgcctttaagctcatccagctcaaccgcaagtatgacttcctgtccagctccaggtcgtgcctggacctgtgtgccgccccaggtgcgcgtgtgaggtgtttacttctggggctggacaggaggcccccccacaagccgaggactctggaaggcgacaccagcatgcgtcctcgctggcctttcactgttcgatccattgtgattttttattctctcgcgtggtcgtgtaattcctcccgccctgacccctctcccctccccaaccccccgccccaccaggcggctggctgcaggtggcggtgaagaacatgccggtgggcagcctggtgctgggcgtggacctggtgcccatccgccccgtgcgcggcgcccgcacgctgatcggcgacatcaccaccaccgagacgcgggccatgctgcgccgtgaggcggcgggcgcgctgttcgacgtggtgctgcacgacggcgcgcccaatgtgggcggcgcctgggccagcgaggcgtacagccagtcggcgctggcgctggaggcgctgcgcctggccagcgacacgctggccccgcgcggcacctttgtgaccaaggtgttccggtccaaggactacacgcccctcatgtacgccatgaagcagctgttccgcagcgtggaggccaccaagcccgccgcctcgcgctccacctccgccgagatctttgtggtgtgccaggggtacaaggcccccgcccgcatcgacccgcgcctgctggaccccaagcacctgttcaaggacgtggcggaggctccgcgcaacgcgggccccgacgccctggtcaagcagaaggtcacgcagcgccgcttccgcgagggctacgaggacggcctgtccagcctgcaccgcacgctccccgccgccgactttgtcctgctggacgcgcccatcgagctgctgggcaagtacaccgtgctggacctgggcgccgaggccggcgccgggggcgagggcgaggggcgcgagctggcgcgcttcgtcgccgaccaccccgccaccacgcccgaggtcaggctcctgtgcggcgacctgcaggtgctgggccgctccgagttcaagcagctgctgaagtggcgcctgaccctgaagcgcgacctggccaagcgggcgccggcggcggccgaggccggggcgagtgtgaagggggccgaggacggtaagaccgcggaagacgaggaggaggatgcggagacgcgtctgctgcgcgagatgggggagatcaaggaccgcatggagcgcgtggccaagaaggagaagaagaagcgcaaggagctgcgcatgaaggcgcggctgcgctccgcacagatggctgaggcggagggcatcggcgaggataatgggccggagagcatgttctccctggcctccatcaagggcagcaggcaggccgtggagcggctggcggcggcgggcgtgccggataccgaggatctggactccgggtccgaggccggggacgtggcggaggaccccggcaccgagtccgaggtcgactcggaggacgagcagaggcgctacgacgccgtcatggacgagtacctggagacgtcgtaccagtcgtggaaggagcggcagcgcatccggggcaagggcggcgcggcacgcaagcggcggcgccgggtgggcatggagggcgacctgtcggaggaggaggaggagggggccgacgccggggacgagcccgtggtcctgggcgggtacagcgacgacgacgacgacgatacccccggcgacggcggcggtctggtcgtggagctggacgagagcaaggtgggggtggccaccagcgcggcggctgccgccgcgcagtggttcagccaggacatcttcgccgacgccgacatcagcgcggcggcggagggggacgatgcagggggcgcgtcgggagacatgagtggcgtcgaggccgcgccggcgcccgctccggcggtgaagaaggcggggcagcagcgtgcggccgtgcccgccgcgcccgagccctcggatgctgacccggagcccctcacaggcgggcgctctggtggggcatctagggcggggttcgaggaggtgcctgccaaggactcggactccgactccgactccgactccgactccgagaacgagttggagctgctagacgacgatgccaaggtggggcgagcatcatttgtggagtgcggcagtctcgtgggattggtgtacaagctcctgtgtgggtaaggatctcggcaccgttctgcatccccaggggagggagtgggatcatgggggtcaatccaactgggacttgcaccgcgagtctgaggtagctgaaagaagataaaacatgtggttccatatacccactacctccctcaggccacgatgatggccctggccaagaagatgctgcggcgcagggtcaaggacgacatcgtggaggcggcctacaacagatacgcgttgtgagtgtcgcggccagtggggtgggaggatactcaggcagggcacctttacgtgggctcatttattggcaaggaggcgaaggtgtgatggtgtgcctctcctaaatgcattcacagtggaagcatacagtgactcccaatagggtctctgactcaagattcctccctttccactgtcnnnnnnnnnncggcgaaggtgtgatggcgtgcctctcctgaatgcatacacagtgcaagcatacagtgactcccgatagggtccctgactcaagattcctccctttccactgtcttcacacgcagccacgacacgggcctgcccaagtggttcgaggaggacgagaagaagttcatgcgccctgcgccccaggtcacgcccgcggagtacaaggaggcgcgggaggcgctgcgcagtgtggacgctcgccccatgcgcaaggtggcggaggccaaggcgcgcaaggccaagcgcctgggcgagcggctgagccaggcgcggcagaaggcagaggccatcgccaagtcggaggacggcagtgcgggggccaaggtgaaggagattgagaagctgtacaaggtggcgcgggggcgggggcggggcaagaagaagccctcccgctctgaccagtacaagaagaaggggccgcccctggacgcccgcatgcgcaaggacaagcggggtaccgaccgggcggccgcccggaggggggagaagaagccgagcagagggggtagccgtggtgggaagaggcggtagggctgttacctgtattgcctgccctctgctgcgccgccccaaccgactttcgccacaagcttgtacattacgatgacagacaggggggtcctccatgggtaagccaggttgattctggcgagtcaggaacctcgtttttgccaactgacttctcatcatgttcttagaaattgttgaatctgctgttggatggtggctggagcgcccaccctgctggcagatgttcacgctagagaaagctgatgaagtctttgggatgtggatcgcaccgagtgttcttccagaccttttcatgtgaaactagtcttcgacacaacagtctctgctatggcctggcagtctttccctccaatggcatctggcatctgatgcgcgcaagttttgcacatacaaccattgtggcacgccatcagcagttcaatcgagcacagtgtacccaaatgctaccagtagcagtcgctgacatgtatacgggggttgtacgagagccgagccgtgcatgggcccaaccgtgnnnnnnnnnntgcaccgagtgtttttccagacctttgcatgtgaaactagcgttcgacacaacagtctctgctgtggcctgtcttcccctccaatggcctctggcatctgatgcgcacaagttttggcacatacaaccattggggcacgccatcagcagtacaatcgaacacagtgtacccagatgctactagtagcagtcgctgacatgtatacagggggtgtacaagagccgagccgtgcatgggcccaaccgtgcacatctagccagtccgtatcccaggcggctgaccaggaaccctccggcgagcacggtgacaagtgcgctccgcaagaatccccccttaccatccaaacggaatcggttgtgtacttaaacgtgagtgatgcgcaaagctaccgcctgcgtgcacataaacctttcattcatcgagatcaaccatgggtacggcagccatgaccacttagtcggtgcccgactgctgtcgggcctgtacaatgcgacagaccttgcagaccagacaatcagcgacgcgtaatgttgctcggtatgctctatgaaccacatgggaatctttctttgggaattcggacactgtcgcacagaatcccaatcgttttgaagctgccgcgaaacgaaaaaaaatgtgtgacgattacgtcactgtgtgtgagtgcgcagcagacggtccgcatgaacgactgggcacaatacgggagggtcaacacggggatagcccatataatttcagtctgataatattatttccatgggaatcgacgaggatcagaaagcccgggaggctgggactccacgggtggtcccgtcggggaccagctacgggtccgacggtcacaggaacgcctccttcctggagcgcacgcacactgtgaagctgcagatcggccagacagatattggaaacctgtccattatcgagtccataccaccgaacaagcgcgtggtggtgcagatcaatgctgtgagcgcacatgtccccaacttcttctcggggccctcctggacctccaagctgaatcccgctacatggcggaagagcagcgcggccacgcccgtggatgaccgccccaccatgcgacaagtgcgtaccctgtgtcagtttggcgtcccccagtactgtgtgccctgtcgttttccatgaaccggcccatcggttggctggtgtgggtagccacatccccctcaccacttctggatgaatccagctcatcccccttcccaccttcccacaccacaaccccctcacagatcctgttcggcatccaggggcgcatcgagccaggcgaggtgctggcgctgatgggcccctccggctcgggcaagacctcgctgctgtccatcatgggcgcgcgcgcgcagaagctgatgaaggtcagcggcagcgtgactttcaacggcgcgccgctgaccaagcgcctgaagcgccaggtgggctacgtcctgcaggacgacctgctgtacgagtcgctgacggttgaggagacactggggtacgccgctgcgctgcgcctgccacgcgagatgtcggcggcagacaaggccaagcgcgtggacgacgtgatcaccgcgctaagcctggaggggtgccgcaagaccgttattggcggcttcttccgcaagggcatctccggcnnnnnnnnnngagtctggaggggtgccgcaagaccgtcatcggcggcttcttccgcaagggcatctccggcggcgagcgcaagcgcacctccgtcgggcacgaactcctcatcaacccctccatcatgttcctggacgagcccacctccgggctggactccaccaccgccatgcacctgctccagatgctgcagttcctggccaagggcggccgcgtcatcgtcaccaccatccaccagccctcctcccgcatctaccagaccctggataacctcctgctcctgtcccagggtgagttgtgtgttggttgttggggggagggagggcgcggagaggatggtatcctcaagtggctggcaaaggggtctacatttgatgcaaaatacggattgttgattttccagggacctagcattgccgctctcctttgtgctgcatggggacgaatggtgtgcatcaggtttaggatgatcttccggctcagctcgaggccctgtggacaacaacctcccgcccatcctaccacaaaacccactcacagggcactgcatgtaccacggcaaggcacaccacgccgtcgactggtttgacgcgttgggttacaccctgccctaccgcgtgaacgccgcagacttcatcctggacctggcatccgccgatgtgtccacggagggcggccgtgacggcgaggagacgcgcaagtgagtggctttttagtttcttaggggggggtccttgttgtgtgtcagctggggattgacagcttgaagggatgcgctcagagtctgtgctgctgaaactgtgttggggctgcaggccatggcaggggagggctgggtgccagatcaatggggctcaccgctggcctccaattgctcgatcagcttgttgatcccctgtctcaaccctccccccccccccccaaaaaaaggaaccgggggnnnnnnnnnnctggtgtcctgctctgagctgttcatggcaaagcaccccatggagggctttgactttgatnnnnnnnnnntaggtacctggtgtcctgctccgagctgttcatggcgaagcaccccatggagggctttgactttgataccgacaaggaagacctgcatgaggtgaggttgggagggatatcctgacccttaacaaactcagcccctcttggatggtgtttgtgcacatgaaacttggcgctcaaactcctggacgccacctcaccctgttccccactcatccatcgatcagatccgagagaagctggacggtgggtccccagacgtcagcacctccagcctggacccggtcgacctgaatggcggcaatggcctggagaagaacgggcaggggagcatcaaggcactgcatgtggtggcagaggagggcgggcagggaggnnnnnnnnnntcctggtccccactcatctatcaatcagatccgagagaagctggacggtgggtnnnnnnnnnncaccggtggggggcttcctacaaggaccagctcaagatcctgttccagcgctcgatccggacccggcgctttcaggtgcgtgattgtgttcctgtcatagcggttgatggtgttgtgcagtttgaggggggtgggaaggggttcctgcgtcatgctgtttttgtatgtggcatgttgccaatgcatcatcatgtccctttggggaaacgtgtacaacttgtgtnnnnnnnnnngatggcggttgatggtgttctgcactttgaggggggtgggctggggttcctgcgtcacgctggttgtggatgtggcatgttgccaatgcatcatcagatccctttggggaaacgtgtacaacttgtgtnnnnnnnnnnggcagggaatgtgggtatttcatagtacgcatgatcaatgtagtctcctgtacaccaaaactcacagctgctgtcagattgtgtttgnnnnnnnnnnccatctcctttcacagaacttctccgtgcaagacatcgcccagctgatggtgatcgccgtgctctccggcctcttctggctgcagaaggcccaggacgacaccctcctgtccgctcgaaacaccattggtgagctggcatgctggcaaaaaggcagggaatgtgggcgtttcatagttcgcatgatcaatgtagtctcctgtacgccgaaactcacagctgctgtcagattgtgtttgcgcacagcacaataaaaagcccgcccactccacaaactctctcccactccccaggactgctcttctttgagatcatgttccttgccttccgcatgctgtttgtggcgctgttcaccttcccggaggagcagcggatgatgctgaaggagcgtgccagcggcatgtacaggtccgctgcccggcagagtgtcgtgggaggggtggacgggaggtgtagttgtgtgttgatcgaggatctgggggttcgtggagggtcagtgacgcaacaacaccgtggacggcacctggtgggccgtcctcagctagggacatggagaacgagatccccaacccacttctgtctgccgnnnnnnnnnntccggcagagtgtcgtgggaggggtggatgggaggtgtagttgtgtgttgattgaggatctgggggtgtgcggagggtcagtggcgcaataacaccgtggacggcacctgttgggccgtcctcagctgaggacatggaggacgagatccccaacccacttctgtctgccgtccgtctacccctcctgcaggctgtcagccttctactttgccagactcatgtccgactggcccatggacttcaccattcccaccctcttcatcatcgtcgtctacttcatgggcgggctccggtacacagctggcgccttttttgccaactacttcactgtcatcctgtccatgctggtggcccagagtctggggggagtttaccgaggggttgcgtgtggtagtgtggtagggatttcaagggccagattgctcttgggtgaccatgaagcctctggcagtattatttggcactggctgtcacactagcgtgggctgtctttgatggtggcaatgccctggcggctagggaaggcatggaccttgatgggtggcgacattgtttaaagctccatccccaatgagtcaacccgtcttcatgtgttgcagactgctcattggcacgatggtcatgaaccccaagacggcacagacctacgccaccatcatcatgctggccatggtcctgacaggaggtgtgtcaagtggctcgctcgcgcgcgggggcatggccgaactctgcatttgttgcgttgttgtttacacacttgcnnnnnnnnnngggtggctcgctggcgcgcgggggcatggctgaactctacatttgttgcgttgttgtttacacacttgctgccactgcgttccaagaggtgcatgtgctgcttgtgggcagccccaaccatttcaccccatcccacactgcaaaggcttcttcgtcgtgggcctggcggactggatcggctggctcaagtacctctcattcatctactatgcgctgggcatggtgctgtactttgagttccaggggcgcaccatatacagctgcatggagcagggcaccgacacctgcgtgctgaccaaccccagcgaccctagcaccagcccggaatgcaccccggtcaccaagtgagtgctgccgtgtggatgcacgaccagggacagcggggtccactgcgctgtgcctgctgctgtgctttgccagggaaggagctgctttctggaacatactgaagctccttgtccaaggcgtcctcccgaccaacaccaccccaccaccaccacctcgtcatgcaaacacagcctgcaggactcgctgcagctgctccaggaccccaacagccagggcgaagccatccgcaacgggttcatcctgctcggcttcctcatcttcttccgcgtctggtgctactatgccctgcggagcaagactgcggggctgtgagggccctgaggctcgtcccactcttcacggaactgtcggagcaggggggtcagcacgccgcagccgcacctgcagcgtgggcggtgcaacccccgttcatcccaactctacacgtgttctcaaggatgtattgatccatttgtccaggagggacacctccgtacctcaccttgatatcccatcctgtcacccaacccttgtaccagagacttctgcgcatgccagtgctcatcaatgcatgtcgtctgcagaacctgtgtcacctaggcaccctgcagcccgccttcatgatgatgttgaaaacatgaaaattcaccggcagctattcttgaaccttgcagtgtgcaaggttcagtggttnnnnnnnnnngcttcatgatgatgttgaaaatatgaaagttcaccagcagctattctcgaaccttgcagtgtgcaaggttcagtggttatttggttcgttgcctgggttcatcctgtttggtaggtcaggggtatggcaggagcaagaggcatgccatcccatcacagaatccagtaatggaaaatcttgtcggcctgacgagcttccgttatatcggcgcagtgtacatcatgcacccctttcacagccgcctgcatcggcagtgccacccctgggcttcagtacctccagagcaggcgtagccctgagatacttgagcagccttggacagcaacaagggcgactggttgcactggttcctcaaggcagcgtcctctacatatttggctcaaccccaccccgnnnnnnnnnntcatgcacccctttcacagtcgcctgcatcggcagtgccacccctggggctcagtacctccagagcaggcgtagtcctgagatacttgagcagccttggacagcaccaagggcgactggttatactggttcctcaaggcagcgccctctacatatttggctcaaccccaccccggaagggttgcatgtagatggtgcagtatcgagggacatagatgagctgtgggagtccaagacaaaatcttgtttgcatgggaatagccacattggtcttactgcgcatcaataaaactttacagacattgttttgcaatgatatgaagatgggtatcataacacgttgccgattgaggaggctgccttgattgatttattcaccgagtaccatggcaaactgcccacgtgcgggcgcctcgagttcaaaatgcatccagatcgtattcggaccccaccccagggaagcttcaagatcgagctgcaggagggaggtggatggtatcatctaggttgtggtgtgcgatctccagcatcagggtctcatgagatccttcgaaggactggttgcggtagcgttccagagggttgaggtgnnnnnnnnnnnnnnnnnnnnnnnnnnnnnnnnnnnnnnnnnncaacaagacagagaagggcatttcatcggcgttaaagatgtcaggaagtgccagaatatgccgccagaccttgcggaggcggcctgccatatcagaaactctggccacatggagaagcgtccctatagctatttgttaccggctccgccgctgacagccctggtacannnnnnnnnntcagacgctgggcccagtaccacagggcaatgctggtgctgcaactgcatcatcaccgcaaatannnnnnnnnnccagacgctgggcccagcaccaaagtacaatgccggtgctgcaactgcatcatcaccgcaaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgccgccagaccttgcagaggcggcctgccatatcagaagctctggccacacggaaaagcgtccctatagctatttgtcaccggctccgccgctgacagccctggtacaagcagcaagcccttgaaacagggaggattagaggacgcactgaaaacccagggaattgcacaagcaaggggtactattgccaggttcttctcccaggagggcatcccctttgataaggtgggatgacacatgtagagatcgctctggagatgctgagtaatgccccatcccagtcactggctgtgcttggcttcccttgcaggtggaatcgtcttccttctgtagaatgatgcagagactcgcggacattgatggggatatccgactcccgacgtacagcgaactgtgcgggccattgctggccaaaaacgttgagaatctcaagaaagaactccaacctttgatgcgtgctgaggaaaaagaggtaagacttcaaaggcgtgacttgcacagacaagaatgagaccttctccaaacagtggaacctgttatccccagtttccaagtccacagggcttgacccttgtcatggatggctggcaggatgcagcagatagaccagtgctggacttctttgcaatgacgagtgcgggggggcgtttcacaaggagcactgatgctgctgatggctgcaagactgccgagtacttggcagatcagctggaggcggtcatcaaggagattggaatcaaaagtgtagacctgatgatcaccgataatgctattccttgccagctggcgggggccatcattgagcagaggtgaggcctggctctggggcatggtagcagaactgcctggagacagacattgctgactgggaaaacatggtggcccctcccaggtatcccagcatccgatagacgccatgnnnnnnnnnnccctggctctggggcatggtagcggaactgcctggagacagacattgcggactgggaaaccatggtggcccctcgcaggtatcccagcatccgatagacgccatgnnnnnnnnnnctgggtgaaaggggtcttttacccatgtctcaagatatgcatgttcatgtatgacaaccctacggctgtgcgttgcctttgagattcttccgacagcttgccgttgaactgtggtgagtgtttggtgatgcccaatcctgtgactagtgacctgagtctcggcaatggnnnnnnnnnnttgggtgaaaggggacttgtacccatgtctcaagctatgcatgttcgtgtatgacaaccctacggctgtgcgttgcctttgagattcttctgacagcctgccggtgaactgtggtgagtgtttggcgatgcccagttttgtgactagtgacctgagtctcggcaatggaatcaccaatcctgtcaaatcactcacgatcgtgctgtaggggagactcgtctgacgtacaagtatttcatgctggaatggctgctggagaacctggagaacctgcaggaaatgactgcggcagctgactggcagaactggctttacgggatgccttggactgcgcggcaagaaccggacgagattgcccagctcattcagagccctgggtgaaagggtcgcggtcaagcccttctagagctcatcaggtacgtcaatcaaggatgtgggacatccttaagaggatataaaagctcacttcccccctttgctccctccctccaggcctctcatagacttgttgcaccttgtggctgaagacagtgcctgcaccggtgtcctctatcgtccggtatgtgaggtagaggacaaccttgccagcacagagatcatcccacacgccgaaaggcaacaggtgctggcagctttccaactgtggacgaggaggtccatcacagacatacacctggcagcgcatgctctacatcccgaaaactttggcgtggagctctcagtggagctcaaggatggcctttacagggtgtttgagcacttctacccagatcccagggagtgcatcgggaatttgtgggaggtcccgacaaactggagagaaggcaacatctgcagagaccgggcatgaaaccccatctttggtggaaccttgtgggtnnnnnnnnnnaacaccgcattgcatcgggaatttgtgggagctcccgacaaactggagagaaggcaacatctacagagaccgggcacaaaaccccatctttggtggaaccttgtgggtggcagccacaagcatctgacgcatgtggccgctcggctgctgagcaagcgctgcagcacttcaaatcgcgtattgacttgcagccatactctttccattcagagcaagctctgcgctgggttacccattaaccgtgcactggtcttggtctacattattgccagttctcatttcattgatgctcttgaggtggtgaatgcattccgtgaagatgatgaacctgttgattggctcgccctgccctccactgaattatgttcaattgcgaggcggttcgcctatcccatcctcctactgttcatggagggaataccatcatcttagggccgacaacactcggtaaaaattcaatcatnnnnnnnnnnacatgaagggaataccatcaacttagagccgacaacactcggtaaaaattcaatcattgccgaaacataatcgttaacaaaatccccgcgataatggcaaaccaaaccccaaaggtggattttcctgtgccgagctgcatttggttgctttgctggagtgggagtcgatgatagtcattacagtctgataagaagttacaggggcgcaaacaaggtaccgatgcgacgctgaattgcgatatggatgccagggcgcgacatgcagatttacgaagcacgagcaagaatgtcaggattccacgcaaaaccacagatgcacttgcacgagttgttaccgtgatataatgctcgaattttgagacacaggcagtctcgagaggcccagcacttccgggcagcatcatggccgtgtgggtgccccgtgagggaatgcacaagcccatgcacagcttctgagccctgcattggtcatgtccagaattgtaccgtggagtagaggtcttgtatatacatttggaccacgtcgtctccctggccttcatggtgacaagctcgagccgggagtccagcgtcgcaacaatgccaggccccatgcccagccccccaccctctcaacactccccggcctggccacgggccccgaccaagcggcacaccgctccaccggcacgagcagcccgcagacgccccctcccgacctgcccgtcctgaccccccctcccgacctgtccgccctgacccccctgctgaccagccttctggcttgccgcgccccggccctccccctccaccagctggaccacaagtctgtgcactggctcctgcgccagctggaggcgcggggcgcagccaacgccgcgctgtgcctgttgtggagcctaccccccgcctcccgccccgcccccgtcgtcacgcgggtcatgcaggtctgcctgggccagggctccgacgccggccccggcgcggtgctgaaggtgtggcgccagctgcggctggagggcctggaggcagacgccacctgcttcaacaccgtaatcaccgcagcaggtgcatcggatgttttactcttttgtttgagaaggattgcattggggtgattctccaggacaccgagccagacctcgtcggcgtcagccccgcccggcgccgcctgggctgggcatgttcgtcatatccatgctgtgccccatctgctgagtggcgcggtacggaaagaaagggccagaactcaccccaggtcttctcatattcccagccacgcctgtatcgatcctgccacccacactcctcacccgtcgcaggccgggcgcagcgctggggcgtggtgcggtcggtgctggaggacatgcggcgcgagggcgtggcgcgcgacgtcttcacctacgccgccgtgctttccaactgccgcgacgcccagcacgcgcagcgctggttcgacggcatggcggcgcacggtgaggcccgggcgtgtgggggctgtctttagagatgtcggtccgatggtgagtgtgtgagcacagcttggcggcgtccccgccaaagtccatcatcgcnnnnnnnnnntcgcacggtgaggcccgggcgtgggtgggctgtctttagagatgtcggtcccattgtgagtgtgtgagcacagctcggcggcgtccccgccaaagtccatcatcgccccttcaacattgatatcccttccacataccctctcaccgccccttgatccctcaccaccaccgccacacacctctgcaggcgtgcagcccaacgtgcggcactacaccgcccttatcaactgccagcggcgctggggttcggcgggcgacgcgctgcgcaccttcgaggcgatgggtcgcgcggggatcgtccccgacggcccggcttacacggcggccattgccgcggcggcgcgcctggccgactggcagcgtgcctgggcgctgctgtctgacgcgcggcgcggcggcggcgccgcccccgttcgcgcctggaatggcgtcatctgcgcctgcnnnnnnnnnnagcctacacggcggccatcgctgcggcggcgcgcctggccgactggcagcgcgcctgggcgctgctgtctgacgcgcgccgcggcggcggcgccgcccccgtccgcgcctggaatggcgtcatctgcgcctgc

SEQ ID NO: 48097 - DNA, 68 bp, Chlorella protothecoides
tgagatcagacgccgcctcaccatacctcgcctagagcctgcatgaggccgccagaaccactgcgacg

SEQ ID NO: 48098 - DNA, 73 bp, Chlorella protothecoides
gcgcttttgccgctggcctccagtctcaagcaccatggtattcctcacagcgtcggtgcctgcgtgtccgggg

SEQ ID NO: 48099 - DNA, 106 bp, Chlorella protothecoides
tcagcagcgtcctcggagtccctctcctccgcagcagtgaggcagtcaaccgactgcagcttgcggagactgttgaggcctgcacatgtgttggttgccagaggga

SEQ ID NO: 48100 - DNA, 22342 bp, Chlorella protothecoides
  modified_base (354)..(363): a, c, t, g, unknown or other
  modified_base (495)..(504): a, c, t, g, unknown or other
  modified_base (1433)..(1442): a, c, t, g, unknown or other
  modified_base (4059)..(4068): a, c, t, g, unknown or other
  modified_base (7431)..(7440): a, c, t, g, unknown or other
  modified_base (8797)..(8806): a, c, t, g, unknown or other
  modified_base (13006)..(13015): a, c, t, g, unknown or other
  modified_base (14636)..(14645): a, c, t, g, unknown or other
  modified_base (15756)..(15765): a, c, t, g, unknown or other
  modified_base (15955)..(15964): a, c, t, g, unknown or other
  modified_base (16621)..(16630): a, c, t, g, unknown or other
  modified_base (17797)..(17806): a, c, t, g, unknown or other
  modified_base (19106)..(19115): a, c, t, g, unknown or other
  modified_base (19837)..(19846): a, c, t, g, unknown or other
  modified_base (20157)..(20166): a, c, t, g, unknown or other
  modified_base (21683)..(21692): a, c, t, g, unknown or other
ggcggggcagggcggcgggcgcgcgccgcgcgccgcccaccagtccgcgctggccaggtggcccatgctgggcgcctgggccgcggcgccggcttccgaggccagcgcggccagggcgccggacaggggcgtgccctcggagccggcactcgactttgggctggcatcgtgcatcccgctgggctcggcgcccacgccggccaggcgaaggtagcgccgccgccggtccacggcctgcagcacgaaacccctgggtcaaatggacgagtggggcgtggctggttgtgtgaatgcctttgtggacgaattgtacgtcgagcaccgtgtgcattacaggcacgcatgtgtacctcnnnnnnnnnnttgaatgccgttgtggaccagttgtacgtcgagcactgtgtgcattacaggcacgcatgtgtacctccggacacacagaaatatctcaactcaaagcgcactccaccaaaccctctcaacgacaacaacaannnnnnnnnnacacacacacacaaatatcttcactgaaagcgcattccaccaaaccctctcaacgacaacaacaagcccaagccccacctgtgcccgtcgtcgcgctccgtgcccgggtccagggccgccaggtgccactccgcggccgaggccggatcgaacctgcccgtggccgccgccacggcgcggccggcgtcggcgtagcgccagaccaggtccaggtccaggcgcaccggcaggcggggcgggcggaagaaggccgccagcacggcgcccagctggggcccggcggccggggcggggtcgtgggacggcggggaagccagcgggaagctggcccgcgcctggagcgagacgcgcggcaacaggtcgcagccatggggggcgccgacgccgtcgccgtcaccgtcttcgtcgtcccgccccgcttccgcggcgtcgcggcaggactgcgcggcgggggcgtcacgtgcgtccaggcgcgccgcaaacaggcgcagctgctcgccagggtaaaacagggcagagggcagggcggaggtgtgcagcgagtcggactcgtaatgggcggcgccgccggggtccacgcccagcgccccgtcccgcagcgcgtcctgcacggggacgaagaggggcagggggcaggcggcgttcgaccccgcgatggctcccgcgctcagcagcgtgctggcctcctgcaccaggtgggagcgcagagaggaggggtggggtatgcaggtggggatggcgtcgtggcatgaggggcaaatagaccatcgccacagcctcccttggcgccgaaggctgggaacacaacgttgcccaggaagatggtcacattcaggtacgcttgccccatggagcatccaaaagacttctctatggcgcccaaacagcccaccgcctaacaccctcctcacctcttggtccaggatgcnnnnnnnnnngggctgggaacacaacactgcccaggaagatggtcacattcaggaacgcttgccccatggaccatccaaaagacttctctatggtgcccaaacagcccaccgcctcacaccctcctcacctcttggtccaggatgcgcccggagtggctgtcgggcaccagggtcaggtgggagtccacctggaaccagtcctggagcttgctggcgcggtcctggagaggggctgaggcagggtcgccccggatcaggctcagaatgtagttgtccctccggaaggggagggcatggtcgatcacgaggtagctgctcctctctgggtggagggagggcaacggggcttgggatgctaggtgccatgagcctcatgtgatgctgtttactgtgcaacatatctgcaaccagggcatgcacggtaacggtgctcctcccatgcccttgcctttgaggagcagggcctggatgctggtcgtcagcttggccaccagtctgcgcatggacgaggggctcgggcgccaatcatttgcatgagatacaaatcaagggaagtgttggtctcagcaccactgtcaactcacctctcaaagggtgtggcaacactaaagtccaggaatccctcgtcgtcatcgctcattcccagtgcaaccccgctgcagcgcccgaagggaggcgaggtaaggcttcgatttgctcaacctaacatagcttgcaggcagcgcttatttcagcggtattcaggcccacaggcccagaggattattgggggagacctccccgatcgtgtatcggaaccccttgttccgggcgcaaaatgtttaggcgcgcaaatgaagaaacctggaaattgaccagtcaaatcaagactttcgccgagcttcgtcggtgcagtctgcaaacctggcaagcggcgatcacgagcattctataaccgagtacggatagcatccaatcgttacagcaggcccttgcggctggggaagatgcagatctttctgcgtggcctctcagggcgtacccgggttctcgaggtggactctgcatctagcatcgcggacttgcagctcaggatccaggtaggtactgagtgcggaaagtgttgttagtaagatattgcacgcgatggagatgaagcctgacgacacatatttacggcactcatgccgtgcaggacgtggagcatgtcagccctgcagaccaggtcctggtggccggaggtcgcctgatgagcggagaccatacgatagaaagctcgtctctgagccacggatcaacgctgcacctctctagccgcctgcgtgggggggtgcctgtgaaggtgcgctgcctctgctgctgctgccgcaatcctgggcgctggcaaatggggaagggggaagcttcagagaccgcagcactttgacatcccctgtgctgcagaaagtcgtggaagcctctcttgcttcccttttctttgaacattaagccgcacacgccgtgcctctgcaggtgaagatcatcaccccccacctggcctgcgggaatgaggtcaccattgatctggagcccacagcaaccaaggatgaaattaagctgaagctggtggacgccactggagttccgtttgagcaccagaaggttctgctgtctgggattaaccagattgcccttggcgacaaaaggtgtgagagtggcttgaatgaggcggatgttgaaaggggatggtggtggagctgtaatgtgaacttcgactcgcctgctcagtgaaattcagatgcgtcatctttggaagtgtaatcccagaggtcgaactgacaaatgtgccatatctaatcactccacaggactaacatcgggtttgcttcgtgcgggagtgcaaatggtgtgcaaatggctgtcaatgccaagtgatgactggggggtgtggtccattgtgcaagagtcgacactccctcccagctcgccatgtaattccatgtcaagatgctgtatcaaagcaacaggtatactttaattgaatgtcagcagggattgggacatgaaacgaaatgcatccccattgtacatgactttgatggtcttctccgtgaaacggccggcctcatctccactccccctgaccaacagcatggctcttggtgaggagacatcagggaggagggcaagccttcagtcattatgccgaatctggggttttgtgaagcacaagcgattgctgtgtatagtgtacctaaaccggttgcctcgtaatggagtttaggcagtagacccacatacagggcgatcagaatgtgacatagatatgcagactgattcgtgaaaacagctatctgcttgcaccatctctaagtgcgtttgggcaacgtaaccaggcaacctaccttataaagccgactcaagatgtcattcaggagtctcacaaaggcttccagcagaagcaaaccctcctcccagcgatggtacagcgcgcgcaaaccatgggcgcggaaattctcccccagtattcgtggcgttcacctgccctggatgaacccacttcactctatgaacaacacatgatatccttaagtatattttctggtgacagataattgaagtacgccgggttgacaagacagtaggcccgctatggacaggaggcagnnnnnnnnnntatgatatctttaagtatattatctgggaacagataattgaagtacgccgggttgacaggacagtaggcccgctatggacaggaggcaggtcggccacctcttctggcgatgcgcagcacaacttcagcagattaggtcattcaaatccgtgtctagaaaacttgatgtgaagctcctcaaggtgtgaggtcgttggggaagtagctgggtcgaatacaacgtcttaccctgctcaatttccaccgaaccccgcacagcccacctcccgaccatttgcgacaggatgtcaatggcctcggagaatctgggtcagtagtccaagtctcggccggatacgcccggaactacctgctcccgcagaaattggcacagcagctagcatttgacacatcgctgagtcgacgggaacgcactcagcaggcagcagctgctctgcagggtgctgatttggccacgagcacaagtcagagccaggtgtgtagctgtgtgcgcagactttctgagaaagaactgacgaaagcacgaccacgtggctttgcaaatgttccctgttatcttgagtgtctcaaacccatcccatcatgcctcccaacaggctgaggagcctgaggccaagagcacccccaaggacgaagctggtgctgtaatggagaagctgaagactcccctggtgggttggggaagttgggtgggatattgacacgtccatgaggtgcatggatgaggtctgatgtggctctccttgtcaggcatccttacgattctaggagatgcaaggggtaacaccaatacctgtgcgatgttgtagatcagtaatggcatgctgacatgttagcatgctgcaggtcaacactctgccatgcacatcctcaccccaggtgttcaaacggaaggccgaggggctcaagctggcggtccctctcgagcgggaggacgtggtggaggcggtggctcggcagctgcgcatcacccttgtccccgagctgttggacatcgggaacgagaagctgagcgaggtgggggagttcctgctgcccctgaagattgtgacgccggccggacagcgcgcccagctggaggtccacattgcagcgacgtgaagcaccctggaccttgcctgtctgaacgtagcagcacgaaagctggcagcctgggggcgaggcagggatttcctgttcctggctgcttgagggaggcctcgagaggggtctggcatatgaaatgatgcgcgggaaggctgggcgcgcgattctcgcgacttgaatacgaaatgaagctcggatcgaggcatgcagaggaggcaggggcaaagccgtgccccgatcgcggctgcgcagggttgaatgcaatgattgtagcgtcgcacattctccaatccgacctcgctcgcccggcatccagccgacacacccccttgacaatccgatcatcctgactggatcgcagcgccacccaggccgcacacccactgagcatggatgtggacgccgcaaatgatgcagcaattgcacgactactggtgcggtgtggtgtcgctgggcgtacagttggggtctgtgacctgtgtgccaggggtggatcactcttcacagggacccatgcagcctgctccacgccaaggccgatgcgaattctgtactcttggccgccgaggacctcggactgatcaccacctcaggcaaacgaggatggtggtgacgacgaggaggagtactcactggacgcagatgagctggagtacgctgcatgtgccccagagtgcctgtctgagccaggtatgcagctgtggcctgatactgccttgtggcccacgacggtgacatccgtggagcttgccgccatcgctgcaagctcgccaccattctcggccctggcaggcctgaaggcgcatggacggctgtctcctgaccctgtcccggccgaggccggtcatgttgccccagaccagcaccagctgacggcctcaggccgacgaaaacgcaaggacacaggtgctaggggtgggcgggctgggttggggtagaggtgctgatctagccagggatgcgcatcccagtcgactttctcgtcacatcggatgattgcaggcaagcagcgaacgacctcacgctcatggtccagcggggaggagagcctattcctggaggccctggacctccacgggcgcgactggaagaagtgcgccgagcacctcgtcaccagggatcccaggtagtgtggactggggacgccccagatccttgggtgtcacaaccgggagattgcaagagtctggcgtggagctggaagtgcgccatgcagtaacggtcgcgtcgggagatgagccacccgttccctgtaccctctgcacttgaccgatggtgggcaaacttcagaggtaggaatggcagctcctctccctcgttccatctcaagcagggcagtgaccagccatgcacagaagcacttcatcaagctgctgcttcggggcgaggccttgcctgaagcagtcgcagcttcgggggccggctacaccttgtcaggtgccgatgcatgctgagaccgtggtgcaggagactgcgcgtgccgttctgcacaaatttgcgagtccgacccttcgaaatctggaccaggtcgtccgctggaccccaactgcgcctctgccagggcatacggtctccgtcccgatgccttccacagtgagcgggttgtgcaggccgctcgctccaagtgtgcaagcatgggtcaatacatgcatgcatggctaggcctctttgtgtgcgtccctggttggtcgctctgcgggccctgcggcggaccacgggcccgcaggaatcatccacacctgcccatcctaacaggggtggcagccgacgggaagctgacagtgggcatccatgtcaccagtctcgagatggaggcagagccggcaggtgttgtcaaacgcttgcccaaaggtatgcccgcggatggatgcccctgggaatgtcagccggtgttacaatggggtcttcgaatgtcttaaactactctcacaacactcaccaccctccttcaccacccctgcttgtgcagcatcggctgcgctgagtgccgccaagcgtggccgcaagaagaggggctcgagtgactcggaggatgagggcaggcccttggcgcctgctttccccgctgcggctgaggtgatggggtggccgaggggacgttcaatcccctgatgtgcccgctctccaggaacccatgccctgcctggcctgccagcaccttcccatgccattctctcatgcctgttcacgccccttcccggccttcctcctgcgtctaccagggctcctcccccgcggaacccaccgaatactccaaggcacggccacggcggcagnnnnnnnnnnatgttcaaacccctgatgtgcccgctctgcaggaacccatgccctgcctggcctgccagcaccttcccatgccattctctcatgcctgtttacgccccttcccggcctccctcctgcttccaccaggggtcttcccccgcggaacccactgaatactccaaggcacggccacggcggcagggaggccagcgtgccgtcatgggggacacgagcgaatcccttgacctcacctgccccaaggagtttgtgggccctcccgggtcggccgcccccctcgcacagccctttgcagtggtcacctcgagccaggtggggtgtaagtacggcgtagttgtgttatcgccctcgcccagctgctcgacagcaggcgccttggatcctgcgctggcctcacctcactccgtatgccccctccccgtgatccatctctgcatcgcgcacgctgccttccgccccctctcccccgcaccctcacactcacacggcgaccgccccacccaggcgcggctggtgatggacttccacgcccacctcagcgggtacgaggtaattggcctcctgggcggccggtacgaggctgggcgcagggtgttgcacgtggacgaggcatacccctgccgcagggcgcaaggctccgactccggtgaggccctggatgcggggccagggccgtggtcttggtggtaggcggttgtttcagaccatggggaagggaaggcgcggggttttcctgcactgcaattcctgccgccgcatcgtgaggagagcccctttcatcaccagagttctgcatttaaggcgtcaagctggccgacagaccctcaatgtgttgtggcagcctaactcctcatcacctcctgtccacaccctcctgcaggcacctcggtggagctggaccccgcgtcgcaggtcgaggcgaccaccgccatgtcagcgagggggcaggccgccgtgggctggtgagcgtggcggcgggtcgacggcgtggggagcgcttgcgttgcagggcctgacgacgcatggtcggacctggaaaccccgggtgcctgcgcccgcctctgcagtcgtcgctggcgagtctcgccgtgccacgcggagctcgctgctgcatgcggtgtgcgggagcctgctggaggctgtacaggcttccgtccgggcgcagcttcgtcctgcccccccacgcgatgcttccccctttactccctcctgcccactgccaggtaccactcccacccggtgtttgaggcacggccctctcagaaggacaacgagaaccagcgcaactatcaagccctctgccacgaccctgaggccgggctggcgccctgggtaggcgccatcgtctccccctacgacnnnnnnnnnnccaggccctctgccacgaccccgaggccgggctggcgccatgggtaggcgccatcgtctccccctacgacgccagcctcccctccacggtgtgtccaggtggtgagggtggatttctgaggggatcaggtggcagggccacgcgggacgccagcaagggccatgctgggatttcacatgtgccaactccagcccgggccgaggtgatcaacctggatgcctacccgtcagagccgcaacatgtggtgggggtgagatcattcacaaaccccacccgtcatttaaatcctaaccccgcaggcatcccagatccgcatgtgggtggtgcggaccagcgccggccgactcacccccttctccatcaggagccaaggggcggaggcagggccggccagcgcccacgacgatactctcagcagtctgcgagcgtgagtggtgttattttcaaggggaggagccaggggtgttggtgggaaagagtacgtggcgtgtgtggtgtcgatcgacgatgggcagtgcatgccaccccgtgtggggcctgttgacacgtgggtggcggcgccgtcctgatgcagcccgggttcagtcgccagagctgcatgccagggagtgtgcggggtcccttgtggaagactcagcatgttgttgcggcaaagcagccttcatacaaccccttccatccatgcctccctgcagggcgctggtggcgcagagggacgaccccagccgggtgcggctgggcgcggtgtggaggggctacacccgcctcgtccagggccaccccgacggccctccgctcaccaagctggagaagctgcaggtgagcgtcaaatgctgcgaagatggctggcatcggtgggggcaatcgagtcgtttgggctgccaccgcagggcgaggctgggcacgcgacagagtcatgatccgcgcagcgctcggtgcaacatgttcgctgccccccgctttcctccaaagggggcgctggcggcccacctggcatcgcaaggccagcgagatgctcttttctcctggctgctggatgccgtgcacgaggagtggggcgtggacctccagcccctcgccgcagccaaggcggaggctgtgccggcggagaccggcgaggtgtgccactgtgagccggggctcaacctgtccggggagtcgtgcgccgcctctgcgggcgcagcggaagctcccccccccggcggcaggccatccctgggcctcacgtagtgccccgctctgtgcgtcatgcagtctctgactctgtccactcacggtacccgccatgcctccaccctgcccattgattccccccacccatgcataccgtagcttccttcacaagtcaacttcttgtcgtaatggtcttcacaccccttcgaccctcactccatgcaccgcgtcagtaccagtgcgtggtcatgcccgtcttccagtggtgcgtccccatgatgctgcgcatgagcagcgcgccgccggcgatgagggcgtagcccagccggcgccgcgcggcgctgtcccgcacgcgcggcagcaggtgcgtgcccgcggccaccgccaggccgaagagcaggtactgggtgcccatgatgtacccctccgcgcccagctggccctggccgggcaggaaaaggttggagctgcgcgtccgctggtcgaactgcacgaagggcatgccccggatgatgatgtacatgccgcctggcgagagaaggagagggggttgagaaggaaaatggatatgagagagagggccggttgtagacatgagagctgggcagggtgggacatgcaggaatgactgggtggcattgcctcctggcagctgccaggatagaacctgatgtgcacaggatcccccccctccctaccagtcgtctcacccgagacggagaaccagtagatcacgaggcttcccgccatgtagatccaggtgtggcgcaggaagggggcgtggtacaggcggtaccccagcactgcggcgctcgccatgaagaggagcataaagaccggtgcaaacctggtgggtgatggggagtgcgaaaactgtgccttggcgaacacctagagtcaagcattgttcaagccgcgtactgctccctgaaatctctcagagcacccagctgtgtgcagcgtggtagacccggcctggcacgacagccgcccgcaccccacccagtcaactacaccccctacctggacttgagcagcgagggccgattgatctcgacggcaggcaggcctgccgtctccatcacccaccccgcgatggtctcggccgaccaggggtagtcgttgaggggcatggcatggtccttggtgaggccgacggcctgtgcagcgcccactggcaggctgggggggatgagggcgaggtgtggtagcgacacgatgcccagcctgcgggggacgggagtatgattgttggttgggggaagcaggacttgtagacgagggaacagtgagcagagacatgtgttccgcgagccatacggctacagcttggacctggcggatcgcatgggcaaccttctgtggtacatacttcacaccacgcattccggcgccgtctctgccacccttcccagatgccaagcaatcttcacccccggttcctcctctcactttccaaacagctccttctcgctggtaaactctgcccgcgtcaggaaaaccttgccaggtgttgccttgcggagggtggaggccaccaggccgtattccctggctacctggccgagcttcatgttgccctggttgcgcatgtgcagagcatctgcgcgtggcaggagtacagaaatcgaaagatgctattcctgggggagcatggtcaccacaaaccccacacctcacacccccctgacctgccaagacgtagagggtgaagggccgagcagggcccacgatgtatcgatcaaacacctcctttgtcagctgaatgactccatcgctggattgactctgtagcttggatagggcggccacctgtggcgcggcaaaggagtacgcttgcctactagctagcccccgatcgcagacgcactacctgttgtagacgcatagtactcgcaccttctcaacgtctgtgagctcctgtggaacagcaaggcaatgactatacaatccgatgcagatcgctgtcgtgaggagcctcactgcaccccggccgggagccatgacaccccttctgtgaggaacactgtgatcgatgcggctcgcgggccgtgagtactcctggtgcgactcttcggtatgatccggggggtgggtgcggtgtctgggcttacatttggaaggggagggccgatgtggcagaatttcgagcacgctgggctggcttcttgaaatctgccatgtggattgctccagcgaaatgaatgtctcaggcgcccacgcaccagtcaagcccatcagcactgtcactgaagtccaggcgcatctccagccacacatcttggccatggaccaccgaggaagggccaattaacccaaagcccgctccctcatacaaagctacctgcagagtagtgatggcatgcaccacggcttcttgttgcaggacagatctgccaactgcagggcgccatttcaagtcggcagcttcaggcacaccataccggcaacattaatactgcaagcctgtccactacctcgtcgcaccaagtggtctttgcagaggaggaccatggtagatatctgaggggctgtcacttgcacatattgtatgtaggccttgagcaatctggaaagtacgttgatatgatgtttcagagctcagaacaggcatgccaggggctggagtcaatcacttggactgcagctgagacaccaggaaggaggctacgacgctgctgcacaagtcagcaggccccagtaactatggctacatcttatctttccaggtagtctagcgtgcccatgcccctcacctcgtggcgaggccctgccgtctgtgctttgcagcgacgcagacagagtgcagcgcgagggtgctaccctctggatcatggctgctcatggactcgtgggtgaggctgcttccatggcaggctgtgccacaagcataggccacaactgaggagtcggggccttctgctaccaaaaacagctccggagctgaaggaactttcaaatatctttgagttgcaatcgactgatcttggtaaccaggagaccatacctgcagttgaggccaaatcnnnnnnnnnngtttcaggtatctttgagttgcaatcgaccggtcttggtaacctggagaccatacctgcagttgaggccaaatccagcactacaattcccgtcgaaatctgacattccagatctccactaaatatcctcacgataaagtgtaccttctcgtaggcggaactccagttggctggggctggccgcctcctccaaggggtagcctgcagcctgaaccaagtaggagggtgatgtgcaccattatcgaatcatgctggctccaaaattccctagtgatccttgcatgctgcccttgctgctacgactggcaacccagctcacctcaagcgcacatatcctgctcagatcatggtcagagggtggccggaagaagacggggggcgctgggtgcgctgacgccgacatcgcacgagacttcaacgattgcaatgatctcctaggggactatctcatcgggtcttcacaggcagcattgcattgcatgttttcagacaggcacatgaggttgcaggcctcccgaccgcgcgctgtcaagtcatccagccagcgcgccgaaaggcgcaacccggacctcgggagcgatgcacctcgagttgtgacaagctgcagcgtgcattgtatgtattatatatatattgaatacatttcgtgtgcaagcaggctgcgctcgaggctgaagggtgtacctaggcttcactgcctcctcgtagaataaatttgtccggccctttgccgtttccagggcgcacgggtccctcatggcgccgcctgagaaggctggtgggtctacagggaaggctgacaatcaagaaatggacgaccgcttcgctgccgtgagcacggaccctcgcttccggcgcttccccaagaaggagagcaaagtcaagattgatgaccgcttcgcaggtatcgtgtgcactactcgcgtgtctaccacgatgtaccctacttggagcactgttttatcgtgagggatgcgccgtttactccccacagccgtgagagatgggtgcagctcaccgcattgaggtcccttcctcatgcatgcaggcatgttcaaggatgccgccttccaaggacaaggcgctcgggacaaacgtggccgcaaggtcggttggtggtgactgattgccactttgtgtgatggtattaaggccttggtgctgacatgaccgttgctggagtttgtatgaaactcccgagatgcctttgcacggccgcctgaccactcttcaagtccccgaacgacagaaagaccatgcccctcctccccccaacataaccaggtaaagagcggtggaaaaggcgagaaactacgctcctactatcgactggcaggagacgaggaggagcccgccggcaagggcaagcctgttgcgtctgaccctgattcgagttctgaggatgaggcggctgaagccgaggcgcgatgggcaaaaatgaggtgcggcttggcaattggaatggaacgtgcatcactttccctggactcgtagttttgacaggggtgcaccctttcagcactgcgagcctgtgcccttctcttgtactccacatcgggcaggcgtatgcaaggcccgaatgtttctcaggacagaccctcgcatcctctccgccgccaaannnnnnnnnngaggcctgaatggttctcagcacagaccctcgcatcctctccgccgccaaatgcatcaggggtctgggctccgcgtcgtcttcctccgagtctgaggccgacagcgatgtcgatgaggcagccattgaggccggcgtggaagctgcggcgcagctggacgcggagaccgaggagcgcgaggaggcgcgggccaggcgcctgtttggcgtgggggccatggccgccaacccgcaggagcaggtgaggtgggcttgggtgtgagggaggggctggtctgaacgcgtgatgtggtgtggagggagtcggacgtggtggagccaagcctccaggtctagacacccgatgatccttgagatggacgacgcggtggtgaccccactcattcgcttaacaccacgccgtatcccgcgccagatcccgctggtccccgacgccacaccgcggctggccgtgctcgacctggactgggagcatgtgcgagccgtggacatcctggcggtgctgcgcagcttctgtcccccaaagggcggggtgcagcgggtcactgtctacccctctgactatggtctggagcgcatggcggaggaggccaccgctgggccccagggcatctgggacgccggagccgatgggaagcaggaagaccagggcgggtctgaggaggacggggagggcccgtctgcggggaacgacggtgtgtggagggggagaggaggggggttgggggatgatcggccgtagtcaggccagcacaggcgtgcccatgcacaggtctctcaggagccaggggtccagaagaagacgccgttcctgctgctgtgccatgcaagggcaggtggcgggcgcagcatggccacggtcaacgactcgtttccttggtcccccatcattccatgcagccgaaatagagcggcggcggctccgggcgtacgagctgtccaggctgcggtactactatgcggtcgtcgagtgcgacggcgcggcaaccgcttcgcggctatacgaggagtgtgacggcatggaattcctgaagagtgcgtggagggctggagtttggaggggagggagtgcatgcctgggatggggaggccgagcgcctgggtggcatgcnnnnnnnnnngttcctgaagagtgcgtggagggctggagtctggaggaggggggatgcgtgcctggtatggggaggccgagcgcctgggtggcatgccgatcggtgcaagtcgggtggcacacaccacgacccaggtccgatgcgctgtgtggccatcctgcactccctgctgcaccctgcagcggcctgcaagttcgannnnnnnnnnaatgcgcggtgtggcaatcctgcactccccgctgcaccctgcagcggcctgcaagttcgacctccgcttcgtgcctgaagggcagagctttgaggggcggaaggtgagggacacggcagaggagctgcccatcgactacgcgccgcccaatttccagacaaaggtggggcgggcgggcgggctggggtgtccgcctttggctcatcgggatgtcaccgcctgaggcccgctcagcgagccagcggcatgtgactggcctgcgtaccgacgcagaaggccctcccgctccttgccacaggcgctgcaacacacgaatgtggacctgacatgggatgcagtggactctgggcgcaagcaggccctcggacggaaagtgacagacgaagagatccgagaggatgactacaaggtgcatgtgaaccatggtcgtggggcgtcggagggtgcacaaggtggcgcagcccagccccagtggtgctctggaagacattggtgggctggcagtcgagctttggccgagcatagctgctgccctaaagggtgctccttccctgtttatttcttgggtggtgctgtgtgtcgccccctgtgactacgttggaaggtatggggatgtgttccctgacggggctctacccccaacacacacaggtgtannnnnnnnnntgtgggaaggtgtggggatgtgttccctgatggggctctacccccaacacacacaggtgtacctggcgtccgaggaggaggatgacgaggaggatgaggaggatgcgccgcggggcgttgcattggacgccgaggcagttcgggagaggtacaggtcgctcctttccggcgcgggcgccgaggatgggccgaccaggaccaaggactgggccaagggcggggcggaggggcccgaggccggcggggaccaggctgtccgcgacaagggtggggggagatggcggatggagcaccttgtttgggtgtgcggctcgctttgctgcgagtcgggcagtgtggcagtcaacagcgtcggggctcaggggagcaagcatcccctgaccctgcacagggcacgcgctctgctgatcctgcggctggtgctggggggccggagcgggggtccccactctgtccataccccctgatcccccactgccccacatccaaacagacatggagctggaggtgaccttccaccccgggctggagaccctgggggagcgcctgctggccaggaaaaaggccgccagcggcgatgcggagtcggtgtgggacgcgtacatgcggcggcgggccgagaagcgggcccaggcccggcggctgggaaagagcggcgtggggagcagcgacgaggacagcgacggcgacccggaccccgcctcctccggggacgagggggagatgctggccgccggggtggccgacgaccccttcttccagcgcgacgagggggaggaccccttcgccgaccccttcttcagctcggctccgggggtccctggtgccggcatggcggccaacgctgccacggccaggaagaaggagaaacggtccaagagggcggaggagggggcgacggccgcagagcgcgctgagctggagatgctgctcatggacgaggccgacatgctgcgcaaggcccaggccggaggtgcgagccctcggggggagggtggaaagggcgggacggcggccatggtaatggcgggttgggaagacctgaccctggtgtgtcggtacctggtgtatctgttgcacgagatccagtttggacaccgccaaccccacgccccgttccccaggcacgtccagcaagccggcccccaagctctccaagaaggagcnnnnnnnnnngccctcggggggaggggtggaaagggcgcgacggcgggcatggaaatggcgggttgggaagacctggccctggtgtgttggtacctggtatacctattgcacgacatccagtttggacaccgccaaccccatgccccgttccccaggcacgtccagcgagccggcccccaagctctccaagaaggagcgcctgcgcctgaagaaggcagcgcggcgtgcggagcgcgcccagggctccgacgacgaggagcttgcgctggcaggtgcgtgccgtcggttcacaccggggccgtcagggctcggtacacggctgccagggatactgggttcagtggcctcatccacagcgcccccccatcctcacgcacagcacactcacacaatggccctacctcttgctaccccgcaggcaaaccggtggcaggcgtggaggatccccgcttctcgagcattgtcacctcgtccctgtatgccctggaccccacggacccccgatacaagggcgagagcgcgaccctggccaagcaggtggccaagctgcggaaggagggggcggcggtgccggcggcgtcggagccggtgccgcgggagccggccgcgcccagcatggacgccatcgtgcagtccctgaagcggaaggccaaggagggccggcaggcggggaagaagcccaagcccgcacggctgtaggggatggggctgtacgccccacctgtcatgccgtattcacattcaaacgttttggcctgggatgctgccaggacatgccatgcacaaaagaatatgtcaggcatgccgcttcctgacgtgcggagaacatgggggccaaataggtaggtgaggtgcagcatctcccgccaccgtcaaccacggtgggacgagtcggcgcatggccgagagtcaagacgacccccgccctgcctgtgtcgtgtgacgtgagaattgtgcgcatctcggcgagctttccaaaacgccgcgtcctccccgagacgacgatgccagattgctagctggcatcctcaggatgctttagtaccacgatgccaggtcccgcggtaccttgcaccggacatgcccctcggattccactgcggacgcactgtccgggcccattcactcaaagcaccatcacacgctcatgcgcacctcacaaatttgagacatcatacagcgtcgccagcccgtcttccctcgcagtccagatctggccgtcctccccggagcgcgttcccgcacaaagttagctccgtttattttgtgaagcgcagtacttgtcgccaccgacttgccaacacaatgnnnnnnnnnntctccccggagcgcgctcccgcacaaagttagctccgttcattttgtgaaacgcagaacttgtcgccaccgacttgccaacacaatgtctcctcctcttcatgaccagtgagcgcacatttgggcgggtagtggtaatgatgttcccagtcacgccagggatctacccacccatcgcccactctccctctctaagtcctcctacccccttctcctcccctgcctcaggcttgacattgtcatacctaccagtacgttgttggcagtgcgcatcgtgattgcgtgcatttggtactctcgcttgcctatgatctcctccctcccctcccaccccctttcacagtccggagccttgacttcctcgagcagtggtgagatgaggatgcacgtcgggtacacatctctgcagggtgcacggggtgatcgagaggtcttaatcatgtcgcaatctgaccaccccctccccctccccgtggcccaggcgtcccttcttccagccctaccacctcatcgtcatccaggacggcgacccttctcggagcgtcggtgtcccagaggggtgcgtagggttgagctgctgggttgcacaaagacgaccaggagagttctggcagggcacacccgtgtcatgacgtatgcggtcggcaagcctaaccttgctcggcccccatgttgcagctttgactatgaattgtacaaccgcaatgacattgagcgcatccnnnnnnnnnnatgtcatgacgtatgcggttggcaagcctaacctcgcttggcccccacgttgcagctttgactatgaactgtacaaccgcaatgacattgagcgcatcctgggcgacaaggcctggtgcatctccttcaaggacagcgcgtgccggtgcgttgttacccgaggatttcaacttggtggttgcctgcttgcccggctgcgtggagtatgggttgcaagaagggggggtgaatggggtttatactcatgaataggtattgctacaaggtcgaaactctgcccaggcttcttatgcagtgcctggtgcgcgtcnnnnnnnnnnttgaataggggttatactcatgaaaaggaattactacaaggccggaattctgcctaggcttcttatgcagtgcctggtgcgcgtccaactgcccctccccaacttcccctcttccagctcactcccctccaccctgttgcccatcctcgcagctgcttcgggtacatggtgagcaagaagcgctacatctacactatcgacgacgactgcttcgtggccaagacccccagcggcgaggacatcaacgccctggagcagcacatcaagaacctgctgtccccctccacccccgacttcttcaacaccctgtacgacccgtacgtggcgggcagcgactttgtgcgcggctacccattctccatgcgcgagggcaagcccaccgcggtgtcgcacggcctctggctcaacatcccagactacgacgcgcccacccagatggtgaagccgcaggagcgcaacacgcgatacgtggacgctgtcatgaccattcccaaggtgtgcctgagtttggtgatggagggtaggggggggaggggggtctgaacatgctgctttcatcccttgtctgtagggtgcatgctcgggcgccatgctggccttcccttgcttcctgcttgccctgcggtgcttgcggccctcgtcgcgacgcagcccccaaaccaagtccccccctcccctctcacccctcagggcacgctgttccccatgtgcggcatgaacctggcctttgaccgccacgccatcggccccgccatgtactttggcctgatgggggagggccagccctggggccgctacgacgacatgtgggcggggtggtgcgtcaaggtcatcgccgaccacctgggcctgggcgtgaagacggggctgccctacatctggcactccaaggccagcaacccctttgtcaacctgcgcaaggagtacaagggcatcttctggcaggaggagatcatccccttcttccaggccatcaagctggacgccagcgtgaccaccgtggaggccgccatgctggacatcgccgagcgggtgagggggagtggggagggagtgggtctgagcatgggtgtggaggccgagagggtttggacgtgcgctgggcgtatggcgggctcggggggcctggccagggggtgcggaatgaagacgtggcgggacgtagggcactgctctgtgtgcatgcgcgggcccgttcacctccaccgcatgcacatcccactcagctgatctctccacccccccgatccacactctcgcaggtgcgcaaggggctggcccacctggacccctacttcgaaaagctggccgacggcatcgtggcctggatcgaggcctggaggcagctcaaccccgagatcagccactgagcggggcccgcgcagagggagggtggcgccccgggcgcgctcgtgcctcgaccgcgtgctttcggcaccgggatgcgcccgtcgccccctcgaccagccagcccgtcgccccaagtgcctgcggtccccctgaacctccaacccttnnnnnnnnnngcccttgaccagccagcccgtcgccccgggcgcctgcggtccccctgaacctccaacccttggccccccttgcgtgccctgcgtggggctcagcgcccccgattgccatctcactcgccctgcactgcacccaggctggggaccccccgtgaccatgccatcctgaaacgcaccagcaccaagctcggcggaagatgcaagagaggggggtgggggcagggttgctgccgaggtgctggacgcagggcacgggaatgaggacggggattgcatggagccagggccgcgggcagatgcagagaggctttcgagtgtgggcctcgtgtagcggccttggctgtgaccgctcgccaggcgctccgaccgtccaccgctcgggttgctcgcctctcccccccaaacccccagacacacaccctcgcgccctagccggccgcggcgccgcgcgcggccatgacgcgcagcgctgcgtcctccacccagcgctcggcaaagacgtcggccgggggcaggacatccagcgcgtcaccgccggcggcgatgcgcaggtcgcgcgcctgcgccgccaccaggtggtgcaccgcgtccacggggctgccggcaaaggcgaggaggaaggcgcggcggcgagcggcctcgccggcggccgc

SEQ ID NO: 48101 - DNA, 67 bp, Chlorella protothecoides
atggcgagggcaggctttgcaatggagcagagggtgcctgtatccacactgagccaggggcaggagg

SEQ ID NO: 48102 - DNA, 79 bp, Chlorella protothecoides
aaaggaggaggaaggatgggcgctatctgagccatgttctggcggctcgcctctcctacagcggagggctgcccctttg

SEQ ID NO: 48103 - DNA, 7930 bp, Chlorella protothecoides
  modified_base (232)..(241): a, c, t, g, unknown or other
  modified_base (531)..(540): a, c, t, g, unknown or other
  modified_base (1041)..(1050): a, c, t, g, unknown or other
  modified_base (1138)..(1147): a, c, t, g, unknown or other
  modified_base (1279)..(1288): a, c, t, g, unknown or other
  modified_base (1704)..(1744): a, c, t, g, unknown or other
  modified_base (1807)..(1816): a, c, t, g, unknown or other
  modified_base (1897)..(1906): a, c, t, g, unknown or other
  modified_base (3236)..(3245): a, c, t, g, unknown or other
  modified_base (3439)..(3462): a, c, t, g, unknown or other
  modified_base (4199)..(4208): a, c, t, g, unknown or other
  modified_base (5594)..(5603): a, c, t, g, unknown or other
  modified_base (6237)..(6246): a, c, t, g, unknown or other
  modified_base (6471)..(6480): a, c, t, g, unknown or other
  modified_base (6754)..(6763): a, c, t, g, unknown or other
  modified_base (7843)..(7852): a, c, t, g, unknown or other
gcggcggcggcgacgacgccgccggcggggacgcgcccctgcgcctgctggagcccatcatgcccgcgccgctgggcctgggcgcgaggacggggctggcccgatccctggacgcctggccgcggtcgctgctgccgccgcgggcgcaggttgagggggcttgactggcacgacgcgaccccttccaatcttttcgcgagtattgcacccgtgaacgccatgacctgaagcnnnnnnnnnnatgagggggcttgactggcacgacgcaacacctttcactcttttcgcgagcattgcacccgtgaacgccatgacctgaagctgccgagccttgacgcattgccctgacagggtcacgccctgggacacctataacacggtcccatcccccctaggacagctcgcctgcgggtttcgtacggtatgccgggggcgcgctgaaaacgcccgattcttcctgggcgcgatgctgccgatcaggtgcttttacgacaacaaaacgcatcgatgcatcccgcgatgctcattacnnnnnnnnnntgtacggtatgccgggggcgcgccgaaaacgcccgattcttcccgggcgcgatgttgccgagcaggtgcttttacgacaacaaagcgcatcgatgcatcccgcgatgctcattacaccgcacgcacaacgcatgcagctgtccgcatcggccgccgcagcgtcattcctgcccatctggcaggggtgccgcatgcgccctgcgctcattctcaggaggagtgtgcggacattctcgggcatggccggtggaccgatcgagatctccatcaaggagtacgtcaaccagggtcctgcattgatacgctctgcatcttgtggatcctatctcgcgccggtgattgtcatgcatgaatagtccgtcggaaaagcaaagcccttgccgtgccccgtgcaggaagctcacggctggactccagcccgtcaccctcaagctgaccaacgagagccacaagcatgcgggccacacaggaaaccccacaggcgcccctgatgcagaaacnnnnnnnnnngagggtcctgcaatgatacgctctgcatcttgtggatcctgtctcgcgccggtgatggtcatgcatgaatagtccgtcggaaaagcannnnnnnnnntcacttcaagtgggtgttggagctggggggtgatttttgggggatggaaccaactctgcctgtccttgaacctaacccatctccatgccacgccctgcccgcgcagcgtggagatcgtgtcggaggccttcnnnnnnnnnnccatttcaagtgggtgttggagctggaggggaattttgggggatggaaccaactgtgcctgtccttgaacctaacccatctccgtgccacgccctgcccacgcagcgtggagatcgtgtcggaggccttccagggcaaacccctggtggcgaggcaccggctggggtacaccctgctgaaggaggagctggatgcagggctgcatgccctggcactgaagaccaagaccccctcggaggtggcacgatgacttctcattcccatcaggttataggctgaagcccaggtgacgggttgcttccccttgttaaccctccttgctcggtcagcattgacaaaatctcagccgggaggtggaggcaacaggaggcgcttgggctgacgccgtgcagcagggaccgagggagggtccatgnnnnnnnnnnnnnnnnnnnnnnnnnnnnnnnnnnnnnnnnncaagtgaggagcgtaagcggtgagggagcactgggacagcaaaggtggcacacgaatagccgnnnnnnnnnncgtgagggtgacggtgtacggaggaggggtggtaagtttgaggcttggatgggcttggaagccatgcacgcccaccagaannnnnnnnnnccgagagagcagggacgcaggagcagacagagaaggtgtgtgtatacggattcgatttagagagaactcggcggccaaagtgaggagagtaagcggtgaggggaataccgggacagcaaaggtggcacacgaatagccggcccagccccgcccgcacgcatcaaatgcgggtgcctgccttgatggtggcgttgcgggccaccaccacgatgccagagcggatgaagtagccctcctcctcccgcgaagcctcctggaccccctccctgtgtgggtgtgacggtgtccggaggaggggtggtaagtttgaggcttgcatggggcttggaagccatgcacgcccaccagaacccagcaggcacaccaacttggagagtggcttcttcagtggcaaccccggagccttggcatggccccacccgccccagcccagcccgcgctccgttgggaacaacggcagcatttccctcgtagggccccccaccccgctcaaacaactcacgggtttgtgatgtgcacatcctccgcaatgcgggcgttcttgtccaggatcactcgagtcagcttggaattggccccaacgcccatgggcacctggccggaggcaatcagctccgcacgctgctcgttggactcaaagtagtcctgccccatcatgaggacctcctgcgcatgggagcgaggcgtccaccggctgagtgatgggcggtgctgctttccagcaagctactctgcgcgtgcggaacctctgcccaggcggcagcaagacaccacccagccacgcatcccctgcgcgcaccttcatctccacgcccttgtcgatgcgagaccggatgccgatgatggaagtgtccacaaagcagtccctgaggagcgagccgtggctcaccaccgcatcctgaaggcgagtcccagtggggaaaggttaaaatggggtgtcaggaccggttgtagggaacacaaggacgtgattccggggtgtgcaacgcaacgctggtgcctcgtcaaattcgacgccatcccatagtcatatactgaatcatagggtatgtgcgcccccattaatcttaacagatcacctgtcaatccacccctctctcccatcccccaactcaccgtcacgcgggatcggatgatctttgcgggggggaggaagcgcggcgatgtgtagatggggcccttggggtcgtggaactcgaactgggggggctgcagtgaggacgggaggttgtttaagatggtgaagggctcgtgaccctgactcatcctgacattgatggcatgccgccgatattcatcgctgtcctcgtcaggccacatgtgagcctgnnnnnnnnnnaaactgggggggctgcagtcaggacgggaggttgtttgggatggtgaagggctagtgaccctgactcaccctgacattgatgacatgccgccgatattcattgctgtcctcgtcaggccacatgtgagcctggacccttgcactcccaactcacattccgggtcaggttgatgttggactcgaagaaggactcnnnnnnnnnnnnnnnnnnnnnnnngccatcacctgaggggcggcgatgggatgccaggtcagaaatgaaagtgtggttggaaactcgaggtctatcaactcaaaaacaatcccaacaaggcaccttgttgtccttggccgactgcggtatgatctcccccccaaagtcgttgcggctggggtcgtccttcagcagcttgatcatgacatccttgcggaagacgtagatgcccatggaggcgatgaaggggttggcggccgccgcctctgcatccagccccagcacggtcgtgtccaccgccatggcctccaacgccgcgccgcgcggcttctccgcaaagtccacgatgcggccctcgccatctatcttcatgagaccaaagtcggaggcgcgagtgtggtccacgggaaggcagccgatgctgatgtcggcattgctggcgcggtgcgcctccacgaacttcatgtagtccatgcggtacctagatggtggaagaaatggggggggggtggtaatagaaggaacgccagggtttcaaatcagcatcctcgagaaggagttggagggctgttttctggagggatgtgcatggcctctcctggagcgtggagtcgggtgtgtcccgcccccacctgctcaccccagccacaagaatgtgaccgcgcacatgggcacaggtgcatgagcagccgactcccccaccccacctccttctcgccaccgctccccagaaacagccacagagcccccctgccccggcnnnnnnnnnncctcctggagcgtggagtcgggcgtgtaccgcccccacctgcacaccccagccacaagaatgtgaccccgcacatgggcacaggtgcatgaacagccggaccccccaccccacccccttctcgccaccgctcccctgaaacagccacagagcccccctgccccggcacacacaggtggtcgccggaaaggacgacgatgtcctgcacgttgcggttcttcacgtcttcaaacagccagctgtactgccgcaccgcatcggcggtgccctggaaccaggcgtctgtggtgggcgtctggttggccgccaggatctgcgggatgcgggggagttgggagtggagtgaggggggagtggagtgaggggggagtggagattgatgaggtggtgaacatgaggcagcagagtggagggagtgcgggcgagatccgtcggccgatctataaggcagccaccattgccaagcagccaccattgccaagcagccatgaatgagcacgcccccccatccccgcacccccgcccgccgcacctcgacgaaggagtcccctccaaagcgcacacccgaggtgcccatgttgtaggtgcgtgccagatggcggttgagagaggtggagttgaactgggtgaggatgtagatcttggagatgccggagttgatgcagttgctcatgggcacgtcgatgaggcgataggcgcctccaatgggcacagccggcttggcacggttcttggtgagggggtagagacgggtgcctgccccgccgccgaggatcacggccaggacggagctgctctgcgcgcgggggctggcgctggtgtcggaggagcgctcgggagtggccacctctgcgcggatccttggctgggccctgcgggtcgggacgtggtgatgatccatggggaagaatgtcttcacatgcaccgccagcaggctgggcgggccatcactccggcttgagggggtcgagacagtgaaggcacgagccagtgccactggtttcgacacccacaaccatggccgaccttgagttgcacggcgcacgctgcttcttcgactgcagcctagacccacgcagggcattggtggagctgaatgggctggctgtagcctgggcaaccatgggccgaacaccggcgaatggtgctcggctggtgcaggtgcttccctgcattacggtgggaggcctgagaatgctttgaatctgaaaacccgtttgcaggaccttgaattctatcaatgggtcagggtttgtgttctggcagctcggtagggtgctgaggtcgttgataggaggagggagaggcccaccccctgaacatgcggagcctcccgctttccagcccgattcaggcaccccccccgctccatcatcgccgcgattgnnnnnnnnnngggaggagggagaggcccaccccctaaacatgcagagcctcccgctttccagcccgattcagggcccccccccgctccatcatcgccgcgattggacgccgaggaccccaccccctgatggctgccggacccttgtatgcaaagcacttcgacatcgtcctcgggagcctagccaagcccaacttccagggtcatggagatgggaatctgaaggcggaagccccgtcgcgtggaagttggactgccccatggatccccaccatccgcacacccagagctctttctctgcgcggcaacacagcaacatcctcactccttacattaggaagtgcgtgggaagtggcccgcgggtgtcgcacgcaggcccgggccctggggctcaggctgcaccctggtgggcgcacgatgacgccaccttgtccccttccccgcatgcagggactaccccacgaccgccgatgcctatgatctgctggaggaggcgggccggggcgtcagtgccacggtgcgggggttcatgggtgtcggaggacccacaggcatttactggtgggcaatggacatgtgtgggcatggcatgggaagctttgggggactcgtgccccctgcatcatgcaccctccattggatttcnnnnnnnnnnctgctggtgggcaaggggcatgtgtgggcatggcatggggacctttgggggactcgtgcgccctgcatcatgcaccctccattggatttcgtatgccaggtgtggcgtgcctactgcaaggtcaccaaggaccatgtcgcggtgaagctgctggacctggagaacatgaactgcagcctggtgtgtgtgtattcgtgtagggggggggggggggggggggggggnnnnnnnnnngtgaatggaagcgtggtggtgggcctgatccctatggaatcgagagcatggcattgatcctttgccggccgccctggtgcatctcctctctagcatattcacggggcccgtcggtgtagcgcctccctccccctggtcccccatccaaacacacacaaacacacaccaaaaaaacaaaaaattccctgcaggatgagatcgtgcgcgaggcacagacgatgcgttcgctgaaccaccccaatctgctcccgctcctggcctcctttgtgcacannnnnnnnnnagcacattcacagggcccgtcggtgtagcgcctccctccctctggtcccccatccaaacacacacacacacacacaccaaaaacaaaaaatccctacaggacgagatcgtgcgcgaggcacagacaatgcgttcgctgaaccaccccaatttgctcccgctcctggcctcctttgtgcacaaggacaacctgtggatggtcatgccctacgtctccggcggcagcgtgcagaacatcatgcgcttcgcctactccgacggcctggaggagggcgtgatcgccaccatcatgcgcgacgtgctgcgcggcctggactacctgcactcccacggcatcatccaccgcgatgtcaaggccggcaacatcctgctcaccagctcggggcaggtgctgctggccgacttcggcgtggccgccaccctggagcgtggcgggtcatggggcaaccgcgtggtggcgcgcagcacctttgtgggcacgccctgctggatggcccccgaggtgatggagcagagccacggctacgacgcgcgcgccgacgtgtggagcttcggcatcacgctgctggagtgcgcgcacgggcacgcgcccttcgcgcgcctgccgcccatgaaggtgctgctgatgaccatccagaacccgccgcccacgctggacagcgagcccaccaagaagacctataccaaggccatgcgcgagctggtgggcaagtgcctggtcaaggacccagccaagcgccccaccgccgccgcgctgctggagcacaagttcttcaagtccgcgcacgacgccgactacctggtgcggcgcctgctggcggggttgccctccgtgccggagcgggtgcagctcatgcgccaggggcacggccagaagcccgacgcgcaggaccgggagatccaggccagccaggaggagtaccggcgcggggtcagctcctggaactttgacgtcgcggctctgaaggccgccgctgccgaggcgcgcagcgccgaagagcgtctgccacccatctcggagagtgagtcgtcgactaggttttggggggtgggggcgaggtgagggggggggatgcctctnnnnnnnnnncctgccacccatctcggagagtgagtcgtcggctgggttttggggggtggggcgaggtgaggggggggatgtctctcg

SEQ ID NO: 48104 - DNA, 66 bp, Chlorella protothecoides
gacagtcccgggccgaggagatggacactggggcccacagcaccatacagagtcaatcaccaccag

SEQ ID NO: 48105 - DNA, 61 bp, Chlorella protothecoides
ttgacctgtcctgtccctcagcatgccaccaccctcccccccattgagcaggagcatcctg

SEQ ID NO: 48106 - DNA, 110 bp, Chlorella protothecoides
ggagcgtcaacgagagtcaagccgattcgcgttcgttcgtcggatgcgtgattggcacacaaccagtagatccaccggcacccagcacgcatcggcggattaacagtgaa

SEQ ID NO: 48107 - DNA, 65 bp, Chlorella protothecoides
agacgggaagctgaaggacatgcatcgaaaatctatgacatctcatggaacgacaaagctcaggc

SEQ ID NO: 48108 - DNA, 61 bp, Chlorella protothecoides
ctgccattccactcgcatggatggttcaacactctgtctttttcgtgtttctttgtgtcgt

SEQ ID NO: 48109 - DNA, 100 bp, Chlorella protothecoides
gggtgtcaggaacggattgtcttgcagcaggctgcgtctagcacttgcggcctggcagccgagcgccagcaggcagatcgcgagggtgtaggcccgcatt

SEQ ID NO: 48110 - DNA, 12245 bp, Chlorella protothecoides
  modified_base (469)..(478): a, c, t, g, unknown or other
  modified_base (1121)..(1179): a, c, t, g, unknown or other
  modified_base (1758)..(1767): a, c, t, g, unknown or other
  modified_base (2085)..(2094): a, c, t, g, unknown or other
  modified_base (2147)..(2156): a, c, t, g, unknown or other
  modified_base (2250)..(2259): a, c, t, g, unknown or other
  modified_base (2719)..(2728): a, c, t, g, unknown or other
  modified_base (4805)..(4814): a, c, t, g, unknown or other
  modified_base (5067)..(5311): a, c, t, g, unknown or other
  modified_base (5445)..(5454): a, c, t, g, unknown or other
  modified_base (5512)..(5521): a, c, t, g, unknown or other
  modified_base (5592)..(5601): a, c, t, g, unknown or other
  modified_base (6846)..(7074): a, c, t, g, unknown or other
  modified_base (7127)..(7136): a, c, t, g, unknown or other
  modified_base (8886)..(8895): a, c, t, g, unknown or other
  modified_base (10056)..(10065): a, c, t, g, unknown or other
catgccgcaaggcctggcgcgggcgcggggcccgccgtggtcgtgcccccggcgcccagcggcgcgacctccaccggcggcggctccctcgccggcctccgtgccgactccgggtcgggcggcgaccggcaggagggcgcgcgctccagcaagcgcgcgatcaagaaccgggagtcggcggcacgatcacgcgcgcggaggcaggagtacacgcagaccttggaggccaaggtggctgagctgcaggaggccaaccgcctgctgagggagcaggtgctcaccgccgcggccgccgcggcggccgggagcgggcatgcgggggcgccgcgcgagagcggcgcggcaaacggcccggcgcaggtgggggtcaagcgggcccgttcgctctgacggggagcgggactggctcccagcctttgcggcgacgagcggaagtttcatccctcttttcttgacgtgacgccacgannnnnnnnnngacggtccggcgcaggtgggggtcaagcgggcccggtcgctctgacggggagcgtgactctgtcccagccttgcggcgacaagcggaagttccatccctcttttcttgacgtgacgccacgatgcagctcgggaggcccagggcctcaccttgtgaccattactcttcattctccaccccatttttcagtatgtgatacccagggccagtttgatggaaatcagggcgagaatgtgtatcgatgtgtgccatggccatgtgtgggtgggtgcccgagtctctccaccggcgcgccagccagcgcgcgcgggttaacaatgcggggatgcagattaagccatgctcgggtccagtccccagccagaggagtgtcggggtgggatccccgccttgaacgtcgaggggccagctgcagggttggaagaggcgtggcgtggcgcaggctcgtggtgatggctggcagacccaagagtcagacccccctggtgtgccacggacacaccagaccaatcgtggatctgcacttcaggtgcgagatgggtggatgttggcgtcgtggaccccgatctggagcttcgagcacacatcgccagcctccctgctgcacggctaccgcttcccccaacccgcctcccaccccccnnnnnnnnnnnnnnnnnnnnnnnnnnnnnnnnnnnnnnnnnnnnnnnnnnnnnnnnnnntggctacttcctgatctctgccagcaaggattcctccccccagctccgcaatggcgagaccggggactggatcgggactttccagggccacaaaggggcggtgtgggctgccgtgctcaacgactccgccttcctggctgccaccgcctccgccgacttcacggcccgggtgtggaatgccgtgaccggggacgagctgcattcctttgcacacaagcacatcgtgcgaacagccgcatttgcaagggggcaggactcctgcaagctcgtcaccggaggtgagctttggttgtatatcgcttggctggcagcgggcagactggtggttggggaaggatgggtgtccgaatggctggagggcttgccgttacctttcgtgtctggacctgaggcccgtggttaccccaagccccgggccttcctcgactcaatcccctccccttcctgtgtccccaatcctaggtcccgagaagctacttcgtgtgtttgatctgtcacgccccgatgccgcccctgagacggcagccctggcatccagtatccggggggcggcctggatccacgacaacaaggccatgnnnnnnnnnntgttacctttcgtgtctgggcctgaggcccgtggttaccccaagcccggggccttattcgagttaatcccctccccttcctgtgtccccaatcccaggtcccgagaagctgcttcgtgtgtttgatctgtcacgccccgacgccgcccctgagacggcggccctggcatccagtatccggggcgcggcctggatccacgacaacaaggccatgctcatctcctactccgacaagcccaacctggagtgagtagggagggcggggggggggctagatgctttgcgccaaggcaggcactctgctccggcaagacttgcnnnnnnnnnngggtcctagatgctttgccccgaggcaggcactctgctccggcaagacttgcnnnnnnnnnngtcgctgcggctcgccatcaaaggtcacctgcctttcgtcacccttccgtcctttcttcctgtgcgcagcgtgctggacacgcggacgctgagnnnnnnnnnnagtgcttgcacgagactgctggtcgcctggcgcacccgctgtgaaggggtgccaggaccccaccctttcgctgcggctcgccattaagggtcacccgcctttcgtcacctttccatcctttcttcctgcgcgcagcgtgctggacacgcggacgctgagcgtggtgaagacgctggagacggcgggaccggtgaccagcatcgacgtcacggactgcggcagattcatcgtcaccgccgacggcagccaggttggtgcaggaggtcggcgggggagtggggcagtgtttgagaaggagcctggaggcgcgactgccaggcgcggcgcgcggccgctgagccgaggtgcaatcgccagtgcgggaaggcgggccagggttgccgccgggtcacactcaccgaaatgcatattcacgctttccacccccaactccacacacaatcccacggcgagccaggtnnnnnnnnnnctgccgccggggccacactcaccagaatgcatattcacccttccccccctcacctccacacacaatcccacggcgagccaggtcctgctccacgacggcaccgactttgcggtgaagcgcaccttccgccccagcgggtactcggtggaggcggccgcgtacgcccccgaccgcggcaagctggtggcgggcggcagcgacatgtgggttcacgtgtatgacgagacggacagtgaggtggaggcggggcgggggcaccatgggcctgtgcacggcgtgcgtttcgcgccggggcacgcgacctttgcctccggctcggaggacggcaccctgcgcatctggcagacggagccgccggcggctgctgtggcggcgccggtggcggccaaggagacgagggatgggcagggcgtctgagtctctggcgctggggtgggaggtcgatgccgcctccggcctggtcagagctgcacccctgctcaccctggctgctgctgccgcccctgcacagacgctcctcctgcctgcacacacgctaggcgcatgccaggctcccttgcaccttccactcggcctgggctgtgaacgtcttggcctcctctggtactccattacatgtgcgcaggcgagggagatgcgtgtgaggtgctgcgcagcgggcactccaagagcaggtctcccaaggaaaccaagaagattctacagcagcagtggggtggcatggggcacgctgctttcatcctaacttgtcgttactgggctcacgccagcgtctcctccttccacgagggtgccgatgagatactcacggaccaagtcatgcacagtggcggggtgctgggggccgtggaagccctccgtggcatcgcccccagcatgcgtgaagatggcatcgccccccgggtgatcctcaatgtactgtgtgacgtcatacacccctgccacgcccgtggtcctgctgcggatgatgagccaaagatccgactccgaggcgtgccgggcgacctcctccttcgtgtaccggcccagcggcttctggattggcttcgtggcgaccgctcgtttgccagcatactctacagttgacgggatggtatgtgattgagggcgcagtcatgcaagcgactggaagctgaacagcacaagaaaccaacccagcacgaaggtgggcctcttcaagcagtctatcagaccagcactcacttcgattcttcttctcgtcgatgccaaaccagactcttatgaaagccagcactatcgcaccgaggacgagcgtgacggggagcacccaccccggcagggcagcgtcctccatcgagcccaccaggcagcgttcaaaacccccttattctcgcaccaggagtcccgatcatgcgtcggaagcttcctgcttggacatcgggatcaattcgctccgtcgtgcatctgagctctcagggggtccgtcgatatgggcaactcggcgcgcgagacgaatctgtcacgtggtgcaagcttagggataaataagatatcgtcccaggggcagtgcagtatttctgtggctcctggcgctccctgtggtcggcttataccctagaacaaatttcattaggaccattaccttctagacttatcacattgtcgcctctccaacccctggagacgctttaggattctcacgatgggcacccgcgccctgcccggcaccatgcaaaccaccatcgcctccagcgcgatccccgtggcgtttcaccctgccaaggtgggtaaatgtgtgcccgatgtagcggcgtgcttgctccacgggtcgggctgtgtggcggtggtctttcccccgatgtataccggtgagatccccatgggcgcccgaatccttgcaggcatcgggatcccgtcgccgcagaccctgccgctcccgcaccggactggtgagatggctggaataattctaccgccgccatgaatgctcccgctgtgaccatccccgtggtccaatgcatgggcaattgtgggatcggactcggtccagtgctaaatctcgtcctatactggcccatgcacatgccctccctgcaacaggttaccaaggcagtgnnnnnnnnnnatggtccaatgcatgggccatcgtgtgatcggactcggtccagtgccaaatctcgtcctgtactggcccatgcacatgccctttgctgctccctccctgcaacaggttaccaaggcagtggccaccggcccccgagtaccctccttcaacctaggagggcgggatggcgacgagcccctgaagatccagattggggagggcatgatgggtgagctgggtcggagtgaatcgtcgagcttgcagcaggctgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgttgagggtgaggggggtggggtgccgaccagtgccgcgcgtcgatccctgcatcaggcgccttggacatccatggaaggcacaaccatcctgttgcgatggctgcgccacccttttctccacacacacacannnnnnnnnngagggcatgatgggtgagctggggcacagtgaatcgtcgagcttgcagcaggctgtgnnnnnnnnnntgattgtggtcttctaaccttgcgcaccatcgcatcctgccataggcgggggcttcacctccctcgacccnnnnnnnnnnggcctgggcccagttgctgtgtgtacattgcaaacgctgagtgctgtcttcttgcacgattgtggtcttctgaccttgctcaccatcgcatcctggcataggcgggggcttcacctccctcgaccccgagacccggcgcatcgtccctgtgccagcgggccgccccaaggtcaagatagtgtacgtggtattggagtcgcagtaccagtcctcgctggcagcagcggtgaaccgcatcaacgctgtccagaaggaggtgggcttaaggattgagggtgaggggagtgggggtgtcgaccagtgccccgcgtcgatccctgcattgggcgccttggacatccatggaaggcacagccatcctgttgcgatgcctgcgccacccttttctccacacacacacactcgcacaagtcttccttccttccctccaccccacaatgccaggtgtgcgtggagatcgttggctatctgttggaggagctgcgtgatgccaccaactttgcgcactttaaggcggacgtggcggacgccaacatcttcatcggctccctcatcttcatcgaggacctggcagacaaggtggtggaggcggtggggcccgcccgcgactcgctggacgcctgcctcgtcttcccctccatgcccgcggtcatgcgcctgaacaagctgggcaccttccagatgagccagctggggcagtccaagagcctgatcggggacttcatgaagaatgcgcgcaagaacaacgacaagtttgaggagagcatgctgaagctggtgcgcacgctgcccaaggtgctcaagtacctgccctcggacaaggcgcgggacgcacgcaacttcgtcaacgccctccagtattggctgacgggaaacgtggacaacctggagaacctcatcctgagcaccagccaggcctacgtccctgcgctcaagggcgtggacttcgaggccgccgagccggagctcctgcccgacgtcggcatctggcacccactggccactcacatgtttgaggacatcaaggagtacctcaattggtggggcggttggtgtttttttgggggggggagggggggagttgaggtttgactggttcccccccatgtggggcaaagggctctcgaggaggcagtgggtatttcattccaccaaacccatcctccttccccccatcacatcacaaatccaattcccccatcacattcctcccgttttgacacaggtacgacacgcgtcgcgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgacgccgtgctttctttgactggattcgcgctggtggggggccccgctcgcnnnnnnnnnngggaggcagtgggtatttcattccaccacacccatcctccttccccacatcacatcacaaatccattccccccatcacattcctccctttttgacacaggtacgacacgcgtcgcgacatgcgcaccaccgccgacagccccaccatcggcctggtcctccagcgctcccacctggttaccggggacgaggggcactactccggtgtggtatccgagctggaggcacgtggcgcgcgggtcatccccgtcttcgccggcggcctggacttctcgctgccggtcaagaagttcttctacgaccccctgaagcccagcaaggcgcacgtcgacgccgtgctttctttgaccggattcgcgctggtgggggggcccgctcgccaggacgcccccaaggtgccagacgtcgttgacttgtcgtgtgtgtgtgtattttggtggtgggtgctcaatcgctacccagggacaataacacaatccctggtgctgttgtatctcttcgactctgtttctccctcttctggaccggcacagacagtgcgcgacccaactttccagccccgtgagtcggattggccctgggacaaatgaccatattccccccctcattcatgcatgcaggccatcacggcgctcaaggctctcaacgtgccctacctgtgctcgctgcccctggtcttccagaccacggaggagtggttggagagccagctgggcgtgcacccggtgcaggtggcgctgcaggtggcgctgccggagcttgacggcgccatcgagccgctggtctttgccgggcgcgacgcgggcacgggcaagtcccactccctccccgaccgcattgagtccctggccgcgcgcacggtcaagtgggccgcgctggccaagaaaccggtggctgagaagaagctggccatcacggtcttctccttccccccggacaagggcaacgtcggcaccgccgcctacctcaacgtctttggatccatcttccaggtcctcaaggagctggaggaggaggggtacgatgtaggagagatgcccgccgacgagaagactctcatggagtcggtgctcaaccaggtgtgtgttatgcgtggttagggtattggggagtcgagggcttttgctgtggtggaaggaactcattggggcatgcgagaggactgtgtcactattctgcagatactgcctttgccacgggcatgtctggatttaccttgcttccttgagcagtgccttccaagacacaatgcagacctcctaatcccatcacaccccgctccactcgacccctcacaaccacccccgtcttcctcctcaggaggaggcccgcttcaactctgccgacctcaacgtggcctaccgcatgagcgtggatgagtacaagcggctgtgcccctacgcgaccgccctggaggagaactggggtccgccgcccggcaagctgaacaccaacggacaggcgagggcggctggtagttggcaatggaggggcaggactgtgtgtcacccgccttcttgtagtattgagggctttgtgaaggccattgacacccctttgatgtgccgctgtatgcttgcatgtgcaggcagcggcatgccccgtctgatcgagcacctgtgaccatctgttgcgagaggccctgcaacacgcccaccagtgcagtcaaccccagtcccaatatcccccaatgctccccaccccctccttgcccctcactcacacaggacctgctggtgttcggcaagcannnnnnnnnngctgctccccaccccttcctccccccatcacacacacacaggacctgctggtgttcggcaagcagtttggcaaggtgttcatcggcgtgcagcccacctttgggtacgagggggaccccatgcgcctcctcttctcccgctccgcctcgccccaccacggcttcgcggcctactacaccttcctggagcatgtgtatggcgccgacgcggtgctgcactttggcacgcacggctcgctggagttcatgccggggaagcaggtgggcatgagcggcgagtgctaccccgactccctcattggctcgctgcccaacctctactactacgcggccaacaaccccagcgaggccaccatcgccaagcgccggtcctacgccaacaccatcagctacctcacccccccggccgagaacgcggggctgtacaaggggctcaaggtgggtctggagggttgggcggacctgcaggctggggtggcggtctaggtattgggaatttacgctgggagctgttttggagggcagagagctgtgagcatcaaagaatcagacctcaatgtatcccgaacagtcctggcatcccgcgagagctgtgtttgtagttgtcctcaatgcgcactcatcaatccttgtctctcccacccccccattaaattccaggagctcaaggagctgatcagtagctaccagtcgatgcgtgagacggggcgtgcctccgccgtcgcagccagcatcatcgagacggcccggcagtgcaacctcgacaaggtgtggcgttgtgtgggagggccaacttgtgggagttttgttcactggcagcccaaggaggcagtattcacacacacacacacatcatcatcatcatctgttggccccaacaggatgtggagctgcccgacgccgaggccagagacctcaccatggaggacagggactctgtcgtgggtgcgtggaaatccagagctttgtgatgtggttgttggtttggaagtatgatggtatcattcatgctaacatctgggtggctggggagcactgtgcatcgtagtgtctctatcgacccttggatgtgcccatgcatcccagccgcctgggctgatggcgtacatcccctcccctcctcccccattcccacctctccaggcaaggtgtaccagaagcnnnnnnnnnnagctgggaagcactgtgcatcttagtgtctctattgaccctttgatgtgcccatgcatcccaaccgcctgggctgattgcttacatcctctcccctcctcccccgtttccacctctccaggcaaggtgtaccagaagctgatggagatcgagtcgcggctgctgccctgcgggctgcacgtggtgggcgtcccccccactgccgaggaggccatcgccacgctggtcaacatcgccgagctggaccgcccaggtgagggtgctgggccttgaatccggctgtgcccgcaggtccagcggtgaaagggagggcgggtggggggcgccagggtccagcattggctgctgagctcagacccaccctgcgtccgatgccacccacccctttgattctgaccacgctcacaacccctcctgatccccaaacccaatgcccctcacatcagacgccgacccaccgatccggggcctgcccggcatcctggcccgggcggcaggtcgcagcatcgaggaggtgtacgcgggttccaaccgtggcgtgctcaaggacgtggaggaccttgcgctgatcaccgacacctgccgcgaggcggtgcgcgcctttgtctccggccaggtggacagcgcgggccgcgtcaagcgctccaccaccggcggcggcctgggccgcatgtttgggctggagcgcgaggcctggctggcgccgctgaagggcacgcccttcgcccgtgccaagcgcgaggagctgcgcacgctgttcgactacctggcgggctgcctggccaagatcgtgcaggacaatgagctgggcgcgctgaagtccgcgctgcgcggcgagtacgtggagcccggcccggggggcgaccccatccgcaacccgggggtgctgcccaccggcaagaacatccacgccctggacccgcagagcatccccaccgcagcggcggtgaagaacgccaaggtggtggtggaccgcctgctggagcgtcagcgtcaggagatgggtggcaactacccagagagcatcgccgtcgtgctgtggggcaccgacaacatcaagacctacggcgagtccctggcccaggtcagttggtagactggttggggagggggggaaggggggattgaaaagagaagatggtgcgtgactgtgatttgatccaatggggtctctcatgggcaaacatagagaaggatcattgcaattcttaaacttaatgaatcgccatcacagtaacacacctctccatcgcacctgtcaatcttcacccaagtctcaatccccatctcccatctcactccctttctttcctccccaccccattctaaggtgtgctggatggtgggcgtgcgccccgtccccgatgcgctgggccgggtcaacaagctggagctggtgtccctggaggacttgggcaggccccggatcgacgtcgtggtcaactgctccggcgtcttccgcgacctctttgtcaaccaggcgcgtgtgggggggaggaacctcaggggaatgccttgctcatgtcattgcggtgccttgccagctgttccaacgccccaggacccggcgtccacatcccgactcccacaacaagaacccctcacacatccccccatctcaaacccacctccccaccccaaccccaaacagatggcgctgctggaccgcgccatcaagatggcggctgagcaagacgagccgctggagatgaacttcgtgcgcaagcacgcgctggcgcaggcggaggagacggggcgtagcctgcgcgactctgccacccgcgtcttcagcaacagctccggctcctactcctccaacgtcaacctggcggtggagaactcttcctggtccgacgagcagcagctgcaggagatgtacctgtcgcgcaagtcctttgccttcaactccgaccgccccggcgcggggggggaggagtcacgcgacatctttgtctccgccctgaagacggtggaggtgaccttccagaacctggactcgtccgagatctcgctcactggtgagggtggtggtaggtggtgggcgggtgggggttgagagggccgggtgggggttgagagggccgggttgtgtgaatcgaaagccgaaaaggaggtccccatgagccctcgtacactcttctctgacacccttgctgtcctggtactcctctgctgccctac

SEQ ID NO: 48111 - DNA, 76 bp, Chlorella protothecoides
gtttatttgcttgcagagcggtacattggtatcgctctgtatctcgtactccaacatatgcaatgcatggcttgct

SEQ ID NO: 48112 - DNA, 79 bp, Chlorella protothecoides
tccggcacccctggggcctctttgaggtccttggacctcagctgcgcagtcctctcggaccctcaaaagcttggggctt

SEQ ID NO: 48113 - DNA, 61 bp, Chlorella protothecoides
ggtggctcacaaggagtgtccgatggagccatcccgcccttgaccagcatggccctgcaat

SEQ ID NO: 48114 - DNA, 61 bp, Chlorella protothecoides
gaagcgcaaaggccctagggtgccctgaaagttctgtcacaggccttcgatgtggtggata

SEQ ID NO: 48115 - DNA, 61 bp, Chlorella protothecoides
gagtgtaaaagagtctgcattgtgcatcggattgttgttgggcctgcacgtgcccacgtga

SEQ ID NO: 48116 - DNA, 73 bp, Chlorella protothecoides
ctccagggctcccccgccggcgtggggccccggcaatgggacgcattcctggcctcgctggcagagcggcagg

SEQ ID NO: 48117 - DNA, 61 bp, Chlorella protothecoides
acttcgggccttgctgatgaggttcctgtacgctcctcgcagggtttgggcagcctggcgc

SEQ ID NO: 48118 - DNA, 61 bp, Chlorella protothecoides
cgtggtgggcggcagcctgaacctgcgcggaacgctgcgcgtgcgcgcgacgcgcgtgggc

SEQ ID NO: 48119 - DNA, 61 bp, Chlorella protothecoides
aagcgtgtatctctcatttaaaccgtgtatacttatccacgaccgtgcacagaagtattcg

SEQ ID NO: 48120 - DNA, 66 bp, Chlorella protothecoides
gagggccgcctcggtgccgcgccggctggacggccggtccccggccagcaccaggcagtagcggga

SEQ ID NO: 48121 - DNA, 61 bp, Chlorella protothecoides
ccatcccaatcaatggtgagatgatgggttcggatcatgagtttgtgggagcaggtgtgca

SEQ ID NO: 48122 - DNA, 137 bp, Chlorella protothecoides
aggtggggtgcgttgatgccccccattcgattcgcacctgcttcaccatctggagccggtttgtgtccggtgccttttggctacatgttcaggagattaaagtagttgtgcctgcaagtggcattgtggacttgcat

SEQ ID NO: 48123 - DNA, 130 bp, Chlorella protothecoides
actgcagggttggtggttgcgggggaggggaaaggggtgctggagatctagggaaagagtggggggtgggtaaacggcgtatgcctggtggcaggggtatctgcttggatggtggggcggtttgaggagg

SEQ ID NO: 48124 - DNA, 61 bp, Chlorella protothecoides
tgacgctgggcacagacggaaaaacaggcgaccctgccgcatgccagccggccaccaggga

SEQ ID NO: 48125 - DNA, 71 bp, Chlorella protothecoides
tgccccccatcccctcccccccagcttctacccgacttccgtgctggagacggggcacgacatcctcttct

SEQ ID NO: 48126 - DNA, 129 bp, Chlorella protothecoides
cgtccccggggcccagcgacacgcacgtcatgggcaggcgtgggctgcgcgccaggtcggcgtccgcgtggttcagtgagtcgctccagaccgggtgggcacgcagggtggggtcggcggtgggcgggg

SEQ ID NO: 48127 - DNA, 72 bp, Chlorella protothecoides
gggggatgcacagcatgattccgattccgatactatccctttccggaccttttgagacacactattgtgatg

SEQ ID NO: 48128 - DNA, 61 bp, Chlorella protothecoides
gaggcttcccgacggtcggcgacagcccgcacctcgccgcgctatcactgttccgaatggt

SEQ ID NO: 48129 - DNA, 61 bp, Chlorella protothecoides
ttcaaccatgcgcgcatgcagggtggggtcaagggacgcctccatcccggccctgctcata

SEQ ID NO: 48130 - DNA, 61 bp, Chlorella protothecoides
cctcccccgcttcccctctgtgtccacctggtactcctccgcctttccacggaggcaggcc

SEQ ID NO: 48131 - DNA, 78 bp, Chlorella protothecoides
tggaataaaataagggccggataaataaccaagggacggcccttcaaatctggggcgccggccgcagcgcgcgcttca

SEQ ID NO: 48132 - DNA, 61 bp, Chlorella protothecoides
tgcccaggtcgggcgtggccccggagcgcaagtgcgaggtgtgcgccggcttcaggtccag

SEQ ID NO: 48133 - DNA, 61 bp, Chlorella protothecoides
tgcatctgcgccgtagttgtaatgggtgggggggttgaaagggtgggtggttgtttggcac

SEQ ID NO: 48134 - DNA, 61 bp, Chlorella protothecoides
cacgtgtagttggtaagagtgggcgcggccacctccctggctactgcagagtcaaaggcgg

SEQ ID NO: 48135 - DNA, 75 bp, Chlorella protothecoides
acaactcaaagtgcccttgaactgagacggaatgatgctcagattagagaggcccgcatgtattcattctggcga

SEQ ID NO: 48136 - DNA, 69 bp, Chlorella protothecoides
atagggacctggtctgcgcccagaggcagctggttgtgtacgttgttgctgctgcgttctgtcattttt

SEQ ID NO: 48137 - DNA, 14481 bp, Chlorella protothecoides
  modified_base (1777)..(1786): a, c, t, g, unknown or other
  modified_base (2677)..(2686): a, c, t, g, unknown or other
  modified_base (2886)..(2895): a, c, t, g, unknown or other
  modified_base (6081)..(6090): a, c, t, g, unknown or other
  modified_base (6178)..(6187): a, c, t, g, unknown or other
  modified_base (6420)..(6429): a, c, t, g, unknown or other
  modified_base (6974)..(6983): a, c, t, g, unknown or other
  modified_base (8443)..(8452): a, c, t, g, unknown or other
  modified_base (9133)..(9142): a, c, t, g, unknown or other
  modified_base (9812)..(9821): a, c, t, g, unknown or other
  modified_base (10285)..(10294): a, c, t, g, unknown or other
  modified_base (11158)..(11167): a, c, t, g, unknown or other
  modified_base (12750)..(12759): a, c, t, g, unknown or other
  modified_base (13642)..(13651): a, c, t, g, unknown or other
  modified_base (13969)..(13978): a, c, t, g, unknown or other
  modified_base (14146)..(14155): a, c, t, g, unknown or other
ggcgcggcgttgctggcgcggcccagcgaggacagcgaggcgcagcgcgtgcgccgccgcgccgcgctccaggactgcatgctggagctggcggcgcaggccaagggcctcgcggacgtgggcggcggcgggccgccggcggggccggtgggccgagggccggtgggggtgctggccggcgtgtgctgagagggggcaccgctgccggggcagagcgtggcggcgacaggtcaaccgaggaatacaagggtccctgtcccaaacgtcacgagtccaccgtgccctgtactctatcgtgtgtgagaccctgccgccccgctcacccgtgatccatgccacccttgctccccatggtaacatgcaacaggtcttggtctgagaggggagggccaggtgagtcacacatgtatcagtccctgccgccatggatgcccaccacacagcagttcctgcggctggacgctccaggagtcccctctgcgcacacacacacacgccatcaagccgcctccacgcggcgcccgttctcccacgtcgcgtcctccaggatgccgccgcgccacaccacggaggccagcgcggcggccagcagggccagcgccccaccggccgcccgcgcccagaccggcgtcgtggctcgggcggcgagggcggccccgccgcccaccgcggtcagcagcgccgcaaagagcagggccgtgctgagcttgccggtgcggtgcaggcccgcggcctccatggcctgcgcgtcggcggcgccgccgcgcgtgaacacgaagagcgagccgcgggagcccaggcccagccggacgcggcggtccacatacactgtctgcagggagacggtgctgggcgggccgacgcggatgtggatggcctcacccagggacaggacagggggctcaaaggagacctgaggggcggagattgggagggaggggggggatgcaagggggtgaaggggtaggggcagaggtctggaggcctcagtcgccagggggtagagggagatcctacagaaggacgcgtccacggcaccattccgtgcggcaggagcaccctgccaccgtcccaacaccccccccaggcaccttgacggtgtccagggtctcctcgctgccggtggcaaagttggggatgggctggagcttgccgcgcagcaccacggatccggggatgaggcccagcagcgcaaagcacacctgcaatgggggccagatggcgagcctggccctctgcacctgggcaagatggctgactagacaagcccaggcacaaccaccgccatcctaccccaaacccgccccaccttgttaaccacgatgtcaggggagagcacgctctggaagaggccccgcgtggggaagagggccttccccagggtcgacctgaacctgcccccggccgccgcaccgggctgggccgtgccgggggacacgtacgccaccgaaaagtttccaaacaggtcggggttccgcagggggcgggggtcctggccgtccccgatgcgagccaggtggcggatggtgtcgtcgatgcgggcgcgctggggcggggacacgctgtccccggcgtctgtggagcgaagggtggaggagggacagggggcttgctccatgaagatttcagaacctccctcctgaagtgtaccagaccaaaccccttgtgaccacggggccccttcctgagtcgataaaaaccccgacaacagccaggcaaaccattgttaccccccgacctgtgctctggatgtcctgcaagagggtgtcgaccaggnnnnnnnnnncccccttcctgagtcgaataaaaaccccgacaacagccaggcaaatcattgctaccccccgacctgtgctttggatgtcctgcaagagggtgtcgaccagggtatcgggatgaggagacgtgtcattactggatgtctgctcgaccctctcctgctgcacccggcgcggcgagacacgatggggttgtgatcgggacgggtacatgcgtgggctgggcagggtcagtgcttgtcccactgcaggcctggcacggaggcacgacctgcatggcgacaccctcgcagaggcaacggagtgcatgctgacagccgtcgacattgcttcaggtgcacatgcaatacgtagatcttgataatggggcgcgggagggatcaaacgcaatgtgttaacacatcgcggaccagtaaatcgggaaagtaggtgcctgcatgcaaaatcatgcgggctcgagatctgaagatattcccctgatgcgcagcagcatgcggcgcgttcatcgagcggaccagctctcacggtctgaggagcgatttcgcgcgcacagagcaacgacaggaggtggaaggaggaatcggagtatttcaccggctaagaatgtccacatgtagcgcatgagtggcatgggagcgggtgtcggatcggctcaacccgtacaccggccattatggacgcccagcttccatccggcagcctccaactctacttcatcccgtggatgggctaggccgcaaaggttacggcgagctggaggcagggctcccgtgtgctccgcaggtgcggctctgccctgcatctgatattcatgccattggcccctgttgtccctgaaatgcactgcagcctggcttccctgcctcaaccccctcgcagtttggagactggtgcggggnnnnnnnnnngtgtccctgaaatgcactgcagccttgcttccctgctccacccccctcgcagtttggagactggtgcgggggaagtcggacggcaacatctcgctcatgtcatccctgctggccgccacctcagcgccctacaggtgggcaccaggtcaccccggtctgagcggggcgtgccaattccacaaggaccgtcaggaactctnnnnnnnnnnggcgccctacaggtgggcaccaggccgccccggtctgagcggtgcgcgccaattccacaaggaccgtcaggaactctctttctgcaggcacatgcatgcatgcatacgtcgagtgcaggccgcccccccaccagccatgcccctatcccccccacacacgtacaaacagcacctacctccccgagccggagacctggctgcaccgcgccggcgcgggggccaagcagctctggtgcatgggcctgctctccctcctcatccgcggcgggtctgggtgcaaggcggctgtggtcctgtacctcgtgctcgtcaccaccctgtctctgccgcggcacgtctgggggccgcagctgcggcgcctgggcaccctctgcgccctcctcctcctcctcaccgcgctgggctccgacttggccgcggcggaggggctggagcggggcccggcgccgggcggcgcgggcctctccgccctccccgcctccatgcaggacctgccgggctcaccaaggtacagcagcgtgctcctgaagctggggttcctgcgcgtcacgcggcgcagcttccgcctggcggtgagtgccgcggggcgggcggcgaggctcggctcggcttggctcggctcgccgagcattctttccagatgcatggatcccagggatgcgctcggcccctgggctcggtcctccacacccatggcggtcctgctgctcgatgtccctttggttcaaagagatcattccttcctccctccccttcactccccggccaccacaggtgagcactgcggcgctgacctttgcagcactgcagtcggcctccctctgcctggcctgcacccccccagagcgcatggccgcggcgatgagctctgccctgagcccgctgagggtggtgggattccctgccgacgagctggtgctcacgctcttgctcgcgctgcgcttcatctcaatggtgggctctgggtccaatggacacatgtcgcagggggtgatggggcggaaccctagttcccagtgcagcatgtgtccactgccctgctgcacccctcccctggacgcccatgtcagcatgaggcgctccatgcacccctcctactgatggcaggtgttcgaggagggaagacatctgctcctcggcctggcgaccaggagcgtggactactcgggcctaggggtaagaggtactgccagtatcgctctgaccggagtggtccggttgtttgccaatttgcaggctcgcgcgaacaacgtcgcactctccatgactgctagagggttcgcgggaccggggtcgcaccatttgcgccttgaccggggcgcggccttcctgcaaacaccccagaacgcgattctcctcctgtccctgtgcgctgtcggagcggtttgcagcctcataccttgaaatctcatgtgccgtacatcgatgcactgtggacatagggaagtgtgaatcggcatcttcagcccaccaggctcggcacaaacccgacctgggaggggtatacaagacatcctttccaattttggccctgccacttcctggtagaagagaagagacacctcgaccatctggcgtcgggcctggttcaacccgcagttcctgtcatgatttaggatcgattaacgtcgtttgtaaccttgcaccgtccattgccggggctccactggatttaccggcaggttccagtcagctcccgtgaaaccttccccaccctccacaccgagcgtcttcgccccctgacgcacattcggtggctgtgggaaggccgcacctgtgcgaatcgcaccacatcggtgcaggatgcaggccaagaggccagaggctctagaggggcacgcaaagtatcagaaggtgtggtcgcggagggcaagctcggccccccgaggcagcggagtgccggacgcccaattgatcccctcacacccagccatcgcccaccattgcagatcaaggatctgaacagcggcacattcggattcgtccagttggtgctggacaagaccacagggcgccaggtggctatcaagttcatcgagcgtggtgacaaggtgtgcaggggggacgggagtttggaggtgccattctgggatgagatgccccagggtgtgacctggtcctggtgggaggaggactggcattccagaggtggagctggcggggggtgatggcgcctgaagcatgcccctcggcaggcattgcctcccagccccacccctcgccgccctcaccaccaggtgaccaagtatgtggagcgggaaatcatcaatcaccggcagctggtgcacccgcatatcgtgcagttcaaggaggtgaggcgcctgacggcggggagtgcctggggtccctgtgagtgctgaggcccggatgtcacggctcagcctcgtcttgaggcggcgtcacagcgcctcttcgctgagtcctggcgcaaccccccctgccccaccccccttcctactcccatcccccgccgcttcaggtatttctgacgcccaaccacctgggcatcgccatggagtttgctgcgggcggagacatgtttgagtacgttgtccgcaagggcggcctgcgcgagaacgaggcgcgctggttcttccagcagctgctggtcgccgtggactacatccatcgcatggtgagggctacgctgctcaggcgctgcctgcgcgtgcggctcagtacttcccaggaatcctgacctggcaggctgtggaagcggacgaggcgagccctcctcatcatagcgggtatcgggcagccagcgattcacgacacccacgcactttctttgcagggcgtggcaaaccgcgacatcaagcttgaaaacacgctgctggacggcagcccgcggccgctcatcaaggtatgagggcggtgcgtgatgtgggacgacggtgggatcctgaatgttgggagcctttgtgccaccagcgccaggacctgtcatgctcaaaaccctgtcgtgctgggccgcactgccgagcagtccccaatcgcttactctccgggcccccagatctgcgactttggctactcaaagcacgagaagtaccagtcggcgccgggcagcagagtggggaccccggcctacctcgcccccgaggtgatcatgaccaccaaggggaaaacctacgatggcaaggtatgttggtggtgtgtgtgcgcaaggtttgggtgaggagggtnnnnnnnnnnactcatcaaggtgtgagggcggtgcgtggtgtgggacgacggtgggatcctggatgctgggagcctttgtgccaccagcgccaggacnnnnnnnnnnagaggtgatcatgaccaccaaagggaaaacctacgatggcaaggtatggtggtgtggtgtgtgcgcaaggtttgggtgaggagggtggaagaaggggagatgggatggtctttggccgttcacctgcagacgctgtgtgtgctgtattagggtcacgtacctgtcgagtggcaagtcggaggcgtgcatcatgcatgaattattgttcacacctggggcctgggtgcagcgcnnnnnnnnnnagtctttggccgttcaccggcagaccctgtgtgtgctgtaccagggtcatgtgcctgttgtgtggcaagccggaggcgtgcatcatgcatgaattgttgttcacacctggggcctgggtgcagcgcagcactgtgctgagctctcacgtcgtggcatacatccatggaaggtgctgagcaccggcctccacaccccggtccccctcctttccacccaggttgccgacatctggtcctgtggcgtcatgctgtatgtcatgctggtgggcgcctacccctttgagcggcccgaggacaagcacgacgcgcagaagctgcagaagatgatccagcgcatcctgcgggtggagtacgattggccgccgcacatcaagctgtcgccggagtgtcgggacatcatggcccgcatcctcgtggcaggtgcgtcatgctctcggtctgctgcagcgcccaccattcccagtggacccttcgttcaaaccctccccaacccaccccgtatctctgctctccgctcgcgcagacccacagaagcggatctccannnnnnnnnncggaccttacgttcaaaccctcccccaacccaccccgtatctctgctctcccctcgcgcagacccacagaagcggatctccatccaggagctccaagaccacccctggtacatgaaggacctgccgcccggggtcaaggagatgaacgacaacatgcggatgccgcccgcggggtcccagtcggaggaagagatccgggagacagtcgcggaggctcagaaggcgccggggcgcggcggcggcatcgccggctgggaggacgactacatcgacgacaccatggatgcggagaactacgagtcgtcgttcgacgagtggggggggacctgagcgccccgcctggccgactgccgggaggtgggagggcgggccccgccgcagccgccccgaccagaccctgactgcgctggagggaggcggcgtgagtgcacgcgcccaggctgcccccatctgcttgtattccccgcctttgtccgttggaacttgaacacatttgtacacctagttcatccctcacacgcctcgggaatataccccagcattccagggccctgatgatgacatgagtcggggcgcggcgatggtaatgccgcacgtgcacataaactaaacccccccaaccgctgccccgcccggcccaggcactcgcgctcgcactctgaacaacacaaacgcacctgattcacagccaattggtgtacagaacgtgctacgatccagagttgcctgacgatcccgtctgcaccactgcctgtactgttgttttcggcactatggcgtcgggaccccccggcggcactgacagcctgctggagggccaccctcgctactccaaggtgctgaatgttacccagcgcatgatgagtggggttcgggactgtccacaagggttccggtcgcccacatccccccacacacccgcagatacgagacctgggcaaaggcgcctacggcgcggtggtgcacgcccgggacacggaaacgatggaggacgtagcgctcaaatttatcgagcggggaccgcaggtgcgaggttggagcagttggcggaggagcaatgggggagacagctgccaatggaacggggcaggggccagcttcatgctgcctccaagaggccagctgctgcctgctacctcgccgtcaacgccacctagccatggtctgagtctctgatatccattcaatctctactgaatcccggcagaacgtgaacaagtacgtggagcgagagatcctgaaccacatgaagctgcgccacccccacatcatcggactgcgcgaggtgggtttgccgtggccattgccggttaggggacctatgtatgtgtgctgagcatcgctttctggacgaggggcgaagagcctctgcagaggagcaggtattgcgagggtccagggcagctctctgagccctaggtccagtgacaccttccccccctttgccctgccgaccgcannnnnnnnnnttattgcgagggcccagggcagctctaagccccaagtccagtgaaaccttccccccctttgccctgccgaccgcaggtcttcctaacggccaatcacctggtgctggccatggagtttgctgccggcggggacctgttcaagtacgtctccagccgcaagtccctgggcgagcctgaggcccgctggttcttccagcagctcattgtcggcatcgactactgccaccgcatggtgtgttgagcgggacagtgtgtgggaaggtcaatggggctggagagcaggctcagaaccgagggcccagcatctcatggctaagccaccagggtgctggccatgcatgctgcacgggctggcgggcgggggttatggacgtcccaacccccctactcatgcctccatgtcatcacacaagcccctctgcattccctccttgcagggcgtcgccagccgtgacatcaagctggagaacacgctgctggacggcagcccccgcccgctcatcaagctggccgactttgggtgaggggcctggctgttggcgcatgcatgggccggagtgggtgcggcgatgctcgtgattggttcattgtagccttcgataaagtggagcgaggtcgcagagggcgacaacgcccagactgggacgcttcgggtggtccagggtgcccagcccaaccctnnnnnnnnnncgatcggttcattgtagccttcgatggagtggagcgaggtcgcagggggcgacaacgcccagactgggacgctccgggtggtccagggtgcccagcccaaccctggccccacccacaccacctccacaggttcagcaaggacgatcagcagtctgcgcccaccagccgcgtgggcacccccgcctacctggcgccggaggtgatcgtgagcaagcccggcacgcactacgacggcaagaaggcggacctctggtcctgtggcgtgctcctctacatcctggtgacggggacctaccccttccagcgcgtcaaggactccaccatgaaggggccccagaagctgaacgccatcctgaaccgcatcctggcagtggactacatcttcccggagcgcaagcgcctgtcgccggagtgcaaggacctcatctcctccctcctcgtgctcggtgagctggatgatggagcgtcaccgtgtgccatctggagggtgcttgggggtgtgcaaggttgttggggctgtgagaacacatgtcttggcgcccacacctcagtgctgggcgttgttggccgtctctgctccaaggaaacccaatcccagcatgccctctgtgccgtccgtgccgtggcaccctcccttctcggaccagagatcgttccgccgacccgcccnnnnnnnnnnttctgctccaaggaaacccaatcctagcatgccccctgtgccgtccgtgccgcggcaccctcccttttccggaccagagatcgttccgccgacccgcccgcggctgcccatccagcctcacactctcgcccctgcatcgtcacacccctcccttccccgccccccagatcccaacgcacgcccggacattccggccatccaggcacacccctggtaccgcgtggacctcaaccccgccgccctctccttcaacgacaccctggtggccgacagcctggccaacgccacgcccgactcggtgtacgaagacattcggtccatcgtcagggatgcacagcaggttgtgcgcggcaagccccagcacgcaggcaaggaggggcggagggggccttatatttgagagggggagggaagggggggcagggcgggggatcccgagaaggatcggcgagggcggcccttcnnnnnnnnnncatatttgagagagggagtcaagggggggcagaggggggggcccgagaaggatcggcgagggcggcccttcaccgctccatccacagtccaccgctgcatcagcagtgtatcctcgtctccagccacatcgatcatcatgattccctgtcctgctcacgcgcagatgagaactcgtttgacaccaccctgggatccatggacttggccgccgagctcctccactgactgacccgcggggatgggttctcgactcccaaaccccgacactgctccccgcccaacccggcgggaccccgcccagcgtacccattcatgtcgccctgcgccggctgatctctcctcgccacgcttgcgcctacatcaccccaccacgtgacccccacatcattccagaacaccgtcccaggccccaccgctgcgcaagttgccactgaccactcgatacaagccctttccgtgccattgggtatcgcacacagctcgccaccgcctgcccatccctccacgaccctgctgtaacacagcgcgcccggcactcaagcaaacagccatgccgtctgcttcgcacgcttggcctcctgcttggagcgccgcaactcggccagttgtgcaggcgtgggccgccgctttcgcgccgcggcggcggcagccagttgtgcgggcatgctctctgggtcgccccaggagcccagctccccatacagcgactcctgctcacagacatgggccagggaactggcgtgtgggcaaggatcgagcgaaaatgaatgggtaccaggtgaaaagcctctcaccagcgccgctcagtccactatacgcacattgtgctcccgggtgatgtcctcgctctcaatcgacaaatnnnnnnnnnntgcagccagttgtgcgggcatgctctccgggtcgccccaggagcccagctcgccatacagcgactcctgctcacagagatgggccagggaactagcgtgagggcaaggatcaaacgaaaatgaatggggaccaggtgaaaagcctctcaccagcgccgctcagtgctctatacgcacattgtgcttcggggtgatgtcctcgctctcaatcgacaaatgtcccatcgggtcagcattccaagtccccaacgcacctggcctggggccgacacccggcccctgccccggctgtgcagggcagtggtggtgtactcaccgctcccatggttccaggcaaccacctcctggatggacttgccgacgcccgccgccagtctcgcaacctggcaggctcaggggaaatggcgtgctgggcgtaaacacctgccaaggctccaccaccgcgcagcgtgagtgccatgcaagcctcacaatctccccacccaccccccgcggccgcgcctcacccgcacggcatcgtcgtcgggaggaagccctgccagggcagcagctgcgtagcccgctgcactgccccctctctcctccgcctcgtagatcgcagctggaggggctcggcttgggccctgggcatgggaggggcagagcggggtcacaaccgctgagaatagcgctgatgttggctgccgacggtgcactccttggcaaacgagcgtggcaggggaacaacaatgagggccgcaaacatgtacagtctggtgcgtctgtcgacgagcctgtcccaccagatggtccagccaagacggccacgcagccccccacccctgcatccatcgcacccacagcagacacacccgctctgcttcctcagggttggcatcgtgccactgcctcagcaggccatcgtcgcccagcacggtagcaaggtactgctgcgcctcatcaccagggcgccacatggggaggtccatgggcagatgcccgcgccacgcccgcagctgctccctatcaaaggggccctgtgtcgtcccctccgcatccacgtagaagtatccgtctggggaggggttgtaacccacacctgattcgggctgctgcgccccgcctgcctccctgcaaggctgcccttcccatcctgggggtgcgtgccagacagacactcccgtctcctgacaataccagtagtgtctctgggagttcctgtcaaatgcgcattgccaagaggcttccactgggacgccctctgcctggcctggaaggggggtggcctccgcctgttcaggtctctcggggctctgatgttctgtttcctccttagctcctgtatcgccacactcggtttgttcggcgctgtcgcttggacgtgggctgtcagcactgtttcctgctgacgagctcacggaagcactctcgccggaacatgcgctcatcaagagaccaatggctaggagagtctgatcccttctgtcgtacaagtaaataagaaagtataaatgtttagaacaaatgaaatgttcgagccgtgtcaaaggcatgacagcgacctgcagagcttggcagcatttcgtggcggtgtccctgccgtnnnnnnnnnncaaatgtttagaacgaatgaaatgttcgcgccgtgtcaaaggcatgacagcaatctgcagagctgggcagcatttcgtggcggtgtccctgccgtccaggcgcagcgttcaacccctccctggcaaagatgtgtcgcaagcactgtgcttacgggcgctttcacgggtttggcattatacattgacatacagcgtgatgacgccatcctgcccccctgcaaagacccagggctgggtggggtggaaggccacggccagctgcggcacgccgccatgcaggatcttgacggggacgatgagggggttggtcatcaggtccgcgtacaccattccgtggaacacctggaccagtccgtcgtcggatgccgaggcgaagagcgggtatgatctgcgaggaagggatcatgaggagggggggcctgggatggcacggcagtgggtcaggccctggccatgcctgtgcggaaaacccgcgccggcccctgaccccccaggcccgccgcgaaaccgaggcccctgcacgcccacctgtggaaggcgacgccccgcaacgccttgctgtggaatcgcagcgccctgtatggccgcgtggagaggtccagatcgtaccaggccagtcggttgtcctccgagcccacgatcaggtgatcgcctggggttgggggcggggcaggtgggcgaccttggcatggagcaggcgggccgccagcggccagaggagtgcagcacgcaccggccaagccgaggtcactcatcgcacgatgcaccctgccccaaccatcacagcacgctcaggcatcaagcccgtgccaggtgaagacactcacgcatgtacatgccatccccttcatccccacccatcccaccaacctgtggagtgcannnnnnnnnnccaggcatcaagcccgtgccaggtgacgacactcgcgcatgtacatgccatccccttcatgcccacccatcccaccaacctgtggagtgcagcgcgatgctggtgatcacccccgcccccgtgaacagcttcttcaccatggcttgcttggccaggttgtagatgcggatctgcacggggggcagggcttgggagagtgaccatgcgcccgacattgctccgccaggcgcggaggctcgggcgcacccatcggaacgtgtgttccaggcagtgccactcgtgcagcgcagctgttgggttgtcgacccactccccccnnnnnnnnnntacccatcggaacgtgtgttccagtcagtgccactcgcgcagctcagctgttgggttgtcgacccactccccccgccccgcggcccccccatgccacgagaccccgcacccctctgtccccccgttccccacttcctgcgtccctcgcgcaccccccccccccacccnnnnnnnnnnctgtcccccctttccccacttcctgcgtccctcgcgcaaacaccccccccaccacacacacacacacacacctgctgctgcgtggccaggaagaagaggggcttggtcgggtggaagagcacctgcacgggcctgccgcgcgtcttgcggaagggggcctgcgtcgcgcccttgctcagctggtgcaccagcaccgcctggctgggcgaggccgcggagaccgccgccaggtagtccccgcgcgcgtgccaggtcagcgccgtcacgcgcgcggcgtgcgggagcagcaccgcgccctcgggtcccctgcgccgccaggcgcgctc

SEQ ID NO: 48138 - DNA, 70 bp, Chlorella protothecoides
ggcacaggagggtaagcatgcatgcccacccatgcagggtgcttcttgctggcaacctgttgggcaaaaa

SEQ ID NO: 48139 - DNA, 77 bp, Chlorella protothecoides
aacatggggttgacagggtccaagctgctccggccgagcgagggccgtgcgggcgtgcggccgagcctccagcgggc

SEQ ID NO: 48140 - DNA, 70 bp, Chlorella protothecoides
cgctctctgcccttgccagcctggctgatgtcctggcactggccgaggagccactgtctcctggcgaccc

SEQ ID NO: 48141 - DNA, 61 bp, Chlorella protothecoides
ggggctctgggctgtggaggagaggcggggccgcgccctgcgtgttcccgggaggggtttc

SEQ ID NO: 48142 - DNA, 73 bp, Chlorella protothecoides
aggaacgctgctggaggatggcttgcacccctcagacctcctcatctcgcccaacggcataggctttgtcccg

SEQ ID NO: 48143 - DNA, 72 bp, Chlorella protothecoides
tctccactgctgcagcgcaaactcatcggcgtgacccaacccccgctccccaggtggcctgctggaccgggc

SEQ ID NO: 48144 - DNA, 61 bp, Chlorella protothecoides
agggaggacctggccaatctgcagcggaccaccccctcctactctctcccagaatttctca

SEQ ID NO: 48145 - DNA, 408 bp, Chlorella protothecoides
  modified_base (90)..(344): a, c, t, g, unknown or other
tgcgagtgatagcgatcgttctgtggattacgtttgacatcccaatatgcaatcaggggtgtgcgggagcggtgcggcgtgtcctgggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctccagacagcattcagtggcatcctgactggtgctgtagtgcagtattgatgatgttcatg

SEQ ID NO: 48146 - DNA, 61 bp, Chlorella protothecoides
gaggtcggttcatgtcggggagaagcggggtaccgctggagcacagcatgggcactcagtc

SEQ ID NO: 48147 - DNA, 99 bp, Chlorella protothecoides
tcgagggtgtggcaatgcacccagcgacgtcgcagaggagccacgtgccagctgatcacttcatgcatacaccctttctgccctgcacagtaccatttg

SEQ ID NO: 48148 - DNA, 61 bp, Chlorella protothecoides
aacctgaacctggggagtcatgaaagcgaagggacttcccagcctttgtaccttttcacct

SEQ ID NO: 48149 - DNA, 61 bp, Chlorella protothecoides
tggtgcccacggaagcacagccccggtgggaacccccgagggggcgccaccaggggtgacg

SEQ ID NO: 48150 - DNA, 61 bp, Chlorella protothecoides
acacaatccataccaggctcagaccagattacagtgtccctcttcagtttcgcaactgcaa

SEQ ID NO: 48151 - DNA, 63 bp, Chlorella protothecoides
ggggaggagcgcacgagcgagaacgagtgctgggggggggtgttcccgcgcaatttcctgcgc

SEQ ID NO: 48152 - DNA, 61 bp, Chlorella protothecoides
gactgaatgtcgtcatggtggcatacccagacccgctcttggaagccagccatgaggagct

SEQ ID NO: 48153 - DNA, 61 bp, Chlorella protothecoides
cagcgtctcgccctcatctgtgaccttcactgccagcaactggagcacgccgcagtatgtc

SEQ ID NO: 48154 - DNA, 74 bp, Chlorella protothecoides
gcttgagccagcccccgcctcacccattgtattccagcagcctgtccctgaacagggtgtgagagaggggctgg

SEQ ID NO: 48155 - DNA, 61 bp, Chlorella protothecoides
gtactggtccccccttggctcactcctcattgcaggtgcgccaactggagaccgatgcgca

SEQ ID NO: 48156 - DNA, 61 bp, Chlorella protothecoides
gctgctcccggaaagcctcggggctccaggaccgccggtccagttggctctccagggaagg

SEQ ID NO: 48157 - DNA, 7050 bp, Chlorella protothecoides
  modified_base (541)..(550): a, c, t, g, unknown or other
  modified_base (1111)..(1120): a, c, t, g, unknown or other
  modified_base (1280)..(1289): a, c, t, g, unknown or other
  modified_base (1500)..(1509): a, c, t, g, unknown or other
  modified_base (2396)..(2405): a, c, t, g, unknown or other
  modified_base (3814)..(3823): a, c, t, g, unknown or other
  modified_base (4538)..(4547): a, c, t, g, unknown or other
  modified_base (5518)..(5527): a, c, t, g, unknown or other
  modified_base (5802)..(5842): a, c, t, g, unknown or other
  modified_base (6000)..(6009): a, c, t, g, unknown or other
  modified_base (6508)..(6517): a, c, t, g, unknown or other
  modified_base (6767)..(6776): a, c, t, g, unknown or other
gtggggccgccgccgggggaggcgggcagggcggcgacgcgcgcctcctcggccgcgcgggccgcggcggcggcgtggtgcggctcccacggcttggagaagaagccgccggagcggatgggcagggccaggagggggaggagcagcaggcacagtccgcccacaaacacgctgtgcacggcgggggagacgtgggaggcggccagcgcggtggccgccaggtagatggccaccgtgcccagcacgcacagcgtgaaggcaaagcgtcgctctgttttgcgattggaagtggtggtgggcagtgatggcgagacattggggcgggaggggaatggatgagtggcatgggcactggagggcgagaggacaggttggggtggggtaaggggcactgccccggatacatgcagcgctccaggtcctcgcccgctcaccctggagctcaagtcagcatgtgcacacccgttgctccccccctccgcacaggtaccaactcctggccccacccctgcacacaccggtggtgaaggtgcgccgcccnnnnnnnnnntggatggggtaaggggcactgccccggacacatgcagcgctccaggtacttgcccgctcacccgagagctcaagtcagcatgtgcacacccattgctcccaccctccgcacaggtaccaactcctggacccgcccccgcacacaccggtggtgaaggtgcgccgcccgcgtcgtttcagctcgctgtgctggatgaagggcacgtggcccacgaacagcgtgcccaccaggtcgatgactgcgggcgcgacggccatgaacaggaggaagggcttggcgtgcggcgcaaacacgccgaggtagatggcggtgaagacggaggcggagaggccctcgcaggacttgatgatgcccaccaccgtgccgcggtgctgcggcaggttgcgcacgttggtcaccagcaccaccgtgtcggtccaggtgttgccggagcaggcgatcgcggccagggcgcagacctgccagtacggcggcgagatgcgcctggtttcgatggcggggtgggggggacggaggggggtgggggtgatgtgtgcacgtgagggcagagagaccaggcgnnnnnnnnnngcgatggcggggtggggggggcggagggggatgggggtgaagtgtgcacgtgagggcagagagaccaggcgtctgatcaaaggatggaagatgcagagtctcgaggacatgggcgtttcatggcatagagccgcgctacagcacccgttcacgacatccnnnnnnnnnnacaaaggatggaagatgcagagtctcgaggatatgggcgtgtcatggcatagggccgcgctacagcacccgttcacgacatccactccccgtgctgaccagagaaataggccccctacaaatcccaaaagcaacccccttgttcccatgcattcatgcatgcatgggtgcacggaagaccgaacatggattcagcatggcaacaggcgcannnnnnnnnnatgctgaccagagaaacaggccccctacgaatccccaaagcaacccccttgttcccatgcatccatgcatgcatgggtgcacggaggacggaacatggattcagcatggcaacaggcgcacacactgatacggaacacgatgatgtcgagatctcgatgcatcaccccccaccatacgccagatgatgcagtgcatacgtcacattcccatccacccgcctgcctcggccccccactcaccctgtgacaaccgcccagaggcccaagtagccccccaggttggtgaccatgcccaggaggagcaccaggcgggggcccagctggtgccagtcctgcagcgcgtcatacagcaggccggcgaagatggcggccaggcccccgatgttggcggcggcccccaccagctgcagctggccctggtcaaggtggtaggccgccttcagatccgcagaccatatggagaagcagtagactatgccgctgctcagcccaatgggcaagctggcggcgaaggtggaccacttgttgactgggcgcatgctggcttccaggccgtgccagcccccgtctgcggcagaaacccgggtcagacctcttcaagaacccggcatgcgagggtgacaatgcaggggatcgcaccaccgcgggtcggggattctgcagacttgcacgtgcatgagcgcgagcaaatgcggtgtcgtgaaagtgggtcacccccgggacccgccttcccagcaggcatctcatgaaaccgggatgtcctcgcggtggacgccttcccaccagagaagtctccgacgacggtcctccacctgtgtgaagacgggattcctcaccgaaagccttttgaggtgcacgatactgcttaagaggtacggaccaagcgnnnnnnnnnngccgaaagcctcctgaggtgctcgatactgcttaagaggtacggaccaagcgtgtcgtccccagtttccccgccagccgagcattcgtccgcaaccatgaatgccatcgtgggccacgctgcgagcccatgcaccctgcttcctggtgcgtcagagatatgttatggctcagtgagtatcattacatgctcgacgagcttaaaaagccacccacaccacccgcagaggcggcatggcgacacggcgcggtgcgatccctctctcgcccggtgggtggggccagcactgttgcatggggggttggtgtgccgcgcacgcgctgctgagccagcatgggagcgactagaacatttcgacccaatcccatgctataaatgcctccattcaggcattgcccctacgccacaaggccacacgagtttttgctgccaagaatgatgagttgctcgccaagcctgtcccgcggaggcccagggaggagcaggctcaacaaaaggcagacgccccatcggcagcggtacagggccccacaccaccttcacctgcctcctcacctgccgagacggagaaggccacttccaggtgggtctgggggtgttttctgcgcctgctgcagaccctgatccggcaagagttcatgcaggagatgtgcaatttcctccttttcacaggacgcctggcgtgagcctggagcatcagcgctcccaagccaagctcatgctcaagtacttcagggagaagcaggcagcaaagatccagtccagcggaaggtgcggagccgagagtcgaatggtttggaatgggcttgggatgttggtctggtagacatggggctttggaagtcaggacaccacctcagtctatcgaaaccctgctcctcgcccccacagtatttttggctggaacaaaaagaatgagatcctgaatgggcgctgggtcatgatgggcattgctatcggcttgctcacagaatatgccacgggcgtgagtctagtggaccagatcaagctgatgatctcgtacctgggcctggccgacatctatgactgagtctgctgggcatggctgtggcatgactggcgccccatagtgctgcattgcatgattggcagtccttacatattccaaatggaagatattcgaggtatgattggtacattctgctccatgggcagggcactggggatgactaggatcatgtggtccccagttcatggctctgggcagtcacactcagaatcagagtcactccactctccaaactgcttttgtttgtggaatatacagcattctgcggggtgaaggggtaggaaggtggatgaaccgcgagacattgtcaggattcttgatgaatctcgaggcaggaggagcaagaatttgactgttaatgtatccctctgttgcatggnnnnnnnnnngggtggatgaactgcgagacattgtcaggagtcttgatgaatctcgaggcaggaggagcaaaagtatgactgttaatgtatccctctgttgcatggcgcccttgcccacactgacgtactcttcgatttccttctgttcaacgtctcattatccacgacgtcctcggcccattgcacgccctttttgggcttcttcttccgacgtggagccagccgcaggaccagatgttctgcgccagggagggaggactgttccttgaacggtgacaccaagcgcaccccctccaaggcgagaatcatttactgccacaatataccacagatgatgtgggtgtgggctccttgaggtcaacctgcgagcttcaccttgtgccgctggctgctcgtccactggcgtggatgtgctggcctcctcctcggtggtctgcgctaccacgccttcacgccctgtcgggcgtgtactcatgcagaagttcggacggtggaatgtttgagcctcgttgaccctgtgtcgtgctacgtctacgagcgtggcgctgctgaagtcggtggacgaggacaatgggaggagattctcggcgagaatcaatttcggggcagtcacaggtctaatatgggctgcgtcagataaaaatgctgctgaaagggcctgataaggcttgcatgccgtgtccattggagtagtctcggaaggatgcttcacgcccggggcatnnnnnnnnnnaataaaaatgctgctgaaaaagcctgataaggcttgcatgccgtgtccatgggagtactctcggaaggatgcttcacgcccggggcatcccacacgcgcctggtcgagcgcgcgcggtcagaggcctggacgatcgacagcgaaagagatcgacccagccactggcgttcctcctctgaccccgtagcacgaaacattgcgcagcattggccgatctaaggacccattcccagccgggttggacgacgccgatgtgacagcgtgcctgcactcgccccgatcacttcgcaggcacgcccctcccccctgccatgccctccacctgacgcccgtcacgacaatggccgacacggcagtctcctccagccccagggagctggctcaggccccctctgaggaccccctggaccggcccgacttcgacgtcaccgcctatgtaaaccgcctgtttcccacggaggagtccctgtccgggctggaccccctggtggcctccctccagcaccgcatctcccgcgtggacgccggcatcctagccagcgtgcgccagcagagccgcgtgggggggcgcgcgcgcgccgatctggccgccgcccgcgccgacgtggcggccctctgcgcccgcgtcgccgccattcgctcccaggccgcggccagcgaggccctggtgcagcacatctgccgcgacatccggcgcctggacgccgccaaacgccacctcaccgccaccatctcctccctgcgccgcctgggcatgctcatggccgcgctggacgcgctgcaggccgccgtcgagcgcggcgactatgccgaggcggggaacctgctggaggcggtgcaggcgctggccgcgcattttgccgcctacgcccacgtgccccgcgtcgcggagctgcgcgggcggctgggcgcgctggagaccagcgcgcgtggccgcgcactgcgcgagtttgaggcgctgggcgaggcgnnnnnnnnnncgagctgcgcgggcgactgggcgcgctggaggccagcgcgcgcggccgcgcgctgcgcgagtttgaggcgctgggcgaggcgctgcccccgcccgccaccctggagcgactgcgcgcctgctgcggcctggtcgccgccctgggctaccaggtgcgttgttttgtggggggaggtggggtgcctgtttggcactggctggtggggagggccaagcccctcggtacgacgcaaagggctggcagcttcagccgcgctggccgagcttgcggctggnnnnnnnnnnnnnnnnnnnnnnnnnnnnnnnnnnnnnnnnngacctggccatgccggtggtggcgatgcatgaagccccaggggtggctgcacgacggcattcaggctccggattgcggaatatggtcagggctagatgcctttcatcacctcacaccctgcctagacaggcatacgatactgactgcttgggcatctnnnnnnnnnntgacggcatccaggctccggattgcagaatatggtcagggctagctgcctttcatcacctcacaccctacctagaaaggcatacgatactgactgcttgggcatcttcccacctcccacacactctcatccccaaaatgatcccatgcaggtccgggacgagctgatcgacgcggtgtgccggcgcgagaccggggtgtacacccagatcttcggcatcacgggcgagaccgcgcgcctggagcgcaccgtcaaccgctacaagtggctgctcaagcgcctggatgcgaggcgcgaggtgtgggccgtcttccccccggcctggcatgtcacgcagctgctctgcgtcatgttctgcaacattaccaagaccgcgctggccgagatcctggacctcaaggtgaggaagtgcagaaggtgggggggtgggggttgagggaggggcggtgtcaccacgaggactgggctctgggtctggggagttttgactgctgagcgannnnnnnnnnaaggaagtgcagaaggtgggggggtgggggggtgagggaggggtggtgtcaccaagaggacagggctttgggtctggggagttttgactgctgagcgaggagagaatggctccgagtggtagatgctggatgacatggattgcgcgaacgagtgtggcacctgagacggagggcgccaccagcatgccccttccgtggcccacctttcccctctccctgtcaacccacctccatgggcaaagcagtctgnnnnnnnnnnacacctgagacggaggcccccacttgcatgccccttccgtggcccactttttccctctccctctcaacccacctccatgggcaaagcagtctggggagctggagagccaggtggacgccctggtgaaggcggtggaggcgaccaacatcttcgaggcagagatggcgcggcgattcgagccgcccacgcccgccggaggcggcggcgccgagcgcgcgcccagccccggcccgcgcgcgcgctccgagcacgacggcatgcgcgacgacgcggc

SEQ ID NO: 48158 - DNA, 61 bp, Chlorella protothecoides
ttgcccgtattgtcgcgggaggtgggtggatggcctcttcccagctacatctcaggcagac

SEQ ID NO: 48159 - DNA, 61 bp, Chlorella protothecoides
agtagatgtgggagcctaggactggggaggtgatgtaccgggggatgcccaggagtttcgc

SEQ ID NO: 48160 - DNA, 68 bp, Chlorella protothecoides
agaaaggggacatctggttgtgatcaggaatggaatgaggggggtcgctgtggcacatcccaaagtca

SEQ ID NO: 48161 - DNA, 61 bp, Chlorella protothecoides
gtggacgcctccatgaagaccgagaggccctccgccctgcagaccgacacctccatgaaga

SEQ ID NO: 48162 - DNA, 61 bp, Chlorella protothecoides
gacgggttttaaccgatccatcatcacgcgacagccgatcggctcaccgccatgaatggtg

SEQ ID NO: 48163 - DNA, 75 bp, Chlorella protothecoides
gagaccgcgtggcgtgttgggtctgaacttggacgagtacccttcttcaatcatccaagccctgcctggcctttg

SEQ ID NO: 48164 - DNA, 61 bp, Chlorella protothecoides
ctccccccaaaacaaatttccctgcaggctacaagcggagcgagcgctgcgcaaggcgtct

SEQ ID NO: 48165 - DNA, 61 bp, Chlorella protothecoides
gatcgtggagggactgccacgcgtgggaccttcaggtcccagatcactctgatgctgcgtc

SEQ ID NO: 48166 - DNA, 61 bp, Chlorella protothecoides
ggatacccgtcgctcccgcgcgcccccttcaccccccccttccaccagctgtgtgtgcctc

SEQ ID NO: 48167 - DNA, 64 bp, Chlorella protothecoides
aacagctatggcaacagcttggagaaacctttaaaatcgctaggcatcgcctgatctggtactg

SEQ ID NO: 48168 - DNA, 95 bp, Chlorella protothecoides
ggagcagtggctcaggcagtggtaggcgaactatgaatgctcgtgtctgacctcggcgcatcccccaacgatgagatctggcagcgcgagcgtgt

SEQ ID NO: 48169 - DNA, 15356 bp, Chlorella protothecoides
  modified_base (887)..(896): a, c, t, g, unknown or other
  modified_base (1799)..(1808): a, c, t, g, unknown or other
  modified_base (2374)..(2383): a, c, t, g, unknown or other
  modified_base (2441)..(2450): a, c, t, g, unknown or other
  modified_base (5424)..(5433): a, c, t, g, unknown or other
  modified_base (6192)..(6201): a, c, t, g, unknown or other
  modified_base (6929)..(6938): a, c, t, g, unknown or other
  modified_base (9621)..(9630): a, c, t, g, unknown or other
  modified_base (11945)..(11954): a, c, t, g, unknown or other
  modified_base (12625)..(12634): a, c, t, g, unknown or other
  modified_base (14349)..(14358): a, c, t, g, unknown or other
  modified_base (14648)..(14657): a, c, t, g, unknown or other
  modified_base (15211)..(15274): a, c, t, g, unknown or other
ggccccggcgcgcccccaggtggcggcgcggccgacgaggccgcgctgcgcgaggcggaggaggccgaggcggcgggcgagccgctggactttggtgccgtggtcctggtcatcggcctgcgtggcacgggcaagagcgccaccatcgacagcctgctgggccggtcgggtgatggtggtgccggcgccggcggcgcagcggcctccggcggcggctacgtgcccaccaggcgcgtgagcctggagcgcggggaggtggcgggcctgcgcctgaccttcatcgacacgcccgggctggaggccagcgcgggcgcggcgtcgcgcaacgccgccaccctgcgcgccattcgtcgcgcgttcgacgcgcacaagccgcacgccgtgctctacgtcgacaggctggacgcctcgcgccgcgacgcctcggagctgcatgccctgcacgccgtgtccgacacgctgggcgccgacgcctggttctccacgctgctctgcgtgacccacgccctggccccgccgcccgacggcgcctcgggccagcccctgggccaggacgcctacctgcagaaccgccagcagcagctggtccaggtcatgcgcgccgtggcgggggacagcaggtgaggggttgagggtttgggggtgggtaggggggggttgatcgcaggggctcacatgcctcgtggggtgctcgacgtagtgaagaggggtggcaagtgggttcttccatttctacacctgggcaggtttgcctccccacatgcccagccacaacccgcttgccaagctgccgttccccgcgctcggctaagaaaacaccgggccctcatatggcgcacagcccccaagctaacaaggttccccgcctccccccccccccccccccnnnnnnnnnnattcccgcgctcagccaacaaaacaccgggtcctcatgtggctcacagccaccaagctaacaatattccccgccacccaccctcctccaccccaaggatgatgaaccccgtggcgctggtggagaactcgcccgcctgcgcgcgtggcgcgggcggcgagcccgtgctgcccaacggcgtggcctggcgccgccacctgctcatgctctgcgccaccacgcgcgtgctgaacgaggccagcaccctgctcaagcccgggcggggggccaaatcccccccgggcggcgcacgggcccctcccggctttggcggcggctccatgaaggtcccgcccatggcctggctgctggccaagctggtggagttccgcgcgccgcgcaagttccccgaggacgagcgcgagctgatgcgcgacgacgagatcgcggggctgccacccgcgcagcgcgagttccagctgcgccggcgccgcgtctacctgcgccagcgcgccgacgaggcacggggcgaggagaacgcggtgcccatcctggcccccgagcccgcactggggccctccttcgaccccgaggtgaacaaccaccgctaccgcgtgctggagagccccaaggccctgctcacgcgccccgtcatcggcgagggcggcgtggaccacgaggacggcatcgactcggtgcaggtggagaagtcggccatcctgcgcaagcgcacccagttcctggggggggtgcccaccctgtcctgggtccaggtgcagaaggacaagaacagcctgaccttccaaggtgggatcttgggactgggggttgggggtgttgggggaggtggggggaggggagtttgggtgtgtgtgatatggagggaaacggtttctctcctgctcctctctgacacacctcacgnnnnnnnnnngtgggggtgttgggggaggtgggggcaggagagtttgggtgtgcgtgatatggagggaaacggtccctctcctgctcctctctgacacacctcacgttcaccaaaatcaactcctcactgatcctgcacattcccaatctgcaggcgagtcggacgccgcgctgtaccactccacctactgggtcagctacgcctcggtcaatgcgcagtcgctccagcgcgacgtgctctacaccggccggttggagagccgggtgcgcagcaagggcaagcgccagaagttcaccgtcggcctgctggccagcaagctgggcgaggacttcaccctgccgcccatcaaggtaggggtatgtgttgcttgaaaagtggggaagaggcttggtgtcaggcctgcaaggagcagccggaagtgagtcggccatgtggagaaggggcccagtcagtcggtgcaatgtccaacactgcaggctacatgcagtcaggctgctcttctggctttgcgactctcatccccccccccctcaacccaccacgtaccccgacagggaggcaacggggcgtacggnnnnnnnnnnggggaggggaagggggggcagaggagagggggaaagggactcgtccttgcctcatgcnnnnnnnnnntgaacactgcaggctacatggagtcaggctgatcttctggctttgcgactctcatcccccactccctcaacccaccacgcaccccgacagggaggcaacggggcgtacgggctgaagctggacgagcggctgcgcatcactgacagcatcaagctgcgtgccgccgtgggcaggctgctcaccaagatgggcacccactacgagcccggcacggcggtggcggccgacctgaagctgcgcaacccggccgacgacagcgcacgggtgtgtggagggaggggaagggggccagagaagaggggggaaagggactcgtccttgcctcatgcgcatcacacagcaaggaatgtggctggcgcctccctcccttcgtggaggaaagtcatgcatgctgggaacgaccacagtttttgttcaggtgtctgtgccccttcttgcatcagtgactcactgggacgcacccaacacatcacacagctgctcctgggcggctccgcccagtggcagggccgcgacaagcgcgccgccaagcagtccctggtcatgggcgggaacatcgcgggcgaggtgcggctgcccaagatggacgggacggggatgaagtccgacacccaggtctccgccaatgcgcagtacaccacccggggccaaggtaccctggccctgcgcatcaactcgcacgacgtgccccagctggcggcgatcatgctcgtccccgtcctgcgggccgcctgggacaagtgctttgcgcgggaggtggaggccttctgagcgcagtgtgctgggaccaccgtatcgccgaggtgaaccacgcctgcgcctggggctgtgtcattgctccgtaggtacagcggccagcccctgtcgcttggtcaccccttgagcgttcaggcccgctgcaatgcaccatacccatgccagtctgggccgcccctgttggaactcccttgttgctgcacgagctaaatccttctcctgccgtgcgccggaccttccttcctcgcaccgaagtcgtcgaggacggatgccagcgcaggtgcagtgccacccacagacccctttttgccatgtctgcagctgcatgtgtaagcgccctgcaggtggcaccaaggcccaggctggatggttgtggtgtgcgttctgttgtgttggttcttctcttgaaggtcaaccagcccaagtgaccacagaggtcttggttggggcagagtgcgaggaaagtcgtgcgaccgcgatggctgctccatgttggagttcccatttcaggagaacggtgaatggcaatcatacctaccaccgctgtgcctcatccttccgtatcgctgtgccattcaatgttacaagcttatattagttgacttacagcacgaaaactactgtaggcaagttctgcgcggtcgttggtgagccacgggaactgccggccgcctcacagagcgacggcggcttctccctctctcaccagcacgacaatttttcactcatgaaatgacgaacttaggagtgcagagcagcaaggtgatcgcaagagtcggggtgcgctgaggaggggaactgttccagtctcaggagccccctaagcacacctagactcggccgtataagtacagggaaggggagatgggcccgcccactgtcctgggcttgagagcccgaggaggccagggggcgacagggcatgtgtgcatgcgtctgcacctccaaaaagcagggcgcacagcgtgagctgaaggctggcgcggcccggcccgtcacatcaggcgggccccgccgagggtcgctgcaggcgggacctgcccgccacggcgccgccctggcatccaccactgcctgcatcccccatgaccaggccgggggggtccaacgtcgcaaatgctgcgtccctcccgacactctcacgtccatcccactgggagcatcagtgggcgccgtttccgttggcatgaggggcgctgccgttggaagccgccgcagcgctgccgttggaggccgccgcagcgctgccgtgggcggcgacaccaccacgggtcgcgtcggacactcgccacgtggtccgcgcgcggaccaactccgtctcgccgcgcaggaggctgtgcacgtagcaggccggctccctgcctgcgccgttgtgcgtcagcgcttcctgcggcggcacctgctgcgccagggagcagaccacgtctcccgcgtggcactcggccttgaagtcgatctccacctggtacaggtgagaaccggcccagacctcttccggcaccgcctccagtgtccaggccaggtaggccacgttgttcacgtgcccattcatgtccatgtcggcgcggcgcgcgacctggcggttgccgcgcagcggggccgggtccgccaccgccggcagcttggcgcgcgtgacgtcgctgggcagggccaggcgcggcggctcgcgcgcgaagcacgccgacttccaccgcaccagctccggcatgcggcagggacggcgcgtgcgcatgttgatcatgacccaggtggaggtggcggcgcccaacacctcgccggtcagcttgtcgcgcaggagccactcgcgctgcgcgcccagcttgcccgcggcctggaaccaggtctccacctggaccaggtcgccccagcgcgggtagcggtgcatctggatctgcatgcgcgtcatgacgaagatcaggccccgctccaccagctccgggtcggtggcaaagccctggctgctgcggccccacatcgccaccgcgtggttgcccgcagcctcctgcaggatgttggccaccgcggcaatggtcacgtgctgggaggggcctgcctcgttaccgcggatcctgtggaggggaggaagggggaatggtgagcgggcgagggggagggctcggcgggcacatcagcatggcgacccggtgggttggaaaacggtggccgtcccaacatgcaccgacgtagtgtacaaccaaaaccccggggccgcaccggnnnnnnnnnnaggaaacggtgagcgggcgagggggaggctcggcgggcacatcagcatggcggcccggtgggttggagaacggtggccgtcccaacatgcaccaacgtaatgtacaaccaaaaccccggggccgcaccggtgctcctccaggaagacgcgcttgttctccaccatcttgcagggttctaaggaggtccaaaactcctgggcaggctcggggcggacagagtagtccaccaccgcctccgccaggctcgcccgcggcgcgcttaacctgggccgggcatggccagctgcgcgcccttgatgcctgaagacccgatcacccgggccggggcgagaacgtgagcagaatgaagcggcagacttctgtatttggccagccaaccagggagcgggaggagcggttaggacggtcatggccggtccgggtgttcaaacgtgtgaaagggagatggaggagcaggcgcggggttctctaggccatcgacgatcaaatgcgctgcttaaattcaccaagtgctggaggaacgggtcggcagggtcctgtatgtgccaatctgtcagcgacctggccacccaagagctgacagaatggagctccccactgcgtcaatcgacggactggggtcgaaccgcgcgcgccttttctcatgtgtttgggctgatgggcattccgaggtacgccaggtggtgagagcctttaggtagtgtatattcgattgtggctcgatttcgaaacaacgcaaactgagagccgacttcaannnnnnnnnncttgggccgagaggcattccgaggtgcgccaggtggtgagagcctttaggtagagtatattcgattgtggctcgatttggaaacaacgcaaactgagagccgacttcaaaggggagggatgggtgattgagccagccacgtcagagtagggtgatctttgccccgaggctcctctagcgctcctcccagggcccaacttcacctaccatcatggtcagccaggacctcgtactggatcgggatgtccgggactgggtgctgatccccctgaccgtcagtgtgatcctcatgaagctcctgcagcagtacgcagtgaaggtaaagaggcaagcacaacacagagggccgctcggtgttgatcatcattggtagtgccgggtcataagattgacctatatgtacacttgcactgcagctcatggccgcacccaagcccagcgagccaccaaagccggaggacgtgcagcagaagaacactctggcccgcagcggcctcctccgtgccaaccacggcttcatctcggaggcgggattccgccagcgccgagcttatttttctggcaaggtgtgggaatatgtgctgcgggaacagcgtccaggaagacaggatgtggattcagagacactcatcgctctggagtgctcagtgtgtgcgccacccatctggggtccaccaaccaagcagtgccctactcgccacaggagggggtcctgcagcaaaccttccnnnnnnnnnntgccacccatctggggtccatcaaccacgctgtgccctactcgtcacaggagggggtcctgcagcaaaccttccccgccaagggtctgaacgacatgatggggaatccagacgctatgcaaggcatgctcaagcagcagatggggggccttgtgccacaggtgggttttgagaatgctttctgttgttcctggctacttcatggaggggcatgctgccaggggcagctccttggatgcatactgctcctcgatgcgtggagtgccctgcctcagaccagagcaggcggccgatgtcttgacctcacctgcaagtgcctgcttgccagatgcgccgtaacggccctgccactccgatccactcaccgcagatgggcatgggtgcctttgtcaactacttcttctccggcttcatcctgggcagggtcccattctccctttctcccaagttccggcccatgcttcagcgcggcatcgacctgcccgccctggacccctcctacttcacctccctgtccttctacatcatggccctgttcgggctggggggcgtgttccgcctcatgtttgcggaggacgcgatcaacgacgccgcgcagatggcccagatgcagatgggcgggatgggcggcggcggcccgcccaccctggacccggccaaggcttacgaggccgagcggcaagcgctggacgtggtgaggatcctgggggcgagggaccaggggagaggggacaggatacttgtgtgtgtgcacgctggcctacagtggttgggtgcttccattgtatactgcggctatcaccaggatcaagtgttcaaccctggcgccacatttcaccaaggtggagtatcgctcccggctggagaactctgagctgaggagcctgaagctgctgcgtgcccaactggccgcctgaggtgctctgggtttggcagcatgccttttcccgtaatgccctgttgcagcgctgcctgtatgcaacacctccaaacgcaaagaagatggggagggaaggaattgctcgactgcagaaaggcacctgagagacctcggagcctcccctgtcagtatatctcgatttgcccctgctcaatgatgctttcaacaactattttagccttgcagcagcctagtcaatgtaatcgttgtccaccacagagaacagatgctgggtgagacacgagccaggaaactaatcgcccctcctctgactaggctctcattcctagagccccacaggtgccaagaagtctcagctgcctctctagctgccctcctccatggcgccttcgtcataccagtgcaccatgcccagtccatcgccatcggccttggcggtgaccaccagaggggcgtgcgggcagtctgcagagccagggatcgggtcacccctcgactgcgcggcgctctggtcgacgggcgtgggcggaggtgtgtaggtcaggcccgtgacctggagcctgactggcaggccggtctcaaagtagagctgagaggcgccctcctccccttctaggtcccatgaccatgccttcaaggggggttgaggtaggaaacattcagtcagctgctggtcgtcataggacgccgaatgaactcccgccagcgtcctgctttcatagttacgcaaggaggcccaagccgagatgtctcagtccttgtagaagggcatcgtgttcataccaaggattgtatgggattccatggtggaactgcactaccccatttgcacattctgggcgcaccttctcctcaggatcccagctgtgcggttcaggcatcccgtacggcggaatgacaatgtcttcaaaaaagccgagcccgacatggaccccagtcctggcagtggtgtgtgaaagggcatgtgcacctcaccaacgatggggggaagcggccatgtaagtgcacaatcggtacacctcacacaaaccccacgccaagcgaccccacctctcgtcctgggagatcacctctcccaccagcacttcttcttgggacgggcggaaggcgacgacacggaaggtggtatcgtggtgcactcccccatctgactggaacacgtagccatcgccaatctccagtaggtcgtacagcgtcaccaccaggcccaggtctgggatgacgcggtcgaggtacgtcttctcgaggacggcagtgaccgcatctgctgtgtccaggcggagatcctgcgcgcagggagggtggtggaggttgctaaaaggagagaagcccactctttctagtgggcagggatggagctcaagcagaccaagttcatacactcacggcacctaccttgggtgctagtcgcactttgtcctccaatgtgcacaggacgaacatgggtggaggccctgtctcatggccgtgcggtgcccgggaagcaagggccaatgcgcttgagatagtgcattcaacccctattatttgtgacgtatgataaaatgtacatccagtgctctttaaatcccagacttcgccccgacattatggggagtcgatggccggattctgtgccccccggtcccgagggcgcaggcgcgactagagttcccaggagctctggccccaggatggaatggatacggaagcgcttgttcgagtaccaatccactgtagggtttcgaagaccaacttacaagcccttgtctgttgctctcatcaattctcgattgcccaaatnnnnnnnnnnagggaatcgatggccgggttctgtgccccaggtcccgagggcgcaggcgcgacaaaagttcccaggagctccggccccagaatggaatggatacggcaacgcctgttcgaataccaatccactgtagggtttcgaatactaacttacaagcccttgtcccttgctctcatcaattctcgattgcccaaatctgctcgcaagatcaaaccccagcacggccagggaagtacggccaagcgcatgctgcgcatggacagtggtcaccgttgtatgaattgggtcccatgaggcggtggggcaaaggagcgcgcagcctggaagtcctgccacgctttgaacttcctgccatcgtctgcctgccaccatacagggaaaactcaatatggtcggcaagattttcacatcagccccccttgctattgctctcgactgtttagcactctcagttgccatggtgaatttacaggctcctatcaagctgtcctggcaggcatgcggtcagacagacccgcagctattgaatggaaacatcaaagcaagattgtacgatggattggacttcaacatgcatgcatatactccaggaggtactaggaatcagctcccgccatcgactcagcacaaagaaagccatgtttagaaaaccagtcgtttcaggcctcaccctcctgccccctcctaaagctggggcagcaggctcttgagcgccgccacgacggcggcggcagtctcgcgcctcgcccggtccgtcagcaggcactcggtgtgccgcgatgtcaggcccaggctgagcacgcggtccacgtcgcagtgcggcgtggtggcggccaggaacagcgccccgatgcggtcctccggcagcagcgtggccaccggcccgtcgaagacgccgggcggcgtcgcggcgggcccgcgcgacagtcgcttgagcagtcctgcgcggtccagggtggtgtacaccgccgcgtcccaggcctcctccgcgtcggccagctcgggcggccggaagctgttgagcagcttgagctgcgcggcgggggacccggcgccgcgcaccacatccacgaactcgcccatggatccgcgcaggcccccgatctcgcgcaggaggtagaagagcgcataccaggagacgtcgtgcagggggagggcgggcgcgccgacgcagccgtcgacgagcaccaaggccacagcggcgccctcggcgcgcagcgcgcaggccagcgcgtgcgcgagcagcacgccgccgacgctggagccgaggaggaggtagggccccgcgggctgcagcacgcgcagcgcggccgcgtaccgcgcggccagctcggccagcgtggcgcaggcgtcggcgtctgggcccatggccaggccgtagacggggagggggagcagcgccgccagctccttctgcgcggagctcaggtcgccgcgctcgccgtgcagcacccagagcgggatgcgggtcagcggcgcggcggccagcgcggcgggcgtcccgctgtgcagcgccgtggcgcggcgcaggatgtagcgccgctcggggcagaggcggttgagtgggaggaccaaggtgtacgtgtccaccggcccgtccccgcccggcagcgcctcgctggccgcgccgacggagatgcggcgcgacacgcgcgcggtggaggccgacggcgtctgcgccgtctccgaggcctgcgccgcgcgctcctccgcgcggcgcaccacgtcccacagcaggccctgcagctcggtggccagggcggtgccgggggacacgccggagcgggcgccggcgcccaggctcgcgctctccagcggctgcaccaggaaggcgatgctctcccaggcggcgtgcacggtgccgatgggcgcgggggccccgcaggtcaccgccagggtctggcccaggaacacgtccgaggggcggtactcggcgcagatggacgagaagtaggccaggcgggagagcagggcgttgatgcgctcgtcccagtccttggtcttctcctgtgtgcccagaggggaggggttggggtaggggggagggatcatgagcgagggttttactagttgtcgagtggtaagccatcttgccccctcctgacaaacacacgagaacgcatgtccctctccccgccagggcgcccaagacccacccaagacccccccttctctcacagtacatcgaccctcaaaccccctcacgtggtgtggccggaacagtgcgatgtagtccagctgcccgtcaaagccctggatggagcccaggcgcgtggcaaaggcctccacacccggcgccccccccgccgcgccgccctccnnnnnnnnnnatggtgtggccggaagagtgcgatgtagtccagctggccgtcaaagccctggattgagcccaggcgcgtggcaaaggcctccacccccggcgccccccccgccgcgccgccctcctcggcggcggcctgcacggtggggtacagcaggctggcgacctggcccacctccgcggcgcgcgcgggcggcagccaggccagggccgaggcgcgcaccgcctgccggccctccagcagcaccaggcccagcacgcggtccgatgcggcggccgcctgcagcgccagctcgtgcgcgaccaccgcgccgaagccgacccccgccagcaccaggcggcgcgaggcggggacgtgggcgcgcagggccttggtgcacaggcgcgccagctcgggcacgcttggcgactccagcagcgcgctgtcctgcggcagcttgaccacgaaggccggcatctccagcgcggccagcacgggctccagcccggcggtgccgccgttggcgtcggcgcagaccacgagcacgggcgcggcgccccaggcgccgtcggtcagcgtcagcgcgcgcgcgcccgcgttcagcggcgcgacctcgtgctcggcggccacggcctccatggccgccgtcaccgcctcctcatccagaccggggagctgggcctccacgcgcttgcgcaggnnnnnnnnnnagcctccatggccgccgtcaccgcctcctcgtccaggccagggagctgggcctccacgcgcttgcgcagggcggggtccttcacccccatcttctgcaggtaggcgtcgatgtcggggatgtccaggctggacgcagcggccctgcgcccgccgcggttcaggatctcggtccagccgaagggcgccagcttgactttgagcgccgtgacgatcaggttcatgtcgcggtcgtcctggcgcaggacggagaagtggtcgccgggcaggtcgatcacctcgatgtcctcgcacaggtcgtaccagcagaggccgtgcgggtgggcgcccagccgcccgtcgtccatgtaggtgcacatgccgcggtccttggcccggaagtagaccaggggtgccttggtgcgcggcgccatgtggtagtggtggcgcaggtcggagatgttgctggcctgcttggtgaccagggccacgtgctgcacctgctccttgacttcctccaccgagagcggcgcgtcgcgcatgacgcgccagatgggcgcgaagaactcgatcttctggtcgaagtccatgcccttccactgctcgctctcgcgcgggtgcgccatggaggcgccgatgcccaccgcgtcctgcccaagcgcgcccaggatcatctccaccagctccagcgtgtcctcctgagtggcgacagggacgtcgggctgcgcggcccggatctgctgccgcatgggcgtgtccatcacctggtgcaaaaaggggggggggggagttaccgtgtgggtgattgcagagtcacttcacattgcgattttctgattccaacactgcacatcccagtgatgcctgcagaccaatccggcctgaccctggcagaccaacccgccacgtccatccagaccaatccgacacttcaatgcagaccaatccgcccccttcccaagggacaccaatccaccacttcccaaatccacccctatgccccttccgacacccaccaggacgaggccgacctccaggccccagctctccagcaccatggcgatctccatggccacgcagccgccgtaggagtgcccgcccagcaggtagggcccctcgggctgcacgcgcacgatgtcggcggcgttgcgccgcgccaggtcggccacggtgaggtcgttgtccttgtccagcacgtagatgggctgggtgctccaggccaggtactgcgagaaggagaagtaggcggcctgcgcgttggccacgccgggcgcggccaggaagagcgggcgctgcgcgggcgggccgcgcaggagcttgagcaggtccgacggcttctcggcggcagcggcgccggcccccgcgccgccgcgcttgggcggcgcggcgcggggcggcccgcgggggctgcccgacccggcggagccccggccctcctcctcgctgtccacgctggagccctcctccggggcctcctcgggggcggtggacaccgccgtgttgaggtagtccacgatggcgttgatggactggtagtcgtacagcagcgtcacaggcaactgcgtcggggttgtttgggaggggtgtctttgtgtgcagatgtgtctctggatgaggcgaatggagtacagagggaagaggtcgtgtcaggatggagggaatgctgtggggcatgggaccatgcaaagacaccagcacagtacacatacacacacaccgctcctcacctgcagaccgnnnnnnnnnntatgcaaagacaccagcacagtgcagacacacacaccgctcctcacctgcagaccgatggcgtccgccagggacctcctgagctccatgccaccacgtgaatccaggcccgccaccatcagcggctcgtccgggtgcacagtgtggcccagcatctgcctgacctcccccatgacctgttggtgtgagggggatgagggagtgttgagtgaaacagggggatggcagggctccctcgagagctcaatgccatctcttctctgcgcccgacacagcacaaagtaacctagnnnnnnnnnnataagggagtgttgagggaaacagggggatggcagggctcccttgagagctcaatgccatttcttcgctgcgcccgacacagcacaaagtaacctaggagtggctcttgcccactcccctcaacattctcacctgggcttggaggtgcagcatccgctcttcttccgacatggcaagcagggggtggccagcagccagccccactgccgcctcctcctcctcgccagcgccagggctgccgcccgcctcctcgccctcctcgcccaacagcgcggcggctgcgacctgggtaggccccggggaggtgggtggcaggtcgtgctcgcccagcaccaccccgaacaggctcatggccgcgccgggggtgcgcaggctggcgcccccggacgcccaggcgtccagcggcgcgtaggtacccagcagcgcgcactccgcggccggcgccgtggaggagagcagggcgcccggctcgctgcgcgccagcagcgtctccacacgccgcacccaggtgaggggcgacggcgcgccggggcccgccgccagcgtcccagccnnnnnnnnnnnnnnnnnnnnnnnnnnnnnnnnnnnnnnnnnnnnnnnnnnnnnnnnnnnnnnnngcagaaagcgcggcgtccagggtcgcggggtgcgtgcccgcgggatacccgctgacgtcggcggcgcgcgccgcggcggcca

SEQ ID NO: 48170 - DNA, 68 bp, Chlorella protothecoides
gaagggattgtcaggtctcttgagtatgtgatcgctgctcaccatgtcctccgccattcctacttgtt

SEQ ID NO: 48171 - DNA, 61 bp, Chlorella protothecoides
tataccaccacgaactcatgcgaggatgttggaggcgagtgtccatggtatcaccttgggt

SEQ ID NO: 48172 - DNA, 61 bp, Chlorella protothecoides
cgacatggggtgaggaatagagtgggtgggtggcacgcgctggaactcgaccgacgcccag

SEQ ID NO: 48173 - DNA, 16617 bp, Chlorella protothecoides
  modified_base (504)..(542): a, c, t, g, unknown or other
  modified_base (2627)..(2636): a, c, t, g, unknown or other
  modified_base (3597)..(3606): a, c, t, g, unknown or other
  modified_base (4404)..(4413): a, c, t, g, unknown or other
  modified_base (4800)..(4809): a, c, t, g, unknown or other
  modified_base (4870)..(4879): a, c, t, g, unknown or other
  modified_base (4981)..(4990): a, c, t, g, unknown or other
  modified_base (5290)..(5299): a, c, t, g, unknown or other
  modified_base (5640)..(5649): a, c, t, g, unknown or other
  modified_base (6412)..(6421): a, c, t, g, unknown or other
  modified_base (6718)..(6727): a, c, t, g, unknown or other
  modified_base (6831)..(6840): a, c, t, g, unknown or other
  modified_base (6943)..(6952): a, c, t, g, unknown or other
  modified_base (7562)..(7571): a, c, t, g, unknown or other
  modified_base (7867)..(7876): a, c, t, g, unknown or other
  modified_base (8240)..(8249): a, c, t, g, unknown or other
  modified_base (9581)..(9590): a, c, t, g, unknown or other
  modified_base (11107)..(11116): a, c, t, g, unknown or other
  modified_base (11317)..(11378): a, c, t, g, unknown or other
  modified_base (12668)..(12677): a, c, t, g, unknown or other
  modified_base (12818)..(12827): a, c, t, g, unknown or other
  modified_base (12904)..(12913): a, c, t, g, unknown or other
  modified_base (12992)..(13001): a, c, t, g, unknown or other
  modified_base (14042)..(14051): a, c, t, g, unknown or other
  modified_base (14178)..(14187): a, c, t, g, unknown or other
  modified_base (14394)..(14403): a, c, t, g, unknown or other
  modified_base (14744)..(14809): a, c, t, g, unknown or other
  modified_base (15184)..(15193): a, c, t, g, unknown or other
  modified_base (15420)..(15429): a, c, t, g, unknown or other
  modified_base (15567)..(15576): a, c, t, g, unknown or other
  modified_base (15788)..(15797): a, c, t, g, unknown or other
  modified_base (15876)..(15885): a, c, t, g, unknown or other
  modified_base (16037)..(16046): a, c, t, g, unknown or other
  modified_base (16427)..(16436): a, c, t, g, unknown or other
gcacatacttgcagaaggtatccgcgctgtcgagctccagcatgtagacttgcggtccatatctattggagatgatattggggatggggaggatgtggagtcggtgcacacaatccggaggccgcgtcccataccttcacgcagcggaatccgggcatccagaaggagattcgcccacttggattaagcaggccgtaaatacaaccacccgagtatgccattcgcaacttacgtggctgctgggagtgagaagaacttggaagtgcacgcgccctgggagaaggaaggtggggtcttgccagcatcagaagccggggctggctaaatcaccgtcccagtccttcagaagaacgtttcatgtaaccaagatccttcaaacctacatttgaaagcacagcgaggctcaagagaaggggaactccgctccaacgcggtgtccgtccgtgcgacggcatcatgccgaactatatccgcgccgagctgggatgtccttgtctgccagannnnnnnnnnnnnnnnnnnnnnnnnnnnnnnnnnnnnnnggataaacggtttcgtgcataacctgttgtgttaatttttgcgtgcccatttcgataatccccctctttttagttctagtcgaacgaaaactgtgacaccggcgaccatccggggagcacaccttcccccacaaatgaaaccggggtatgtcggcattacggtggacgtaccagacccgacttcggtggatcgtcttgtacttgaaggtccacagagctcttcggtcgtgactcgggtgacaacaaccatacgcgagtgaccgttaaaggcagcctctgctcagcatcctacccgcagtaatatgcccgatccctaccctcacttcatgtcctcgctttgtaccttttctgataagcatatataacgcctgagcaccactcacaaaaaggatctggaggccagagcatgcacctagggccgaaacgcctggctcgcgccaccaggttggctggaggcagaccctccacagcacacctcatccatgcgcatccctgtgcctcaaagcatcagcctgtcggaactcgagtatgaggttctggtgatgtccgcttgggccgcgacaatggtccaagtagaggatctctcccatgaatgtgaccctggaggacttcccacatgaggtatggcgaggctcgtggcaagtttgcacccttgactcacacccacacaccttttgaagtcgattgctgcggtgatggtgggggtgatggtcgagtcgggattataaactcattccaaggggggtacaaagaaatttgcacatcgtgcacagcacactccccctcacctaatcctcccgctctagatcatccaaacgtggcggatctgagtaaaaaatgttacggagtgacgttgcactggcctacgcgtcctgccgctacagaggtggttgtccactcgaaccttcagaaccgcatgggctggtgttttccctcacaccttggacactcaatccatacttctttgagtctttccatcatgctctaacaggctgctcatttcgggaaaggctgcaagaggctgacagggacaatcatggtcaccatagccccgccccttcaagatgacggatggttagagatcttcaaattcagacactgcttgagctgaacatcactcccaacagacattcataccgataagcaatccttgtttggacgctccgacttccacccgttggaggctagtaaaacagtatgtgtcgccagggttcgctgtatcaggcgggatgttggtgtacgtgtgggagtttggactggaccatgaatagagcttcctatcacaactgtagagggtgatactatttaggtagtaggattctaccatcactgtatccttcactctgttgcctccaaatacaaccgcctctagaagttgggcaggtagggttggtgggaggggagggggagaaggcgggggagatggcggagagtgggggggaggaggactgggaagaggactgggaggaggagtggcaggaggactgcgaggaggggaggcaggaggactgtgaggaagagagggaggcgttggtggagggggtgatctgactggagggggtggcatagacgccttctgtgatgcggtggggatgccttcttcgggggtgggggtgacaccttcttgggaggtgggggaaaggccttctttgggggtgtaggagacgggtggttgtagtccctgagcgcagtcttgcaaagttcctgaaggctgcacgggtaggtaatcgttgtccaggttgcaactgcgttgttgcaccgcagttctttgaccttatcgttgcaaccccagttgagttctcccctgttagaatctcctgtgaagtacggagtcaagaggttgaatcaggaccaggtcatggtcatgcgcagcgatactctccctccatcaaattcaacacctggagtccattaccgtccgaccattcctatcatcctgctcaccagtgttgttgttgcccacattcttgtcgccaaagttgttcttccccgcgttcccggtaccaatggtgctatccttgtccgcgatgcatgccatctgttcagtcttgagccactcgacgctcaacaggattcttgtagacnnnnnnnnnnaatgcatgccatctgtccagtcttgagacactcgacgctcaacaggattcttgtagaccgacccttaatgatctcaaagagagtcatcttgatggcgctggcagaaacaccggggccgtgcagagctgtctccctaacaaaattcgccttgccgttgcccattcacctgtgaaggttgacatcgggaagctgcatcagtcattgccagccacttgaggaatgtgactggcttggacctgcaaacccacgcacgaccaaatccgacccaggacgaacctgcagatggcatcagcgctgctgacatccagcatgtagacatgggacccgtgcctgtgagagccgagagggaatataggggtggtagtcaggactagagttacaggtgtccggatcccggttgacccaacttggcggggcgaaacttcctcgtcgcacaacagcatccggatcctccgggagcaagcctcgaagacaacacgcctcaactctagacagtcatataacaaagacttcaactcacatgacagtggggagtggagagattcttgtaaagcaagcgccctggggtcagggatgcaggatcagcggacttctgaaatccaaatgtggtcggtgacgcgcaccacattcctacaaccatcgtgcacatgcgcttaacctacccttgcgagcacgccgaggctcaggacgagaagcgttacggtcaacagcagagagcgcccgcgcgacgccattttttgcagcccctcaaaccgtgcagggctcggaagtctaccagggaggtacaccaatataccttgggagcttgaagacttgaaacaaaagtaaaaatagtgcgcacaccaagattcttgatgtgtctacacccctttcccccctccctgcccggaatggttggtgcatggggaaaagcgtcgttccggagacgtcaagagctttctgccgtcatcagcacatgcannnnnnnnnnacagaggagagcgcccgcgcgacgccattgtttgcagcccctcaaaccgtgcagagctcgggagtctaccaggaaggtacgcctttataccttgggagcttacagactttaaataaaagtaaaaagagtgcgcacaccaagattctttatgtgcctgcccccccttcccccctccatgcccggaatggtcgtggcatgggggaaagcagtagttccggagacgaaaagagctttctgccgtcatcagcacatgcaaggcggataggaggacccgcgcggacattccctattagatattagactcactccaattcaagagactctcagagggtggacggccgttgtccggtacgagaacggtaggagtgcttggtcccacctcagcttcagtcttctgatctgccggccagtccttgtcagcgtcgctgtacggaaatagcagagacccgggcatgctgcaacgttgccttcagttatgaggggccagtgtagaatccttcacgacagtcgccccagggtgacagaggatgtgaggtcaggctcagtgacctacacagccgttgccaaagtgggaaagagcatcttcggtactaacctgaatattttggcaaggccagccccagccccttttctttggaaatgctcatactgtgtgaaagatagatgacctcctaactttccagctcacagctagcttgctcgagcacttattgctcttatgacttttgtattccaaatgtttaatcggtgccgccttcggaggaagttgaatgcaaggcaggagtggcagggcagaannnnnnnnnnaaaagatagatgacctccgaacttttcagttcacagctggcttgctcgagcaattattgctctaaggacttctgtattccgaaatgtttaattggtgccgccttccgaggaaggtgaatgcaaggcaggagtggcagggcagaatcgctccgcaaatctcagggtcttgccaaaggggacgtcttcagcgcttcttgcagccaaacactccatggaatggccctcgaagctggtgacaacgcttcacacatcggtgctgccgactcaaggcacatgctcatgcaagaccctggagaaacacaaggagtctcatcatgtctactacacgtatcaagaagaacgcttgccaagacgtgggcatggccagcagattaagaaagagtccannnnnnnnnntgtatcaagaagaactcttgccaagacataggcatggccagcagattaagaaagagtccannnnnnnnnngcactccatggaatggccctccaagctggtgacaacgcttcaaacatcggtgctgccgactcaaggcacaggctcatgcaagaccctggagaaacacaaggnnnnnnnnnnatttgcagcacaggtccggccctcgtacaccaaacggccaaggtttggatcagcccgagtcttcagtctccgtcttgcgtttcgccgccatcgtttgccgctcctgcatgatgatgtccacgagacgctgccgccgctcgctgggggagtgcaggcgcccctccgcctcggccagcgtgtttgcttggtaacccagcccacctgcgctgtgcatccacagagatcctgcggggatttcaaggggtgacggggtgatgcatgagtaatgttctcccaggcattacacagttcatgggaggnnnnnnnnnngttcaaggggtgacggggtaatgcatgaacgatgctctcccaggcattacacagttcatgggaggaaccctctgagactctcccagctatgatgaccctcttccaagtaaggaaccgcaggatcgatttccagccacgccgggcctgctcacctactagcactccacagccagccaggaaggtgagcccggcgaggagcaggcctgaggacggtcgcctgtggaagcgtgagggcaggctgggatggtgtgcctcacaatgaggggtgcgaagggcatcacccctcaccctcagtttgatgcatctgaccacagcagcacaccgtcaatgttaccatgcgnnnnnnnnnnaaagggcatcacccctcaccctcactttggtgcatctgactacagcagcacaccgtcaatgttaccatgcggagctgctatggtccatgctcgcgacacctcacccttgttttggtcgccagacgttgtgcggctggcgatgcacgtggctgtagccggtgtggggggtgttgacctgctgcgagccctgctgggagtatcaggggaagtagtgagcgccatcctgtctgccagcccgccggtatctgggccttgccccttgtccacgatcgcaactcgcctgttggaggagcttctctgcggccgccgttacctccgcaaatctggctgttgattcaggggttgggcagtcgcaggtgtcgggatggagccggagggcgagctcgcgatagcgggctttcacggtcgcccggtcactgcccaatggcagccccagtactccccatgggtcgcccgggaatcgagacatggacatctatgtgcgcatctgctggcatgaagacctcatatcacggggtccgatacgactagtgcgatgtgggccaggactcctcacagaatggggtcgatgggatccagagggcgatggtaatgctcagcttcagcagagttatcctcaagaacataagctgcgacgagcccgagcccgggaagtcaagtttcgtgactggcaaacatgaagagtccttttctccgccaaatttgctcttgcatcactcagtctgccctcggttaactttgcgtttgtaagatactcggttcnnnnnnnnnnagcaaacatgatgagtccttgtctccgccaaatttgcttttgtatcactctgtctgccctcgattaactttgcgtttgtaagatactcggttcagcgctcaccatgatgctacagagactataataatccttgctgtgctatgcgaggatcatttaggtcggcctacttcgctttgcatcgtcactgggattctcccctcagcggtgtcggggtcgttgtccacactttattccttatattggatggaatagtctgtccttgttcgatggactcttaccagggcatctgtcagcacnnnnnnnnnnccccctcagcggtgtcggggtcgttgtccaaactttatttcttatgttggatggaatagtctgtcattgtcccatggactcttaccagggcatctgtcaacacnnnnnnnnnncatgccgtgcagccttgaagcatgcccaactagaatgttttggatgtgatgagtcatgagcggctgataccgcccctgttcctgttacagcccaccggtcggnnnnnnnnnntctatttcatcgcgggcgcgcagacaatttgcatgccgggcgggttgtggagcgcggaaggatgccgtgcagccttgaagcatgcgcaactagaatgttgttcccacgtttttggatgtgatgggtcatgagcggctgatattcccctgttcctgttacagcccaccggtcgggcctccgacgtgcatttgtacactggcatgtgagcggcaccggctccagcggctgtttggttcagcctggtagagcatgtattcaatcagaagcgagattgtgtatctcccatcttcctgtggagatccctcaccatctcatagggcagagtcctggtcgtgactccgaaccagctgggccccatccaccatggccctctaccagctaacattcacatcgaagcccctgctccaatggcagtacaccgctcccatgaacagtatggacttgagacgggtggtatctgggtctgtcttgcctggctcgtgtcgtccagcgttgctggcagacagttgagatgggagcaattcaagacatctcccacatgccccctcccaatacgcaaaaccccctcccccttcaccttgcagcctctgcggctccaaactccaacttnnnnnnnnnncatcgtgcagtgttgctggcagacaaatggggatgggagcagttcatgacatctcccacatgcctcctcccgatacgcaaaagcccctcccccttcaccgtgcagcctctgcggctccaaactccaactttttcaagggcgtgcagtggtcgccggacggcaccttcctcctgacctgcaacgacgatgctgtgtgagccccagggtcaggctgtggggtggggggcgcagctttgcctgggtcggctgctcaagctcgtgcaagccgtgcgcaggctgcgccccggcaagctgtnnnnnnnnnngtgcaacgatgacgctgtgtgagtccctgggtcaaattgtaagggggaaggggggggcccagctttgcccgggtcggctgctcaagctcgtgcaaaccgtgcgcaggctgcgccccggcaagctgtgagccggttcatggtggtgccaggatggctgctcatgggcgctcacccacgcaggggtctgcacatgtcttcgcccctccttaaccccccgtgaaagtttgtgaagcagagccaagtctcacgccaaccacgatcctgtccgtacgccccttgaatctccctctacctactggcagactgcgtgtgttcagcaacgtgctgggtaccggccccgacttgggcgaggccccccccccgnnnnnnnnnncatcctgtccgtacgccccttaaatctccctctacctaccggcagactgcgtgtgttcagcgacgtgctgggtactggccccgacttgggcgaggccccccccccgcccctcggcatccctggcggcgaggcggtgtacgactacgcgtggttccccgggacggccgcgggcgaccccgcctcctgctgcttcgccagcaccgggcgcggccacccggtgcacctgtgggatgcgtgctccggcgccctgcgctgctcctacgtcatccacgacgcggccgacgcgcccactgccgcccgctcgctgtcctttgcccccgacggcggccagctggcggcggggctggaccgcgggatccacctcttcgacaccgcccggcccggccacgccagccgtcgcctgcccacccacgcccgcggtggcgagggccagcccggcatcgtggctgcgctggcacacagcccctttgaccccggctggctggccgcggggaccacgggcggagctgccgggctgtacgacacgcgcgcgccggaggcgctgtgcctgctgcagggctgcgcgggcgccggggtcaatgcgctgcgctggtcggccgacgggaacttcctgtacgtgggcagccgcgggcggggcggcggcgtcgcctgctgggacgtgcgcggcggcgccgtgccctacttcatccctcgtgctccggcgggcgcggcgccgcaccagcgcatgcagttcgacgtcgagccggcggggcgccacctggcggccggcggctgtgacggcgcggtgcgctggtacgacctgcgcgacgggtcgcaggccgacgcctgcttcgtggcgggggacaccatcaacggcgtcagcatccaccccgcgctccccctgctggcaactgcctcggggcaccgccgcttccccctctgccccagctccagctcgtccgaggaggagggggaggggggcgacgaacctgggccggccagcgataggtccctggatctagcagaggcccctgcgctgggcctaggagagcaaggaggtcagagggagcgcagtccactgggcctcgctcggtgctcacagggggacgaccccgcgcacggctgcaacgtgctcagggtgtggctgctggattcgcagccgtttgacctgtactccgagcggtcagggagcgagcatggagaggcaaagatgtaatgcagtgactgccggtgaagggtggtgttgctgcctagatattccaagtggctggggatctttcagatgtgacgagggcgcaaccaagtcgcgcgcacacaagcccctcaagtccttgatcaagcgtcagctggacnnnnnnnnnntgtgctcagggtgtggctgctggagtcgcagccgtttgacctgtactccgagcgatctgggagcgagcatggagaggcaaagatgtaatgtagtgactgccggtgaagggtggtcttgctgcctagatattccaagtggccggggatctctcagatgtgacgagggcgcaaccatgtcgcgcgcacacaagcctctcaagtccttgatcaagcgtcagctggactcgatctggcgagctgattatccatttaagaatattcattgaccaggtctccaccggcccagccctggggatggtcccagcatacaccggggcgtcgccatgatcacccgctggctgtgggtggtggccttgttccctgctgcactggcgcaggtcgtcggatccacggtgcacctggatgccgacaggatcgccggtaacaagttcttgcagcgtagcgccaccaaggactctgtcgtgcactctcaacagtacgtgccagggttttgctctgcaaaggccacctgggctggatgtcgaaaaggactgccctgccccatggtccccagcccgccccgcccgcccacacccacccctcccgccaccacaccacagggacgaagtgccctactccacctgcagccacgacctggccatcaagtggcatgcgagggcagggtcggcggtgtacgctacccccctcatcactgacctgcatagcgatgggcggcgggacatcattgtccccgcctttgtgaacagcctggaggtggtggaggggcgggggggcgccaagcaggcggacttcgaggccttccacgagtccaccctgcacacctcccccctgctcttcgacgccgactttgatggcgtccaggacatagtggtggcgacctacggcggggagattctcttcttcaaggacaatgtgagggggggtatagtgtgagtgtgcatgtttgttggtaggaatgggggcccggcaacctagggaacggggggcatgtgagaggcaagcgcgtcgcaggctctcgatgctgatgtccgccctcctcaccccgatatcaccttggcccggcagggcgaggaagccagcaggcgcctggtcatcccgcccctggaggttcggcggggctggttcgagggcctggcgctggaccacgtggatcacacccggcccgacgtaacgggcgcggagcagcagaccggcgggcagggcgctggacgccggctcctgtcccagagcgagggcggcgaggcggtgcctgtgctggaaagcacggcaggacagcagacggtgcaggagcgggtgccgggtgatgcggcgccgcgcccggaacccgaccaggttgcgcctagggggagagccacgaggttgctggcagaggaggcaggcggcgcgggggcggtgggcggccaaggcctcgcagttggtgccgcaaccccgcctggtggccagaatgccacaggcagctttggcacagtggctggggccatgggcacgcccggcggccaggggaacgaacccggggnnnnnnnnnnaaggagctgtcggcgtacgagatcggcagcgtggccgccttcctgtgctcgccgctggcatcggcggtgacggggcacgtaatgtacgtcgacaacggcctcaacaccatgggcctggccctggactccaaggtgctggagcgcgagcccgtggacgccagcgcctgagcgccaagggtttcgccttttcgcgggtgccannnnnnnnnnnnnnnnnnnnnnnnnnnnnnnnnnnnnnnnnnnnnnnnnnnnnnnnnnnnnngccggcggcctcggggtggatgagagggcggcccgctccgcgctgccgacggccccttccaccccctccggaccctgccatccaccctggcccctttctgagaccgaatctgggacttagaactctgcatagcctccttcccttgctccgtgccagtgcctcttttgtccccagactgatcctctgaaaatggcccctccccgggcctcagtacacggcaacagaccaattgagaaagggggatcaaaccgcagcagcactgtgactgggcgtgtgggagtctacatgttgagggggatattccgtgcaagggaaaaggcacggcgtctcgacgccaccattacctccccttccccgtgcactcccctcccatgccacttcgcagtgcaacccagacctcctcccttgctttcatcacataggcagctccagctggcgccccatgagcacgacagcggcgagggtgaaggccaggggcagactgaccagccacttgagcagcttgtagtagtgcatgtggaaggagaggctgaactcgtcgcacgtgagcaggccaaatctgtcccgcgcctccaggcgcaccgtggcggtggtgcgggcgacggggcagggcacctccagcgcgtagcgcccgcccgcggccaccgtgtcggctgcgccgatcaccggcgcctcggcagccgccatgtgggcgaggggggtgttggtcagcgtggccgccacccgccagggcccggggccaggcacaggccacgatgcattgctcccccccgccgccgcccccctccccctcgccgccgcgccgccgtccagcagcgtgaagcggatggggagcgtgcggccgcgcacgtcgcgcggcgcgcgggcgtcggccgaggcccacaccccgcgccggccccagcgcgcggtgtgcccgttgaggccctgcgccgcggccgtccaggcgcgcagcgggtgtgctggggcgggcgttgccaccgcatacaggtcgccgcccatggaggccaccagcagctccagccggccgtcgccgtcgaggtcgtcggccagcgcctgcgcatacccgacctcgcccaggtccagggcctccacgcagccgtcggcaccgtgcagggcgtacaggaagccgtcgtgggcgagcaccacgaggtggaggtgagtgggggagggcgaggcggccagggggaccagcaggatgggggccatgatgcggccgcccgcctgggaggatagaggggaatggttttaaattgtggggaggcatgagggtggcgtggttgggaggagccnnnnnnnnnncagaggggaatggtttttatttttggggtggcatgagggtggcgtggttgggaggagccgtgtattacaggtgagtgggggaaggggctggtaccgggggggtaggctttgcaccgaggtgcccgctactgccagcccacnnnnnnnnnntttacaggtgagtgggggaagggctggtaccggggaggtaggcttcgcaccgaggtgcccgctactgccagcccacnnnnnnnnnncacccccctccccccccccaaaaagcctgccttgtaggggaagggcgcgaggtcgcggccagtggcgccctccatgacnnnnnnnnnncacaagccttttgcagctgaatcactcgccgccccacctgatctggaccccaagcccccaacaccccccctttcacccccccaaaaatagcctgccttgtaggggaagggcgtgaggtcgcggccagtggcgccctccatgacgtggatgtggccggaggccgtgcccaccaccacctccaatgcgccgtcgccattcacgtcccccaacgtgacgctctgtgtgccggggtttcatgggggatggggggtcatggtagggatggtgtgttgccatgatcttgaatgggagggagcagcaaactttccggtctcagtgcagggccatcgactccacgcgtacaggataacaaccagttcagagcagcatcgagtcgtgatgactacccgccgatacctacaggtccagtaaatggcggtggtctggtcacgggacccttatgccctgagttaacaagagcaaccaaacccacgccaccctcatcagccacccccctgaacctccctgccatccctgcccacctggctgatggcagactcaaggtggcgctcccacacctccttcccagtcccatcaaaggcggcgacgttgcccagggtgtctgtcgccaccagctccagcttgccgtcgtcgttgatgtcgtccgccacgaccgctccaaggatgggacccatctgcacgggccaaccctccaatgctcccccggtcaccgcattcagcacatacaggaaaccctggcggggcgagttggaggagggttgaggggctgggcgaggttggtggggccgggggccggcgagaaaagggggtagcaaggagagatgtggcaaagacacacctcctggggccccctgaccggattgcagcaccccaagccgagccctgttcagcagggtgccaggctccacgagcgccatcagcacttccccccctcgacgcaccacagaggtgccaaacacgacctccagcttgccatcgccgttgacgtcgaccagtgtcggtggtgagtaagagaccgcccggaactttgtctggtctgtnnnnnnnnnngggggctgggcgaggttggtggggcagggggccggcgagaaaaggggttagcaaggagaggtgtggcaaagacacacctcccggggccacttgactggattgcagcaccccaagccgagccctgttnnnnnnnnnncgacaggtccagatgctgcatgcagggggaaagggggagtccggctctggaatgcggcgacggaatcggtacgcacctgtccagcgcaggacaagactctggacaacgccggctcagagcatgtgacatgccgcgtacagagtccgcgatctgagctccctcacgacgccatcgtgcagggaagcctggaaacccccaatctccacnnnnnnnnnntgacaggtccagatgctgcatgcagggggaatgggggagtccggctctggaatgcggcgatggaatcggtacgcacctgtccagcgcaaggcaagactctggacaacgccggctcggaacatgtgacatgccgcgtacagagtcggcgatccgagctccctcacgacgccgtcgtccagggaagcctggaaacccccaatctccaccacaagatagtgcccacacccacctgcctccacttcacggtttgccggttgaggtcatacacgatcacccccacggccaggtacttgctgatgtccacatccagtcccagctcctggcggtgcctctgttgacannnnnnnnnnnnnnnnnnnnnnnnnnnnnnnnnnnnnnnnnnnnnnnnnnnnnnnnnnnnnnnnnnctcggcaaggcagcaacccgttcagcaattccaccccgccccaggggccgacgcagctggaggagactccatgcctcgagtggcatacagggagcctcactgccggcaagaggacggccggccggctcacctcgtcctcgtagtagtctctatcgtaaaaataagaaaccaccgccaccagctcgtcatggccgtcgccgtcgatgtcggcgatggcgggggtggccagaacatgggcatccaccctcaggttgaagctgtgggaggtgcggggcgtcggccggttgctggacgttgcctttgggatgccaagaagtcgcctgccaaacagctggttctcagcaacgtatcctttcccccctccccactctgcannnnnnnnnngtccaccctcagattaaagctgtgggaggtacggggcctcggccagttgctgggcgttgcctttgggatgtcaagaagtcgcctgccaaacagctagttctcagttacgtatcctttcccccctccccactctgcaagtgcctgggcaggcctccgacggccctccagtggaaagcacctcgcgcacgcacatcccaccttccaactggaatggtatggtctggggnnnnnnnnnncgaggggtgtgggtggtgatgtggtggtgggcgggggaagggccgggatgcagacgcccatgtgagggtgcgggctgtcaagtactgagaccgtaaggaactgagctgggtcgctgcaccacctgccatactccctcnnnnnnnnnncggtgccgcaaccccgcctggcggccagaatgccacaggcggcttcggcacagtggctggggccatgggtccgcccggcggccaggggaacgaacccgggggcaatgccgtcggcgtggagccaggggcgcacgtgatcagcgaagaggcggctgactcctacgccgagctctttggggatgtggtggagaaggacaccgtggtggaggtgnnnnnnnnnnaggggaacagcatggaccaggattgccaatgccattcccggaggaaacctggtcaccaggcagtgccacatgtgccttnnnnnnnnnntggccctccagtgggaagcacctcgcacacgcacatcctaccttccaactggaatggtatggtctggggcgtgccactcctcatcctcccacagatcagccggctgcaccccaccaccagccggaatgtcactggagtaagggttggaatgnnnnnnnnnntgagggtgtgggtggtgatgtgggggtgggcggggggagggccgggatgcagacgcccatgtgaggagggtgcggactgtcaagtacggagaccgtatgaaactgagcagggtcgctgcaccacctgccatactccctccacaatcccttttgcaggactttgggagtggggtgaagaagcggatccccagcctgaggagcctggaggagggcaacatagggaagcaggagcgaccctatggcctcgccgaggggtgagtggcggggcagggggaggtcgtggtgggtacccgaccaggcatcatggtttcagagggtagggggccacccaaaaccccggttggtttcattgagcccaaggagggtgctcaggacatgctnnnnnnnnnntagagggtagggggccaaccaaaaatccggttggtttcagtgagcccaaggagggtgctcaggacatgctggaaggcacatgtggcactgcctggtgaccagctttcctccgggaatggcattggcaagtcctggtccatactgttccctccattccaacccttactccagtgacattccg

SEQ ID NO: 48174 - DNA, 293 bp, Chlorella protothecoides
agagacctgcacatgcgatgcacctggtgacacgcaatgctagccttgcatcccaccatgacactgccgagagctcacttctggaacgcaaactctgccatgctctcccctgttatgctatcttggagacggtccatgaagtcatacaacctttgcctgaggtttgggtgatttttgtgggaaacgtcggaaagacatactcaagtcagagtcctgtcataaaaggacaaagtgattttcagccggtcattggtattcaactccatctattgcctattgggtccaatcaacca

SEQ ID NO: 48175 - DNA, 69 bp, Chlorella protothecoides
cgccatgtgggttcccagtagcctgcaagggtacagggtaggtgtggcgggatgatgttgatacaacta

SEQ ID NO: 48176 - DNA, 889 bp, Chlorella protothecoides
cccccccctcccacacacatgtggctgacggtgccgtagatgcggacattggacagcaccccgcctgccggcagctcccgcgccagcccaaagtcggacaccttggcgtgccagccccggccgtcgtcgggcgcgcgcgccgcggagcagaggagcacgtttgaccccgtgaggtcgccgtgcacgacgcccagggcgtgcaggtgcgccagggccgacgccacctcgcacagcgtgcgcagcacggcccgcacgtcggccggagcgaagccgtcgtacccctgccgcagccagcccctgcatgggtgtgtgtgtgtgtggggggggggggtttgaggtatgtgtgtcggggagactggggtcggaggggtggtgaccgtgtgggggaccgaggcaccgacctgttcctctgatcccctcgatctccaggtcccgtgtggaccaggcccgtgcatgaggcgaaccctgcagtccatgcacaggcaccctggcacaggccacagccaggcccagccccactcccgccggctggcccgcacccctcccctccctccctctggaccatgcctttcaccccccagagcccctctgtccacctgtcgatggcgtcgtacagggtcccgccgtcgcagaactcctgaacgatccagaggctggggtcggcctcgcccgcgccctccgccacgctgcactccagcgtgcgcaccagcgcggggtggtccaggcggcgccccaccgccgcctcggccaggcccagtgcacggctggcctcgtcggagacgggcagtaccttgaccgccacggggcggccctgcagcgcgccgcggtagacgcggccgaaggaccccgcgcccagcggcgcgcccagcgtcaggcggtccgccaggtc

SEQ ID NO: 48177 - DNA, 61 bp, Chlorella protothecoides
ctggaccagggccgagcactgcccgggggcaagcaggccatccagtgcctcctgggcggca

SEQ ID NO: 48178 - DNA, 61 bp, Chlorella protothecoides
ctcgccgcttcagggcttgattgattcgtggaaggcttcaatgggacatgactgcgcgttg

SEQ ID NO: 48179 - DNA, 61 bp, Chlorella protothecoides
gtagctgcctggcttaagtggagacctctcgggggtcaacacggccagcaggcggggaagc

SEQ ID NO: 48180 - DNA, 69 bp, Chlorella protothecoides
ctcccagccaaggttttgtaggaagcagcattgcgcgggatgtttgagagcgctgccacttgcccagcc

SEQ ID NO: 48181 - DNA, 79 bp, Chlorella protothecoides
ttgttggggtcacggcttgccttggagtgtccaggggtgggtcaggagcgacagggagcacatccaagcacgggcctgc

SEQ ID NO: 48182 - DNA, 74 bp, Chlorella protothecoides
ccttcgtcttctctgcttggaaaacagagctgataatttcctcgcgcaaggtgtcacttcccttcctcgatgtg

SEQ ID NO: 48183 - DNA, 72 bp, Chlorella protothecoides
gggggccagcacagtggcttccccaacctcccctgccgcgccgggcatgccgccctcgccgtactctggaaa

SEQ ID NO: 48184 - DNA, 61 bp, Chlorella protothecoides
tatgaaagtattgcaacgtcttccagtatatctgtcacctggcataaacaggcaatcgtga

SEQ ID NO: 48185 - DNA, 65 bp, Chlorella protothecoides
cctctccacgccggcaaggaagcaggcaaggaagaagaggcctgtgtcggccacaggcgccctcc

SEQ ID NO: 48186 - DNA, 79 bp, Chlorella protothecoides
cggaggtcgcttggggggctcgtccatgtcgtcctcctcagcgccagaatcgtcagaggctgtatcagcatcggggttg

SEQ ID NO: 48187 - DNA, 61 bp, Chlorella protothecoides
ctcgcatccatgcatgcaggcgcttcccggtctgctggctgtcctgctcccctgccgtacc

SEQ ID NO: 48188 - DNA, 100 bp, Chlorella protothecoides
cagtgtaggtgcccacggcaccctcctgcacgatggacctggcaacgctgcagtcaatcatctgtcccaccttccagagcaccagcccgtgggccccatc

SEQ ID NO: 48189 - DNA, 72 bp, Chlorella protothecoides
tcgcctcagccctcccctgcgccggcctctccgtcaccctcctcgcctcagccctcccctgcgccggcctct

SEQ ID NO: 48190 - DNA, 61 bp, Chlorella protothecoides
ggagtacctcgcccccatcatcacacaccacgaggccatgctggccttctccccagactcg

SEQ ID NO: 48191 - DNA, 61 bp, Chlorella protothecoides
tgcaggtgtcgaggaccgtatatcccgcgccctccctccagctgactcggcctcggcacct

SEQ ID NO: 48192 - DNA, 65 bp, Chlorella protothecoides
catggctcagagcgcaggcctctccctgtcggaggacattcgatcctgagtgtgatcctgtctgg

SEQ ID NO: 48193 - DNA, 79 bp, Chlorella protothecoides
tgaacctggcggggggggtgggggacaccagggggagaggggttgggggaatcatggtgtgaacccctcgagcgaatcc

SEQ ID NO: 48194 - DNA, 61 bp, Chlorella protothecoides
gatcttgttctcgttcttcttgtagtcctcgaagaagcggcggatctcggccaggcggtgc

SEQ ID NO: 48195 - DNA, 61 bp, Chlorella protothecoides
aaaaaaaaacaaaaaaaaaaaaaaaaaaaagaataaaaaaaaaaaaaaaaaaaaaaaaaaa

SEQ ID NO: 48196 - DNA, 986 bp, Chlorella protothecoides
  modified_base (126)..(174): a, c, t, g, unknown or other
  modified_base (478)..(487): a, c, t, g, unknown or other
ggcgcgcgcgcgcgaccagcgcgagcgcagccgccgcggcctcccccgccgcgacatcgccgcgcccctgccagcgggagaaggcggcgtctgcggccaggtatgcggagcggcagggcgcccccnnnnnnnnnnnnnnnnnnnnnnnnnnnnnnnnnnnnnnnnnnnnnnnnntcagcccgtcccagaacaccgccagggtcaggcggcgcaaacccgcacgcaggtggcaggcgtaggcggggaccagcgcgccgtgcccggcgtcgatcaggtaggcgacgtagaactgcagcaggcggtgcaggacgtcgtgcgtctgcgcaaacgccgccctgcggagtggaaggagacggtgagtcgccttggtgggcagtgcagggacagggaagggtgtgtgtgcgtgagggtggcatggcgccgcccctcgcagcacccggagaccttgacgtcccagtcctggtccctggacgacaannnnnnnnnngggatggcacggcgacgccgctcgcagcacccggagacctcgacgtcccagtcctggtccctggacgacaaccacgcgccaccccctctcctcccccttcccactcagcccaccccgagtctgcggcgtccagccccaccacgcccagcgcccagagcgccagggcaaggtgcgcggcaaagcgcagcaggccagggtcggcgggcgcgccggcgcgtgcctcgcccgcagctagcacccagccgcgcagctggtgcaccaccagcgggcccacccgatcgaggataagggccagctgcacctcccggaaccgcgccgcggcggcggccggcggggggggaccggggcggccgggggcacacagagtgacagcgacctcggagccgtcctcgtcgtcgccgtctttcccgacggcgcacgcggaggcgcgctcggcggcgcgcgccaccgcctcgccaaaggagggcgccagcgagtcgcgcagctgcgcgggcggcca

SEQ ID NO: 48197 - DNA, 80 bp, Chlorella protothecoides
cacacacacacacacacacacactctctttccaccagggtgcgcgtcatccaggagctgcgcacgctgctggagcagcgc

SEQ ID NO: 48198 - DNA, 63 bp, Chlorella protothecoides
tgtatcgtcttctcccgccctcccacccccccaaccccctctggttcgccgatcgaggcaacc

SEQ ID NO: 48199 - DNA, 61 bp, Chlorella protothecoides
ggccctgcaggcgctcgctgccggcgtaccactccgccagcccggtcaggttcttgacctt

SEQ ID NO: 48200 - DNA, 129 bp, Chlorella protothecoides
gtgcgttcgtgtgcgggttgatggcctccatgctcttcatgtcatggtgtccggatgcgcggtcccgtggagctcttcgcaccggatgttcggtcaatgggcactcaccgctctgcgcacaggacaaga

SEQ ID NO: 48201 - DNA, 68 bp, Chlorella protothecoides
gtgcggtgacacatacacacctggagaaaggactggttctcctagatttaagaacgcagtcgcagaca

SEQ ID NO: 48202 - DNA, 72 bp, Chlorella protothecoides
cagccgctcatgcagcgagctccagcagccccccccaccacatgagcgcatcccttgggatgaaggaccccc

SEQ ID NO: 48203 - DNA, 62 bp, Chlorella protothecoides
accttgagaggcgcaaaggcttgtgtgatcaccccagtctccaacgctggtcacttctcctt

SEQ ID NO: 48204 - DNA, 68 bp, Chlorella protothecoides
agtgtggcgagtgggatactttgggagtttcgccttgaaaacatactcaacttggtagaacaggactt

SEQ ID NO: 48205 - DNA, 118 bp, Chlorella protothecoides
tgacgacgccaggtttattgtttctgtcgcggctgccgtccccggtgagattaagataatgcgatgtgatggtagcggagggggggggcgggtatcttgcgtctctgctcgtggatac

SEQ ID NO: 48206 - DNA, 73 bp, Chlorella protothecoides
tgtcgcagggtccattcatggtatggcccagagccgagcgtggcgcaccatcccagcaccgcccggagcccca

SEQ ID NO: 48207 - DNA, 70 bp, Chlorella protothecoides
gaagcagtcgagagcaccctgggcaccacgctagagtacttgcgacgcggtttcagatgcatcctgggca

SEQ ID NO: 48208 - DNA, 77 bp, Chlorella protothecoides
tctcaggagtggggctcaggatgcattggactgcagggtcggtcgagccttcgctgcgtgggcttcctgcgcgagct

SEQ ID NO: 48209 - DNA, 61 bp, Chlorella protothecoides
cgggaagaagacatacacgctgctcatgggaaagcccagcccagccaagctggccaacttt

SEQ ID NO: 48210 - DNA, 61 bp, Chlorella protothecoides
ttcaccttttcccaacgctgggcctcaaaggcgatgttcgggtcagggtctccgaagacga

SEQ ID NO: 48211 - DNA, 61 bp, Chlorella protothecoides
ctttcgcttgtcctgcatgattaggcagggtaccatgtatgggtaagtcaggccatgcctc

SEQ ID NO: 48212 - DNA, 39054 bp, Chlorella protothecoides
  modified_base (489)..(498): a, c, t, g, unknown or other
  modified_base (1115)..(1124): a, c, t, g, unknown or other
  modified_base (4263)..(4272): a, c, t, g, unknown or other
  modified_base (4706)..(4715): a, c, t, g, unknown or other
  modified_base (4896)..(4905): a, c, t, g, unknown or other
  modified_base (5439)..(5503): a, c, t, g, unknown or other
  modified_base (8042)..(8083): a, c, t, g, unknown or other
  modified_base (8205)..(8214): a, c, t, g, unknown or other
  modified_base (8746)..(8755): a, c, t, g, unknown or other
  modified_base (10104)..(10113): a, c, t, g, unknown or other
  modified_base (10183)..(10244): a, c, t, g, unknown or other
  modified_base (11123)..(11132): a, c, t, g, unknown or other
  modified_base (11197)..(11206): a, c, t, g, unknown or other
  modified_base (11279)..(11288): a, c, t, g, unknown or other
  modified_base (11806)..(11815): a, c, t, g, unknown or other
  modified_base (12243)..(12252): a, c, t, g, unknown or other
  modified_base (12505)..(12570): a, c, t, g, unknown or other
  modified_base (12959)..(12968): a, c, t, g, unknown or other
  modified_base (13785)..(13794): a, c, t, g, unknown or other
  modified_base (14813)..(14822): a, c, t, g, unknown or other
  modified_base (14901)..(14910): a, c, t, g, unknown or other
  modified_base (14989)..(14998): a, c, t, g, unknown or other
  modified_base (15204)..(15221): a, c, t, g, unknown or other
  modified_base (18074)..(18083): a, c, t, g, unknown or other
  modified_base (20804)..(20813): a, c, t, g, unknown or other
  modified_base (22378)..(22387): a, c, t, g, unknown or other
  modified_base (23300)..(23356): a, c, t, g, unknown or other
  modified_base (24058)..(24067): a, c, t, g, unknown or other
  modified_base (26138)..(26147): a, c, t, g, unknown or other
  modified_base (26842)..(26851): a, c, t, g, unknown or other
  modified_base (27669)..(27678): a, c, t, g, unknown or other
  modified_base (28256)..(28265): a, c, t, g, unknown or other
  modified_base (28946)..(28955): a, c, t, g, unknown or other
  modified_base (29723)..(29732): a, c, t, g, unknown or other
  modified_base (30557)..(30678): a, c, t, g, unknown or other
  modified_base (30798)..(30807): a, c, t, g, unknown or other
  modified_base (30945)..(30954): a, c, t, g, unknown or other
  modified_base (31089)..(31098): a, c, t, g, unknown or other
  modified_base (31926)..(31935): a, c, t, g, unknown or other
  modified_base (32499)..(32508): a, c, t, g, unknown or other
  modified_base (32856)..(32865): a, c, t, g, unknown or other
  modified_base (33615)..(33624): a, c, t, g, unknown or other
  modified_base (33996)..(34005): a, c, t, g, unknown or other
  modified_base (35995)..(36004): a, c, t, g, unknown or other
  modified_base (36457)..(36466): a, c, t, g, unknown or other
  modified_base (36837)..(36846): a, c, t, g, unknown or other
  modified_base (38526)..(38535): a, c, t, g, unknown or other
ccgcgcgcagcgcgtccggcagcgccgaggcctcggcctccagcgccgcgctctccagcgcgcagcgccgggcctcggcctccgccgccgcctccaggccgcgcgtggcccaggccttctcgaacttctccgacgcctggtcaccgatgttgcgcacaaagttgccgggcgggttgaactggcggcagttggcaaagatcagccgcacgtcgtcccggaactccagcaggctgctgtaccgccggtggtccagctttgctgtcatggtgagggcacgtcgcggggaacagggatgagtgaacgccgcgagcgggtatctgcggggcaaggtgagcctcgggtgccagccatgccccaccccaagcacccctctcccaaagtcccacggctcgtcacctctccccgctccccccatgactcgtcacccctccccactccccccatgactgaaatccccaagctcactcttcaccgtgcccaggtccatgnnnnnnnnnncccccatgactcgccacccctccccactccccccatgaccgacttcccccagctcactcttcaccgtgcccaggtccatggggtttttgatgaccgcgtagtaccccggcgcgtagtttgcgtccacgggctgcccaaagtactgcttggtgcgccccgacccattgagcgcggccaggatcttggcgcactgcgcccacagcgcatcgccgcgccggcgctgctcgtccagtagcgtcgcgcgccgcgcctccagagactggcccgggtgcggcgtggccgggccgcccccgctcgtccgcgctttcttcgcgatagcctggatcttgcgcagcacctgcacggcggggggtgacgaggtgaggggtgggtgggtgtacagccagtgagggagggagacgcaacacggggcatgggaggcgagggggaggaggagtgctccctccaaccacctggcaacctcggcaccgtcgcacagcagacttcctggcccaggccacccacggcaactgccgaggctggacaggctactggggcccaccatgtgcggacatcaccaggtgtatactggcagatgacgaaggcgcagcgtgccatccttccaccctccaggaacnnnnnnnnnntcatgtgcggacatccccaggtgtatactggcagatgacgaaggatcagcgtgccatccttccaccctccaggaacacaacagtcacccagatgcccccacctctgccttctgggagcgaatgaggctgagatcctcccgcagctggcgcttcctcgtctgtccatcggggttggtagctgctgccatcatgttctgcgctcgaagggaagggtggaggattcctcagctcatcctcgagttgaactggtgtaggcacggggggtccgttgaggggccacggaacctctcccacccacacctcgaggagcgcgactgcttctcaaactcccgcgatgttcacctctgtctatatgtttccagggcagcaggggtagtgcgttggagcagctggcgcagctccgcgcacggattgggcagctgacggcgtgtcttgggaaggagggacagcctagcttgtacaacgcctgtcggctgtcatccttttgccgctgtctcgggaaggccgctccagcggaggacgagcatgggggcccggacaccctgagcagaattcgctccatgctttctatcgatcccaattttttggcgggatttgaggactccatgcccggatgcacgcccatgcatgaacgtgacacctcggcttcgcaagctgcgtcctggacaagctgatgaggcggacatttgcctcatgagacgaggcatggctgtcgttgtgatccggatgctttctttgtagtagcgatctggcggaacgctggcaggggcctctcacatcgaaagagcaagtgtgatgccttctcccatgcgcagtctgaactgcggcgcatcgtccacacacagaattttgattgctccagcttcttttgcgcatgctggtgagctgccattcgcagcgctgaggcatgtatatggtgttgcatccgcccctatcataccaacatgcctgcattcacctccacccagggcgcccatcgaggactcctcttcgccccacctccagtctcatcaagcctcccttcaatgtcgtcatcacgggaggcaccaagggcgtgggaaaggcgctggcatccgagttcctggcggccggcgacagcgtggccctgtgtgcgcgatcgggtgagtagagaaaggggggtgcatcccgcattgggatttttcaagagccccaaggctgctgcaactccatcttgtactacacgccccgacatgcagcggaggctgtggacgccatcgtggaggagctacgatcaaaagggagggtagtcgggcgcgcctgtgatgtagcacgggcggctgatgtggaggccttcacctcctttgcacaacagggtgatatgcggttgggagcgcgcgtgggcatgccttggcgagggctgtcggctttgcattgcaggcagagcatgctcgtgttgcgccaggggcctggcgattgcttcccaagcgcaatggcgtgccttccaatcctcttgtgcccccacctcgcctgcagagctggggcgagtggacatgtggatcaacaatgctgggaccaacgcctaccgctttggtgcgctggaggaccaaccgccagaggacctggaggccatcctgacgacaaatgtgctgggggccatgcttggctgcagagcggtaaggattaaggggggcgggattggcagggggggtggaagggcaatacggaatcgagggtgaccaagattatgatcaggaactggacagggcccatactgcgtacacgatcaggcagaggatgcaagcttgcacaccattgttgcaggatgtggaagtccttgtgtgcaccctcgccgtgcctttggggtttttcatttggagttccccaccaatcgtgaacattgttatgccgcaggccatgtctgtgatggcagggcaaccaagcggagggcacatcttccttgtggacggtgcaggtggggatgagaaaggaaggctggggtaagcggtttgagtgggtttccagcatcatgtgtgacgctgacgggacacagaattaccggcggcgattcacactgctctcagggtgcattgtatctggagaccgcacaagcatgcatctttgctggcaggagcatgtgctctctgactttgatatgtttaattagaggatgaggtctcaacattgcacacctcttcactcggcgcccaccaaaaatccgtttgccagccagaactcgtcaccgtttccgagtccaacatcatactccccacaggggcggatgggggcgccacccctcgctttgcagcctatggtgcctcgaagcgtgccctgagccagctgggcaagagcctgaatgcggagctgcgagggtcccctcgccggggacgaatcacggtgcacacaatgagccccggtatggtcaccaccgagctgctcatggcgggggctgacacccgcgtcgcgcgcttcttcataaacgtcctggctgagacgccagagacggtggcggccaacctggtgcctcgcctgcgccaggtggtggaggggtccaggggagtccttggatctaggccccaatacatccggtgagatcgtggtgttttcgttgattagggtgagagggtccactgtctgttgggaaagggggaggtgggagtgggggcgcgcacaatgaaggagatggacggggtaggggccttgccgagtcagcagattttggacagctaggcctgattcatgtttgctgttgggctcagcattttcccggcctgagatgtaggctgcgataacgtcagatgttgatgcggagaaggtccatgtctatgtcaccaacttgccatatgcggtccctcttaccaggtatctgaccaagcccaaggcgtatggtcagattctgatgcgactcctggccaagcaaaggaagaacaagtttgtggaggaggagtgacagtcaggatgcaccatggtgttgtggggcaccctcttttggccctcccaccctttccaccagcatccatgccctgggccgtacctgcgccgcctggagcagcgcctgaactgcaagccccccaccgagttcggggtctttggttgtaacatgcctattgtaggtcagatgcatcagaccacattgtggggtgtaccctatcccaacaacatatggtgatgagaaagggannnnnnnnnntctgaaatgcaagccccccaccaagttcggggtctttggttgtaacattcctactgtaggtcagatacatcagaccacattgtggggggtagcctgtcccaacaacatatggtgatgagaaagggaccgccctcttcccaggctccctttgggtgagccaggagcctctcccagccaggctgaacatcatcctacctccgagtggttattaagagtaaagacttcgtggtgcgaatgaaagatcaacagagtcatagtgacgagtcagctgcatgaatggtaattacactatccagagccggtgtacaggctctccttcttctggagggaacgaacctacggaaggtgaggaggaagggaaatgaagcggccatcaccaccatttactcgcccaagccacaaagcaacaagctcatggagattgccgccagtgnnnnnnnnnnttgaggaggaagggaaataaagcggccatcaccaccatttactcgcccagcccacaaggcaacaagctcatggagattgccgccagtggtatccggaactgagaaatccacccctgcagctcagatacacccatctcgtcgcctaccccttcacccacctttgccaaagagaggatcgcannnnnnnnnngtacacccgtctcgtcgcctaccccctcacccacctttgccaaagagaggatcgcaaacatgccagccaccccggcacctccaaacgcagcctgagcgagcagctgccgcgtggctgccgagcccacctgcaccagcgcgctggccagcagggcgtacagcgtggcggtttgcattctctgcagggtgggaaggtggaaatcaggggacgagggccagggtgagctggagctgaggcccacttgcctatcctgaatcaccttccttcccaagtaacaaacagcctcggctccgccaactcaccgcgaccctgtctagagcacgctcggcctccagggcccggaccctgagcttgagctcccccctctccagccgttgcagcaggtcggcgctgtcttgcaccaggttgggggcgcggaacaagttgaccacggcgcggttctgcagggccaggcgccccctgaagtcctggctggccttggccagcagcggccgaccctccagcaacaggtcccgtgcgtagggggctgaaggnnnnnnnnnnnnnnnnnnnnnnnnnnnnnnnnnnnnnnnnnnnnnnnnnnnnnnnnnnnnnnnnnattggtacgccgatgcagggggctgccacaagtgtaaaaagcaggcatgcatgcgtctaccaggccgccctccatcccaccccacttcccctcacctgctatcttggagatgtcaaagccaggggctagagtcttcccaatgccatccaggactgtaaaggatcggacctgtgcaggcacagtgtatgccagggggggagggacgagggttgagctgaagcgcagcagagccagcaaagtgacgagtgtcggtactgaaacccatgcagcgagacagtgggcagagagggcccagtgccaggcaagacaggggtgccagcttctaagggtaaactccaggcaccaatcagccacacaccacaaaagtgaaggtggcggggaagcggaagggcttgtctgccgctgcgagcaggaggtcctcccctgcaagatttaggggccacggcagggttcaccagccacaaaatgcaagcgagctgcgctgccagtccaaagatatgtcagatcccgggatcgcacacgaggcatgcacagcttccgggatggcaagcaggcaggttcattgcaacacaacaacgagtaccgctgcacagtgcttcaaatcccgcgcccccaagtcgacccatcacccaccaatggaagagaggatctccttccttttcatccgcttctcctccttggtccggcgctgtggctcctgtgaggccaagagtaggcgatggagttggactcgcaggagaatgagctgagtgtgggcccctcctcaacccctcccaaccccgcagggagcttccgtctggacaaatcctgaagatgccatgtgcagcagctcttcctcgctcgcaccccgcacatttgcccctcaccttctggttggtcaggcggtcgctgaaggagcgcaggaagaagtctgccgtcctcctcaccgcagtcctgtgcacagggatggggtgaggaaggcccagtgagtgtgtgttttgagcctactctgctcttcgtgcaacgctgtgagcaagtggcagggacgcgcagcaccaaagtctgcctcggagcaggtccttgtcaggaatgcatgggcctgtccctgacagccccgggggcaacctacatgtcccccgttggcacaagtacccccatggccgtcagggcagtgagacagcggtccgcgtccttctcatacacgccgtagaacagctccagcaggccacccctggggggtgagccagggtatgcttgtatgtgagggagggggttgctgcctcgggaacagggcataaaatcgtcagaggatgaagtgggcaacatcatgctggtccgacaccccccccctttcgagaattcctcaacaaccccatgcgaaggtcaaagcgctgcccccccaaaaccccccacactcacctgacgtcccccgggatggaccccatcatgccaaagtcatagtagatgagccggccctggccgtccaccgcgatgttgcccgggtgggggtcggcatggaagaagccgtggcgcaggatctgctgcaggtacgcctccaccgcccgcgtggccagcagctggcggtccagacccaaccggtccagctccaccgtgttgttgatcttcacacctggcgcgtactccatcgtcagcacccgctccgtggtcaggtcccacttgatgcggggcacctggattggaggcaggtagtggtggcaacggggccgtagagcaggaaaacgccaagaacttgcgctggtaatcagccattccggtgaccttggtcacgagaggggtgttgcagagcagcgatgtcgccactccacccccttgagaggatatttcaccttgccaagcgaaaacacgcgcacgcacccaccttgacccagtcaacaccggcaaagttggcgcggaacaggtcggcgctggcgccctccttggtgtagtcaatctcctcatacaggatgcgcgagcactcgtcatagatggccacccagtccctggccgcgccgtcggtcttggggtccagctgtgtggatggtcggatggtggtggggtgaaggacgggaggctggacagggcacccgacgtcgccagccccagaagcaaagccatcactgcagattggccgatgtgcacatccttacgcgcacggcccccctcctcccatggaacgaaataccccccaaaacataactcagccacagcctcaccctctgcagccactgtgccagcacacggatgttcttcaggtcgatgtcgaagaggcgcttgaggcccggacgctggatcttgaccaccactggctcgccgcccgccagcgtggcgtagtgcacctggcccaagctggcggcggccagcggggtgcggctgaagctggcgtaggccgcgcctacgggccgccccagctcctcctccagcatggccaccgcggtggcggagtcgaaggccgggacattgtcctgcagcttctccagctcctgcacgaactcgcggctcagcacgtcgccgcgcgtgctgaactgctgcccgattttgatgaaggtggggcccagccgcnnnnnnnnnnnnnnnnnnnnnnnnnnnnnnnnnnnnnnnnnngagagcggtgtttttttgggggggttgtatgggtgcaaacaaaaaggggttggaagtgagggtgattggaagatagcagagagtgctgcgggggagtccatctatatcttcggcgctgtctnnnnnnnnnngttataagatagcagagagtgctgcgagggagtccatctatatcttcggcgctgtcttgctcacaggatcttccgagccatgcatggagcacaccatccccggcctcagaactgcgtcaaggctcagatgcctgccccaggttctcaccagctccgtcttcttggcggagacggcttccggggtcatgcccgtcctgcgataggccaacttcttcccgctccaccacagccgcaccgcaaaggagatcgcgaagctccagatgtcccacgtgcgctgggggaggaaggcgtggaagggggtgagggggtgattgacaatgctgttgtacaggcgccaccacagctcagcacgagacagcagggcggcataggagcgggataaattagggacgaagcacatggagcaacaattgagaccaggctggtcctctcactctcaacccaggcccctccttactgcacatgcatttacaatgaagatcgtcccccccccaccccacccacctggatcgtggagtaggactgcagcctnnnnnnnnnnaatggatttacaatgaagattggcccccccccccccgcacctggatcgtggagtaggactgcagcctactccacttgcccccaggactggagtaagggttggcagcaggctccgaggcgggggcccctgtcgtcgcctggggccgcgctgctgtggagctgtcaatgatcgtggggtcagcaagcgccttggggtccatggagctgagcgtttccacggcacacagctccagctggcccgcatcacaggaggaaaggacgtcgtggtctactttgggggtggactgctgcatggcagtctccttggcaagggaaggggtggttggtgcccccgccatgggggcattgccctcccgctcgctgccattggacgacctctgctcctcgaatggggtccgggacaggaggcgcggtccagccccgctggacaggtccacctttccgttggtgtgtttaccattgctcaaggatgtgggtgcaggcaggagagtgtggtggccattttttctgtacagtcttcccccagatggaaggctcccccttcccctctgcacatggggaaggaaaatcaactggcatccccttcagcccatgcctggcgctagcacacggcaatgagcaagtcaaacacacagacgaaaccgtaatgccttcgagtctcatgcatgcgcctcgccggtcacatcttggactcacaagggtttggcgaggtgctgggcagccctgcctgtgcccggccaagcatgtactggaaagcatcatatctccggagccgaagccgtcgatatatgatccgggaattttgtggcctcagaaattcataggaccctgggagacgtcctgttgatcgtgctcagcatgcgttgcgatcgaaggagcttatcctacgcatggattcgcgcccccctctccgaatcccgccaaagatgtgccgacgacccgacaaactcgcaggacagcaacgcgagctcgaaacacttttggaagattggacattctttggacccatcctcctgtccagtatagctgagcttaggctgtcgcttgattctcggcgctgggcagagcccctagctttgttcaagttatcacgtatgccaatcctagccagcgaacggtgaccttctcccatattcctatcgggaatagctgtatatttggggaagaccgccctatccgcaaacacgaggggatctggcgagaatggacttgaaaaatccaagtcagtactgattttgtgaagggcctcagtccccatcacccagtgtaaagctgcaccaatcagggtagcccagggctgacaaaatgagaacagcacacccaacagaaggctttcatcttgctgagccnnnnnnnnnncgggaaagactgccctatccgcaaacacgaggggatccagcgagaatggacttgaaaaatccaagtcagnnnnnnnnnnnnnnnnnnnnnnnnnnnnnnnnnnnnnnnnnnnnnnnnnnnnnnnnnnnnnncgagcccgtgggcgtccctctttggccacaccggatgtcctccaatggaatgaactcgattgatagcactgggtatggccccacattgctgaggatctgcagttgcaaaagcctgggccattcgtgttttcgtggcgctgctgtaggactgaaggctcaccactaggtcctgggacgtcaagattactccagaaaagggccactaagcaagcgactcctgatgtcgagggatctttccacatcgtcaaagttggaggacaccctcatcttggttgtgcgccagtgttgactggagctctagccacactttgggcagggtgccaaattgagcctgaaatcacgcgcatccttcatgactgtttgaaggggtgtaccatgaatggtgattctgtggtttgccaggaacgcactcagtcatgcaccaagaaactcaagtctgcacccatcaccgggcctggatgctgtcaagttgagtcagctggtggtccacctgaagtgaccattgaatcctgtacaggttgaagcatgctaggtggtgattgctgtctccccgatgtgaggaaggcatgttcgattgatgtcgagcccttggcaggatatgtataaagaggcggccacagaagatccaattgtcgaccagggacagcgcacctgagtcaatcagcttgccaaactgggcagccactgctgccttcactgcactccaggatgacggcgtgtaccagcctgcagcctcgcacaggctctgttgtatgtatgggtgtgtgatgagatcattactcagtgatctgaagccgctcgcaaggatcagtgtggtgaataatatataagcaggtactgtgtggctaccgacaaagtcgcacaaggcctcctgccccnnnnnnnnnncatgcatgggtgtgtgatgagatcattactcagggatctgaagccgctcgcaaggatcagtgtgnnnnnnnnnntggaaggagggcgccccccccctccagatctcccgcctcggtatgcacatcctcagcacccctcccacgcacnnnnnnnnnncggaaggagggcgccccccatctccagatctcccgcctcggcatgcacatcctcagcacccctcccacgcacctcgctgaagttgctggcgtcgttcagcagcgcctgcacctctccgtcatcgatctccccgacctggaacagggtggtgcgctggctcggcagcgcctggaacgagtgcagctgagcccatgtcgcgggcggtgggggagtgatcagggggaggggccgtggctcctgcccagcgttgcctgccccagcaggcccggcaggggcctcttcggcggcctgagccttctggaccgccttgacttccacgagacgctgccaccatgcctctggcagctcatacgccagggtctggagccgccgggcctccgggtgggcccgggggtcgtaggctcgcctcacccaggcacccttccaggggcctgggcggtggggatgggtgcatgcttggtactcattcgtgcacgtgatccaggaaggggcccgaaggcatcgagggccaaggagannnnnnnnnntagctcatacgccagggtctggaggcgccgggcctctgggtgggcccggggatcgtaggctcgcctcacccaggcgcctttccaggggcctgcggggtggggatgggtgcatgctttggtactcattcgtgcacgtgatccaggagggggcccgaaggcatcgagggccaaggagatgcgggcccacacgcagcattggcgcctggtcacatcctgaggctgatgcccaatctggttggcaatgcgcggggcggcccaagctccccagcctcaccgcttctgaacttgtagcagaggtgcggcaggagtgcagcagcgtcgctcgcgggcaggggcgcgatctgtgtatcgaaatggtgatggacggcgtcaggatcctgtcgagaggaattaggattgctgagagctggcaggtgctcccccacccnnnnnnnnnnataccgaaatgaggatggacggcgtcaggatcctgtcaagaggaattaggactgctgagagctggcaggtgctcccccacccgctgccctcggggcatccaacctcggggcatcccttggcccctggttaccttttccatcaggctcgccggggtccagacgggcttggcgtccaggaggagcgacagctgggcgagagcgggccgcagggcctccggcactgcacagagaaaggaggaagttgggggggggnnnnnnnnnnnnnnnnnnnnnnnnnnnnnnnnnnnnnnnnnnnnnnnnnnnnnnnnnnnnnnnnnnacatgcaaggctgcacctgcatcagggcacacaacactccagctcagaagagttctcagcaggaaccacccttcctcaaaggacccagcgcagtaccagaggaagctccctggccagccacccgaggagtttgggggtcggagaagcggatggacgtgacgctggaggaccgctggcgcgccctacgctctgcgacaggggaggattcagacacccagttgatgtcggatggtagaactctcagtgccttgctgactcagggggccacggggtggtggtctcttcatgcggcatctgcaggccttgcaattttgacgacttcccagccaggacctcagtcgttcatgcatagccttcaagagctttcaagccacgcaccgccaaccgannnnnnnnnntccacagggtggtggcctcttcatgcggcatccgcaggcctggcgatttcgacgacttcctagccaggacctcagtcgttcatgcatggccttcgagagctttcaagccacgcaccgccaaccgaaacggctcaccttggagggaggccgctgctgtatggtagaactcatacacagggccacgcaggaatgcgggcggcagtgtgcacagcggctccctgtcgaagccaggcgggagggcgccgggaatggcgtcgctgggcagggaggccgcctcgcagggtcgagtgtcgctctgcacatactgcatgtcggccggatggaggaacctacgcgggtgtgtgtgtgtggaggcatcctcaatgagctgcccgtctcaaactgcatgaacttcatccagacaagcaactgtcattcagaaagaatggaccctcacttccacagccattgcttttcgacccttcctttcgaatccggaccacttgctcgattcttccgaatctcacacacctgtactctgatttcacgaccccaatcacggctgcgctgacctccccatctgcgcttctcctcagcctcacggccagcttcttggcccgggtcctgttgcccaccactgggtggcagtaggggtcttcaggtcgaaagtacaagggcagagtcatgggattttcctgcatgcaaggaagctggaggatggaaaggccatcgagtagaggtgcagccacaccggaaaagcgcacccctgtggtgcttcggtataaaacttctagtaaggcgcacaatccaccacccccaaggcacctggaggtggcgnnnnnnnnnntgaaaagcgcacccctgtggtgcctcggtataaaatttgtagtaaggcgcacaacccaccacccccaaggcacctggaggtggcgggacatggcttccaggccacccatcattgccagcgccttgtctgggttctccaccaccccagggaattcgacagcgaggcactgggctggattcgccggcataatcagatccactgcatggcagccaggttcagggacactgggtgccgggagggggctgaccatgaggcctacagttgccgaggagctccgctgtgaactcgtcgcaaaggaccgtcaagatgcccacaatgtcggtgtggccccttcccttgcgattttgtgttgatcgcaatatgatttagatctattaacatgaagcaccgttgaatgaagataactcttgatgcgcaagatcactatgcggttcgggcgccgagcgcatgctgaccgagcatgtgttcctgcgaggatgacagcgcaggggtactataagccacatagacacgcctgatcaaattgctcgtgtattttgtcaaaacctgtgaccagtgcttcctggaagaaggggaagcttctcgcggagatcggggctcctggtgctggtgcactcgtaccaggggtgtaagggaattaacgatccccagtcctctaccaaagagcgccataatgtcagcgctgacgagggctcgcatttcgtccttccttgccggcgtggccgtcgcgggtgcctttggggtgttccaactccggcacgacctggaggagagccgggcagtcctctctcaacaagtgcgcggtgcactgcgtgctggagctcgcatttttttggatttgttttatctacagactgctgtatcaatatgttgtcctcacaggtgaaggagtatgctgcccagctggaggggagggttgccgccctggaggcatcctcttcacgcaagtagaccaatggcagcgactgcagacgcctccaggtttacgccacgattgacgaccaaggcatttggtggcnnnnnnnnnnatgctcttgcaagcatacaactgagcaggaagcctctctggtgacctaaatatacacatgaccagctaaatgctgtttnnnnnnnnnngtgctcttgcatgcatgcaactgagcaggaagcctctctggtgacctcaatatacacatgaccagctaaatgctgtttnnnnnnnnnngccaatagcagcgactgcaggcgcctccaggtttaccccacgattgacgaccaaggcatttggtggcgtattgccgtccatcgaaatgcatgtcgaggctcaacatccactgagtgcagcgtgacaacccctctctcacagtgtcgacaagcatcccaggcttctaccaatgctgttcagtgttacactttggatgtaatgctggnnnnnnnnnnnnnnnnnngccgcagaggcagtggcgggaacttcaagcattcgcaagcttgggtgcagtctggtgaggagggtatggtatggggatcctgcccttgctgctggaatccaaaatgtagggatgcttctcagctttcctcggccggctctgtgagcaggaagagggagtgtagggttcatcagagcaggaactggtgcagtagcatgcatgctcaatgctcaatgcaggatcagcactcgaagtgtgcctcaccttgccaaatgatcctctgaagatctgcaataatttcagagagagtttgacgtcagagggcatccagagggagcagtgatccctcgattcagtcgacaccaatctgcaagcacgcgcaagcgagctcatgtcaagattagcaaatggtcacggccatcacccgacattgccttacctttcccttgcgagtactggcatccctccttcccagtgacgctgcgctggtgtgcaggcagtgtgcctggcaaggagacccagtgctgcatgagcacggggcctgcggagttgatgcacatgcctgtgtcaggggtgcagccgcagtagcacaactttctgtggggcgagtcgcaaggagacggaacgctgcccggcgcaacatggttgtgccgcaagattgagcactgtctcgagtctcctggctaaaggaccccccaaagtacgaggcgcaagatactttcaatcaatctacaccaccaatttatgtattgaaaactttatgcgacccatctgaggcatcagctcaagggctctgattaggcactcctgcgcgcgtgtcttgggcaacgggtacctaccaatttacgcaagggtaccacgggaccgcccagcggaccatgcaccgccgaaccctcaccctcacgctggcaccacagggaaaaccacgaagttttgatgaatggaatcagggaatgcacattatttattccccgaacgtgctgctggtccacatattcggcaacacaaagttgtcgtccagcttccggacggtgcatggcgcgcccagcttaaacgtcgggacccgaaggacgacggctagggccccgcaccaatacccagcatgagacccaagcagttcctcgcggcgcaggtgcgtttgtccctctcctgccccatcgcgcgggcctcgggcctgcaatgcgagggtttcaatcgggggtgttccatgcagccacataccgacccccgcactctcaccccgcccaaagatctggtatggcgtcagtggcggcgctcccaccttcatcctgcccttcctcaacatcttctattccgataccttgaaattctctgcggcccaaatcggtctgctggccgccatcagaccatgggtgtcagccccatgcggtgagaatatcttggttgtgcgccggaggtctgcccaaactaacccactccaccgtgccgagcgcgctggagcagcaccatgtagtggattagataatgttgggatggtcaaagtccaggatttctacccctgcaggcagcatcatcgcagggctggcggacaggggcaggcgccatgctgtggtgctcacagcgtgctacctcatggccaccctggtccaggtggcctggtggaagtgttttgtggttgaaaatggccttgcatggggtagtggttggctagaccatgccacagtgcggcaattgtccatttcaaatgcctgtgtttgtgcagcgcccgacatgtgtgggtccagtacttgccaggggccattcaatgaatgctgccgcgcatgcttctcactctttggctcccactcacgcattccagggcgccatggcccttgctggctccttcccgctgcaacttctcctcacactgctggcctccgccgtgtgggcgccaccccagatcatcagcgacgcctgcgtcatggcggcctccacctcggtgaggcctggtggtcgtggagtggtggtcctggtgctcacagcatggcacaggctggggctgtgcccctggggacggcatgcctgaatctggttgtgcaaaggcttgcacatgcttgcacatgcatgacattccccctcaatctggccccacctcaccatccctgtcccaaacctcccgacccacccagcccggagattatggccgtatccggagcctcgccagcctggcctggtcggtgatggcccctgtggctggctttgtgaatgggaggtggggcatccgcgctgggatcgcggcgtacacggccctcgccctggccgcccttcccgcggcccttaatttgccgctggaggccctgcaggtggggagttcaaatcgcgcttcaactcttgatgcagtggttttgcgggccttgttcaagtgttctgagactgcaactccatttccccttgtcgctgcaattcactttgcctgctcttcaaccccaacatgcatgctttctattacatacaaacacacatcccccgctgatctcacaccgcagggctcccatggacccgcctcgtccggcgaggctctcggcccaaaggatgtggaagatctgcatgcccccctgctcccacctgggacaacagagcaggagcccccttctccaaaggtggacgtggaggcccctcgctcctctgccctggcctccgccctcgcaatcgtacgctacatagagtccatcacggagatgggcctggtggcgccgacccccgggctgtacggctttgccgaggtgtcggggcccttcatgcagcgacacctggcgcccccagagctggtggcaggtgtgtgaattggggaaggagggtgtgtgtgtgttggtgcgcaattggtcgaacatgcctcacttcccatcactccctggtcacacccccccccccccnnnnnnnnnngaaggagggggggggtgttggtgcgcaaatggtcaaacatgcctcaactcccatcactccctggtcaaccccccaccccctcgagcaacacccctcctgcgcaggcttcgaggcggaggaggaggctcagcgcgaggcgtcaaggcatgttgagccggccagcccctcccggctgcccaccatccgtgaggccccctcgcagcggtccctgccgctgcctgctgagtccctgccccgcgacgagcgcacgctgagggaggcggcctcactcctcagcgcctcggtgccggccgcgctccagcgccagccctccctgccccgccccatcagcttgggcaacctgcgtggggcagggagggcccagcgccacgtcctcgccacctccgaggtgggcgggtcggcctggcgctcgtgggcatgttgcaaggtcctcagcgggtcgtcacagggcaggtgacgataccatccaacagcactgccacgtcgctccaacccctttgcagggtccgcatgccagccactgggcgatagaggagtcggaggtcgaggatggcgacgacgaggccagctacctcaccggccaagagtctgggagggactctggtaagtgggtttggtggtcgtgggactgcagggttccggtggtgcgattcacttgccatgaggcatgaagagacaagctacccaggttgggagggtctgcatttggtttctggctccccgaccgcgacctactcccatgggcaagcttgggttgtggcagtgcatcctaacccctgcccctgaatcctcgcccccccaccctacacgcctcgcagactccgacccggccggaagcgtgcagagcgccttcccctggtcgccacggagtggggcggacactgccgccggccccacccccctctttgacctctcccggcacgagtcggatgtgggggacgtggacgcggctctggcgcggtccacacaggggctgccggccctcggatcccggaagtccagcgccaacgcgccactgccgcccttcaagcccgcgccggtggtggcggcgccgcaggccgaggattccaagcctggccccgacgcgggcgcgccgggcacaaccccggcgacggggtaccgcgcggcggccctggagcgcctgtcccacctgttcaaggcgggggaggacctgagcgatgtgggcgggggcgagaccagcgaggcgcccacgccctcggggccgggggccctgactcccgtgcgtcgctacatcgactacaggtgcgtatggcctggatgcagcagggcgagaggtttcgcggaggggtgtaccgtcgcacgtccgagccagggcagttgatgtgtcagcttgctgatgtggagcttgtgcgctgaagccttccagtgcccagttgcacgtctcggagcctgtggtcacaccccctccccctcaatgcctgcgccacgcaggaagggcatgctgcggggcgcggccgaggggcaggcgtctgcgctgccgtgcgctccgcgcatgccgccctccacgccaccgctcctgccctccctgcccgggtcgctggcggccgcacaggcggccatcgcccccgccacgatgcgggaggcggtgcggctggagggcgagagcgcgcccgacgcggccgggtcctacatcatcaacatgctggagggcaagctgcggcggctggcgcgccaggcacgcgcggagcgtcgtgcagcgcagcgtgcgcagcgcgaacgccagcgcgcgcggcaggccgtcgccgcggggggggagtccggggcgggggaggccagggatggccctgcatcaactgggcctgtccccaccgactccgacacggcgtcggcggcggataaagcagggctggactccgccctggtcatggaactcgccccgccgggcccgccccccagcatctcgctcctcctgcgagatccagaggtggtcttcttcttcgtcctgaccaccgtcatgggcctgggccatgggctcatcggctcctacctcttcatgttcatcaagcacacgggtgggtgttgacgttcagggggagggcgcaaggggtgtctttcattatcagtggtgcctggtggcagacaggctcagaacgaccttgattgcccgaccagggggtgtggcaccctctggtgagggcctggcaagtggtgcttgcccgggtctgcgcaccgtatactcccatcccccttctcctcccacacacccatgccacacacactctggatccctgagcgtgccatgaaaaccttaccctactccaggtgggagcgaggcactgatgggaggcgtcctgatggccaacgccctgcccgagctccccgtcttcttcttcttcggccgcatcgcccagcgctgcaccatgaccctcctgctcttcgcctcctgcggggtcctggccctgcgcctcctcctattcccgctcctccccctcatcggcgtccgctgggtgctggccattgagaccctgcacggcatcaccttcgccctgggctggtcggcctgcgccatgaacagcagcaagatcgcgccgcccggcctggaaagcacaacgcaggtatgtgtgtatgtgtgtgtgtggggggggtaatgtgggaagattgcaaactgccccccatcccttaaactcctgctggccctcaggaagagacagcctgcatgctgatggagaacccccatacaacccctcccaccccgtctcnnnnnnnnnngaggaggggggggggcggggttgtggaaggattgcaaactgcctccatcccttaaactcctgctggccctcgggaagagacagcctgcatgctgatggagtacccccatacaacccctcccaccccgtctccaacaggcaatcttccaggggctgtggacgggggtgggcacggggctagggggcctggttggcggcctgctataccactcccagggccccgccgccatgttcttcgccgcagggtgcctcgtggcgggcgcctccacgctgtgcgcgctgggcatggcctggcaccgcgcgcgggtggcgcgcgccagcgcgctgctacgcgcgatgagctcggccaacatcttggcggcctgatgctgattggaggcaggccggtttgtagcgatgaggcctgcaccctgacgcagacatactacacgcacgatcaactcaccacaccagtacccatgcctgagctgatttcttgtcccagctcattctcacatttcacctccccaccccacatgaatgcatcagttgcccactccgggacacccagtacatgtttcctcacagcgaggccggttcatcgctggcccttttgcccctctcccgtgccctgtagcgttgcctcattgtcaaattagccagcagcaggaatggtgatagcaaagggaagggagagagcgtggagcagcagagcagtaggatgagtgatgggtgttgtgagctgggaactggactggaataggcccagaggccacgccttgggcggggatctcaagggtcccccaagcagccgagcaagaaatacaactgccatgttcatactttcttcagcagcaggaagatgtcctcatccacgtccaggtcagcgaggcgcttggggtcgccgatgagctgcatgagcaggccgccaaagctgacaaagacctcggccctgacctggcccccagagctgctgtccttgaacttgaagatcttgccgtgcatcacgtactcgaagtcgtccgccagggtgcgccgcgcggtggggcggacggagtcgtagctggcgccggagggggtgccgtccgtgttcagggtggtggccaggcagagggccagcttgtcgcccaggtcgacggggtagatgtctacattaacatccaggagcatgtccatttcgaacaggtcactcctggccctgattcgactcactgtgaggaaggggttttggttagggcgggtggattggaaatggatggaggatggtgcagcatgtgtgagtccactgtgcataagggtcccctgctagccaggatcatttgtttgcagagcggggggaatgaatcgtctctagtacaacacacacctttatcaaacttcttgccatcggggtcgatctctagcacctcaaagatatcgttcaggacctgggccttcttcgcggccatggtgcgcactggccagacggcgtcggggcgccagagcacgccctctcctccgtaacaggttgatgatcagtctatagggttacacgcatgtgaaaattgttgttggttgtgcgggacgttcggccctcgagtcagcaannnnnnnnnngccagagcacgctctctcctccgtaacaggttgacaatcagtctatagggttacacgcatgtcaaaatagttattggtcgtgcgggacgttcggccctcgagtcagcaatggtgccgagaaaggaggtctctcacggggagtgaggcgcatgctaagcctgggcgcgacggacggagatccgcgaccaaggcactctggggcctgctgtggcccttcatttcaacgccagcatacacgattggcctgaaagaggcaatcacgcctgttgcatgccggtctggtgctggagtgccctgccatgagtcggcccgtgggctcgagctgcaccggcttcagaacatcgcatcttctgagcagcgcacactctgtcgcgggaccacacccatcgtgcgtatttagatcccagtccaagctcagagagcgtgctcggcacccacttcactctcgacgtgcgtgcacattgtgtcgagagcaagaggggtttggggggtggagctgttcaccgccgtgctcatgtcctttccttcaggccaagccttcatgcacctctgtccccaccaccacactccccaggcgccctgcgtatctcctccctggacgctgcgcagggctttgacttcgagtcccgcaccgcccagaacctggaggaggcgtccacaatgttcgtgggcatcctcggcttcggcacctttggccagttcctggccgccaggctggtcaaggcggggcaccgcgtgatcgccacgtcgcgcagggactacaccagggaagcggcggccatgggggtggaattcttcgccgacgtggatgacttttgcgaggagcaccccgaggtggtcatcctctccaccgccatcctgtccctggagaaggtgggccattgggttggggggggggggggggggggggggnnnnnnnnnnnnnnnnnnnnnnnnnnnnnnnnnnnnnnnnnnnnnnnnnnnnnnnnntcattgcatgctgttggaggaggtggagggttgggtactcgttcttagctgactggttccaggatgcgtcacgtctggacattcctcccctgctgtctcttgtcatgctacctgggcaacgaggttgcctgggagtgcaaacaagcagcccctgcagcaccctcaaaagccaggcagacccccccaccgcccttcccccgaccctcaccgcccccaaaggtgctggccgcgctccccgtccagcgcctcaagcgctccacactcttcgtggacgtgctgagcgtcaaggagttccccaagcaggccatgctgcgcatgctgcccgccgacgccgacatcctgtgcacgcaccccatgtttggccccgactccggccagggctcctggtcgggcctcaacttcatgtacgaggtggcgcgcctggtgccgggggacgccgcccgccagcagcgcatgcagaacttcatacgggtgaggagaggtcttggaaaggggtaatacaattggggccttgcaccggaggagggagccggggctcagcgttcgtgggcatgctgcccttcaatgactgcgtgccatttctgatgcccgcccgtcgaacgctgagcctggtgccacagcggctctgccgacgatcacatgccaagccacccgccgccccacagttctttgcgcgggagggctgcacgatggtggagctgnnnnnnnnnnggcgttcgtgggcacgctgcccttcaatgactgcatgccatttctgatgcccgcccgccaaacgctgagcctggtgccacagcgactctgccgacgatcacatggcaagccaccgccgccccacagttcttcgcgcgggagggctgcacgatggtggagctgggttgcgaggagcatgacaggcaggcggcctccacccagttcatcacccacaccgttggccgcatgctgggcgagatgaaggtgtggtgtggaggaggaggggcaggacctggggtgggactgtgctcgtgctgtgcagggctgatgtgcgcgggatgatgtgccgtgtgctgggaccccttgacgcagatcgtggacgagctgcctcccccccgcttcccgtgctcgcagttggaaccgacgcccatcgacacccgggggttccagtcgctcctcagcctggtgggcaacaccaacaacgattcctttgatctctactacggcctcttcatgtacaacccggtgagttgctgcagcttgagtcgggggaccgcgatgcagggcaacaaggccctgctgtggcacgacccacccgctcacaactggccctggcgggatctcgatgggaggtgccccctgatcaagcctggtcctgtctgggttctttgaactggggccccacaagcatgcacatttgcggcaccctgggccccaccacccccctattcctttcccatgccccctctgtagaatgcgacgcaagagctggagcgcctggagcacgcctttgacagcgtgaagcggcagctgttcaggcggctgcacgccaagctgcgggaccagctcttcccctccccctccgcgccccgcccagaggggacgttcctggaagcccctgccgcaccgcctgcggccccggccctggagccgggaattggagtgctgccgagaggcagccagcgagaggctgagctcgtcagctctcggagcaggaaacgagccagcctggagaatgggtcgtgagccaggggaggagctcgttacttgcattggatgccgatgcgcttggcgcggcgcaaaccaatcgactgggccccgcccctgccttgattgcccctcattgtgcgggctgagtaagacatgtgctagagcgatgcctccctggcggtttggtgatggtgttgacatgtgttggaagcatgtgtccctcacagcaggcacacggagccctccgccaggagtggctgcagcggctggtaccggatgacaaacacgtcgtccttgttgaattgggctgtgttcctgtaaggcaggggtcgttgttgagaaagatctgaataaggtcgttgagctacatgcctgatgctcgggcgggcaggacccatgggagggagagcatgggcggactgctcctgctggggaatggcttccttcctccccctgccccctcactacccctgtacaacgcacccggcgtcgtccaccggcacttgacctctgtcctccagcacgcggcaaaagacatgcttgtccaggtcggggcgcggcaccatgtccttctccgggtgggccgccgcctggcgcaccagcgaggagaaggcttcggggagctgccgccccactgccatcttgaggtgggtgccctgcagcatgaagaactcctgggcatgggcgtcctcccggtctgacagccgctccttgacctccgcggtgtccaagatgtgcatggcatactcctcgatcttgtgcagccgcacccggtagtagcagcggagcaggtaccgtacctgcagacggggaatggggaggaaaaggtggagggggatccttgaggtggcaggagctttgagatttcttgagtgggctggggttggcaggcaggggcattccaagtagaagaaggggatctctgtctgcaagcacggcccaagcagggtggaaccatgcgctggctgagccggagacgcgagaaagaggaggcaggtgccatgcgtgggccaagccattagaactacagactgccttgccatgcgatgatgcgctctcgaagccttggctataatttagtctgcatccaccaactctaccnnnnnnnnnnaatgcgtgggccaaggcattagaacgacagactgccttgccatgcgagaatgcgctctccaagccttggccataatttagtctgcatccaccaactctacccaccccatacacaccctggcgagctctgtcgtgaatatggtccgcaagagctctaggtcttggttgcctcgcatgagctcgatctgctcttcctgtgacatcggatggggaagtaagaaggctgggtcatcggttttggaggggctgctgctctacgactggcaaatgatgacgtggccagcccctcctcccgacggacttggtagtcgatttgggcctcgatgcgcgacacaaggtcttcctggaacattaggatctcgggagaagacttctcgttgatgagtgcgatcttgagggcttcctgatcgcttcgacccgaggtcccaggtgtggcttccgggaaggcatccatttccgtgggaacagagcagcgccccctttcctttttataatgtgtaagactagctttgttatcagggtgtgtgcactagttttgcactggcctgtggggagagcttgcacctgatgatcaagcagttgaattttgtcgcgcaggcgcgctggcgccttgctgccccccttcggagtttcctggcaactcaacgtgagcgttgatcatgtagtgcatttcccatgtgcgcatgctcggaaatnnnnnnnnnncttgaattttgtcgcgcaggcgcgccggcgccttgctgccccccttcgaagtttcctggtaactcgacgtgagcgttgatcatgtcatgcatttcccatgtgcgcatgctcggaattttcaaagcactctccaggtcccatttccgtcgatgatcgagcatgtcaccatgaaatcggatctttacatccgcagggatcggtgtgcacttggccgttctgtttgccaggttacttgcagcaccaatcccatgcacggcatgtaagtcctgaaactccattgccatagcattgaatgaatcctagacacacacgaacgcctcccctcacagcgtcctttctccgacctgtcaccttgagttgtgccttggtaccctgtgtggaccctctcctgcgtgacattgatgttactacacgctgtcccccccccggcacaattcatcagcggctgagtgcattcaagccgtacatgacgctggggagggtgactgcatcccggaccacgcccaggcctgcgggcccctgcttcttcatcaactccaggaagcgcgaatactgcatgagcagctgggtgaacaccgcttgcagcacgccgcgggcggcgtgcgtggacccaaagtcttgcgtcacctccctgagcaggtggtcggcgggtgcgtgggaatagatttatggagggagtgaagtgcacgaacagtgcgagaattctggaatatggaaggggggggccaggcaggacagtacccgcccaacccctgtcctgctctgaatgcaatgttgtgtcatactgtaccagcatgcccctcgccgcttccctgccnnnnnnnnnnttggcagggtgggccaggcaagacagtacccacccaacccctgtcgtgctctgaatgcaatggtgtctcatactataccagcatgcccctcgccgcttccctgccacgcacccccacacctgcacatggcctctgccttctgcttccagctcccggcaaaagcctgggccaggggtgctgcctccggcggcccacaaccaggcagtgcctgcccctccggcaggcccgacgccagggcctcgccgcgtcgcacgaatgcaatctgtgagtcaggatcaggacacacagggtggtcttgtaatgagaatgccattggggaaggtgtagatggtaaccacacagcagagcaggcatgcgagctaaagcgtgtcatgccttgctgcgcccctcggcgcgattccgcgcatggccaagcgcagttggccccgagctcccagggtttaaaaccctggtgggtctgagccaagaggcccctccacccagcagatcagccatcatcccacaggtgtgcaaccccccttcccctccacctcggttttgaggctctactcaccagctcaggcagcgccccgcccagnnnnnnnnnnaccccttcctctccacctcggtttcgaggctccactcaccagctcaggcagcgccccgcccagcatgtcgtccacgtagatgctggtgcagcggtgcagcccctcctcaatctccttgagcagggccgcgcccgaggcccccagcccctggcttgcgtccactgccccgtggctgctgctggtccggtgcagggcggggttggcccctgcgcctccctggccgccgcccgacgcagcctgactcatggcctgctgcgacagggatcccgtgcggggcaggccccgggccgcggtgccacgcagcacgccgacaatgtgcccaaagttcaggatgaggaagacggtgccggcgcgcttgctgggcagcaagcggctcaggctcagcagggcgttcatcactgaagggggggaaaggaagggggggacatgggccgttggaggaaagggtgagtgaagtgaggtgagatggggttggggtcaaggtccattttgggggttgggggatcgggtgagtgacacagcagccttctcatacctcaacagctgaaaggccaccacatgcatccgctctgctgcacctggctgccagatccgtccctgggtgcttccccttcccgagctgacagccagtggatggcagacaagtacccgaccccttacctgcgtatcgcaggcgctccnnnnnnnnnntaacagctgagagaccaccacatgcatgtgctctgctgcccctggccgccagatccatccctggctgcttcccctccccgagctgacagccggcggatggcagacaagtacctgaccccttacctgcgtatcgcaggcgctccgtgttgctttccaggggctcctcgggcaggtccgcttggagcaggagcagggccgaggtgagggcagcataccgctctgtgccatcgttatccgggtggggaaaggagtgtacggtgagctgccaggagggggcgctggatgcgtgttcaaacacccaaaggacccccttttgacagggaggctgcacttgtggctgcagaggatcatactgctcaaaaggccttctcgctgcacggccctccaggccccacctgccagcaggtggacggcggggatggggacggcagtggaccccgggtcgactggcatcgccttgaccgacgccagttgggcgtccatgagcacctaaagggatgtgcggtggggggggtgggagggttaggtggggagggatgactgagtcaccgtttgcatgctcatctgcatgggtcagctgtcgcagcccgcatatgtgatgcctcaggtcctgactgacattctggcccatccgtcattgacaccgccagtcccctgtgacccatgagttccagcacatgcccactcccaggtcccctgccctgccccgaggactgccccctgcccctcccacatcctccaacctccctgccccacccccacaccacnnnnnnnnnngcatgtgatgccccaggtcctgattgacattctggcccatccgtcgttgacaccgccagtcgcctgcgacccatgagttccagcacatgccgactcccaggtcccctgccctgccccgaggattgccccctccccatcccacatcctccaacctccctgccccaaccccacccccctccccactccaccccgccccgacaaccccaacaccttgaggcggggccagagcagcaggttgatgcggtcgtagaagccgtccagggcggggttgcgccgccgcgccatggcaagcccgcactcccggttcaggcgcaccatgagcagcagggcgatggggtcatgcagctcggccagggccgccgccagcgaggactccacgaaggccaggacgggggcgaagagcgctgcgtacacgcccgcatcgccccagaactcggcgcagaataggtactcgtgcgccgcggtgtccatcagcagcttgttcacggagcggaagaggacctcgtaagggaagcgcgcgccgcgcgcctccgccgcgtgcagcactaggggcgggccctccacgtggctcagcaccagcgcgcgatcctgcagcgagaaggcgtcggcgcggccgccggccgaggccgcggcggcgggggcgggggcggggcgctggaagaaggacagcacgccgccggaggaggaggcctcggccgcgcccagcgtgtcggcctccgtcagcaccttctcctgtggtggttgtgatgttgaatgagagggaagggaggcttggaagggctgaggatgaggtctgggcaggtcacacggcggcgctgggtgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtagttgcggaagaggtccaggaccttggcggagaccttgtcgatgtaggcggcccggacctggggggagtgggcagtggcacatggatttgggcctcgacgacgacgacagcacttnnnnnnnnnncggaggggcgcgcaggggggggttggggaagcagtggggtgcggcgcgccggccgcctgcatccccccactccggggcagatgcagcaggcaattatacccacacaccgccccacctccagccggtcgatgaccgccnnnnnnnnnngggaggggcgcgcaggggggtggggaagcagtggggtgcggcgcgacggccgcctgcatccccccactccagggcagatgcagcaggcatgtacacccacacatcgccccacctccagccggtcgatgaccgccnnnnnnnnnnagagtgggcggtggcacataaatttgggcctcgacgacgacgacagcactttctcagtcgaagatgaggatgggaaacgggcatgctataagcccgcctcccatgcacccctcctgctggaaacacacctcgccaaagatgtctggggcatgctcgccgaggaaggcgaccagggacttgtgtcgcagcagcaccggctgcttgatctgccatgcagggggaggtggggtggggttcgtggatggcaagggggcagccaccccgcattgttgcggcaatcggccatggcgccccttcatcgcagcaggatgcaccacccctgcacctggacgttggtgcggggacgccggaagtcccagatcttggcgaacaagaagtccctgctcttcacgactgccttgatcctgagcttctccagctctggcgccacatctctgtcaagccgcagtggggaaggggggaattctggagcaaaacagcaggctagcacacaattcatggatgctagacccttcagttttgcacctgaccgccacctcaacctcccaacaccaactgaccgtgactccattgcacaaaaaccaaaagctcacctgagagccactgtcccctggaggtccgggtcccgagctgcagaggccagcttccggcccagggtttgcagggcgctcaggaactcctcgctctgtacatccgactggacgatgccatggatgaggtccggcgtcaggctcactcgacccacaaagtcctccagagactcctgcaagtgtgcggaggtgggccaaggggggggggcgtgcagtctgcctgctgagaggactggtnnnnnnnnnnagaggtgggccaagggagggggggcgtgcgggtgggctggcaaggcaccagcgtgcagtctgcctgctgagaggactggtgcactgcaaaagctgcaatgccggggcgactcatggagctgggccatcacccgcctccctgcacgccccaggagtccaggcttcaccttgagcgccctgcggtcgcgcagcttggcattcatgctctggctctcggcctgcaaggcccggatctcgctggagatgctccccaggtcggtctgaaagtgcgccagcgtggcctccacgccctggaggatgtcgtcgcactccttgatctgcaggtgtgtcggcgcatgagcgcggcgcgtgtcacctgcctggcgtgagcccagcctggggaatacacatcagcctgactctgatgtgcatgcggagctggaacctctcgcagcctcctgtgcacacgttgacttgctgcatgtgccgtgcacgaattccgacacgccgtagattgcagtgtgaggatgtcacctggcgcatagcctcacacaacatgatcaccagatcccctctcctcacgtcnnnnnnnnnnagagctggaacctctcgcagcgtcctgtgcacatgttgacttgctgcatgtgccgtgcacacattccgacacgccgtagattgtagtgtgaggatgtcacctggcgcatagcttcacacagcatgatcaccagatcccctctcctcacgtctgtgtgaagggcgatgagggtgtctgcctccgcgatgtagtcctcgatggaggccagctcagcttgacggagctcgtcctcgtacctgcgcccatactcgcgagggtccagccctgatggcaggccatggggagggtgggtgtgagacgagccctgagcatgaaaagacacctgcaaaagcctggcgggtgcagccnnnnnnnnnncagggcaatgagggtgtctgcctccgcaatgtagtcctcgatggaagccagctcagcttgacggagctcgtcctcgtacctgcgcccatactcgcgagggtccagccctgatggcagggcgtggggagggtgggtgtgagacgaaccctgagcatgagaggacacctgcaaaagcctggcgggggcagccgagcactcgcacaggtttgcactccgggacatataccttgatccaggatagctttgagtacttcgtggtcggctagagcttctacatccttttctatccccgccaggctcaggtgctcggtggtgagatcaagttcgcccagccccagagacaggtcttccccattttcagcgccgtagcctgctggaatactggaaggctcatccatcggatccacgcctgcctgcactgccgtctgcaccatccttccgcgagagacggggcggtcgtcagtcacgccatcccccggttgacagggattcaacttctcattcctaatcggtcccccacacagtgtgatctgcaatgctacagaatatagggagcgatcatttttaacgcgctagttgcatccactgtctcgttctgattctgatagtggtgtcgagcgcgcgaggtgtagggactacacccaacaggagctgggttggtgatgtagatgtcggggtttctgcatattcagaatccagactgatttgttcatccttagacaatgaagctcgcaaactttgttttcacannnnnnnnnngagggactgggttggtgtttttgatggcggggtttctgcatgttcgagtatccagactgatttgttcatccttaaacaatgaagctcgcaaactttgttttcacaaatgccggcatgtactatatacctttgagtgaggggctactcagaaattttcatgcctagaatacaaacaatgtgattctgaaccattacgatcataaattaccctcaagatccttataaagtatcatgtacgtactttgggtggcgaggagagccagccatgatttacaggcccagctgcacgtgtgtggcgttccggcaaatcagtctcgcgtgagcccatgggtgagcaaatgtttcctttcgcgcaccttcgatttcccctannnnnnnnnncaccttttgagtgaggggctactcagaaactgtcatgcctagaatacaaacaacgtgattcatctgaaccattacgggatctatttgccgtgtggcgttccggcaaatcaatttcgtgagcccatttttcctttcgcgcaccttcgatttcccctaaatttttgtatatatatataccgtgtcaaagtccaaccgagatttatagctaatatatattcctgcggtgaccgataccatggcggcatcattcccaacagcagtgcaccagaggcacaatgtggctccaggatcccggtctcggataccaggtatcacttccgccagcaatgccaaaactggactggcgcgccgtggcgagcagcccctgcatgtgaagcagcagcgggccacccagcagcggttgcatgcgggacgacaagccggcggtgttctcgaacgtgagtttcgttgggaaactggccccgcagatattcttgcgagcgtgaatcttatattgagaatcggtcgaacccgggtggggcaccccacccggtggtgaggcacgaatgcacgggtgtgtcgactgacatttattccggaatctcctgcaggatctgtggcacccaccgaggctcccgacacgcagctgcgccccgtgctcaccgctgccgcatggaccgcggcggacatgcgtgccagggagcacgagtggacctaccacctgacccccaatgacatccaggagctggatgaggctctggttctcgccagggcgatggggaagcccatccatgagctcacccaggaggactttcccctgcccttgctggcacccaagctcagggccttgggctccgaggtggtccacggccgcgggttccaaatcatcaaaggtaatgcagacggatattgggggcatgaaggagtgggtcaggcttcagtgctgctcccaggggtgatactgacgtccgcaaccagtgcccctcgtccagtttatgatccccccccctccttctctataccaatttcccccatgacaggcgtccctgtggagcgctggagccgggaagagagcgtgacggcatactggggcatgggtctgcgctggggccgcgccgtgtccaacaatgccgcggggcacctggtggggcacatcaaggacattgggcacgacccgctggaccccggcacgcgcctgttcgcgacgcgcgcggcgcagcccttccacaacgacgcggcggacgtggtgggcctgctgtgcctgaccctgggagagtccggggggctcagctcctggaccagctccgtgtcggtgtacaacgcagtgctggccgcccgccccgacctggcgcgcctgctgacccagccctaggtctgggaccgcaagggcgaggtcccgcccggcaagccgcccacctttgccatgcccgtgttcaaccaccacgcgggccacctgtcggtgaactggagcagcaactacttcctcgccgcgcagcgccacccgggcgtgccggccctgaaccccgcacacctcgaggccatcgcgctggtggacgcactggccgccagcgacgcgctgcgcctggacgccatgctggcgccgggggacgtgcagctgctgagcaaccacaccgtgttccacgcgcgcagcgccttcaccgactcgccggagcgcaagcgccacctgctgcgcctctggctggcgccggaggacgaccggcccctgcccgaggcctacagggagatcctgggcgggtcggtggaggtgggtcggcgtggcggcattgtggtggaggggaccagactccacgtccccctggaagccgcatgatggtgcggcgactgcgatacagagggggagcgctgcgctccaggaaatggcgatcgaggtcgggcatgggagcgtgggtggaccgaggcaactgccaacacccacagcaatcccggctagctgcaccccctccccactcctctctccaacccttgcccttgttcattcttcacagcacannnnnnnnnnttgcaccccctccccactgctcactccaccccttgcccttgttcattcttcacagcacactcttgccaccatcccacatactcacccttctcttcacacttgagggagcgagtaggttttcaccccttccgtgatgctggtcctggaattgctgtgcattgcagtaccccattctttggttgccccccccccctgagttgttgcatgtagatggtttgcgagaccgtccaaccatgaataagaaggagtgggcgctgggtgctgtactaaagacagagatggcaacgatggtcactgcgaattagcttgtgctcttcctggcgacgtgaccattgatggtttaagaattcagctcaccagcgaagcgctgtctgtgctgatcaacttccagaccaggcgcatgcattgctgtcgctaccagtgcgcacatcgatgccatcttggcacctgcgnnnnnnnnnngattagaaggagtgggcgctgggtgctgaactcaagacagagatggcaacgatggtcactgcaaactagcttgtgctcttcctggcggcgtgaccatggatggtctaagaattcagctcaccagcgaagcgctgactgtgctgatcaacttccagactaggcgcatgcactgctgtcgctaccagagcgcacatcgatgccatcttggcacctgcgagacttgagtgtacccagacatccccatcaatggaatactttaacttcacgacgtaaatagcagcaaggaatgttggatcttggataggcttccctaaaaccacaaaggaggtcgaggatgggggagccaagcacccagcttgactagatgcgcnnnnnnnnnngcttgagtgtccccagacatccccatcactgaaatactctaacttcacgacgtaaatagcaacaaggaatgttggatattggatacgcttccctaaaatcacaaaggaggccgaggatgggagagccaagcacccagcttgactagatgcgcaccagctaccgaagcgtacgccaatcgtgctccaggccgagctgccccggctggggctggcgagcccctggtaggactacccgcatggggctggacgggtcacgaaggtcgagcgataggtgtgacatgcaagctcacgcggtgcgagcgaggcgcggagggagcgcggcgaggacagcgagtgcgcaagtctgccctccgtgctgcccaagcccccacctgctgaagagcatgcgatgacggaaacagcaggctgcgagtggaaagggcgatcttgtaccatggcagacgatggacgcgcgccggagccggtccccgggaagatgctgggcgaaccacgtacgtcccctgcgtgccgcacgctggctgtgtgtggggcgcacgccatgggtcagcaaacctagacataccatccaagcgccccgaaccgccaacaaatgcatcacagggagacaaaaacgaagtaggacaaagaagcgagcgcccccggcatcgaacagagctgcaaagtgcgtcggacagggcgccgagcggaaccccgacatgacggccatcgcctccccatgggctcattccagcccctcctactccctctttggcggctccggctttctctccgatgacgatctgcactcccaacatgtatgcgggcgaggagggacgcgatgcgggcaacattggatggatcgggcgccggagggacacgtttcatcatgggccaccccaccggaggggtccccccatgctgcgccatgctgagcgcttggttcctcggacaaacgtccctccctcctcctcactccttcccccattctcaatccacaggattccgtgctgacggtgtctggctccgcctcgcccaccacctcgcccaaggaggcagtggccgccccccaccccttcacccccgccgccctgcgccagtgcgccaagcaggtgaacatgcggctcatgcacgcgcactcccccgccgacatcttctgcatcgtggccgatggcctggagttcttcgacagcatcaacctcaccgccgccttccagcgcctggccaagttcctggccgcgcacccgcgcgagcgcccggccgtcctttcctcccccgtcttccactccctggcgggcatgatggtggaacagtgccacacaggggccttcaacccccagtccaccagcaacgcctggtgggcggtgagcaagctcttcggcggcgacgccccggccccgcccgccctgctgaccgctctcgaggcggcgctgggcgcctgcctggcctctggcgccgaatccgcccgacccaacgcccaagcggtgtccagcacctggtacgcctgggggcgtatgggcgcctacctgcccggcacccgcgtgcgcgacgcactctgggaccgcacctacgccctcgccctcaactttgactcccagggtgggtggagggtctgggtggggggatggtctggtggctggaggggggatggggaaagagcacctcctggcaactggccctgtggcggggggccagggatgtgcnnnnnnnnnnggggggatggtctgagtggggggatggtctggtggctggaagggggacggggaaagagcacctcctggcaagtggccctgtggcggggggccagggatgtgcagtggcccattcaggcatgctggacctccttgccacctgcccccgccagtcatcaaatgatgtcatcctctcacctaatcccccgccccacctcccaaccccccaggcgtggccaacatggtgtggtcgtggggccagctgcggcgccgccacggcgacgccttccccgtgcgcaccgacgtcctggccggactgaccctgctggtgtcgcgcatgcccggcgcctttgcggtgcagggcctgtcctgcaccgccatgggctgcgccaacctgggcgccacgctgcgcgccgcggcgctgccgctggtacgcgtgctcgtgcgcgaggccggggcccgcgccccggccttcaacctgcaggccatggccaacaccgcctcggccctggcgcgcatgggcggcgaggccgcgcgcgac

SEQ ID NO: 48213 - DNA, 79 bp, Chlorella protothecoides
gggcagagcctgtgctgacttgatggtgtggttgatgcataccgccagccttcatctccaggccccgttgcttcatcat

SEQ ID NO: 48214 - DNA, 95 bp, Chlorella protothecoides
gtcaacggatctcgtaagaaaatgtgaaaatacgagccacgactctgggtacacaacatgccgttggccacgtgaccctccctaccttgcttgct

SEQ ID NO: 48215 - DNA, 78 bp, Chlorella protothecoides
ttgggggcccagcagggatgatggggatggacaaggttgtctgccggtggtccagacatttcctcagtgtcacggcat

SEQ ID NO: 48216 - DNA, 68 bp, Chlorella protothecoides
gttgatgcccgggctcgggatcgcaggacagggacgtaggagtctcggccacgaacatggcgccgcac

SEQ ID NO: 48217 - DNA, 64 bp, Chlorella protothecoides
gcgaccaaactttgggggcagaggcccaaacctatgatccctgcaaacccgcatgtcctgctcc

SEQ ID NO: 48218 - DNA, 66 bp, Chlorella protothecoides
acgggcccaatggccgagcaaacgcacagagtgctggctacattctttgagaaatgcagttgtcac

SEQ ID NO: 48219 - DNA, 69 bp, Chlorella protothecoides
cctcacgacggggcgagcggccatggtgcaaactgactgccagtcccaagtctgcccccgtccaacgcc

SEQ ID NO: 48220 - DNA, 66 bp, Chlorella protothecoides
cgggggactgtgcaggccggggctggctggccggccggtccacgagatcggcgtgtgagcggggat

SEQ ID NO: 48221 - DNA, 100 bp, Chlorella protothecoides
tcctgattgacagcaaacatagcagccctggaatgaacggtagctgaaaacattacgaccttaaatctataatttggtgcagtctgaatgcactgctggt

SEQ ID NO: 48222 - DNA, 61 bp, Chlorella protothecoides
acaactcaattggaccatacaatcttgaccaccccatcgcctccccatccactgtctacat

SEQ ID NO: 48223 - DNA, 61 bp, Chlorella protothecoides
gaagggcggcgccaagcgcgtggtcatctccgctccctcccccgacgcgcccatgtacgtg

SEQ ID NO: 48224 - DNA, 73 bp, Chlorella protothecoides
ccctcccttattcccttctcaccaccatcccttccgttacaattcttcaggaaagtggaggagcgtctgggct

SEQ ID NO: 48225 - DNA, 73 bp, Chlorella protothecoides
ttctatgggcatggcaaaatcccttgcccacagttttagttacagcccacccgaggggctccgcgcacctcag

SEQ ID NO: 48226 - DNA, 64 bp, Chlorella protothecoides
cccccccccccccccccccaaaaaaaaaaggtagtaatcacccgaggtggcgatgaggatgttg

SEQ ID NO: 48227 - DNA, 61 bp, Chlorella protothecoides
caaccccaaacgatgccacccatcgatcctccctcacatcagagtattcactcagatcagt

SEQ ID NO: 48228 - DNA, 62 bp, Chlorella protothecoides
aacgtgacatcctgctcctccaaggagttcaactccatgtcggggtcaaagcggcggcagaa

SEQ ID NO: 48229 - DNA, 61 bp, Chlorella protothecoides
tcgggttcgtgcgacaccatggcgtcgcatgggcggactcctatactgttccttacgcttc

SEQ ID NO: 48230 - DNA, 62 bp, Chlorella protothecoides
atcagtgcgcagagggaaagaagcgggaaaaggctggaggttggcgagaacggggtggggaa

SEQ ID NO: 48231 - DNA, 69 bp, Chlorella protothecoides
ggccgatatgccagacagccaatcacagagtagatatcgtttgtgtacacatcacaggacttggtaata

SEQ ID NO: 48232 - DNA, 61 bp, Chlorella protothecoides
aggaacaagaaggtgtgacaggcggtcaccacgcagctgcggagcacttcagatcccctcc

SEQ ID NO: 48233 - DNA, 78 bp, Chlorella protothecoides
tggcaatgcatatgggagtgtccagacatcattgggtgggaaaagaggcgacgagcggcaagatgcggcatgcggggg

SEQ ID NO: 48234 - DNA, 61 bp, Chlorella protothecoides
tcttgccaagtgacgcagtggctgctgaggatgtttggtagaggcacattgagggagttct

SEQ ID NO: 48235 - DNA, 130 bp, Chlorella protothecoides
ctgcgccagctgcagacattgaggcaagggctgggtgagtcgcaggatgccaataaaaggagtaggtatggcatatgaccaggttaagaattgttataaagcgctgcagctcatattatggggtgctcgg

SEQ ID NO: 48236 - DNA, 69 bp, Chlorella protothecoides
aagatcgccattggcgtgatcgcggggaccggtgggccctggatgcaggccgaggcgttccctgccttc

SEQ ID NO: 48237 - DNA, 11391 bp, Chlorella protothecoides
  modified_base (170)..(213): a, c, t, g, unknown or other
  modified_base (381)..(390): a, c, t, g, unknown or other
  modified_base (783)..(792): a, c, t, g, unknown or other
  modified_base (1753)..(1788): a, c, t, g, unknown or other
  modified_base (2453)..(2462): a, c, t, g, unknown or other
  modified_base (3113)..(3122): a, c, t, g, unknown or other
  modified_base (3194)..(3203): a, c, t, g, unknown or other
  modified_base (3286)..(3295): a, c, t, g, unknown or other
  modified_base (3537)..(3546): a, c, t, g, unknown or other
  modified_base (4526)..(4535): a, c, t, g, unknown or other
  modified_base (5246)..(5255): a, c, t, g, unknown or other
  modified_base (5376)..(5385): a, c, t, g, unknown or other
  modified_base (7133)..(7142): a, c, t, g, unknown or other
  modified_base (8248)..(8257): a, c, t, g, unknown or other
  modified_base (8809)..(8818): a, c, t, g, unknown or other
  modified_base (8923)..(8932): a, c, t, g, unknown or other
  modified_base (9308)..(9317): a, c, t, g, unknown or other
  modified_base (9689)..(9698): a, c, t, g, unknown or other
  modified_base (10202)..(10211): a, c, t, g, unknown or other
  modified_base (10427)..(10436): a, c, t, g, unknown or other
  modified_base (11056)..(11065): a, c, t, g, unknown or other
  modified_base (11292)..(11301): a, c, t, g, unknown or other
tcctccacccccacccccaccgcccccatcaagctcgccggccccatctcccgggatctctccttccccaggtaccaagtctcctccacctccatcctacgtagcctcaccgccgccaccatcaaaggcctccccaccgccgccaacgtcttctccctcgccccgcaagnnnnnnnnnnnnnnnnnnnnnnnnnnnnnnnnnnnnnnnnnnnncgcaacctttcccccgccaccccccatcagcaaagacctctacaagtcggtaagttggtttggcatgagggaagtgcacacgtcaacaggaacctgttctagggcagtatccgttcacattctgaacaagttccactgcaccccctgctgcaggcactgtatggatcnnnnnnnnnncacacaatctgaacaagttccaccgcaccccctgctgcaggcactgtatggatcgtacctattctacgaggctcaagtcagcggtgagaagcccagctggaaccgcatcacataccgcggcgactcccacaccgacgatgtcgtcccgggtggatggtgaggcgggtcttgggtcctgaaagttgacagccttgctcgctggcgatactagacattcgcggccttgtacacatacgagtgattggcggggctgcagcctccttttatggagacctgatcggctgttctcttgatggacctgccctgccttcataatcagaacccctgccttccaccaagtcaactccccccccttcctccccgccaggtacgatgccggcgactttctgaagnnnnnnnnnngcgctggcgatgctggacattcgcagccttttacacatacgagtgattggcggggctgcagtctccttttatatagacctaaccggctgttctcttgatggaactgccctgccttcaaaatcagaacccctgccttcaaccaagtcaacccccccccctcctccccctgccaggtacgatgccggcgactttctgaagctgaacttccctatgggccagaccgtgtccttcctggcctggagtctgttggatttcccgaccgcctatgctgacgctgggacggccacccccgccctgaacaacatcaagctggcagccacctacctgatgaagtgccacatcggggagtaccagtacgtgggccagatcggcaatcccggaaccgaccactcctactggggccgtccggagcagcagaccggcacccgccccgcctacacctacaccaaagaaaccacggccagcgacctgctgggctcggtctccgcggccctcacttcctctagcctggtcctggccggcagcgacgccgcgctttccaaggagatgctgatgcacgccaaggccctgtatgcatggggcaaggcctacccaggtggatgggaaggcgtggatgtccttgggggaaaggaggatgagcgggtgggcagagtgggtgcaggcctgttcggcccttgaattgcaaaagttattgctgcaggggcactgcacccagagcaggctcccctccccaagaccgaggatcaccccgccccggccccttgccgtgcaggcctgtacaacgcggcatactcctccgccacctatgtgtactggtcctcgcggtacgtggacaagctcatgtacgccgccgcctggctgttcagggccaccggggacgccgcgtacgctgccgacgcctacaccttctggcagtctgccggaacgggcgacatctacaccggctgggactccacctttnnnnnnnnnnnnnnnnnnnnnnnnnnnnnnnnnnnntaacctgctgctcaagctggccagcgaaggcaagaccgtgcccggcaaagcggcgtacgagaagtggatcgtctccagcttcctctccgcctggcagacggccgacggtgagcctgggggttggctttcctcctggtgcgggatgcaccgttttcttgtccagggcagcggcaggctgcagagtcagccagtttcagcactcttcccaacagacggggccaatggtgcgggccaggagccaccaatgtcattcagcgctctccccccttcagtgctctgagatcccttcccttgtgcacccccattcatcaggcaactggagcatcatcaagacgcccaagggcctgacctacccatcctggagcaagtgggggaacctgcgctactccaacaacgcggccttcatgaccatcatgcgcgcctcctactcctccgtgaacaaggcgaccaacatcgcgtgggccaagagccagctggactacgcgctgagcaccaccggccgcagcttcgtgtgtggcgtgggcaccggcttcccgctgcagccccaccaccgctccgcgtcctgccccaacatgcccgcggcctgcggctgggaccagttctactctgcggcctccagtccccagacgctgacgggggccctggtgggtgggccccccaacggnnnnnnnnnnagcaaggcggcaagcccacagacgctgacgggggccctggtgggtggaccccccaacggggatggcacctacgtggacctgcgcagcgactatgtctccaacgaggtggcggtcgactacaacgcgggcttcaccggcgcgctggccggctacatcgccctggcctgaggcggctgctccgtctcaaaaagccacgcagagtgcccgacgaccgcgttgccctgatcagggccgcagccgaccccccctggaaaccctggccagacacctgcacccttgtatactgcatactgccactgacacactcccctcatcattgtctcctgagacatccaggcatcacccccccccgccccgattgcgcagcgcagccaggtccccctcccggtcgcccattggtgcagggagggggaggcggctcgcgcctgcgcctcagtatgtagccatccttttgattgagatggaagggttcagtatgtgctggaggaagcttgggccctgatctcgtcatgcatcactcggtgaggtctttgaaggaagattcgatgcggttggaggcacaccaggtatccagagcgtgcagcgtgcatgctgcgcacaagggagcgatcgcactttcctcagggatgcattcgtacatgggacgggcgnnnnnnnnnngcactcggcccagggctcaggctcctcgcaacaggccttttccccgcctcctgggtgtcggctgccgggtcnnnnnnnnnnggcacgttctcactgcctgctgggtgagggcctgctcctctgccggccatgcctcggttcggccagcccttgcgccggccatnnnnnnnnnnagcatgttctcactgcctgctgggtgagggcctggtcctctgccggccatgtctcggttcggccagcccttgcgccggccatgggcggctgggtgaggcctccactcggccctggattcaggctcctcgcaacaggcctttcccccgcctcctgggtgtcggctgccgggtcgcaggttgccaaggagcagcgcccgctccaggtcaacctcctggcgtctctgggccgggagccacacgcnnnnnnnnnnccgccaaggagcagcgcccgctccacgtcacccccctggcgtctctgggccgggagccacacgccctacacgtatcgcccacaggcctgctgtgcgacccccttttcggagtcaaacacctgctgccccctgacaaacgtggccagcaccctgccccgcagctgcaggtcgtggtagggcgtgaccttgtgccggtgctggcgcccgcccgcgcccgtgtcggcgagtgcgctgggatcaaagaccacgaggtcggcgtcgaagcccggcctgagcgcgcccttgcgcgcgctcaggcctgcaaggcgcgccggcgcggcggcccaggcgcggaagaaggcggggagccccacgccgtgctgcgccgcgccgtgccagctggcgggcaggccgtactgcagaccggcgatgccgccccaggcgccgcggaagttaccgctgtccaggtgcttgagcgctgggggcgctggggagtggtcgctggccagcaggtcgatggtgccgtcggccaggccgcgccacagcgcctctcggttggccgcgctcctgatgggcggcatgcaggagaagcgcgtgtcgccgtcggccacgtcgtcggcggaaaagaggaggtagtgggggcaggtctccacgctgaccggaaggccctcggccttggccgccgccagcgcggggagcaggctggaggagaccaggtgcacaaagtgcaccacgaatccagggcgggcgggcgtggtgtctggcatcgggtgggggcggttgggtcaggagggggggatcagggagtgggctgggaggcggccccttgtgtggaggtcgcgggtgctgggccgggggcagcaggcatgcacgtaggagcatcccagccacctttggcaccagtccccaggacccaccccggccgagccaggcccccttcaacccccacagcatgcttccagggggccccttctcacccccaggcccacccacacgcccannnnnnnnnncgctgggccgtgggcagcaggcatgcacgtggttgcatcccagccacatttggcaccagtccccaggacccacccccggccgagccaggcctcattcaacccccacagcatgcttgcagggggcccgttctcacccccaggcccacccacacgcccaaccacgcccacccttgcgcaggatgtcgaggacggcgtgcactgcggcgcgctcgtagcgcgccgggcgcctggccaggaactccgcgtaggagcggggttcggcgccgggcgggacgtcgccgtccaccagctcggcgtggaggaggtagggcgcgcccaggcgcttgagcacggggatggcggcggccacgtcggccagggacacgttggggaaggcggccatgcccgagggggagaggaaggacttgaagccccgggcgcccgcgcgggcgagggcgcgcagcgcgcgcgcgtcgcgcgcgttgccgggcacgacgccgccccaggcaccgacgtcgacgcgcgcgccggcgcggatcgcggcacgcttggcacgcaggtcggccacggtgtttgtgcacggctcgctgtttagcggcatgtccagcagcgtggtcaggccccctgccgcggcggcggcggtgccagtggggatgccctcccactcttcccgtcctggctcgttcaagtgcacgtgcacgtcgatgaggccgggtccgatgaccgcgccgnnnnnnnnnnccccccatgatgcagagactcctgggcagtgagcggcagaaccaccggaatgggcccccctcacactcgtccgggaacggaccccaatcgtcatagggaacccaaataactcaccataccnnnnnnnnnnctcccgccccggctcgttcaggtgcacgtgcacatcgatgaggccgggtccgatgaccgcgccgccgtagtccagcagcgcggcgcgcgggttggcggctgcgtagtgccgcgcgaaggccacccggtccacgtcggggccggcggtggccaccgtcacaatcctgctcccgcgcacgtgcactgtgggttgtgtccatggcagggaggcgcccggtgtgacacagccatgcgagggatgggcgggagcagggatgggtatggaagtctcccccatgatgcagagactcgtgggcagtgagcggcagaaccaccagaatgggcccccctcaccctcgtccgggaacggaccccaatcctcatagggaacccaaataactcaccatacccgggaccgctgccaaaggtgcggaccacattgtcgctgaccaggatgaactccttgtgctccagcaggccacacggctgggtccaaggactcattacccaggcgtagtccctggccaccgctagggctccaccggcatacatttgatacactactatgctcagcaccgaggcctgcaggaggaaggccaggaagaggcgacggggatccatgcccagcacgggggggtgctcgccaaactccttccgccgcaccctcggcaactgggagggtggtggggaatccatgctagtccaaatgcaacaaacgatagagcgagctctggttgcacatctgattccctacactgcctcgccctagggccggccgggcttgaggcccgagcgtggaggggttgcagaaccctggcgcgggccacgtgaccggatctcggtaccagttcaaattccagggcgcgcagaacggatatgtcggggaagcaggagctcagcatcgtgaagagtcctcgatacctcgtgcctgacgtctacattctcaagtggtttcctggaggaagatgccgctgtcactagggagcacgcgctctctcaccagggtcctaccaggtacctcattctggaccgagtttcgcttggccttcaggctggatgccaccgatatgcggggatcaacacttagaatcgatgccatgcaggtactttgtcatcgcgccgcaagcatgctacgcggcgcaccagactcaccgctacggccgtggtgagggagagggggagtatccctgaggtggacgcggagggatcggatcatccctggtgcaaattcctctttctcattccccatataaatgctgcagatgaaccaaatccggatacggagcaaggccaagcagctgctggatgctggttgccagattcacgagtttggaggacagacgctggaggagggtggctttggcgacgacgtggcggcgctgcaggcattcctgagcgaacgtgcctatttcaatgcaggtagggtgcagggctgagtatacagaatgcaccgatggtgcattcgccttttgggatgcattgcttgtcgtcgctgtcacacgaaacagcaaggcttgcatgttgcgcacattttccaggggaaggcttcagcggttactttgggagcgtgacgaaggaggctctgtgcgactggcaacgcgacagcggattggaagtcacaggttccttcaacacggcgagccacctggaatacctgcgccagaaggtgagtcgtggggaaagatggtgacggggtgggagtgttgggcaggcatcgatgtgagccaccatgggccaccccccgtgcacctgcaacaatggcaatcaccnnnnnnnnnnaggaaacatgctgacggggtgggagtgttgggcaggcctcgatgtgagccaccatgggccacaccccgtgcacctgcaacaatggcaatcacccaatgccaattcttctcagcagaaggccaacctccatgcggctgtgacgcagcaggctggacaagcggcagttgcctcgactggcgctgccggcgtggcggcctcggtgagcgtggcaagcgagaatcctgggcacctgcaagctttcgtcgccccagctctgcctgctggggccctgggtctggcggccaccctggtcaccattgtcttgggtgtcctggcaaagcggcaggcgccgagagcagtaccggtactgcaggccagggagtccgcctcgctggatgcgccggtggcgcaacacagcgaagttggtcgccaggcacggtcgacgactggcactccagagccgtccccggagggtggcgcgtttgtgccagggcagagacgaaccaggccgctgacagacgaggagctccagcgccgtctggcagcgctcaagggccagccgccagccagcctccctgtgcaggcatgtgcgggatggggtctcttggaattcctgttggtatggggtaatctgggcttgaacggtgccctcgagggtgattccacagcactgcagggcgtttgagcccctcggcaggggtcctttgcccgctggaccaagcacaggagcttgtctggttgcctgactggcagtgaaccctcggaccttcacgtgcaagcctatcatgttgaatgggccctcccacaaccacagaggacggcccccaagcctcttccaggggtcgaggagtacgccacttccctgccctcccgctatggtacgcgagtcaaggttgcaggtggcattccaattccctgagtgccatgcatcgggtgggtgcactccacatcgccttggtgccccaccagagtatgctaccctggcactgcaggggggcgtgggaggcccctgctgggccctcttccctgtgccagcacccatacctactatttaaagccagcattcctgcagcattgactccacctcgcatccccacccggtgcagggcattactatggcggcaagnnnnnnnnnngaggggggcgtgggaggcccctgctggaccctcttcctcgtgccagcacccatacctgccatccagagccagcattcccgcagcattgactccacctcgcatccccgcccggtgcagggcattactatggcggcaaggccgtgtacaaccaggtcaagcagctgctggtggccgagggcagcggcgtcggtctggcgcccaccctcccggcgacgggccttcggacccccaagcccagcgctgcccaggcccggcgtggcccggcccagcctgggcatcccaggccccgccaggccgggcacgccgctgtggcggcgggccgggtggcgcggcccgaccctgcacgggagcaggccgcgcaggccggatcccagcactttgcagacgtgcgagcgcccgaacaggtccccgccggccccggccggccagggccgcacatggccccggcgccagcgttgctggtgggcaccgacctggcgcccctgccggatcggccaggggatccggcgcccggcggcgccgcccccctgaacccccgcctgaccgtggcgnnnnnnnnnntgccacccctgtgcctgcatgcccatcctgcgtgtgacgatgtgccgaagtgagagtgatacttgtgaaacatgggtgaggtgggactgggcagcgtgcacaggnnnnnnnnnntggtcctggcccaccaacccatccgcctgcacaagcccgcgaggctggcgcgctcctgacccgtaccgccattcctgtacctgcatgcccatcctgcatgtgacgatgtgcctaagtgagagtgatacttgtaaaacattggtgaggtgggactgggcagcgtgcacaggcaaacgccggtgatgtgatcaggccaggtgctctgcctccttccccctagacgtccatgttccggaaaagtgccgactcagcaagcgtaccggggccgcgcgcggactggcatggttgataatacctggtccagcttgaattggcagatggcacagttccagcgtagcagtgtatcagagcacacattgttattgctacattacgnnnnnnnnnntttaataatacctggtccagcttggattggcagatcgcacagttccagcgtagcagtgtaccagagcacacattgttattgctacattacggcagccgcgaaccggctgggtttctcgggagcgggaccggcctgccacgatgggtatccgagacctccgagacctgaccatggatgacctgataacctgcaagatgacggcccaggaggcaggacccactgccatgagactgaaggaggtgctggaaggtgccgatgccctccctctgccccaggtcaggaagcaccatctggggctggactccctgggcacacctggtccaggtggcaggtggggccctcctggtgggacgcacatccgtgcacctgagnnnnnnnnnncggaagcaccatctggggctggattccctgggcacacctggaccaggtggcaggtggggcccacctggtgggacgcacatccgtgcacctgagcgatgccctcatcccccactcttcccacagctctggagactggtcagcaagcacgtcctccacccggacctccccttccccctgcacgtcaagctctacaaggccgcctatgctggctgggacggggaggcgcagggccccccaccgtcctgggtccctgacccggacgccatgcgtgacaccaacatagctcgcttcatgcaggagtggaaggtgagttcctttgcgatggcaaggagggacggagcggcacggggcgggtgtgtgcagtgtgctgcaggctagcgcaggggggggtgtttgccatcctttcggtgacaaggtgtccttgcaagatggctcaggcggagaatggcctctcctgcgcatgcttggcgcagccccttcttattcccgcttccatggcctcannnnnnnnnnactcaggcggagaatggcccctcctgcgcatgctcggcgcacccccttcttattcccgcttccatggcctcacgagtctcatgcgccatctgatcgcctctgtccctcaccccgcgccccccccccaaaaaaactaaaacgaccatcagggctctgagctatggcgccggctgcggaccggcgaacccacccaggactggcccctgctgcagcagnnnnnnnnnnccctctgtccctcaccccgtggacccccccaaaaaaacaaaaacgaccatcagggctctgagctgtggcgccggctgcggaccggcgaccccacccaggactggcccctgctgcagcagatctccttcgaggaccccgagtccttctggcccgctgtgctgcagcgcctgcgcatccgcttccacagcgtgcccagcagggtgctggcccgccacgccgacccggaccaggtctcctggttcccgggggccaggctgaacgtcgcggagtgcgcgctggcagggcgcgacccggaccgccccgcggtggtgtgggccgaggagggcacgcccacggagctgcacacgctgagcctgggggcgctggcgcagcgtgcgcagcacgtcgcggacgcgctgcgggcggccggcttccagccgggtgcggcggaattgggtgtcgggacggccagtgcccctggacgcctcccctctcccaggcgtgcgcctcctcggcttcacaccccctgtgcagcgtgaggcactgacgatccccgcctactcacagccctcaccgcatccccccccccccaaacctaaatccaccaggtacgcccatcgcggtggacatggtgctgacgnnnnnnnnnntaccccccccaaaaaacctaaatctaccaggcacgcccatcgcggtggacatggtgctgacggtggacgcgctggtcatctacctgggctgcgtgctggcggggtgcgtggtggtgtccatcgccgactccttctccgcggaggagatcgcgagccggctacgcatcagcgccgcgcgcgcagtgttcacgcaggacgcggtgctgcgcgcagggcggcgcctgccnnnnnnnnnngcgcatcagcgccgcgcgcgcggtgttcacgcaggacgcggtgctgcgcgcggggcggcgcctgccgctgtacgagcgcgtggcggcggc

SEQ ID NO: 48238 - DNA, 61 bp, Chlorella protothecoides
tccccaggcaactccactggcctgcaggagcgcgaccacgctggtggtgccatcgcagtcg

SEQ ID NO: 48239 - DNA, 61 bp, Chlorella protothecoides
cagggctggggctggaggatggcgacactgtagggctggggctggaggatggcgacactgc

SEQ ID NO: 48240 - DNA, 8785 bp, Chlorella protothecoides
  modified_base (1650)..(1659): a, c, t, g, unknown or other
  modified_base (2186)..(2195): a, c, t, g, unknown or other
  modified_base (2665)..(2674): a, c, t, g, unknown or other
  modified_base (3033)..(3042): a, c, t, g, unknown or other
  modified_base (3549)..(3558): a, c, t, g, unknown or other
  modified_base (3890)..(3899): a, c, t, g, unknown or other
  modified_base (4521)..(4530): a, c, t, g, unknown or other
  modified_base (5386)..(5395): a, c, t, g, unknown or other
  modified_base (5631)..(5640): a, c, t, g, unknown or other
  modified_base (6185)..(6194): a, c, t, g, unknown or other
  modified_base (6984)..(6993): a, c, t, g, unknown or other
  modified_base (7573)..(7582): a, c, t, g, unknown or other
  modified_base (7657)..(7666): a, c, t, g, unknown or other
  modified_base (8185)..(8194): a, c, t, g, unknown or other
  modified_base (8247)..(8256): a, c, t, g, unknown or other
  modified_base (8336)..(8345): a, c, t, g, unknown or other
  modified_base (8621)..(8650): a, c, t, g, unknown or other
ccccagttatgtggagtactgcatgtcgcgtgtggagctcctcctctccgccggcctggtgcccgtcatggtgtttgacggagggcgcctgcccaacaagggcgaggaagaggcgagccggggccggtcccgtgccgccgcgcgagagagggcgcgcgcgctggcggccgcggggaacgtggcgggcgcctacgaggcgtaccagcgcgccgtggacgtgacgccgcgtcacgctttccagctcatccgcgcgctgcgccgacgcggcgtggactacgtggtggcgccctacgaggccgacgcccagatggcccacatggccaccacggggcaggtggagctggtggtcagcgaggacagcgacatgctggcctatggctgcccactggtgagctctgaatgcgcacgggtggggacaggggtagggtgggcgaacatgcagcgccatgctgcagccaggttcccctggtaccgggagtgagagggtgactgggtgcggcctggacctgtcggcacaggcatggcaagggacgaggcaggagagcggtttcaaagctcagcacgcttggaactgactgccatgacatccctcggtccccgtccttgcgcaggtcctgttcaagatggacaaggtggggtacgcggatgaagtgcggctggcggacctgggtaacaacgctgggctggacctgcggggctggccacacgacctcttcctccaggtgggaagggttgggagagggaaggggtggctggaggacgtgaatgcggagcatggtgctcttgcggggccgtgcagagaacggcatggcgctgtgcatggaattcagaagaaaaccaggcctgccctttcccgacttcccatggtaggaaaccgttacccccctccctcctgccatgcagctgtgcatcatgtctggctgcgacttcctgccctccctacccggcatcggcatcaagagggcccatgcccatctgaaacgcacccgctgcttcatcaaggtgggcgacctggactggtgggggtgggggtgggggtccgacagtcaggccgtgcacatcctgcccattctgaaaagcctggccatgggttgaagaccaggggcaagccttgtctccaccctcactctttgcgcaagaacctgcgatggcgctgcaggagggagcctcacagcccatacgcacagggacacatcgaacgcccctcacagataatcaatgcccccatcactgatctgaccactcctcctcatcctgcaggcggtgcaggcactcaagtgggacggcacggccgttcccccgcagtacctggtacgatttcagcgcgcgctctggtccttccggcaccagagggtgtactgccggacgcagcaggccaccatccccatgaccccgctgccggagggtgggctggcggccagcaccctcatccctgaggctgccgaggtgtgtggggagggcgctgcgatgtcgggtgcgtcaagggacgcagaggattcctgccccttgaccctgatgtgcaggtgggtagctccactgctgctgccccagacccaccagccactgtggcagaccaggtcgaagttttctcactcaagccctcccattcccaacccttcttccaccagcagaccgtagagggcgagcctnnnnnnnnnnaaagatgattcctgcctcttgaccctgatgtgcaggtaggcagctccactgctgctgccccggacccaccagccactgtggcagaccaggtcgaagttgtctcactcaagccctcccactcccaatccttgttccaccagcagaccgtagagggcgagcctgacttcctggggccctgggtggaggactgcatagcgcgcggcgtagccgagggtggggcggattgtgctggcaaggaggtggatggagggttgcagtactcccacagaagcaaggcctgatgtttgtgcaccccggtccctgcgctcgaccgccacggctccccatcgcaggccggctggaccccatgacgcaccagccctttgccatggacctgccctcgcccaccaagcagcaccctgaccggcagggtggccgaggtcttggacagcagcctaagacctgggccgcccccgccacccaggcccctcccggccccagccccggccccagcgatggtcagcagagcctgctgagcatgggctggnnnnnnnnnntctgaccggcacggtgcccgagggcctggacagcagcccaagacctgggccacccccgccaccggggcccctcctggccccagccccggccccagcgacggtcagcagagcctgctgagcatgggctggggccggggaaaggccagcggcttcctggccctgcccacctgtagcagggaggcgcagcgtgcataccgtgccccccgccccgcctcccagcccgagagcggatcccaggttgcacacgccagctccagccccgccccgacctcgctgggcggtcgcaggagcagtgggaccctcctccaccgctccggcaagcccggcggcggccagggcgtgagccgctacttctcccgcgctccctccgcgccgagcgggggcagcctggatggcgggggcgtcggccaggcgcccttagagccagcagccgacggtcccggccgggtggcctgcgagcctggcctggnnnnnnnnnnatcgagccaggagccgacggtgccggccgggtggcctgcgagcctggcctgggaacagcagctccgagtgcaactccgggggactccgacctccactccaccgcctgctcgcctggcctggcaagggccctggcgacccaggagcagcggcggcgcagcgggcacagcgtgccggccagccaggcatccggcgggtgcggactctcccagggcagcggcggcgatgacaaggagaacgtgtccctgagtgcctcctgggggcccaccgtggtgcccagccaggccagcgtggaggggggagggaagcccggcgacgcgtggagcggttgcgaggcggcggtgggggcccctcccagccnnnnnnnnnntgggggaggagggaagcccggcgacgcgtggagcggtggcgaggcggcggtgggggcccctcccagcccgcacccggcgccctcgccggggttctatgtcgtccagtcgccggcgggtcaggatcaggccgaggcaacgccagagtctggcactggggcgccgcaggtcgtgtcccccgctgggctgcctttggggccgggctcgggcaagcgacgagggtctgggcctcagggcgccccgctgccgcggcggcggctggaaactgacgcctgcggcagatcccccccccagagccagaggcgtcgagctcgctcttcagccagtttgcatttaaatcgtgtgcctgaggagcgatgcagttgcaggtgcctgctggatgtgtgcttggtggcttcttgtatatatccggcagcagcatgccaggaccgtgccaagagtccagggagacacctcgggtgtttgggagtactataatcgtgtcagatgaatgcaactgggatgtcatnnnnnnnnnncgcatgccaggaccgtgccaagagtctagggagacacttcggatgtttgggagtactataaacgtgtcagatgaatgcaactgggatgtcatcacgggccaagtggtccatgcttgtctgttcgcatggcctacttcacatcgattgaggagtccaatcgcaacccgagtgtcggagcaagttagggtttccgacaagctcccgaccgatctaccgctcatccgtcgcgtcgtccttgtcgcacatagtacgtgcagatttaactcacaagcccatgttttcactgaaaccctaaaattggattacgtcaaggagttgaaaggtcaggcgannnnnnnnnnatcgtccttgtcgcacatagtacgtgcagacttaactcacaagcccatgttttcactgaaatcctgaaattgtattacgtcaaggagttgaaaggtcaggcgactcgcctgccgcttgctgcaacggagagtgacacgtcatgggatcatcgtcacattttgcaatacgagctcgcccctcgacaaggaacagagagccttccagcgataactgtggatttcactggctacaaacaaagcaataccgcaccgtgctgcccgcgtgcgcactcgcaaacaccggccagcactccccctgctcagggtgtcggcatgcgggcggtggtgtgcacccggctgggggacgccagcaaacccttcggcacccccgatgccccgctggccctcgtggatgaccagccgcgccagcagctgcccagcaagggcgtgcgcatccgggtgtcggccggggccctcaactttgcagatgccctgatggtcaaggggacctaccaggagaagccacccctgcccttcatcccgggcagcgagtgcagcggcaccgtcatcgaggtgagaatgagagtctcgtgtactaagtaagggatattgctgagaagacgcaggccgagggagccttttnnnnnnnnnnggaatgagagtctcgtgtaccaagtaagggacattcctgagaagacgcaggccgagggagccttttgctggggtcaggccgcgtggcaggtcgccttgtgaacaccacctcccctccaatccctttcgccaggtgggcagcggggtgcggagcgtggcggttggggacaaggtgtgcgccctcacccccagccaagcgctgtgcgaggaggcggtggcggacgaggcgtcggtggtccgcctggaccccagcaccagcgaggcgcggctggaggaggcggcgggcctccccgtcacatatggcacggcctacctcgcgctggtggaccgcgcccgcctggcgcccggccagaccctgctcgtcctgggcgccggcggcggcgtcggcctggcggccgtgcagctcgggcgcgcgctgggcgcgcgcgtggtggccgtcgcgcgcggtccggagaagggcgtggtgctgcgcgcggccggcgccgacgccgtgatcgactcggcggccgccgggaagctgcgcgacgccattaaggccgccgcgccgcgcggcgtggatgtggtgctggaccccgtgggcggcgaccacttcttcgaggccttcaagtgcgtggcctggggagcgcacatgctcgtcatcggcttcgcgggcggggtgcccaatatccccgccaacatcgcgctggtcaagaacaccaccatacacggtgagcctgttgttttcttttgagaagagggaagggggtggtgaagatgggaagtggagagggccgggggtgctgccgaggcgtgctgctgtcctgccaggtgcactggcgatgtgatcaagccccaagcttttgagggtccgagaggannnnnnnnnnggggggtggtaaggatgggaagtggagagggccgggagtgctgccgaggcgtgctgctgtgctgccaggtgcactggcgatgtgattaagccccaagcttttgagggtccgagaggactgcgcagctgaggtccaaggacctcaaagaggccccaggggtgccggattgccatgtcctcggcaccaaccaacacgctatccctcaaccccccaggcatctactggggctcgtaccnnnnnnnnnnctgccatgtcctcggcaccaatcaacacactatccctcaccccccaggcatctactggggctcgtaccagcgcaagcagcccgccgtcttccggaggtccctggacgagtgcgccgcgctgttcagccagggcaaggtcagcgtccacgccagccaccgcttccccctggagcaggcgcccgaggcctttgcagtgctcatgaaccgcggggtgatcgggaagctcctggtgttgccccggaaacaggccaggatttgaggcggcacctggggaggataggctgtgcatgtgcaattttctgactcccttgtatgccaggcacagagaagtgtgcctttctggatggtgctgggcgcttatgtaagagaattgctgagaagacaggcactcgacggcagggaagatgacggggatgagcgaggttgtttttcaggaaggacaaaacgtaaggcgcgtcaggtctagcacagagcgttgtcatgggagagagtcaaggttgggcacacctccggcgagggtggattgaggcctggtcgctgagccnnnnnnnnnntgacggcagggaagatgacggggataagcgaggttgtttttcaggaaggacaaaatgtaaggcgcgtcaggtctagcatagagcgttgtcattggagagagtcaagattgggcacacctccggggagggtggattgaggcctggtcgctgagccacaccaggcagaaccacaggggatactagtggatcctcttgatgcggccggactgggccattccatcctcccgtcaggacgcaatcgcgtcgctcctgatgtataccctggaagccttccgcgcggcagccgcccagcgtgcgtcccgcgccgctcctccctcccctccagccttgaactccacggtctgggtgccgccggcgactaagagcaccgtgctcgccttggcctcgccggggccggccccgccgctgcgcaggcgctggatgagcttggagggggaggacagcgcgtccctcggcaccaacctgccccacctggagccggccacgaagcacttgacctgggggcgggagcccggcttgaaccccgcctgactggtcttggcgccaacctgggccaccgcagccgtgagtgtggaccgcgggaggggccgtgtgacggtctgcaccctccgactgccactccctgtagcggttggattggaggggcaggcgtaggcattgagggtagtgggggggagtgggtaacactcccagcatcagagatcaggatggccagcagacccggctctacattcatgtgtgcttgatgaccaacatagcctccctctcacccgatcgcggactggtgggnnnnnnnnnncggaggggcaggcgtaggcattgagggtgatcggggggagtgggtaacactcccagcatcggagatgaggatggccagcagacccggctctacagtcatgtgtgcttgataacaaacatagtctccctctcacccgatcgcggactggtgggggacttgggctgcaccttgcggggcgtgcctcggtcctcggccccactgccaccgtccgaactggaggacgagcgggccctcaccctcttccgggagtcattcttcacggcggaggcgaggcgtcgcgactcttctcgggccagggaatgccgcgatcgctcccgccccgcccaattcaggttgcggtggagggagagggctagctcggcatcacgttcagtgtcgaggttgccaccgccttccggtgcctcctctttcatgcacgacttctccgatgtctgggatgccgcaacgtgcaggtctagctcacgcacatgtgaagctgaaccaaaaaggcgaagcagagcccacgctgttgctgttcagagaggctgagatcgctaggacgcgatagaatgcttgggatctgggagcagcatgtaggggnnnnnnnnnntcctcttccgggagtcgttcttcacggcggaggcgaggcgttgggactcttctcgggccagggaatgccgcgatnnnnnnnnnngggcgtcccaagttcccgacacccccatcactttcgaagagggacgtgcccgtgctgagcgtgggatgctggagccccagagcgcaggcacttccggcccatgccggagccctcctggaccagcccgggcccttcattacagacgctacgtatgatggaagggaaatgcgattgtaccaatatgcaagtgtcagagatgtgccgcagcataagctctaagttcggccggctgagtttcggcccttgagtgttccaccctagagaccagcctgaggctctcaaggccggctgcagcctagacctatcatggcaaaatccggtaaacggaagaatgcgggggtcggcatcgacttcaagcgtgccaagcacaaggttgggcgcaagctgcccgccgccgcgaacgccaccgacacgaccatcaagtccgccaccatctcgctggggcagcagagcatggccgtggaccgtgcggggcaggctgtcaccgcacgaaacctgacgctcaaggtgcgacgacgnnnnnnnnnnaaatgcgggggtcggcatcgatttcaagcgtgccaagcacaaggttgggcgcnnnnnnnnnntcgctgctgggtggggaaggctattgtggaaggatggggtggggtcgagggaggttttagctttggcctgggtcaccgtnnnnnnnnnngcgctgctgggtgggaaaggcttttgtagaaggatggggtggggtcgacggaggttttagctttggcctgggtcaccgtgtgttttcaaaccctaatgccaggtcgtctggcttgtaatctagattgggctcgcgcatcaccagctgggatattgtccctcagcctgcagaagccaggccatgcctgtgttgctgtttgtctacaccgagtacatcacctgccgcactccccaactccccctccacaggagacgctggcccagtgctcgcactacnnnnnnnnnnnnnnnnnnnnnnnnnnnnnntccgagaaagtacggcgggacgcgctggagggcctggcccagctggcgcacgccgacgcgcgcgcctttcggcgcggcgcctcggccgtggtggacgccgtcgcggcgcggctgggcgacgccgaagccagcgtg

SEQ ID NO: 48241 - DNA, 79 bp, Chlorella protothecoides
aggactgcatgctacacgtgcactctctgctccgctgtcaggggtgcctgttcggcagccttttggaatgcctcaagga

SEQ ID NO: 48242 - DNA, 111 bp, Chlorella protothecoides
cccccagcaggctgtcttgactgcccccccctccccccgggggggaaggactcctacaccacagcgaaatccatgcacccacgcacctatagtcatctgcgtcaccacggc

SEQ ID NO: 48243 - DNA, 72 bp, Chlorella protothecoides
tagcgatgccctctcatcaggccgggactcacaacccacccaccttcctctgggtgccattgaaaggctgac

SEQ ID NO: 48244 - DNA, 66 bp, Chlorella protothecoides
aggtgatgtactcggtgtagacaaacagcaacacaggcatggcctggcttctgcaggctgagggac

SEQ ID NO: 48245 - DNA, 61 bp, Chlorella protothecoides
agcccgggagtggcggagggtgacggcaagtggaaggctgtattggcaacgcagggctgca

SEQ ID NO: 48246 - DNA, 64 bp, Chlorella protothecoides
cagcagctgctcgccgcagacggcgctgtgtgccttgtggcgctgccgtggcgcaggcgaccag

SEQ ID NO: 48247 - DNA, 61 bp, Chlorella protothecoides
ccggaggcttcccccctttctacctgcatctgtgccctgcatccctgtacgtcgcccggca

SEQ ID NO: 48248 - DNA, 61 bp, Chlorella protothecoides
caattgcttgctgaagcagtctgccgcctcatgccgcctcccctctcaagatgggagcgga

SEQ ID NO: 48249 - DNA, 61 bp, Chlorella protothecoides
actttggcgtcatcggcggcgcgggcaagggcctgggcatgctctccgcgggcgtggccaa

SEQ ID NO: 48250 - DNA, 75 bp, Chlorella protothecoides
tgagcttttcctacaagaggctttcgggtaccggcgatgctttcaaggtggaataagtgctattacaacgacttc

SEQ ID NO: 48251 - DNA, 61 bp, Chlorella protothecoides
acacgaaaaaaactcatgaatcagcaggggtgatggagtagaaaccttgacacaggtatga

SEQ ID NO: 48252 - DNA, 13908 bp, Chlorella protothecoides
  modified_base (501)..(510): a, c, t, g, unknown or other
  modified_base (2973)..(2982): a, c, t, g, unknown or other
  modified_base (3136)..(3185): a, c, t, g, unknown or other
  modified_base (3547)..(3556): a, c, t, g, unknown or other
  modified_base (3633)..(3642): a, c, t, g, unknown or other
  modified_base (3752)..(3761): a, c, t, g, unknown or other
  modified_base (4889)..(4898): a, c, t, g, unknown or other
  modified_base (5229)..(5238): a, c, t, g, unknown or other
  modified_base (5315)..(5324): a, c, t, g, unknown or other
  modified_base (6204)..(6213): a, c, t, g, unknown or other
  modified_base (7022)..(7031): a, c, t, g, unknown or other
  modified_base (7606)..(7615): a, c, t, g, unknown or other
  modified_base (10070)..(10159): a, c, t, g, unknown or other
  modified_base (10500)..(10509): a, c, t, g, unknown or other
  modified_base (10650)..(10659): a, c, t, g, unknown or other
  modified_base (10850)..(10859): a, c, t, g, unknown or other
  modified_base (11536)..(11571): a, c, t, g, unknown or other
  modified_base (13805)..(13814): a, c, t, g, unknown or other
ggccgacgggcggcgccgccgcgctgctggtcgccggggacgaacaggtggacgggcgcgcggcggccgccgccctgcgcgccgcatgcctgcgccacggccgccgcttcgccctggtccccggccgggtgccgaggctggggatcccgggcgtgaaagggagcgtgcccagcgtcttcttggaggacgaggagtgagtcagtaaagttccacctgtttgggggtggggatcctcggctcccctgcaggggggccgaggacctcacataggcgtatgcaggagtcggagctagggttctcctgtgcatgtcctggcatgatcaatcagtctggagccccacccgccccatgccggctgggaaggcaagggcacaccgacacgcagcaccgctctttggggtttggcgatgccgagtgctttgtctgggcgtaggaatcaccccaagcaaacacaaacagcccccgtgcaaaccaactccacaggctgcgacctcgcaaggnnnnnnnnnngcccaagcaaacacaagcagcccccgtgcgtaccaactccacaggctgcgacctcgcaagggcgtcgtcctggcggcgggggcatggagcggcgcgcttctggaggccagctggccggacgcctgggcggcctgggcgggcgagctggcgccgcggcgcggtctcctcctggacctgccctggccccggggcctgccggctctgcacacggggaccatggagatggagtacgcacgccactacctcccccgccccgcggcgacgctgggcaccccgttcccgcaggccggcggggcgggggccgccgccgaccggaacctggcgtctccggcggtcagcataagcttcacggccacccgcggcgcggcagggcggctgctgctgggcagcagccgcgagttcgccggcttcgacctggaggccggggtgcccgccgtcgcggacgccgtgctcgaccgcgcgcgcgctttcctgccgggcctgcccggctcctgggcggcggcgcgcggcgccgagctgcgcgtgggcctgcgaccctacgccgaggtgggtgtgccactggggtcccagcaggggggccggtgactcgcgcttgctgtgacaggagtccactcctcgcctcaggttttcaccgctgggctggccggggagcgtgccgccagttcctcccggagtcccctcccaccctggtgccgacagccaccctccctgccctccctcaccctcgcagcgggggctgccccacattggaccggtgccggggtgcccgggcctctggctcgccgcggggcacgagggatcgggcctgctgctggcgccagctggcgctgagctggcgtgcgaccacatcctggggcgccgcccgaggctgggggcggaggtggcccaagcctgtatgcccgcctgctgacggccgacccggcgactgggctgtgctgtcatcgcatcatgcagctggcctgtgttctgcaccctgccaacccctgaccagcactgtgtgcagcaatccttgttgaccaacatctgagtgaagtcaaaggcatgtggacgttgcaaggtggagtagttttctgcctggagggcgctggtccatgtgggatccgggatctcacccctgaatacagaacacgagacaatcagcagcgacgaggcgcaggtgcgagatctcacgcgcacgcttttgccatcacgaatgccgggccggaaagtgcaagttaattctctcacatactgtggcatacaagcacctgccaggtatacaaatcccttcgcagcacgtcccgaatattgccgcggggttcatcagaaccctactctttgtggcactcacccggccataccctggatcccgggtgtcctgccctcgcagaattccactaacacccatcatggcagagtcggtgtcgcaagccctccttgtggtggacatgcagaacgacttcctgctgccctcctccccagtctgtgtggctggcgggatggatgcggtccccgccgtcatgcaagctgtgcagtttgccagagagaatggcgtgccagtcatctgggtcttgagggcgcaccatcacctaggtttgtccaaagaatactggactggagtcatgactggctcaggtcaggggtggcagtgcatgcgcgtctgcttagtcacatggttcaagctgctttcgacacccaggacgaacccactgccctccaggcgtggacgtggagatctcaagaaagggccacttcagtgatggagcaggcgtgtgcgtctacgggacgccaggtagggggcaccacggccttttgtgcggaggggctggtgctgtacctctcccccacctctgcgcatgccttcatgccaacaggtggtcgcccggccaggagggcgcctgtccctgacagtgcagcctcccccccttcccgtgtgcgtacctccaggtgccagcctcgtggcagggctccaggcagaccctcaagagattgtcattcacaagcagcgctttagtggattcatgtgcaccgagttggacctggtgctgcggtgggcgtgggcacgggtgtgactcggagtgggccatgggcacccatgccccggcatggtgcaatagtcacgctgccgcctgccgaagatcaccgtagtgcgcaacacagagtagtctcacagccccatccaaccctctgttcccccacccccctgcaggcggcttggagtgacacgtgtcaccatctgcggggtgcaaacccccaactgcatcagggccaccgcctttgatgccgtggcgctggggtatgcccaggtgagggtctgaggggtgggatggcaggccccggtcaggcactcggcccatcgaggcatgggcttggcatttagcgaggagcgctcaccctgcctcctcgcaccgagtggcagatcgctcccctgaatgacgtcgctccctccaagctgtcccctcccgcacatgttccacctccatnnnnnnnnnntccaacatagagtagtctcactcccccatccaacccttcaatcccccacccccctgcaggcggcttggtgtgacacgtgtcaccatctgcggggtgcagacccccaactgcatcagggccactgcctttgatgccgtggcgctggggtatgccnnnnnnnnnnnnnnnnnnnnnnnnnnnnnnnnnnnnnnnnnnnnnnnnnntcccttgggtaccacaggtggaggtgctgtcggatgccaccgcatcggccagcaaggcggtgcaggcggccaacctgtatgacttgcgccaggtgggggtctccacccctagtctggaagaatgggcctctggtattgtcgcccaggtggctgcacactctgccatctgaagggggccagcctttgcggtgactgtcagaggcagcgaggtttgctgcagacctggaattttcctccttgccacagggcatgcatgaggagggcgacccctttgcctcacacatgccattgactgaccatacccctcatgttgacttggcccttcatgccaacagagacacccatcaccatcagagactccnnnnnnnnnnagcggccaacctgtatgacttgcgccaggtcggggtctgcacccccagtctggaagaatgggcctctggtattgtcnnnnnnnnnntttccccgagaagcgcacaccctgcctcctcgcattgagtggcgggtcgctcccctggatgacatcgctccctccaagttgtcccctcccgcacatgttccacctccatnnnnnnnnnntacacatgccattgactgaccagacccctcatgttgactgggccctttatgccaaccatccacagagacacccatcaccatcagagactccactctattacattggcgcatgtgcatgcctgctgtacaaaagaatgagccaggagaccacgtgccctgaccatgtatgcaagcagtggctggcaggctgtttatttgtgtgagcgacgccaccggggaaaggatcggtgtgtggctagtctaggtgcacgatgtcatttccacaggcactggcttccatggccccggcaccacctggccatggcggtctcggtggccaggcaggtcccagaagaggtcatacctgcatcggtgttggattgaaaaagaacgctgatgaaaagatgggtcaggggaggggggggttccagacgccagattggctcaagagaaccagcctcaagtccattgcctagcactccacccaccaccatcctctctccacacaccctatgtggcccgggctgccttccacgcagcagtggctggacatgagggggttgagcttcctgctgtagccctccaactctttgggcgtcagcaccatcaggcgctgtatgccgcccttcacatgcagtctctgcattgggtgtggatggtggtgggggggggttctgtaggagagatgctggtggaatggcagttgattgatgaggggtgcctcgtctcaaagcatggggacggaaaggacgcaaagacatgcttggtctcctaaacccaccttgtacttgctgaacaccccagagagcgccgtccgcagctgcgccagggaccgatttggtaatatcctgatctgatcgtgctccggcaccgccttggcgtcaccggcagcacattcagtgacatctgaccccgcctcgcacacggtcagcaccagcaccgaggcgttgaccgacgtggcgcggggtttgagcagaaaagagccctcccgccagcggccaggcattcgctcctccatctcccgcatatcgatgatctggtcggagggggcggggtagggcaggcgcagccgtgaccccggcacggtcccattgtgcgccttgtacgaagagtccattcctgccaccatggagggcaggatggcggccnnnnnnnnnnacccggcacagtcccattgtgcgccttgtatgaagagtccatccctgccaccatggagggcaggatggcggccgcaccccccagctcctccgccaggatcaattgcgtccgcagctgggacagctggtggttgaccaggtcgaagtggggcagcgtggaagcgatgtccttgcgccggcccccctaggcatggggagttcgaaaggttggatcaggtgatagcggcatgaggaggctggcctgttgacaagcacattgccgatgaacaaacatatgcaacaagggacgggatcgaatccccctcacctttgcggcggcgtccagcagagannnnnnnnnntgtgtatgacatgccatctcatgaccttcaccaatgcaatcacttatccatcgccctcccaaagcatccgctcccgnnnnnnnnnntactatatggaacaagggacgggatcgaatcctcctcacctttgcggcggcgtccagcagagactgggggatgtcgcgatcgtagctgatgaaccccaccgggtgcgagaagtacgcgtcgggatcctggaccagttgtgagggcggggaggggtggtttgtcatcgacacaacaaccagaggcaagcgggtaggctccacagcagtccatacatacgtgctcatcagaagaaagaaactcgtgtacggcatgccatctcgtgacctccaccaatgcaatcacttctccatcgccctcccaaagcatccgctcccgcccaccttccagagatcatactcccgcaggcgattgatctttgcctgggtgcaggcctggaaggtagcatggacagcgtagggtttcaggcccatgttttgaggcatgcgctccttgtaggtctggcccgagcagaagagggagacgggcagggagccgatgatcagcttcctgtcaaagcccctgcgtggtggaaacgtcaaggaagaaggagagaaagctcaatcacaggagatgcagggcgtgctgatgctggttgtcaaggatgcacccaaaatgcacgaaggtctgatgcccaagctcgcctctcccatgaagcacaaattcgcatcacctgaacagatgatctgatctgctagggatgacctctgcgttgctgaagatgaggcggtcaaagagcacctgatcatgctcccccttcttcaggtgcgccatctcggcaatccatgtctgagaggtgtgggagagaaggggtagtctcagcacatagcaaccggtagacacccaggtgggccagacaatgatgacactacccccccctccctccctcagacccaaggctgnnnnnnnnnntgagaaggagtagtctcagcacatagtaaccgctggacagacaggtgtgccagacaatgatgacaccaaccccccctccctccctcagacccaaggctgcggactcggggtgcctgaaaagcagtgggcatcctgaaaagcagtaccatagcccaccttgacaaactgcgccgccctgggtctgaacagcttgaagccggcgtttgcagaccacccagatgccggccagtgctccaactcctccccttccgcggtggtgatgagctggtcgttgctcatcagtatgtcggcttccggatactgtgggggcatggtataggggaagggggtggggttggcaacggaacagccagacgcagcacgctgggggcccctgatcttcgacagatgttcagcatgcttaaaggacctgcactgcccctggttcaggccccctgatctgcattagtcattcccccagcgagaatccaagccgccgtccatgatcttcaccttgagcatgaaggaaagagggtccctcatccacaccacatcagcatccgtggagaggacgctgtagccaaactgcagaatcttcaggtccacagcaatgcgcgccgtcatctacggtgggggtgagggtatatcagggaaattagcacgtgcaatgcagcatgaatcactgacaccagcatccacttgggctcatgttattccttgcacacgtcgactggatgcaccttgcaagcattgcctgcacaagatagcaagggactcgatcacaaagacctcccaaaccttctcaccagtccaagaaaagccttggatcnnnnnnnnnnggggggtgaggatatgtcaggggaatgagcacatgcaatgcagcatgaatcactatcaccagcatccacttgggctcgtgttattcttggcgcatgtcgactgcatgcaccttgcaagcattgcctgcacaaggtagcaagggactcgatcacaaagatctcccaaacgttctcaccagtccaagaaaagccttggatccccaccacatctccgtggactgcgacccagcatgaacatagaaggcaggaatctcacgctccaccaaccagtccagcgtcttattatcagatgcccctgcgggtaacaagtgcacagagaagtcttgtgagattgctgtcaatgcccaggatcacaagttggccagcaccatagtacaatcacgcaagaaagcgacacacaaagcgccacttccgctcattctcaccgacgaggtatgccttgcagcctgttgcttgcatgtagtgcacccagttctcgatgaagtcgctgcaagagcaaatgtgaaaattttgataggtatacaatagtgagcacatcccactcggagcttcagcggggcagcagtcccagcccnnnnnnnnnntacaagttggccagcaccatagtactatcacgcaagaaagcgacacacacagcgccaattccgctcattctcaccgacgaggtacgccttgcagcctgttgcttgcatgtagtgcacccagttctcgatgaagtcgctgcaagagcaaatgtgaagattttgataggtatctgatagtgagcacatcccacttggagcttcagcggggcagcagtcccagccccaaatgcatgcatgatgaggcaggccgcaaatgaaactcgcccatatcctccaccacgcacatcctgttccagtttgcaagtgtgagtatgacgtgcttatcaaccgccaccaaggcaagtagctccctgggtgattgggaatggagtgaggcatgattgttcgcacttgtgagtgtactctaagcaatggagatcctggaaacacaaaactccagaagcaagcatcccacgcccactcactttgtgagttcatgtgtaggattcagcgagtgattgaatgttctgccggcaaggcctgaagcactgggcgatgtgtcgcgccctgcatgccccgcagcttgggtggcacctttggtatggtcatggctaggtgcaaaagtactattgagtatcagtacagggtcctctgaagatcctgggcgagatgttgagcactgtgatcataaatatataaatggaggagtctttcgtgcaagacccggcgcaaatgacctgcatggggaggccttcggaccagccgagccaccccagctgcgcaagcgccagttccagcagcccctcccacccctcaccgcgtagaggcgtcggcacgctggccacgttgattccggccctggccaagttaaacctggagctcgccgtgtacatgacgacaacggccaccgcgatgcagaagaggacccgggcctgaggcccgggcatgcgccgagctccgagccgcccgcccattagggaggccatcatccgccccgcaagcctggcgaggcctctgctcacagctgccgtcctacgccttgaagaatcttagaaacagctttccactccgacaaaaaccaccaaggcccgagagagaggcaaggtcacggtccgtcctcctgccacttccaggttcgatgctctcctcagtagagctcttgcacttcagtcaagcagtaagcattttaattgacattacaaagcgactagcacggcgtcgacctatgctgtttagatcttggatccagattatcctgctcagacagaaaaccaccggccaagagattcccggccggcttcggcccggcgcccagcattggcatggcccacgaggggcaacgagcagggcagggttgtttacctagtgtcttgccggatgcattatactccttgcttttgtaatccaacgcccagggcagggctcgcgggcgtcatcagtcggaccccttgtccaagcaccgttcacgagtcagactctgtgactatgtggcgggcgtgtgaccaccagcaacttggagcaacattgcaggggctttcgaatgatcaggtgtaagttgtttgtgctcctgcggccacgatggaaatgatagtgcgtcagcaagaaatcctatgtacctgtcaccctggccggatggctggttggaggattcaccccccccccttccagggcgctcgtctgccttgtgtcactcttgagagagtaccatgtctgtaaaagcagcactcaaggaagcacagctcaaagaataggaatgccaggttgttgttgtgcgtgccagcagggctggtcaggaccagcatgggaggggcacgcccgcccaggcatgcacatcgaggattacacaggcagccagagtggcagggtatgaatgtcatgcggcgccagtggggaagcctcagtcgaacacgcgctcccccgtggaggccaggttccagaccacggtgccgatgaggtacaggcccaccgccacaccccacacctggtcccagctgcccgtgctctgcaggatggcccccgtggcggcggtgcccagcacccccgccagcacccccgccgtgttgctcaggcccagcagcacgccggcgtagcgcggcccgatgtcggcgtggttgctgtacagccctgactgcgagaaggcgtccaggccctggctggccatcatgcaggccacggcgccgcgcacggtgtgcacgcggcccagctgggtcaggaagaaagcggggcccaggaagccgatggtctgcatgaccttgcgcaccgtggtgaccgacaccccccgcgcgatcagcgtgtcggccagccagccgccgatgttggccgagatggccatggtgatccagggcaggacggagaagaagcccgaggcacgcagatcaaggcccagcacctggggaggagggcagaacgggtcgggatgggagggcggaacgtcatgtgagcagtgatggagggggaagagagggcgggggtcgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcgctgaagcaatgtggctgcttgcgtgcatcctgaggggacagcgcccatgaagaaccccattctccccatccctttcctcttcgtctctcccccccctcccccccaacacacacacacaccaacctggttgtagtagctgggcatccaggtgagcaggatgaatgtaccccagttgtggcagaagtggcaaacgatgagcgcccagacgctgcgctcgctgagcaggcgccgccaggggatgccagccaccctctgcattcggtatggaggtggggtgattgaggggacggtctggccatgtgtgtgtgagggaggttgttgaagggtgcgaccaccnnnnnnnnnncgattgaggggacggtcaggccatatgtgtgtgtatgagggaggttgttgaagggtgcgaccacctcccgtgcccctccggtttgcatgcctgcaatgacaaacacgcacacgagtcccattcctggtcccgcagtgcgcnnnnnnnnnngcccatttgcgtgcctgcaatgacaaacacggatacgagtcccattcctggtcccgcagtgcgcatgcacacgcgctgccacatacatccggccttacctctcccctgtggtatgctggcgcccgtcactctcccccccacacacacacacaaaaaaaacccaacaagactaacatcctcccgcccgctcnnnnnnnnnngcatccggtcttacatctcccctgtggtatgctggcacccgtcactctcccccccccccaaaaaaaaagaaaccaacaagactaacatcctcccgcccgctcgcctgctcggcgacgccgcccgagatgaactcgcgctcggcgtcggagatgaaggggtcctggcccggggatgaggcggcgcgcgccctccagaccaccgcccacaccacacccagcaggccaaaggcgtagaacacggtgggccagcccacggtgtggatgaggtggggcgtggcggcgagccccagcaccgacccggtgtacataccggaatagaccagggccagcgagcgcgagcgctccgccacgggaacccagcgtgagagcagggtgttcatggcgggcatggccacgccctcccccacacccatgcaggcgcgggccaggaggagggccggcaggcccatgtgcgctgccacgggggtcagcgccgtggccaagctccaccacagcacccccaggcccagcaccagcttgccgccgtacttgtcagcccacacgccgcctgccacctgggtcagcaggtagcccctgccgcgaggatggtttggagtgcattgggggaaccccgtgatgcttgactgatgcacgctggaggaccccaccccccccccccccccccaaaaaaaggtacnnnnnnnnnnnnnnnnnnnnnnnnnnnnnnnnnnnnaaaaactgagaacaaagccaacaattcactgaccagaagaaggaggactggacgaggcccgtggtcatggaggaccagccatactgctctgccatgggcaggatggcgatgctcatgttcacgcggtccatgttgcacagcatgaaggccacgaagcagagggacacgatggtccagcgccggcgccaggcaccgggctgggtcagcaccgcatggatggggttgaccgtccccgtggcggcggagggggtgccgggatcctccagcgacccatcaaggtctagggattgctggggtggcagggtgagtgggaaagggggtggacgtgctgtgattgaaaactgggtagggagggagggagccagtccatgcgggcaatggagcccatcaggaggaggtgccctcgctgaactatccaaccccccttcccaacacccagatgcctaccctgagggaggcgaggggctcggacaggggcaaggggtagacaccatcgtcctggctcttgctggaggccggggtctgcatggcgtgggaggcggtggggggtggcatggggtatcccgggccgcgaccccatcatgggggggggggaaaccctgacacgccaaagcgggagcacccctcaccttcaggtggtttcgccttctgcgccacgcgattggcgcgaattccgggacttgggggcaggatgggtccgcatcacgcaggtacgtgggtgcatgtcccaggcgcatgcatggccacctccccgcgatgggggccctctcaacgcgactcctggccggcacacccctcggcccgccagtccgagacggggcatgtgctcccgtcaatccaagcatgatggacgtccaggcggcggggttctggagggcgcagggagctcggagcggggaagtgcgcaccacccgcccatgagcaatcttcgccccgagggggccgagatcgtctcggcgcaccgcacgcgcgccacgaggaaggcgaaatcgccaggtgcattacggggtgtgacctgggcccctgacggccattccaggtgcagaaaaatgcccttcgatgttcgtcccatgagtattgatctgtgtgaggggttcacccgggcagcaggcggccggtaggcagcgaccacttggccgacaggtccagggccgaggcccccgctggggtctcagcgcatgccggcccctcgaccgcccgtcccaccggctcgacagcgcggcgtagacaccgggacgcattatgtgctcttcgggggacgtgtaatccttggtgggtgcccccgggccagggcacagagggtaggactgtttggggctgtttgattggggactgccctggtcccatgctccctacacttcaccccctctctcgacaggtccggactggaagtccttggtggcttccctcatcctcatctatggcgcagcgggtgggttgggggctggtatgggtgggagaatggggacgcgctgcggtggcttgaccgcaacgatgcactcacccaaggccagctcactcgactctttgtccttcttgcgtggtatggcgggccggtaccagttgagcccctcccctgtcggcaaatcggcgcaccttgcagcccccctcccccgctatctctccgcctccctcctggctgtaccctccgccagctgcggcccactctcagcccctgaccttgcccctttctccgcgattcactcctcaccaccccccaccccccaccctcgagacaggcgtgttcctgggcctagtggtaccccccctgtcccggcgctacagctgggccctgatggcggtgagcgccctgctcgtcgccgtcaccgccgtcttcatggcgcgcaccgcggcgcgcgacccggggtactacccccgctccgatgccgccggggacgaggagcgcgggccccgtccagccacgcgcgagtaccaggtcaacggcttctgcgtggccaccaagttctgcgccacctgcatgcactaccgcccgccgcgctgctcccactgtgcggtctgcgacaactgcgtcgcgcgcttcgaccaccactgcccctgggtgggcacctgcatcggccggcgcaactaccgcgacttcctctgcttcgtggccaccacctccctcctctgcctctgggttatgggcctcagcctggccctcttcctcaccaacacacgggacgctggctgggcctggggcacgggggccgcgcgctccaaggctgcgctcttcnnnnnnnnnngatgggcctcagcctggcactcttcctcaccaacacacgggacgcgggctgggcctggggcaccggggccgcgcgctccaaggctgcgctcttc

SEQ ID NO: 48253 - DNA, 61 bp, Chlorella protothecoides
catgttgtggtggatggtttctgtggaaggtgaaggagcggctgaacgcccgtcctcctga

SEQ ID NO: 48254 - DNA, 61 bp, Chlorella protothecoides
cccgagtgccgcaagtgatccccgcactggtgtggctcagtgccggggcatgcgcctcggc

SEQ ID NO: 48255 - DNA, 6438 bp, Chlorella protothecoides
  modified_base (2252)..(2261): a, c, t, g, unknown or other
  modified_base (2986)..(2995): a, c, t, g, unknown or other
  modified_base (3055)..(3064): a, c, t, g, unknown or other
  modified_base (3159)..(3168): a, c, t, g, unknown or other
  modified_base (3707)..(3716): a, c, t, g, unknown or other
  modified_base (4384)..(4393): a, c, t, g, unknown or other
  modified_base (5025)..(5034): a, c, t, g, unknown or other
  modified_base (5132)..(5314): a, c, t, g, unknown or other
  modified_base (5436)..(5574): a, c, t, g, unknown or other
  modified_base (5952)..(5961): a, c, t, g, unknown or other
  modified_base (6168)..(6177): a, c, t, g, unknown or other
cgacgcgctccgcggccaggctgccgcgcaggttgccggggtcgaagccggggccggcgccgcgcgcggcgaggaaggccgccagcgccgcctcgcggtcggcgggggggaggcggcaggcggccagcagcacctgggcctgcggcatgaagtcgtgcatggcggcaaaggccaggcggaagcgccagcccagcgccgggcgcgggcggtcgtgtgcgtaggggacgtcggccgccccggggcgcatgcgcaccgcgtgccgggactgcaccaggaagtccccgctgcgcgcggagcccaccgcctccagcccctccacgccctcgaacggcagtctgtgatgcagcgaggggggaggggaggggatgctggcgtggctgggcccgggggtgaggaagtgtgaggttgcagcgatctacgacacactcccgagccaggctggcagcaaagcccctcagacaacacctgcccacctgacgatgggcacgcgaaggtcgtcggggtcgaagaacatggagcgggtggccaggcgcaggtggccggccagcacggggcgcccctgccagttgcccgggatctgggggggccaggcgcactccgccacaaactcgtgcactgcggcgggtgggcaccgtggcgggtggcatggaacgtgcaggggttcgggtgggggttgcctccggcatgcaccgggggaggttggtggggtgggaactgccatgccttcatttgcaacacaatgaggtactggattccgcgacgctgtgaacccaaaggacgttcgcacgatggcccccgctccggtgtcacgtaacagcccgtttcagggcccctgtctgcgacgcccacctcaccatattcctccccctcctggagcagcaggagggagaacctggtgggagcagaggagtacaggctcagcatgccggctcctggggcgcagccggctccttggtcggggcggggggggctccagcacccttgggcacaggagaagggagtacggcctggtagtccggacccaccctgggaccgcgccgggtcgggaaggagttcttgagcacgctgggtaccgttcgattcagtttttcgtggtggctgggtgggcgggaggtcaaggcctcgatctccttgatctgggcgatcaatctacccccgggcagggaggggggtgcaggggatggggagcgatctcgtttgacgctgcgggcgtttcgtgtcccgggcaaggggtcgagcgagggattgggggagcctgagtcggagctcatatcatgtgggactcagatgaggtgccactcctcgctggtgctcgacacttgcaacgccggaccgaccgcctgagagcctcaaagcagcgatcaaaggcttttcgattgttcatcaagtgatcactgatgtcatcatgatttcgtcgcctcgacgcacaccagtcagcaaccgtggaatcgcgtgcgatgtcagggtttgccccagcacgcttgctgaccggaggagagacaggttccgcatgccggagcacagcatgccggcgagcgttccaccctttggaaccctgccttcacgtcgattcttgtcgttgcagtgccctgacagatttttcctcgcggtgtgcggaagcaccccgaggaggatgtcgtacgcgcctccccgccccaatgggcgtacccgggctcaggcggaggtcacagacaacctcagcccggcagaacgccatataatggagatggcgaagcgggaacaccgagatacgactgccgcggccaagcgagctgcccaggtgagtggtggaggcgtggggcttaacctccatgttgccgagctgcagggtcacgcagccgtgctcggccagcaggaagacccgcccagcctgcatgtcagccttgcttgctgcctggtactctcgcaagtagcatcgtcttggttcctcaccatgtgagcagatagctgacgagactgtggacgctgggagaaacaccttggtagagatccatcggcaaggcgagcagctggatcacatcgagcggggcctggaccacgtgagtgtgggtgtcatgtgcagtgaagaagtggtatgacctgactatgctgagggggtatggaagtggtcttcccactgtaggccaacatagctgtcaccccatcctgtcgagggccccctcaacatgtggcgaagccaatgccagtcaacttgcacccaccctcgacacttaaactgcttgcagatggaggaggatgtgaaggaggccagnnnnnnnnnnaattaagtgttatgacctgactatgctgaggggttatggaagtggtcttcccactgaaggcccacatagctgtcaccccatcctgtcgagggacccctcaacatgtggcaaagccaatgccaatcaacttgcacccaccctcgccacttaactgctcgcagatggaggaggatgtgaaggaggccagctcccttgtgaagttcatgcggcgctggtgctgctggcagctgtgctgctgctgtttggatccggagcacaagaaagggaggccgagtcgccagcagcgcctcaagatgtgagcattgcatgcagtgctgggtgttggtacccatggtcttagaatgtgctcgctgcagagctatgagctaggacaattggttcgctcccgctgatgttggtcaccggctgtgtgtcatttggtgatcatgatttagggtattttagatgtgtgcctgcctgcagccctttcagtcacccgcagccattcagctcacaacctccatacccttttcccaccccaggcggggcgtgacaagcttggaccaccgagaggaggtcgccaacaagcacatgagcgccgctgccgcggtggaccgcctcataaagcgggatgacgtggcttacaacggggatgagaccggtcagcgcagcgagcttttccagacggcagaggccatcaggtcggagcgaaagaccacgtccatcggctttggaaagttcccggnnnnnnnnnnagcagaggccatcaggtcggagcgaaaggccacgtccatcggctttggaaagttctctgnnnnnnnnnnggttggcaggaaaggggcttgaatgcggggcaaggatgtgccgagccccaagcccctcccacatcctacgcagagtctgatcgatctgagctcgnnnnnnnnnngcatggccggtgagtgaggaggttgtttggtgttgcaggcatgggattctggatggggtcggtacccttctgctctgtgcttgcaacctcaggcaagagcaagcttggtggagaacccttgattggcctgtcccggactgcctcgctgggtcaagagctgctggagcctgcctcaaaagttggcaggaaaggggcttgaatgcagggcaaggatgtcccgagccccaagcccctcccacaacctacgcagagtctgatcgatctgagctcgacagcgagactttaaagcaggaaggatacctggacagcattgggaaggcggtggagagcatgaaggccctcggacaggtgagggcaaggctggagggatcggccacctgcctcaggcccgctagggtttaatgggaatgatctcggatcctgatgctggcatgacgaaacccctgcatccaagtccgagcttgtggcatgtgcacgatgggggaggtgagtaatctccagcccaatatcaatcaatgtatgctctcattggcccctcnnnnnnnnnnatcctgatactggcatgatgaaacccctgcatccaagtctgagcttgtggcatgagcacgatgggggaagtgagtaatctccagcccaatgtcaatcaatgtatgctctcattggcccctcgcccaacaggaaatgtcgaacgagctccaggtccaggacacgcagattgagcgcctgcccacgcgggcagtcaaggtgaacgacgacctgaaccggctcaacaagaccatcgccaagatctgagggctgcgcggctgcattgcccaggcacagtcccgctcgacggcggtcttacgttggtgacatgcttgtcccggcccttgcccctgacgttttccacattggttgatatgcgcggcacatgctcgatcctctcgcctggatgtggcagctcacctgctgcaaccctgcccctggccaggagtctacactaatttcccccaaagttgacaagaccatctccattttgttgcacatcctctccttgcaccaatgacaagttgctgccccctgtgctgcttgtctgttatgacaggctacaactgccacagtggcacccagccatacacttaaaaacgatatcaaagccgacatccgagcgtttgtaccctacatacagatggcatataaaggtagcagaaaaaagtgtacaggcagcgccgtgcgnnnnnnnnnngccgacatccatgcgtttgtaccgtacatacagatggcatataaaggtaccagaaaaaagtgtacaggcagcgccgtgcgttcgagctagtcagattcaggtttattgggcaagacccggcgagcacagtgacaagaccctggcagggggctcgcaaactgtcattcagccgctgcagcaggggcaatcgccggagcgcagcccacagcccaggccgccaccggagcagcaggagccgcaggtgcggagcgcgcaggggcagctccccttgcagcagcagcgcttgggggtgtcgggggcgaccggctccccgctgccggccctcgcgaacgagcccagggccagggcaggctccgctggcaccgcgccaacaggcccaagcgcacagcaggttgccctgtgcggggccgggtggagtttgggcgagggcggcaaggcctgtcgcccctccgcctcgccttccagagcacacaggcgccccgccagtgcgtggtgcccgcgcctggcggcgaagtcggacgctcggtgccccggcggcagctgcgaggcggccggcggccgcaccccgccctccagcagggcctccaccagccgctccgctgtggactcctccccggcggccgcggccaggnnnnnnnnnncagtcagattcaggtttattgagcaagaaccggcgagtatggtgacaagaccctggcagggggctcacaaactgtcattcagccgctgcagcaggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccagggccaggacaggctccgctggcaccgcgccaccaggccccagcgcacagcaggtcgccctgtccggggccgggtggagtttgggcaagggcggcaaggcctgtcgcccctccgcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacccgccctccagaagggcgtccaccagccgctccgccgtggactcctccccggcggccgcggccaggtggtagaccgagagtgggacgggcgagggtttgccgtggcggtcggtgccgtcccacgggcctggcaggcttgagctggccggggacgagttccacaagccccagcccagcacgatctggcggacgagatgggtggtggtggtggtggttgagcgatcgtcggtgtcagtgcagatcaggctacctgggtctgtgaccccacgctgtccgcggttgttgtctacaacggcagagtccctccttgggcgccctccggacgagtgaacccccagcctctcccccgtcctcgagggctgccagcgcatgcacnnnnnnnnnnacgcggttgtggtccacaacggcagagtccctcctcgggcgccctccggacaagtgaacccccagcctctctcccgtcctcgagggctgccagcgcatgcacccaattccccagaagcaggagcccacccgaagtttccgcagccacaatccccaccgggtttccccaccttgacgcaggcggggtcccccgactgcacggcggcgnnnnnnnnnntccacccgaaatttccgcagccgcaatccccaccgggtttcccaccttgacacaggcggggtcccccgactgcacggcggcgtgcagcaggcccagccccgtgcccggcggcgttccaaggcgcgcggcgcggcgcagcgtggccgccaccgccgaagcgtgcacagcgtgcagcagggccagaccgtccaggcccgcggcgcgcgcacccggcagcgcgcgcgccgcgccctccacctcctcgacgacgacgtccagcgc

SEQ ID NO: 48256 - DNA, 31313 bp, Chlorella protothecoides
  modified_base (624)..(633): a, c, t, g, unknown or other
  modified_base (1212)..(1221): a, c, t, g, unknown or other
  modified_base (1291)..(1521): a, c, t, g, unknown or other
  modified_base (1598)..(1607): a, c, t, g, unknown or other
  modified_base (2241)..(2250): a, c, t, g, unknown or other
  modified_base (2592)..(2601): a, c, t, g, unknown or other
  modified_base (3049)..(3058): a, c, t, g, unknown or other
  modified_base (3554)..(3563): a, c, t, g, unknown or other
  modified_base (4729)..(4738): a, c, t, g, unknown or other
  modified_base (5556)..(5565): a, c, t, g, unknown or other
  modified_base (5991)..(6000): a, c, t, g, unknown or other
  modified_base (6269)..(6278): a, c, t, g, unknown or other
  modified_base (6896)..(6905): a, c, t, g, unknown or other
  modified_base (8687)..(8696): a, c, t, g, unknown or other
  modified_base (9280)..(9289): a, c, t, g, unknown or other
  modified_base (9725)..(9734): a, c, t, g, unknown or other
  modified_base (10454)..(10463): a, c, t, g, unknown or other
  modified_base (10854)..(10863): a, c, t, g, unknown or other
  modified_base (11177)..(11186): a, c, t, g, unknown or other
  modified_base (11643)..(11652): a, c, t, g, unknown or other
  modified_base (14608)..(14755): a, c, t, g, unknown or other
  modified_base (14908)..(14917): a, c, t, g, unknown or other
  modified_base (15114)..(15123): a, c, t, g, unknown or other
  modified_base (15324)..(15333): a, c, t, g, unknown or other
  modified_base (15931)..(15940): a, c, t, g, unknown or other
  modified_base (16354)..(16363): a, c, t, g, unknown or other
  modified_base (17144)..(17153): a, c, t, g, unknown or other
  modified_base (17489)..(17498): a, c, t, g, unknown or other
  modified_base (17607)..(17616): a, c, t, g, unknown or other
  modified_base (18278)..(18287): a, c, t, g, unknown or other
  modified_base (18351)..(18360): a, c, t, g, unknown or other
  modified_base (18791)..(18800): a, c, t, g, unknown or other
  modified_base (19219)..(19228): a, c, t, g, unknown or other
  modified_base (19792)..(19801): a, c, t, g, unknown or other
  modified_base (20213)..(20222): a, c, t, g, unknown or other
  modified_base (23894)..(23903): a, c, t, g, unknown or other
  modified_base (24253)..(24262): a, c, t, g, unknown or other
  modified_base (24674)..(24683): a, c, t, g, unknown or other
  modified_base (25785)..(25794): a, c, t, g, unknown or other
  modified_base (26224)..(26233): a, c, t, g, unknown or other
  modified_base (26344)..(26353): a, c, t, g, unknown or other
  modified_base (26423)..(26432): a, c, t, g, unknown or other
  modified_base (27888)..(27897): a, c, t, g, unknown or other
  modified_base (28490)..(28499): a, c, t, g, unknown or other
  modified_base (29871)..(29880): a, c, t, g, unknown or other
  modified_base (30520)..(30529): a, c, t, g, unknown or other
cgacgcccgacgccaccccgcccccgacgcccgccaaggcggcacgggcggggtgggggctgggcgccgcgctggcgcgggtggcggcctcgctgcgcgcgctgtactcgcccgagttccggcgcaccacgctgctgctggacggcatctggttcaccaacgccatcacgtgagggaaaggggtgtgggatggggaatgcatgggagtgggatcgcgcgggaggaacgtggctggaggacggggcgcaggaagtcgtgcgcgcaaatccaggacagcagcagctgtgggtcatctacaccgcgactccctcacgccagacggccccccgcgccacattgtctcacacataacaggtactatgggctggtgctgctcagcacggagctgcagacggcacacaaggaggagcagtgcacgccagatgggcagcccaacctcgtgggccgcgactttttggtgggcgcaagtgcaggaatgaggggggttcatcgcaccggccaccccgccgggactcgaggtcgagtgccatcacgggcctgctgaactggctgccatgtgaggcgctggcaagctcgccctggcacatgctcagcccgcagtgatcgctgcccagggttgctgannnnnnnnnngtcatcgcaccggccaccccgccgggactggaggtcgagtgccatcacgggcttgctgagctggctgccttgtgaggcgctggcaagctcgcactggcacatgctcaacccgcagtgatcgctgcccagggttgctgactgcgtacaccccccgctcagcccatccccaccccactccctccccgcctgcagaacatcgtgatcaccagcgctgcagaggccccgggcctgctggccatcgccttcctggtggatggccgaggcaggaagtggagcctgcgggccggcctcctgctcaccggcctgtccatcctcctcctgctggcggcggggccggggggtggggcccagctcttcatgctcttcctgtcacgggcggggatcatgggggcctactcagtgctgtacatctacaccccggagatctacccgacaaaggtgggcagcgtgtctggtggcgagtgtggggtccggatggacccgtggtccgcgagcaccactggggagtcgagagacccccagtgatgccttcccaagtattcatgcctttcccagtaccatcgcccctccccacctccnnnnnnnnnnaagagacccccagtgatgccttcccaagtgttcatgcaattcccagtaccatcgcccctccccacctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgcgacctgcaggccgtgcgcctccccggaccggagcccgaggacgaggccctggatggcacgccggtcggcgccnnnnnnnnnncaaagaaaaaaccttccccacccaacagctgcgatcctttgggctggccctctgcaacgccatgagccgggtgggcggctttgcggcgccctacgccaccgtgtccctggtggagtcggggcgccagaccgccgcgctgtgcctgctggggggcatgtgcctcctggcctgcgccgccgccttcttcctggagcacgagacgcgggggcgcgacctgcaggccgtgcgcctctccggaccggaggccgaggatgaggccctggatggcacgccggtcggcgccagcccggcgatgtcggccgagctggtgcacacgccccgcccgccctccggggcccaggcctcgtgaccccggggcggcgtgccaggcgaggcgctgccgtgggcctgccacgtcgacggctcagaaacatgtcgcgcccctggtgagccccgtgcccctgcgccatctgctggaccttgcggatgcgctggccggtctcatggacatttcatgtttcccagacacgacacacagctctcctgtaagcgctgctttgaggccttggacaagcccatgcccaggctaggagaagggtaaccaggaaagaggaccggtgtgccgcagcaagggtctgttgagcaatacactgannnnnnnnnntctgctctgaggccttggacaagtccatgcccaggctaggaggagggtaaccaggaaagaggaccggtgtgctgcagcaagggtctgttgagcaatacactgatgcagaaactccagccctacacatgatgcgcccgctcccagcccaggagccagccggctgcccctgtcatatgtcactgcggccccagcgacgaattcaagcccaggtagaacaggcccactccaaagaagatgagcaccgccacgaggatgagcactcgccggattatgcctggagtgtgcatggacgggtggaggtggcatgaggggggcgctgcaacccttactcaggcctgatgnnnnnnnnnncgagcaccgccacgaggatgagcactcgccgaattatgcctggaatgtgcatggacgggtggaggtggctggaggagggcgctgcaacccttactcaggcctgatgcagtggagtttgaacgctgtctggcatccctgaggttggggccaccgccctcttgggcccgcccaccaaccacccacccaggacgctcttgtcgatgccctggatgtcggtgctgagcatgtccgagacgtcacgctccagaacgccgctgggcttggggccgctcctggtgggggaggggagcagggagtatgggccggggcgcgctgctcagtcagggcacctgtccatgcacgcgctgtacccagcacggagggcagcgtctgcaggcacgggcccctgcctcaccagctcccgcccgacttcccgctcgcctccccgctcgcgctcccaaacttgggnnnnnnnnnnagccgctcctggtgggggaggagagcagggagtgaaggccggggcgcgctgctcagtcagggcacctgtccatgcatacgctgtacccagcacggagggcagcgcctgcaggcacggacccctgcctcaccagctcccgcccgatttcccgcccgcctccccgctcgcgctcccaaacttgggtggcgaggtggccgccgccttcttcttctggccctccagggtcgccaggatgaacttctccaactggcgctgcacctggggcgaggcctggagctgcaccagccttttgtccccggactccagcgccgccagcaggtccaggccttggcccaccgcctctgggaattggaggaacggggagtttgtggatgtgcactggcatcacctgcgcatagggctgctggggcatgcgagcagcggcgtgcccggaccaggcaggagggggccgactcctccccgcatcccaccacctccagacattgccccaaacagnnnnnnnnnnatttgtgggtgtgtactggcatcacctgcgcaaagggctgctggggcacgcaagcagcggcgtgcatggaccaggcaggcgggggccgactcctccccgcaccccaccacctccagacattgccccaaacagcatgcgcacctcgcatcgccacctgcgccggctccacgtcgccgaagtaggcgtgcacgcatgccgcattgtaggccatcacccccctctcctcagaggaagcacccttggacgccatgccggcctcccaggcgcgcagcgcgcccatcctgtcgttcttctcgtacagctcgcgccccttgtcgagtgcctggtggagggaggggaggggagtggctccttgccttggttccatcctttggtgagcagccctagcgccgagcgcaagaggggaaccgcaacaccttgcgccaagccatggccgccatccatgcacatgtcgttttgcagaagaccttcagtctacaagcttcacctcggcattggcgcgggtcatgatgcgccgacttcctggatgtggaggcacagacccagaagcttgcatgctgcgatcacgagaaatctcggcacacagcgaatgcgacatgtcgcactgcaaacactacaccgcccaaaacgcaatgtaccttgcagtcgtctgcatcgcgtgcctatgtgcagacggccttgcaaatgggctgcagttctgagattcgaagtgcccgggcatggcccgttcatgcacagagaaatccctcgcatggagacagacgggtgatccgctcgagcacgcctggggtacacagcaacatgcaccaattaaccttctcagcatcatgcaaggacgagttgacgcctgccccaggccgctctgcgtctggccttacccaggatcccgttaggtggaatgcgggactgcccactgttttggtagagatcactgccgtccagcaagtcctatttccgacatcgagagcacagcagcaacttcgtaatgttcacccatatgcattacatgcatgctcgcattcagcgcgatcagcgccgacttcatctcttccatgcctgtcccaatgactcctgacatggacatgcagagcacattggttggcatttaaagttcagcctcggtctaattgtgtgaaaatgcactgtttgtgctgggcgtgcatgtnnnnnnnnnncgacatggacatgcagagcacattgattggcattcaaaggacagcctctgtctaattgtatacaaatgcactgtttgtgctgggcgtgcatgttgtcgcgagtttcaatgtcctgcgcctggcggcgacattctacagagaataccctgctcgacgacacttccgccatcggcccacttccgatacccactggaacctcgagacttgccattgtacgtggcaaattgctgctcagtggaacacgcaccccgggcccgccccccgcgatccatcgctcgttggcagtgctgggcgtgtcgagcgcacgcccgaaaacgttagcaaggaggggacggtataaggctttgcaagccatcacgcctcaactcactgcgtaaatgatgtggatgccttcatactaatccactaagggggtgtaatgggtcaatcggagaggcagggatcgcctggggggtcccgacgccggtcctcggtgggtgtaccctcgcgcctgggccctgcagctcaggccaggcgtacccagggccttccgatcaaaggatggaaacgtcatggtaatgtgggaatagagttgcaggctctccttccaccagatcgcacccatgcagatatggacctccagcccatcccacccccttcccaggctcgatcatcgctgccgtgctcgccattgggctggccctgggacaccgattcctctggcatgaaagaccagtctcgaaatgtgagttgggagggctgatccatggaatgtcaagcccagggtggtcctgggatattgcagtccgtgagcgccctcttcatctcgtccctgcagnnnnnnnnnnaggaggtctgatccatggaatgtcaagcccagggtagtcctgggatattgcagtcggtgagcgccctcttcatctcgtccctgcagggcccaacctggtgccctttccgagccccaagctgctggatctgcaacagttcaagggtagccacgcagaaaagtacctctggggaacctaccgtccagggtattacctcggtgaggatggcgagggggtgtagctggttgggtgctctgtaaggaccaagcagcaccgcctgcccctgccatcacggcactgaagccaggcgctgggttcagacggcgtgtttcaatgtgccggcattgactatcgccctcttcacctgcaatcctcctgtttgagccaaaagcatacatcctcaccccctctcgccgaccacacaggcatgaggccccgccacccaannnnnnnnnngttcaatgtgctggcattgactatcgctctcttcacctgcaatccttctgtttgagcctaaagcatacatcctcaccccctctcgccaaccacacaggcatgaggccccgccacccaacgagcttggttaccggactgatgtgggtcgacttcacgaggtccgactggttcacctccattcgccacgaagccctgcagtcagatggtgggtgggttttggggagggagccgcccagccgtgcgagaagaatgtgtagactgagacatgnnnnnnnnnntgaagccctgcagtcggatggtgggtgggtttcggggagggagccgcccagctgtgcgagaagaatgtgtagactgagacatgtggtgatcttgtgggtaagcaagctttcatcaggcttacggctgctcctgcgcttcggcacccaccgcacctcgctggcagggccatactccaccctagtaccggttacacaacctctattgccccgcgacccatcctgacgcccccctacctctcacctgctcgctcactcctcaccctaaaccccgccctgcactctcaaacccatttcagacctgggcttctatggctggcttgaacacgatggggaaaactatggcatccagcagctggaggaccggcgtttcaacatgaccacctccttggtatgctggactcgggtggtcggtgtagctgcggaatcaagtgatagcgacgacccatcaacggggggcgacgcgagtggtgcatactctgtaggcagctccgtcatcctctggtctatggctagctttcacggcaaacgaggagcctatcacgcccctcaaggctcgccagcgactgctctgtagctgctcccccatccgccactgtcacctccacacacactccttcnnnnnnnnnnacaaatgaggagcctatcacgcccctcacggctcgccagcgactgccctgtagctcctcccccatgcgccactgtcacctccacacacactccttcgcgacccccattcaccccaggtgaagcgacagtgcaagtcctgcggcgcaggcggcgactgggccctgcgcgtgaatgccaagcccgcccagggcagcatggccgacggtgcccctcggcccgtggtctccctgttcttctacgtggcggcagagggcatggaagccatgaccctgggtgccaacgcgtggaagggcgccattgggcctgacgtggaggagccccagccggtgctgtctgggaccagtgccccctttggcaagtgagtgtgaacactccaatcctggcgaggtgatgcctgcaggcggagtgtacctttgagggctttggaggagggaaagggcaaacccctgactgagtgtgtgctgccttccaccggtgcagcgcccattgcctggcagggacccctgctctgtcctggtggcctgccgatcaagttgttttagcaatccattcctgtcggccgcccccatccctgtcatttccggaagaccgctcccacatccttcacaccctgcacctcctatcctccccacaaaaggtgggcgctccacgtgcgcggcgagggcgccggcggcttccccactggggtccactggctgggcctgcgcacgccgtacacggccaacctgacctcggcggtgaaagccggcctgcgccgatccctgttcgaccagcggcgggcgggggcggagcagtttgtcctgcgcctgcccgacgacgccgagccggggtcaaacgtgtacgtgctgcaggtccaggcctggctgccggccagcctggacctggtgttcaccagcggccgcggcgcaggcgagcgcgcgcgcgtcgcggcgctgactggcgccgccttcaacgcccagctggcgcggcacagcgccgccttcaacgcgcgcctggcgcggaccttccccgtcgaggagggtaggggcggcgtgccaacaggtcggtggagctgctgggatgggggtccaaggggttcagccagctggcttgttgggccatcagatgagcggcgagcgtgtgcatcctgtggccccattccgcgctgtgcacgaccccgacccatgcgccgtgcagcggtccctcgccagcccctcccatcgtccccgctcccctcctgatgaacacccactccaggcacacgcgtggtgagcaaggcggcgctgagccagctgctgggcggcatggggtactggtttggccactccatcgtctgggtggtgggcaactggccccccgtgctgcccaactgggacgccgggatcttcacagccagcccctcgcgcagccagtttccgcgcggcttcctctgggacgagggcttccaccaggtgacctgtgggatgttgctctcaaggattggcttgccaatgttgagccgacgccggcccccggcacctcgacaacctaggctccccccactccccctctcgccagctgctcatccggcgctggaacccggcgctgagtcgcgatgtgctggcgcactggctggacctcatggcctccactggctggatcgcaagggagcagattctgggggatgaagctcggctcaggtgcaagggcgctgcgggaggggtttgagaagttgtttggggagtcatgtaggcatgcgtggtggaccatgcgctgcatcgcccggagtgacatgcaggcgaccaaccggctggggtcccgctnnnnnnnnnnccaagggcgctgcggggagggggttgagaaggtgtttggggagtcatgtaggcttgcgtggtggaccatgcgctgcatggcccggagtgacctgcaggcgaccaaccggctggggtcccgctgcgtcttgcatcccgaatctctaactggcgtatcctggatccttgccaggtatttaccgccgtcccttcccattctcactttcctcccacagctccccaccccacccccctttcccatactccaaaccatgcagggttcccaaggagtttgtgccccagccaaccaagaccgccaacccgcccagcctcttcctggtcctgtcagagatggccgcggggttggagtctggaggccccgaggccgaggccgaccgcgctttcctggaggtggcctggccgcgcctgctggcctggtacacctggctcaacaccacccaggtgcagaggcggggcgggtggggagggggctcgggaggccaaagttcttgcctgggagacgggcttcttgcgccggctttgaaggctcggcttgttgcagtggtcagttagcccaggcatcaaggccacagcgccgttccccannnnnnnnnnaggagacgtgcttcttgcgccggctttgaagcctcggcttgttgcagtggtcaattagctcaggcatcaaggccacagcgccgttccccaaaacatccaaaattttgtcaacacccacctctgtcccttttcccaggccgggcccgtgcccgggtccttccgctggcgccagcgggacaacgcaaccacgacggagttgaatcccaggacgctggcttcggggctggatgactacccccgcgcctcccacccctcacgtgcgcctggtgggggatggctttgggttttcaaggctggcgtccgcactgtggtaagggggaagggttgcatgtactagcccaggatcaggctatcaaaaagaacctcggagtggacatggcaagggagagggttgtactggatgagccgccacccaagctggccgccatggctggannnnnnnnnntagggggaagggttgcatgttccagcccaggatcaggctaccaaaaagaacctcggaatggacatggcaagggagagggttttcactgaatgaaccgccacccaagctggccgccatggctggagcggccccagatcctccccttcccatcttcacccccttccacacggatcacgcacggcaggggacgagcggcacctggacctgcgctgctggatgacgctgtcggcgcgcaccatggtgcagatcggcacggctctggggctgggccgcggcggcgccctcgcttccttgcaggcggacgcggccaggctgtctgacttcggggagctgaccgccctgcactacgacgccgcggccggccggtttgcggactggggcctgcactctgaagatgtggccctggcgctcgatccggcgagtgggaagctggtgcggcagacggcctccccgccccgcctgcagtgggtgccccaccacgggtgagtcagggaattgtgtggaaggaatacccttggctgagtgactcggcctggcaaagccgatgtccggctgtgcttggatgcagtgtagaaattggtttcccagagtgctcactgccgactggcggacgcttcggttcccttttcactcctgtcactccaatgcatgtttgggcccagtaaaccccttccttcccttccatcccgggggcgcaggtacgtctcgctcttccccctnnnnnnnnnnttgcagactggcggacgcttcggttccctcttcactcctgtcactcaatgcatgtttgggcccagtagaccccttccttcacttccatccctggggcgcaggtacgtctcgctcttccccctcatcatgcgcttgatcccgccacactcctcccacttggggcgggaattggacgccctcaccgaccctggaggcctgctctcccctgcgggtatccggtcgctgagtcagcgcagcagcctgtattccaagcataacacgcaacatgatccgccctactggcggggcactgtctggatcaacatcaactacctcgtgctggacgtgcgtgcgcctgtggagtttgacctttttttgaaaggggggggaggtggactttttggtgtcggcnnnnnnnnnntgtgcgtgcgcctgtggagttcgacctttttttgaaaggggggggggaggaggtggactttttggtgtcggctcccatgcattccgggtctgcaagcatccatgcggccaaggccactccacacaatcacattgatgtagccattgattgtttgagatgtttcgagctcccacttcccactcttcgctgagcttgctggctgaacagccacatgattggaactcaacactcctctgggccctcccatgcgcacatgacccacccaaccgcaccgccctgtcggccccacctcgtctcgcaggcgctgcgattcnnnnnnnnnncaggccctcccatgcgcacatgaccctcccaaccgcaccgccctttcgcccccacctcgtctcgcaggcgctgcgattctacgcgcggactcccggtccctactcacagcacgccggcacagctgccgcgcagctgcgtgccgccgtgttggacgccggcgtgggccagttccgggagacgggcttcttctgggagcagtacaacgacaccagctcggcgggacggggtgcccaccccttcaccggctggacggcgctgctcaccctcatcgccgccgaggcgtgatgggcgggcgaaggtcgggcgaggcattgcgtgccggccggcgcctgccagagatgaggtctgcatgaagcctgtttgcaaacccccctgttccttttcattgcttcacacgttgcaccccgacagcatgagttcattcttgttgaagaatctatggccagggggcacccnnnnnnnnnnttgttcctcttcatcgcttcatacgttgcaccccgacagcatgagttcatttctgttgaagaatctatggccagggggcacccttgcatgcaccgcgtggatggcttgagaaagcacagatcaggggcctcgccaggttgtccctcttgctggcgacgaggcccccgtttggggacacatgacttccaaacctgcgctggaacacctttgggccccaccgtctcatgccagaccgtcggtacgtcaggcgctgggccagagcgtgcccagcgggacaccagcctcgcagcgcgaaaggatccgctcggcctcctcggcgatctcggcctgcaccgtctctacggagcgagccgcgtcgaccacgacccagctggggtcctgcagggtcccaaacgcctgccgcacctggggacaacggcaggagggaaggtgtggggttgtttcagtgtatggaaacaggggctgagaatgtgacgctggcagctgggcacagcagcacgtgttgacattcaaccccgcaatcgacgggcctggcaacaccagatgttatggaaacccttttgtgagtgggtctcatgccctgtgagcttgtctgcccgccaatgaggtacccgtttgagctcaggccatgtccccgcccccctcattgcaatgtacatgcccccacccctccccttgaccccgggccgccccactcctcttccacagtgtgcaccttcttctgcaaatctgtggtctcgtaccgctcctggccatacccccccctctcggctgcctgctccgggctcaggtccaggaagaagacggtgtcgggggcggggaggcccacgtcgggtgcccggcaccaggccgtgtccagccccggcagccccttggcggccgtgaaggcgacgccggagtgagcataccggtccactatcagcgtggtgccggagttgagcctctccagcattgccgccctgcagggtggtggagggggggaaacagggacacggttgttggcagtggcggtggggtgcagaggcctgtgccttcgaacaccaaacaccaggtgagggtcctggcatgcatggccctggcagcaggggcagtggtggctgtacattcggactcgtccatgcatgccccacctccaatctcaccgtttctcccatcgattggcggagaagaggaggtgcatggcggcatcatcagcctctgactgttttgtcaggtacgagttgatcatgctgccgatggcagtgctacgatcagggaacctccacagctccacattgtactgcgggtggggaggttggcagtgttggaggtcatcggggacgggcctgcacgcctggtgcaccttacatacctcaccctgcagtccgtggccacgacaagcatgtgcagtagctacgcacccctaggtgtcctaggtgctgtgagagaagctcgcactgagtggatttcccggcgcgatcgacgccctcgaacacgatcagtgcccctcgagccggactgcgtgtcatggtgctgtgtacacgcaggttcgcagaggctcgagcgatcagggaagggtgtcgagcggccgctgacaggcaacgatcaaaccacattgctgtcgaggggcgcacggtgccagctgggagctgcgggccctgaaaatcgcctgttcgctgtttcaagtcggagattcgggtttggaccccgtccgcgcgcccccggaacgcacgtgcagggcggggaggggagcagggcaccgcacggtgggctttagggggagaggccgagcacaagacatggagccatgcagggaccgacgcggcatcgtgtcccatccctgcaatctcactttgatgcaagctgtcacgctcatccccggctgtcgcgctgtgcctgagccgtgcctcagccagcgccgacaggcgggacccctggcattcacggctgggccatcacctgtcgaacgacgtcatcgcctggtctgtaagtctgcagccatttcacactctgcggtgagtatgtgtctggcaacgggggcgtgggtcgggatagcggtgggatgtcgctaggggtcttcttcacaggcccccccaaacctgccctcacgcccaggtaactaccaatggcaagtcccaagccctggaactgagcgacctgaccgccattgggcccctggacgggcgctacggcagcaaggtcctccccctgcgtgccatcttctccgagtatggcctcatccgcttcagggtgctcgtggagtgccagtggctgaaaaccctcagcaggctggagggtgttcccgaggtcccgccgtgagtgctgcggtgctgtttccacagccggctgggcggagttgggagtgatgtgtccgcgaggcccccttgtccctgttcctcctcgttgaaagccgccgagtcatggccggttctgcctgccgtttgactctcacggggctggcttgccatccccccagactcttcctgtatctcctccctgtcttcatccaattccatgcaaccccgctcacgccccctccccaccccccaggtttagcagcgaggccgaggcgctgctggacgagctgtcctccaacttcagcgtggaggatgccgcggaggtcaaggaggtggagcgcaccaccaaccacgacgtcaaggcggtggagtatgtcatcaagcggaggctggggaggaacgcggagcttgccaaggtgggcgcagggtgagggggggaagggatgacggggagtgacactccctgcgaggcccaggcgccccgctgcggcgccccaggtgctgcttgccgttcaaggtcaggcacgcaccctcttcctcccctcccccccctttggtaggtgctggagttcacccactttgcgtgcaccagcgaggacatcaacaatctggcgcacgccctcatgttcaaggaggcgctcgccggcgaggtcctgccggccatggacaccgtgatcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctgaccgggcaagcttgcccgctggagacacccttctagctgagcgcattttgttgtcattggagatgtcctggtggcgcgacaccgcctgggcctgccttaggaccttggctcctctcaagcatctcctggtctgcactccagttgaccnnnnnnnnnnagcgattgcagggtgggcagtttaaggctgtagaggctggcatggccgtggtggatgggatgcatgtgagttagatgcttggggtgcatggcatgccttggggtgcctatcgccttgcaggacgacctcgcggggactcaccaaacactgcgctatgatgcctcagggcagctttgctgccctaaacttaaatatannnnnnnnnncgcgattgcagggtgggctgtttcagactgtagaggctggcatggtcgtgctggatggtgtgcatgtgttttagatgcttcggtgcatggcatgctttggggtgcccatcgccttgcaggtcgggcctcgcgggactctcctatccaaactctgcgctgtgatgcctcacggcagctttgctgccctaaacttaaatatannnnnnnnnncgttgtcattggacatgtcccggtggcgaggcaccgccttaggaccttggcacctctcgagcatctcctggtctgcactccagttgacctgtaccctcccatcccactcccgcactttccttcaggctggccaccgagcacgctggtgtgcccatgctggcgcggacccatggtcaaacggcatcgcccaccaccatgggcaaggagatggcggtgtttgcctaccgcctggcgcgccagcggcaccaggtgggaggaggtgctggtgctgaactccgcggtctcgcatggggccgcacaggagcatgttgcctgggttcggattaagaaaggggggctccatgtcatggatatgtctggaccggcctttgtggcatgcccatggatatcccaggggggcacgaatgagtggctgagtggctcttcggggtgagatgatcgtgatctgtgccccatcgcgatgacagccatggctccaaaatcctcatcctgccagcctctgtcccatcaactcctggcccccaactctcctcccagcagcccactcacgcccctgcattcgcgcatccacatcgacgcaggtggctgccgtgccccnnnnnnnnnnccctcccagcagcccactcacgcccctgcatccgtgcacccacatcgacgcaggtggctgccgtgcccctctttggcaagtttggcggggcggtgggcaactacaatgcccacctgtccgcctacccggacctggactggcaggcgattgcagaggagtttgtgaccggcctgggcctcgagtggaacccctatgtcacccagatcgagccccacgactacattgcgggtgagttgtcgagctgaagggatggggtatggcatcgggagggcctggtggactgtcggtgactgcgcaggcaaaaggtggctgcgcacggtcgccggctggcacactcacgggcgctgcatgccggaaggtggctgggtgcaccccgcctgggctcctaccagtcccaaactcctgccgtcctgnnnnnnnnnntggttgtttcgctgaagggatggggtctggcatcgggagggcctggtggactgttggtgaatgcgcaggcaaaatgtggctgcgcacggccgccggctggcacactcacgggcgctgcatgccggatggtggctgcttgcaccccgcctgggttcctaccagtcccaaactcctgccgtcctgtctgcaacccctccatgtctgtctattcggccccccccgcccccccccacccaaccagaggtctttgacgccatggcgcgcttcaacaccatcttgctggactttgaccgcgacgtgtggggctacatctccctgggctactttcggcagcgcacgatagcgggggaggtgggatcctctaccatgccccacaaggtcaaccccatcgactttgagaacagcgagggcaacctgggcatcgccaacgccaccctggcgcatctcgccgctaagctgccggtcagccgctggcagcgcgacctgactggtgggtgggtggagtgtcgttggatggggaacatggggggggtgcttgctgaggggatgaccagccgtgtgaaagcagggacggcaggatcgtggctgcagtaaaccaagccgagcactcgtggggtgccctgccctgctcgagtcggcggtcccggctcgattgccggtgccgccaggcgctcctggtgtctgcaaattcccctccccgcacagctccggaccccccgctgccaccaccgacaaatccaccgcgcgctgcccctcacagactccacggcgctgcgcaacnnnnnnnnnntcgctgccaccaccgacaagtcccgcgcgcaccccctcacagactccacggcgctgcgcaacctgggggtcggcgtgggccactcgctgctggcctactcctctgccctgcgcggcatcggcaagctgcagctggacgctgccaagctggcggccgacctggacgccgcctgggaggtgctggcggagcccatccagaccgtgatgcggcgccacggcgtgccggagccgtatgagaagctgaaggcgttcacgcgcgggaacaccgtgggcaagcagagcatggcggggttcgtgggcggcgtggaggggctgccggcgggtgagtggggggggnnnnnnnnnntaggggagtgttgcgagggagagagagggggggttgggatgcaagggtgtgcttggggccgtgcatttggatgttttctgtggggcgacgccccggctcccagtggggnnnnnnnnnngaatgttgtgagggagagagaggggggtttgggatgcaagggtgtgcttggggcaatgcatttggatgtttcttgtggggcgacgccccggctcccagtgggggccctgctcgtttgcagccgccagcccggcctctctgctgcaaggtgaccctcaacccccccacatccttggaaccctgcgcgtgcagatgcgcgggagaggctgctggagttgtccccggggacgtacatcggcaacgcccaggcccaggccctggacctcaccgctcggctgcgggccctcagccgccgagcctgagcggcatcgcgccccggcaccgcccctccaccgcaccccccgcccctgctgctcgtctgtgtcggtttacatccatcggcaaggggtcacctatcaagtgctggagatcaggttccgagggggtgcaaggtgggagagacagagacttgctagttgctggggagaggaagaggcctggctggctggctggccagatggaatggggcctgttctaataagggggaagggtgtcaatgtggggggaaagagagaggcagggatgaagtgggaaggagagcttctctgatctgcaacagcatggggatcggcacgtgattccaacccgtgggggaagagtggcagggggggggggggggggggnnnnnnnnnnaaaagatcaatgcggacagtgcatgggcccccacaccggcaaggcaaggcttgacgcggagatnnnnnnnnnnaagatcaatgcggacagtgcatggccccccccaccggcaaggcaaggcttgacgcggagattgggttcagggggggggatcagacgagggcaaggccctgcccgcgtcgccatcgcggccaggtgagcgctgcgcccagcaggggttggggaaaatcccggcaaggatgagaggaccttgcagcaagcacaggggggcggtcccactggaggcgtgggaggggaggcatcagaagactcgtggctgggatcaatcaaatacaatccagaaggtgaggagggggccaataggcgccctgacgggggtggcacggggcgaggcctcctcagctccgtagacaagtagaagggttggcagggatgtggtaggggacaggcctgacgagggaagcttgcacgggccccttgcctgggagaacgctggtctagagnnnnnnnnnnaaggcctcctcagctccatagacaagtagaaggattggcagggatgtggtaggggacaggccagacgagggaagcttgcacggcccccttgcctgggagaacgctggtctagagggccgagggagggcacctgggccaggaccccctctgcagggatgcgagggcagcgtcggcgggggcggcgccccggctggcgggcacgcctggcccgacatcggggctgttgctctgcacgctccaggactccggggggaagcggcgcgcagtgcctgctgaggtttgggacgggccgcggttcctgagccagccgcaccccctcgccgggggacaggccctggtgggtgaccagccgttgcccgcgtcgcacgcaggcgcccacagacatcggacacaccacactcacccggcagcgacaggcnnnnnnnnnnatgcccgcgtcacacgcaggcgctcacagacatcaaacacaccacactcacccggcagcgacaggctctctggtatgtccagcccacgactcgaccccaggccgcggccgcactcggtgtcgaggagggcctccggcccaagcgagggcggcgtggccgcccgacccgctgcgccaacatgcggcgggccctgctggccgcccgggccaggcgcgcggaggagggcctccagggcggcctgggtgttgcgctgcgcctgggtggtgggcaggtacagctcctgcacccgcctcagtccgttgaggtactcggccgcagggtgcaccgtctcctgccccacaggatactggtgctgctgctgcagcgccgcccccggtgcgtagaagggcctggcgcccgggccctgggctgcgccgtggcctggcatcgggccatgccccgggcgcacggggggtgggggcacggcgccctgtggtgtgaggggcggtggagcctctgagggggtagtgcagtaaggcgccctgccggggccgggtctgcgccgggacgatcgcgtcgctcggnnnnnnnnnnatagaagggcccggcgaccgggccctgagctgcgccgtggcctgtcatcgggccatgccccgggcgcacgggggttgggggcacggcgccctgtggcgcgaggggcagtggagtctctgagggggtggtgcaggagggcgccctgctggggccaggtctgcgccgggacgatcgcgtcgctcggcccccagggcgctgggtgccacggatccaacccctgcatccagggctttcaggtcacgcgtggcccatcccctctcacgcaccatggtcgacgtcattgcgagcagttgagccagctgctgtatctccagcaggttccccgccggcacgggagcgtgtgcactgccaaacagcccgtctgagacgccgtagtgggggtggcgggacatgggaggggccccgcccccannnnnnnnnngcggaaacgtgtgcactgccaaacagcctgtctgagacgccgtagtggggctggcgggacatgggaggggccccgcccccacgctcgagctggcagcaaggcgcgctggcgtgcttctcacggtagtaggcattgcgatcctccacggccgtcagcgattttatggggtgcccgcagatgttcaggggggacccggtcagggcagccctgaggccctgctcagcagaaagtggaggaggggcggttgatgggctgaaagccgcaggaaaatgacctgcaaccatgacccagtgccggctcccatgccaggcactccaggggtgttcggtggggtggaagtgttcggcggggtgggggaggcggcggaggattatgagcggcagcccaccagtcccagcccactccccaggatcctgggcctcccaaaatgcgcatatgccgaggaaaatgagtgaacgtacagacacctcgtacctcgatggttgcaaacgtgacgaagcagaaagggcggcgcttgagggtcttcttgtgtctggggaagtaaacatctgtcacagggccccactgggagaaatgggccttcacagccatctcatccacttcctgcatcggggaagggtgtatggggcacagcggcgtgagctcggagaggttttaggagcgctccggcgctgcccaagcgaccggtaatccagaagctcatccagattcgcacccgcgcacgcacctttgggacgtgcccgcaaaacaagcggggaccattgcctttcccccctgaaatcgagccgaggtccataaaagaaccgggtaatgtcatttctgccggctgtggtagctgcgcgagggagggtacgtccaggggaagggggtgagggtcagccgaagttggtagcaggcaggatcgagtcgccccaaagggatgcgggggcgctgtctcgtcgactctgaccaatgaggccgcgtattgtgggagtcaaacttcgaatggtcacagcccccgtacgacagtgggtctcaagtttttcttgccgagggtgctgctcacgtgccctctgcgagatgcgtcccctctcccttacgcacccgagtgcccggcaggagaagctgaggggttctcaggttcgacatgtcgactgaatacatcgtcgacgaccagaacatccttggaagatgcctcaagtccagatgcagcttgcgcgaggttatttaggaaagccctgtcgacgagggcgaggcattactcgtgcaggggccacgatccttcaggcaaaccctcgcagacgagctgccatgtctcagatcacgccactagcattatacgggaacatgcagagtgtggcgatcgttagtatgaattgtcgagcttctgcacgctttcctaaatgaggtcgagcggcacttctgctgcgcggaggtttgtgtggcttagatgctgacgtccgctttggcacgtgggagtacggcaggctgacaccggtcgaccgatgggcagctatcatacatcatattaaagccgatggctctcgagttggaattgcagattcccaggagacccggcggaggtgtctccctgtttcagtgtagcaatgactgtcgtaacggtcagggttttacatcccattaccaccccattaccgcggcccgcagcattctctcgagcgggctccgaagcttcacactgacccacccggcatcgtgcatcgcatcgattctgcgattgtgacccatcttcgtatttaaaattgtacctgcatggtctggggcgggagttttagaccggtgtgaccaacctccagcagctatggaaggggtgcgccaaggacttgcgtcactacaccgacgctaccctggataacgaagtaacacgcatgcagtacagcgagccaatcaacaaattgtagtactctcggtgtcaaatcatcgcccgacccccgcattgtgggctgaccaggttcatttcctgtaccttccctgaagaatccagttggggtaagagggatcgcgtgatccaaaccgcggcaagtttcctgactgtaacacagcctacgagagatgctgttgttgagggtgtttttatttaccgatgcgctgaggaaggtttttgcacagcacccaaattactcaccatgcccaacactccatatcatgcgtatcacgttcatccactcgccaaacggcccatgcaaggagtgcagcggaacttccgagcttcggaggtataacgtcgtagtcacacgttttgtattatcaagtctcacgattccgagattgtaaccgtgacgttgagctctcgggcagtctgtgtatgtatcgctgagagagcgagcatcccaacactgcattagctcgggctggttcaagatgtacttcaagtcgagctgaaattgtaattgtcatgtctctggcgtagagcaccaaacacctctgctgcacccggcgaggcgatgcccacctctctcctgcgccccttgcgcctcctgtcccggcctttcacggcggcatgcaagagcatgcgaacggatggtacgtctcgggcgggaatctgcggccgagtaaggccccgatgtccattgtccggcctgtgcttcctcagcggggtccctgtcgccttcccgttgcatgggctcgcaccacagccccgcccctccgcacctcgcctcacaggtctgcgggccacctcccggccccatcgccccgccaactccagcaggcttcctgagtcagtcctacggaggcctggcaaccctgccctgccacccaccgaccctcgggccggccgcgctatcgccggcacctgcctgcgctcgcgctcggggccccaccagacggccgctaccgcgctgcctggccgccagcccggctgcgaacctcgccaggcgcccatgtcttgcgcgggaagacctgcacgtggtccttctcccttgagcaggatccccccgcggccgcacggcggccatgccacccccctccccgccctccccgccgccgggccgcgaccgggcgccgcgcccggccccggcgctgcgtcgcgaccctttcccccccccagccccacggggcggcggctggagctgggcgccgcggggagcgaggtgatgcagtccaacaccgccggcttgcagctgctgacgctgagccgcggcgccgctgcgccgcccatggccatggtcgcgcgcacgcagcaggagacctggctgctggggtgtggggaggatgcgcagcgcggcgtcatgacccagccctgcgtgcacaccgccaaggtggaccgggtgctggtgccttcgctgggcggcgagagcgtgctggggctgccgggcatgctctgcaccatctcctccggccgccagcacggccacgagtggtccgacttccccgtgcacgtatacggcccgcccggcaccctggagttcctcgagtgagacggcgtcgaggggagaggtggggaaccctctggagtacgcgcccaacatgctgtgcaggcaggcgggtgaaaaggggtccaaggccgcgctgctggccatgctaacctgcacaagcagcgccatcgtcgttggggcccagcaagccgtggccaccccccgcgccaccttcctcccagcatctttgaacccccccccgtccccttcctttcctcccgcagtacaatgctggcggtgtccaggacctacctcnnnnnnnnnngtccccttcctttcctcctgcagcacaatgctggcggtgtccaggacctacctccagatgccggtgttggtgcacgagctggtgccaggacccgtcgcccgcccggagccgacgctggtcaatgcgcgcgccaggctctacggcgtctccgtgccccccgacctctgcaaccccagggggtgcgaggggtcggcagttggcctcgtggatcacttcatggggggaggggtgccgtgaaggagcgcgcgcagcgaggagcagaggggccagagcctggcaggccacctgccagcgcaaaccattccgccgttgaaaaacccattccgccccgcacccgcaggtactctgannnnnnnnnncgcaagcgcaaaccattctccccgtcgacaaacacattccgccccgcacccgcaggtactctgacgcggagatgactgccctcctgcagcggaccgctgtggtgggcagccaggccaagcgcgacgagaggagcgggtgccttcccctgcccctccctcccccgggtgagcgggtctgggggttccatggggtactgcggtgggctcggagtcggaaggggtgggcggaggacgggcaggcacgtcgccgatgatcggaggaggggtctttggctggtagaaggagcgagggcagcgctgagttgaatgcagaggctgtgtgctcgaggtgcccttgagacggactgcagcaggcgcagcccagcctgggaggcaggggccgtgtagcactggcttgtggaggctccacagnnnnnnnnnncgagacggactgcagcgggcgccgcccagcctgggaggcaggggctgtgtagcactggcttgtggaggctccacagcatgtcgggccagggaccaggccgtgtgccccacatgcgctgctttcctgcgcctgtgaggcccagagtaccccctcccttcttccttcccacccgacaggcgacccatctgccgtggtcggccagctgtcggacctgcagtggaccatcagggccagcgccgaggcggccatcgtggcgcgtgccgcgcaggccgccccgcaccagcgcctgtccttcctcatccacgaggccgacaagtgcgcggggcgcggatgctctgctggcgtgggtcactgccgcggagcctgggtctgagggtctggaccctgttcccctagcgggcgctgtggggcatgctttccccggcaatgcacccgagacctcgtccacgtgccagtctccccgtggcttgcattttctcggcccctggggccccaaatctcacagaaccctgcttgaacacccagacccctttcaaatgatcctgaacctccgcaggacgggccacctggacgtggaaaaggcgctggcgctgggcgtggcccgcggcccaggcttcggcgagctcaaggcggggcgtgcggtgcgcacggcggctggcacgacggtcacacctgaccaggtgctgggcgccagcctgagagggcgcagggtcttgatcctggacgacgctgcgctcgaaggccccggccgtggcctgctcccggtgctgcgtgggagcgcgggggaggaggaccccccggagccctgcgacgtgatggtggccagcctccgggggctgggcgcggggggccgggcgctgcaggacgccgcgcgggccgtggcggccacggcgcggctggcgcgcgcggaggaggtcatcgtgtggccgcgcgacgccggcaccacggccgccctggtcggcggggagggcgggcgcgccgtcctcaggttagccgccggtgtgcccagggccgcccgcgtgcactgcgatttgtggcgaagatgcctcctttcacctgcatgcgcggcattcctgcagtctgcctgaatattcaaacgccnnnnnnnnnngcggccgccctggtcggcgacgagggcgggcgcgtcttcctcaggttagccgccggtgtgcccggggccgcccgcgtgcgctgcgatttgtgttgaagatgcctcctcccacctgcatgcgcggcactcctgcagtctgcctgaatattcaaacgcctcacacgccaccccccgcctttgctgcgcagggcgatttcggcggcctctggtctgcccgtgtgcctggcaggagcccatgacctgcacgacatccagcgcaagccccgcacgcgatgaaaacatgttgtgtttctgcagggaagtgagcctgatgaaggtgtcacctgtatgacaacggctcctggtgctttgcagcccaggagggtgggttgagtgagaagcgaaggcgaggggaagctcaactcaccaaaccccattcacgcgccccaannnnnnnnnnccacctgtatgacaacggctcctagtgctttgcagcccacgagggtgggttgggtgagaagcgaaggcgaggggaagcttaactcaccaaaccccattcacgcgccccaannnnnnnnnngcaccttactgcgcttcatacccataaactcatcgactaaattcaccgttgtgggcctccagcatggcannnnnnnnnnaacaaccgacccggccatgtaaaacgtggttccaggaccccgtaacagcacataaaccttactgcgcttcacacccataaactcatcgactgaattcaccgttgtgggcctccagcatggcatccaacggcgcagcgaacgcacgggtgagcttgggccctgcgcacgtgctctgcccatatccccgctggaagactgctggcagcggtgacacccctccccctcccccaaaatttccgcaggaggctgcaataaaggctaggtcggcctccaggcagctccaggccctgaagtcggaggaccgggtggccttgctggacgccattgccgacaccctggtggcgcacacggacgacatcctcgcggccaatgcccaggacgtcgagtccgccaccggaaagattaccgactccctgctgcagcgcctcatcctgaagcccgcgaagatctcgcagctggcaggtgctatatttttgggggtcactgagggcctggccttcattgtatgagcagtgacctttcctcacgccctggacctggtcacctctgatagtaccttccagcactcacaacgtgcatattcaacacccctccagacggcattcgatccatcgggcgccaggacgagccgttgggccgcgtcatcagcgccacccagatcgccgaggacctggagctgcgcaagatctcggtccccatcggcgtcctgctcatcatatttgaggcccgccctgacgcacttccccagatcgtgtccctggccatccggtccggcaatggcctcctcctcaaggcgagtggaggcgaatgaggcgtgtatgtatttttttggggggggggggcttcgggccagtctggtcttgctgcagtaggtcgatgtgactgcctctgaaaagctccagagctgaagggcggctgcacttgccctgcctgggaaaacgtggtattcaccagatgccactcagggatcctgcatggtcttccctcccgcctggttgccgcctgagttttggatccctatctcgaccacccttccaaatgccgctccgcaggggggcaaggaggcggcccactccaacgccatcctccacaggctgatcagcgaggtgttggacgccagggcccccagcgtgggctccggcctcgtctccctggtcacctcccgcgacgacattgatgccctgctgaagttggatgacgtgattgatctcgtcatcccccgcggcgggaacgccctggtgaggctcaagcttgagatttggtgggggctgggatgggaggggcaagccagtggcctttcgtggcccttgcttggggcccggggacaaggggagcgcgtccccggcggggggagagtgggtggcactgcccttaatgatgccgctgccttgcctccatgctcccacccccgactccaccattgagcgctccatccccgcaccctccatcaccactnnnnnnnnnncgccttgcctccgtgctcccaccccccactccaccattgaacgctccatccccgcaccctccatcaccactcgcgcaggtgtcccacatccagcgctccacccgcatcccagtgctgggccatgctgacggcatctgccacgtgtacgtcgacgccgaggccgacccggccaaggcgctggccatcgccgtggactccaaggccgactaccccgccgcctgcaatgcggccgagaccatcctggtgcatgcatcgctggccgacggcctggcgcgggagctgctggaggcgctgaagggcgctggcgtggccgtgcacgccgggccgcgggccgccgagcggtacgggctggaaagggcggcgtcgctgcgccacgaatactcctcgctggacgtcgggtttgagctggtggacgacctggccgccgcgatcgaccacattcacgcccacggcagctcccacaccgaggtggtggtcacaggtagcagagttggggttgaggagaggcaggggttgggaggaggtgggggagactttggggaaaagggggtggtggaggagaatggagagccccggtgcacagcaagggcgcnnnnnnnnnnacaggggttggaaggaggtgggggagactttgggggaaaggggggggtggaggaggatggagagccccggtgcacagcaagggcgcttggattatcatgtcgctggcacgctgcgcatggggagcttgataagctgaagcatggacaagggcaggtgtgacggacttccaagtatatcgtcatttccctccaacagagaaccaagcgactgctgacaccttcctccagctggtggacgcggcgtgtgtgcaccacaacgcctcctcccgcttctcggacggctttagatacggcctgggcgcagaggtgggtgggctgacgacgggcggagggggtggggtgctggtgggggcaaggtgggtgccggtcaggcagacgcattcctctcaccggtgtgcatgaaattggtttgcacctggccccggcccttccctgaatccaacctcgacctttccaaaaacttgttgtaggtgggcatcagtacggggcggatccacgcccgtggacccgtgggcgtggagggcctgctcaccaccaagtttgtgctcaggggcacgggccaggtcgtgaacaaggaccagggcgtcaagtacacccatgtcgcacgcgacccccaaaaattggcatgatccggcgcctctgtgtgtacatcctttaaaaacccttgttccagattgtaatcgttgcgcagcctgtgtccggcattcgctccatgcgatggtgcgtggaaatagtgcgggctatggtttccatgatcactcgaacaccatacacttctgctgggcagtgaatggcatcggcgcgaccccaccacgtttgtttggttgcatcattgcagaaggagctgaccgatcgccgtattcgctccgagtcgcggcgctgtgatgaccgtggcggccccctcggctgtgccctctggctccatatggatattcggtgagcaagcctttcttggatggctgcctgaaaagccctgttgcatgtggaggcaagaactccaaaaagcctgtcccctcactccggctggtcaggctttggcagcctcgtccacagccccggcttcgaattcaagggcagggtggaggggttcatccgggggtaccgtagggtgttctggcagggctccacagaccacaggggccatcctggagccccaggccgcgtggcaaccctgcatgaggacccagaagccgtcaccgtgcgtggtggttgaggggtgggtggcctggccgcctgggatggatgtgtgctccgcacattccagtggggagagcagtgttgcaaacatcgaggttgctcaagggggagtgcagcgctcccgcctcctccacgcactcggtcatcagtcatctccaccccgctccccctgcannnnnnnnnnctgcagcgctcccgcctcctccacgcacccgtttatcagtcatctccaccccgctccccctgcactgcacagtggggcgtggcctacgagctggcgggcagccacgaggagcaggagcgcaccctgcactacctggagtggcgggagaagcagtacgacatccggcgccacgtatccgtctgggccgcccccggggacgcccgaccggcggtggaggacgcgctggtgtacatcgcgggccccgacccggggtcaaaccccgactacctgggcccggcgccgctggccacgctggcgcacaccgtggccactgcggaaggcccctccggccccaaccacgtgtacctcttccgcctggccaacgggctgcgcatggtggggtttgaaggaggggcgggaacttcccttgtgggctgcagggggtagaagagaagtcgccagtgaccagatttccgttactctagcaggtgctgtgaatgcgtggatgcacaggaccaactctgccctgccaggggaggccaggattgatggtgcctttttcacacccacccaccgcggaggccccaaccatccttgtgtcacgaccctccaccaatctgtgtgcagctcggcatggatgaccccggggtgtttgagctgnnnnnnnnnngccgcggaggccccaaacatccttgtgtcatgaccctccacaccaatctgtgtgcagcttggcatggatgaccccggggtgtttgagctggaggaggcggtgaaggcccggatggctgagctcggcctcgagtgccagtcgctggaggcaccctccaaccccgcagccgaccacgccgtgtactgggaaagcgtggccaagaagaagggcgaatcggcggacgcctgacagggtcacggcagaggtctggagggtgccagggagcacaaaggcgtcgaccaaggttgaatacaaatggcggcctgctgtgcggcggtcactcctgcgaccatctgcgtcgccccctgtgcacagcctgagtatcatgggcgtgccagcagtgcttcccaccgaaagattcattgtcatgcagtgacttgctgcgtcctgcttccatcgtccattcatagatcccctccattgttgccagctggcttgctctggggtaactggcacttgactacagaatttgaagagccttgcacgactcgtctgcatgggatgcatgcggcaggcatcgacagactacgccccggcagatgcaagacctgacgcggcagggagtcactccggtgtgccactgcaccgccacccctatctcggccccggggcactgacgtcgacacggatcaccacttcaccacctctcgccctcgcggcgtgccgggggcggggccggcctgtcgtcgggccggcgcgggaccctgctgcccgccgcccccgagggctgccacgcgcccgcgcc

SEQ ID NO: 48257 - DNA, 73 bp, Chlorella protothecoides
ttcccgcaggtgcccgacccacaagacagccagcaccgaggttctgctgtcgcgggcggtgtggatcgtcccc

SEQ ID NO: 48258 - DNA, 61 bp, Chlorella protothecoides
agacttggggctcgggctcgggctcttgggactggggctgggagacttggggctcgggctg

SEQ ID NO: 48259 - DNA, 64 bp, Chlorella protothecoides
gctcccaccatgagcgcggcggcggcggcggcggcggcggcgggcccggtggcggttcctcctg

SEQ ID NO: 48260 - DNA, 80 bp, Chlorella protothecoides
gcgctgcagggggccagggtctggggcggggcgccggcgcgggccggtccctcgctcctggtcgagggatggcgggttgc

SEQ ID NO: 48261 - DNA, 61 bp, Chlorella protothecoides
gagggagggagcggagggagcgagggtgtgcttgtattgtgtgagccgcatgttggtgcag

SEQ ID NO: 48262 - DNA, 61 bp, Chlorella protothecoides
gggggccggaggagtgttgaggctggccggtctgactgaccgccgcctgagctgactcttg

SEQ ID NO: 48263 - DNA, 186 bp, Chlorella protothecoides
gcatggatgaagaaatggttgagcattgacaatggacaaagtgctacgaacatttgacgcagagatacagtgcatctgtatagcgcctggtgcctcaacatgtgcatgtccgtcgtccccgagtttctttcaaattcaggcagctcgagtccgcgtcccttcgcactcttcatatgtgacgcacca

SEQ ID NO: 48264 - DNA, 92 bp, Chlorella protothecoides
cgtgagggggtttaagatgttggtgcagggtggccacggagtcattggcgctctgcgagccaccccggcaagcagcaaccccgagccttgca

SEQ ID NO: 48265 - DNA, 61 bp, Chlorella protothecoides
ggcgacgtattggctgcacatgggatggggtggggagagtgtttgcaggtgggcagagccg

SEQ ID NO: 48266 - DNA, 61 bp, Chlorella protothecoides
actgatctgagtgaatactctgatgtgaggaaggatcgatgggtggcatcgtttggggttg

SEQ ID NO: 48267 - DNA, 96 bp, Chlorella protothecoides
caccacctccgctgccttggcggcaccgcctttgctcgtctccgccttggtcttggtgtctgagtccgctgaggcagcctttgccttgggcgtctc

SEQ ID NO: 48268 - DNA, 64 bp, Chlorella protothecoides
gcaagagggttggtacggttggagcgatgcaagatgtcgtgacacagtgcctgcccctgcaggg

SEQ ID NO: 48269 - DNA, 61 bp, Chlorella protothecoides
gtccattcatgagctacagtacccttgtccacccttcgaacgccacgatcacgcacccctg

SEQ ID NO: 48270 - DNA, 61 bp, Chlorella protothecoides
aggtgccggtcatgctcatgccgagggtggggggggtatgcagattgaagatccaccaagc

SEQ ID NO: 48271 - DNA, 78 bp, Chlorella protothecoides
gacaaatacgcagcacagagtatgtagaaagggcgtaggctcctctaggcgagaacgccacgcctggtgcgccactcc

SEQ ID NO: 48272 - DNA, 107 bp, Chlorella protothecoides
gatgctctggttcaagctgcagggtggcaggggtgatgctccaacgacacttgacacacaccttctgcaccccttgactcacctgctggtgaagatgggaggcttga

SEQ ID NO: 48273 - DNA, 61 bp, Chlorella protothecoides
tgcagggcgtggatgggagcatgaaggaggtgtccagcaagtatgcttcaggcatggtgac

SEQ ID NO: 48274 - DNA, 64 bp, Chlorella protothecoides
ggatccatgttttggggagcgaaagcaggtgaaggttatggcacctgccagcctgcagggagtg

SEQ ID NO: 48275 - DNA, 61 bp, Chlorella protothecoides
gcacgattttgtgccagagggcctggcaggtgcagcgcccgtggatcccagcgtccaccta

SEQ ID NO: 48276 - DNA, 63 bp, Chlorella protothecoides
actgccgcactccgggtgagtggtgtcgggttcccgcgtgagaattctccggaaggggagctg

SEQ ID NO: 48277 - DNA, 155 bp, Chlorella protothecoides
tgtgacgatttccagtgtcctccaaaaattgcaatgctggcccgcatgtcgcttggaaatggtgatccttcaataagcattccatctccttctccacacttttgatctgtgagggggtgggctcgtgccgcttctattgtgcttaaactggcagg

SEQ ID NO: 48278 - DNA, 125 bp, Chlorella protothecoides
tgggtggaggaggggggctgggtggaggagggcttgggcttgaaggtgggggaggagacatcttggcggggggcggaggagacttcttgacagggggcggtggagacttcttgacagggggtgga

SEQ ID NO: 48279 - DNA, 61 bp, Chlorella protothecoides
cacctcggcggtgttcacctccaccaggaaggtccccgccgcggtggaggagatgccgatg

SEQ ID NO: 48280 - DNA, 65 bp, Chlorella protothecoides
atgcttcaacacatacacttccataaaacggtcacattgggactcggcatgggtgtcgcgcgatg

SEQ ID NO: 48281 - DNA, 73 bp, Chlorella protothecoides
gagacatcccctggatgcgcaagccttcatgctgcttttcgctatgtcaacattcttaaagctctccttcgcc

SEQ ID NO: 48282 - DNA, 39705 bp, Chlorella protothecoides
  modified_base (995)..(1004): a, c, t, g, unknown or other
  modified_base (2754)..(2763): a, c, t, g, unknown or other
  modified_base (3082)..(3091): a, c, t, g, unknown or other
  modified_base (3326)..(3335): a, c, t, g, unknown or other
  modified_base (3700)..(3709): a, c, t, g, unknown or other
  modified_base (4349)..(4358): a, c, t, g, unknown or other
  modified_base (8547)..(8556): a, c, t, g, unknown or other
  modified_base (9352)..(9361): a, c, t, g, unknown or other
  modified_base (9709)..(9718): a, c, t, g, unknown or other
  modified_base (9931)..(9940): a, c, t, g, unknown or other
  modified_base (10833)..(10842): a, c, t, g, unknown or other
  modified_base (11426)..(11435): a, c, t, g, unknown or other
  modified_base (13227)..(13253): a, c, t, g, unknown or other
  modified_base (13489)..(13498): a, c, t, g, unknown or other
  modified_base (13588)..(13597): a, c, t, g, unknown or other
  modified_base (13687)..(13748): a, c, t, g, unknown or other
  modified_base (15684)..(15693): a, c, t, g, unknown or other
  modified_base (16042)..(16051): a, c, t, g, unknown or other
  modified_base (17677)..(17772): a, c, t, g, unknown or other
  modified_base (18490)..(18499): a, c, t, g, unknown or other
  modified_base (19468)..(19477): a, c, t, g, unknown or other
  modified_base (19887)..(19896): a, c, t, g, unknown or other
  modified_base (20254)..(20263): a, c, t, g, unknown or other
  modified_base (22230)..(22239): a, c, t, g, unknown or other
  modified_base (22291)..(22430): a, c, t, g, unknown or other
  modified_base (23588)..(23597): a, c, t, g, unknown or other
  modified_base (23735)..(23957): a, c, t, g, unknown or other
  modified_base (24271)..(24280): a, c, t, g, unknown or other
  modified_base (27049)..(27058): a, c, t, g, unknown or other
  modified_base (29011)..(29020): a, c, t, g, unknown or other
  modified_base (29428)..(29437): a, c, t, g, unknown or other
  modified_base (31215)..(31224): a, c, t, g, unknown or other
  modified_base (31862)..(31871): a, c, t, g, unknown or other
  modified_base (35165)..(35174): a, c, t, g, unknown or other
  modified_base (35948)..(35957): a, c, t, g, unknown or other
  modified_base (36215)..(36224): a, c, t, g, unknown or other
  modified_base (36658)..(36667): a, c, t, g, unknown or other
  modified_base (36819)..(36834): a, c, t, g, unknown or other
  modified_base (37046)..(37055): a, c, t, g, unknown or other
  modified_base (37371)..(37380): a, c, t, g, unknown or other
  modified_base (37435)..(37444): a, c, t, g, unknown or other
  modified_base (37661)..(37670): a, c, t, g, unknown or other
  modified_base (37764)..(37773): a, c, t, g, unknown or other
  modified_base (37856)..(37865): a, c, t, g, unknown or other
  modified_base (38125)..(38203): a, c, t, g, unknown or other
  modified_base (38874)..(38883): a, c, t, g, unknown or other
  modified_base (39069)..(39078): a, c, t, g, unknown or other
  modified_base (39319)..(39328): a, c, t, g, unknown or other
gggacaccctcttctggttcgcaggtgggacgtaggattggttgtgagggtccggggtctcgagaagatttgtgagggaggcgtggcggctctgcaaccagagccacatcaaccctacccgctcaacaagccccattccccttccatcgcaccccagtcctggtgggcatgtctgggcagctggcatcctttggcatcatctcccactttgccggggcggttggggagaggctggtggccgccaacctcagctggcccgtcgtcttcggcctgctcaacgccgcgtactttgcgctgcactacatgtttgcctcccagaccgcgcatgtgggcgcgctgtatgccgccttcctgggcatgatgcaggtggcgggggtgcccgccgtcctcggggcgctgtccctgggcttcatgagcaacctctttggctccatcacccactttgggtcgggccaggcagccgtgtactacggagcaggtgtgtgggattggtgggggggacctggagagcgactgacaggcttgtgttgtggggcaggggcacagctcctagagctcgagagcattctaatgggaacctgacgatgaaccacgccgtgcgaatgctcctggcgtcctccatccagtccgatggacctgtctcactctctgttcctgcacatcaacatcacaaggctatctggagctgaaggaggtgttcagctacggggccctcatggcggtggtcaacctcctcatctttggcgtggtcggaggggcatggtggaaggtcctgggcctgtactgaggcgccttcctgtccctcacgctttctgtgccagtgagagacgctgtcatgactggttcaggatcaagagtcgaccgagcgggaccaggggcccatgggataggcatgtggtggggtaacatgctgtccatcacacacagactgtggggcgccccgaactccgcatgtgtcgagatcgctcaaatttcgggcccgagggactcacggnnnnnnnnnngctgtggggcgccccgaattccgcatgtgtcgagattgctcaaatttcgggcccgagggactcacggccagaaatcgtgacgctgcaaattccaagttttgatctgcgacactgatcaataatctacagaccactcgggatctcctcgtgtgattcagtcccagtctgcgcacccctggtggccagggaggagaccgcccgggcgcccatgccgcggtgcaccacccggccgctagcattacccgatctatcacgagatgcctgcattgtttcacgaggccatggcgaagctgccgcccgaggaccagctggtgatcgagcaggtcagagggcttctgggggtggtcctgtccctgtccatattcgattctcgctgggccacgcccgccgcgatcacgcactcccaacccctcacctcacatctcaggtccgatcccgcatggccgcctcccgctcccgcctgaccctcttctcctcccccttacccacctgcctggcgtttggcaagagcttggctgacgcgggctggcgcggcgtgcgctggctcacctcccaccgcctcttcctgggcctgggcgtcccgctcatcgccgcgtacctggcgctcagggtcgcggggttggcctcgggggcgctgggcgaggcggaggcctggctgcagtacgccgtgtggtgggtgggcctgggcgtgctctcctccatcggcctgggcaccggcatgcactctggcctcctcttcctcttcccccacatcctcaaggtagcctgcgtgccgtgtggtggggtccgtcaggggggcgtgcaggctgtgtcagcgcatgcattgtatgctctggttccggaggtggcggatgctggcatggaatcgccgggcgccaggatttacttgcctgccgccttcgacactcgtcccaaacggctcattgttaccacccgcccggcctgattcccgctttccaccccctttccccccacccctctcaggtgtgcctggcggccgagcagtgcgggcacctgcgcttcgacgcgcggggcgacacctggtcctccagcgagggcttccactgcggcgcgcaccctcccggccccgtgggcttctgggatgtgttctggaaggtgatcggcacctgcgtgctgtggggctgcggcaccgctctgggcgagatcccgccctacgccatctcctaccacgccgcacgcctgggcgagcgcagcgccgaggtggaggccatgctgggcggcgccggggtgggccccggcgcccccgccacggcggtggccgacccggccaaggcgcgcgacccgctggcggccctggtggcggccatgaagaactggatgctgcgcttcatccagcgccacggcttctggggcatcctggcgctggcggcctaccccaacgcggccttcgacctctgcggcatcacctgcggccacttcctcatgcccttctgggagttctttggggccacgctgctgggcaagggcgtgatcaaggtggcggggcagaccgccttcttcgtggccctgttccgggaaggcacccgggagcgcgcctttgcggccatcgaggcggccaccccggcccgcctgcccttcctggctccgggcccgggcggcgccacgcctgcgcaggtgctgcacgccgtcgtcaacgcccgcatcgccgccttccaggagggcgtggccgcgcgtgccgctgcgccgcccagcgtgcgctcctgggccgcgcgcctgcgcggcgcggcgnnnnnnnnnnactcacaagtcttcccgagacccaggatcctcacaaccaatcccacctcccacctgcgaaccagaagagggtgtcccaagcggccgggtgcccgatgcaatccctccacgtcagcacccccgtggagaggagggcgcagaggcccagcatggccgtcacaactgcactgatgcccaacatgtccccagccacctggggcggcggtgagatggggttgcatcgtacacgagcattacccttatgtgtttgcatggaaagtgatgggcgccctagggtttgtagggacaaaggacccaagcaccagcagtggccaccacgnnnnnnnnnngtaccctcatgtgtttgcatggaaagtgatgggcgctctagggtttgtagggacagaggacccaagcaccagcagtggccaccacggggtgtactcgaatgctcaagcatgccctggcaccccaagagccacatcacgaacagttccacacacaagccctgtccacagcagggtgaatcgccgtgagcagacctccccttctggaagcaaatcagacatccacacgcacaagacnnnnnnnnnntcacagcagggtaaatcgccgtgagcagacctccccttctaaaagcaaatcagacatccacacgcacaagacctcccacttacccagaggcagaccgcggctcccatggtggccagcatgatcctctcgttggtggacatgggtcccatcctcgtcagctgctcttgcgccagctgcagcagaatgacaaagttgaggcacttggacccaggcaggggcgttttgtgggctgcgaccagactctgggccccatgccctgcgaacaacctcactactggacacccatccaggcatgcacgttagctttcccatgcccacgatcgcctccacccctggcaacagcctcacctttggggcctcgggtnnnnnnnnnnattagctttcccacgcccacaatcgcctccaccccaggcaacagcctcacctttggggcctcgggtgtgtcctttacagaaggggggaacagcttgtacatgatcaggggtgtgagcagcagaccggtcagggctgggagcgatgcggcctgcacaggaatgggagcgttctgatgagatgtttgctgtcgcagggcatgggggagctcgcagcatcgtgtggatggcagcacaccccacacactgccgcgcccgcgagtgccacccctccacttgccttgaaccaggtggtccaggcgctgggcacgaccacccctaactcggccgccagcttcatgcatagcaggttctgggcagctgccgtgagaaacagggccgaggagcaggtggagccctgcagctggttcatcaccaggaaggcccccagcttgcgccgggagggcgtgtctgcagggagggatgggggacaccaaggggtcgagatcgtcctgggatggattgcggggctggagaaacgccaggcagggacgagacagtgaccctctgtacattcaggtcaccagaacatgttcctgtttggtgtgcggcggcgtctagagcgctctggaccaacacaagcaacatgctaggctcgcgccgnnnnnnnnnngcgagacagtgaccctttgtacattcaggtcaccaaaacgtgttcctgttcggtgtgcggcggcgcctagagcgctctggatcaacacaagcaacatgctaggctcgcgccggggcgagccacagtcatgtagccacggcagccatcgcgctccacccatagtcccccgtgcccaatgaccaactcactgggcttgctgtctgcctgctgggagagcgaggcgatgatgggcatgaagatgccgccggcacgcgcggtggtggacggcatggctggggcgatgacggcctcggcagctgacagtccgtacgccagtcccaacgtggacttgcctgcgggtcaacatggttgatggaccggctggggcaccaaagaagcactctctgcgacaggtattttggacgccgtgataagtacagatccagggaacagcatcagggcctctcctcaccaaaaaacttgacgaagatggtggcgacccgctggccaagtcccgtcttctcaaagccctgccgacagatgtgcagccgggatgtgtgtgtgtgtgtgtgtgtgtaagggcgcaagggtggatgggtggtgtaacccttctggaacaggggtccacgaaacctcgccagcctggctggaggcaccctgttgcggggtactcccgccttcctctcttccccctttcctatcccaatgccgcctattccagggcaccttatcctacatcacctgtctcccagaagcgatcggggacagttgtaagaactctatctcagaaagtacggcatctgttcccattacggtggcatagcacctgccccgcaacagtccccccacccttgcgttcatccctgctctgccgacggtcccgcacacgaggcagttctggagcagaactttcgcaccttggcaaagaagaaagacaccacgatgagccagatgacgtcgttggtgaatgcggtgaaggcctgtgcaaaggtgagcgtcttggtggccaccgcggtcgtcacgcccaggaaagcccaggccccaacagggagcggctccaggacgaggcctgggacgggagtggagcagagagggtcatggcttgagtgtcccagccagcacctaagtgcagcagctgcgcaatgcaccagattctgggaattgcacgcatgtccgtgccacactccgctgcacccgccccagcataacgacctgcaatggtgctgacaaagatggacagcagcgtccaggcttgcagagagatctcaggggggatgggcaccaggaagcggacggccaggccgaggccgatggatgccagcatcggcaccggctttgcaccctgaacatgagtgcacggaggtgggggggtgggtaaagccggccaggcacgcagattggggaggaatttgggaattcattgagcagatgattgcaagaacatcgcaggagaggcactgaaggcaacaagtgctgctaagcgctcattggcaccatctttcgcccgcctccagggtgccctcctcagtacctgccaagcccgaggctcggacggactcgcgaccgagccgccggccgaggctgaggctgaggccaggagtggcagtgtgtgatcacgcacaacctccatggggtggtagatggggctcatcctcccgcgcctggcgggtccgaaccctagcctgcggtaagcataacagcacgactcgagtggtgaaggcgtggcttcatcccatcggaaaggcacccaggaacctacttatttgtagtactgaggaagtttgtgaaggcccgctgctgtgccctgcagccggaggtcacgaggcaccgcggagggcgcgcggcaggtcggctgctgcccagtccgagacactggatggctggcattgtgccttcctaatggtagtaatgagcacgatatacagctacagacctgggatcggaagagactggcccaaagtccgcatggtggagctaaggccatcgggttaagtggtcgccccacgcaggcgcagcagggatggactggattctggatgcagctgatcaacccctgccaacaagcaccgatgtttttcgatgaccttccagtatggtttagactggaggccgcgcgatcgagccgaaatagcaaagtcttcgaggacggcgagcaaggtgcccagttccgcaaccttggtgacagggccgcaggcaatctaccgggcctgacggtcgtcaatagtctctaatccatattgcgagacggtaaactaatagtctctgaattctgcaaccaaggggctggtttcccttcatgctgtcgcatccgcagcgtctaagcacctgtttcacagcacgccaagctccccccgctcgtgcccgcaacaccctcgtccccagggtgcgtaccttcgtgtcatggacataagaacacactttcttctgcgcatacgattgcgcgtgctgctcccaatgagtgtggtgtataagatggattaacaccgctgcttaagggataccactctgtcggctacatcgcaggttggcaggaggcctttccgcaggactgcaaaagcctttgctgcggccggggccgcgcccagtgcatcatccgacgaccctgccgaggagaaggtatccttggaaactgcgctgcgagaagcccaggaagccctgactttcgttgaggagttccagggtcaggttacctccctccccagcgcacgcctgcccacgacggtgaggagaaagggactggggatctgtgtgagaaaccctgctcacggctttctttctgcatgcagctgtgtggtagaggtaggtgcaatgcggtcagcacgccaggctggcatggcacggcagctgtcttcacagcacatcagctctccctgcatctccccgcacacacctttggataagaaacccccacccacccacctctgctgcccccagctagacatggttttagccaagctgaagcccgtgtttcaggtcgccggcctggtggcgctgtgcgccgccatccacgctctgggcatccccggtcgcctggtcggcggcctgaccctggcgctgtcggccgcctcctggggcctgtcccggggttccctggaccgctccggcgcggcagctgcggtggtggtgggctggatcaccatcgccacctccatgaccggcggcctgctcctcctcaccttcttcgtggcctcctccaagctcaccgcgctgtgcgaccacgagaaggagctggacgacgaccacaagcccggcggcaaccgcgactggacccaggtcctgtccaactccgccgtgcccaccgcgctgctggcggccgccgcggcgctgggcaccgctcccacgctgggcccgcgccacctggcggcgctgcatgcggccgtgctgggctactacgcctgctgctgcggcgacacctgggcctcggagatcggccagttgtccgacgcgcagccgcgcctgccctggggccggcccgtgcgcccggggacaaacgggggcgtcacgctgctgggcaccgccgccagcgccgcgggtgggctcttcatgggcgccatggccgccgtcggctgcctggtcaggccgggcagggcctggggctgggccgcgcccacggggcccctgtggggcgtgctcctgatgggtgagtgggtcagacagaaatgtgtgttgtttgggtggggtggaggggggacctgggggagaagggtcggcggaggcggttgcagtggggaggcagctggtctgtgctgccgcatcccttgggcgccggagttgccggcgtctgtgctccaggtgcaccccggccagcaccaccagatgaactctcaatcctgtaccctgcgcatcccctcaatctaccccaccccaaccctcgccgtccctgcatcgcgctccaggcctcgtggcaggcgtcgggggctccttcctggactccatcctgggcgccaccgtgcagttcacggggtacaaccgggacacacacaaggtgacgagccagacgggggagcacatctccttcattgccggccggccctggctgagcaacagcggggtcaatgtagcctcggcctgcggcaccgcgctggcctgcgcagcagccacgctggtctgggcagtgtgagggctgtgggggcgaggacgtgcacattggcatgagcctggtgggaggtggtatgacacctgagcatgcacgagccttttggcactatgnnnnnnnnnncgggggctaggacatgcacattggcatgagcctggtcggaggtggtatgacatctgagcatgcacgagccttttggcactatggagccggcttgtgagttgtttcttcccggcgccagcaggaagtgggggtgaatgtcaagtgtcagagtggtgatgtggatgtgcggttgctgcactggggctgccgagacgacgaggcccgagccctagcgcttcgtaaggagttacgttcgaacaccgccgcacgctaccatcacatcatccccctcatcacaggacgtgggtacttgttgcgtctcaacgaatatttgaacttgtgcaaatttggcacttgaacccttgcgctgcgctcgagaagcgccgaggggaggcgagacccgacgaaaccctggtgctcgccggctcgacgcaagcttcctgatcacacccgagaaccccggacacgattacgcaccgtcgttccctggcatgggaatcagcttttccaagcgggcgtggcgcgcacagcatttgccggacaccgagtttgccgcggagggcgaggacacgagcacggtcaacaccaagcggctggccagattcatcaagcagggcttcctggccccaatatggtctcgagaaggagaggaagacccagagaatgtgagtgtgctgtgcagatcgcggggaaggccggtgctgtaagggaccgcatgcattggaatgtcatggagccaggtcctcctccgggggcatgttgactcggccctggccggagtccaaatcgagcgtgccctgtgtatgtgtcattcttnnnnnnnnnntctggggcatgttgactcggccctggcaggagtccagctcgagcgtgccctgtgtatgtgtcattcttcgcagtataccgctcacacgtggcctgcttgccagccgcccacccatggcccctccacacaacactcccaccctgcaggaccatgagtgccccatctgcttccatcactttcccaccctcaacagcaccacatgctgcaatcagagcatatgcacggaatgtttcctcaaagtgagtgtgggggtggagtttggggtcagtgtgagccagctgtgtgggggcagctttcacagatgttacagtttgagatgggaggctggcatcttccgtcaggctccgnnnnnnnnnncagccaggtgtgtggaggcagctttcacagatgttacagtttgaggtgggaggctggcatcttccgtcaggctccgggacaaacacagattgcatcgtacaccagaacacggtcatgcacataccgttctcataagctcctcccctccccccccttccctcttacagctcgtccaaccccagcctggaggttcacggtatggcagcccctgcnnnnnnnnnnccaccagaacacggtcatgcgcataccattctcattagctcctcccctccccccccttccctcgtacagctcgtccaaccccaccctggaggttcacggtatggcagcccctgccccttctgcaacaaggttgggttccacgtgtactactcgcccatggcgctgagtcagcgcaagcagctggaggccgaggagcagatgcgcgtgagcgagacccagctacgctccatgctggtgcggaggaccgtttgctgacacatgcatgctgtgggtggggtggggtggggttgggggggcatggctgagctgaccgcagaggtcataccatattctgatcgtcctctgcgtcgggcgggctccatcttattggaccccatgcccccatgcacaggagcgccaggccacaaattcctcaccaacctaccccgccggcacgcccccgtctgtggtgctgcgcatcagcccctcccagaaacccgagtgggagtcgtggccggaggccaccccggccgcccctatgcaagacggaagcactgacgagggggcatccgtccgcgaccccggcgccgcgccattggccgagcacgtcggcctcgggcaggtgctggccgcccccacggctgccgtgctggcgaggcaggtccagcccgggccggggcccgagtccgtcggggtgtcccatcgccggcacaggagctggggccccagccccagcgtcgctcgctgcacgcccgtgctgcaccgtcagagtgtgggttggcaccagctgacggggcacggttccaatgcctcgctggcgggcctcgcctcggcctcctccctgggggggatcgaatctgccgcctccgtccaggacgcgggcgcgctggaggagctcctcgagcgggaaagcnnnnnnnnnntgcctcctcccttggggggattgagtctgccgcctccgtccaggacgcgggtgcgctggaggagctcctcgagcgggaaagcaggccggcaggcggggaggacgctgtggcccgctgtggaatgtctggcggcactgaagacgcagcagccgcagcccgcgacagcggcgtcccgccggcaagccatgcgtccacctgccagtttcccaccctgcagcctggccctgcggagtccttcacgctccatcaaaccttgagggcgggcatggccctgcaggagcccgccgacgccacgcccgacgtgccgcatgatgtgcaagtgtccgccgcatttgaccccggccgggggggggccgtggtggtggtggacccggatggatccagcctgctgtatctcctcacctgcgatgccctgccggaggaggaaagggcggcgctggccgctgctgccgacgcagtgctgacgccccaggggctgaccacctacaatgtgagtcttgaaaggctggaatggcaccccccttgcactgagatgtggtcacagctgggcccggccggcctgctgggagtttgtgcatgcagcnnnnnnnnnngatggcacccccccatgcactgagatgtggtcacagctgggccccgccggcctgctgggagtttgtgcatgcagcgactgcttgggacattaacacaaaggtctggcctcccacactccgctttcctttccaaatgcacaaaaggcaccggtgagcgcgtacgacgacgctctgcgggccagcattgcgcgagcggatgccctcttgctggcaaggacggcggccagctctagccaaccgggccccgatcctgcggcagccgaccctgtcggctggctggaaaggatggctgcggcagatgcagctctcagagccagcgtggaaggctccgaccgcgcgctcttcaagcctcaatagcttgctgggcacgtgtatttaagccagggctggagctctgtcatcgttgtacttcttgtgtatgtattggcaagccctgctcatggacgtggagcttctctgggtactcatcttgatgcatgtatgagactggcattgagccaggatcacctgcagggtatttttgctggccataggatatctccccttgttcacaccccatccccaagtgccttgtgagtggcgcgagacggcgtgcatgagaacatagtgcattcttttatattcggagatcagctaacagcaaggagttgcagacaggggatgcactcacaagtgttggtgccagggggagatgctcctgacctccaaacagcgacatcatcaatgaccctgggacaacgcaatgagtggagctccggctatccgataacgcattcatcagatgctgccagacttgggtgccctgattcccaaggactgcagcacatgctcatactttggtcggtcggtagactgcaggtagaggaggagctgcttgcggcgcgacaggacctgcatcaagcctctccgcgaggcgtagtccttcttgtgctcctgcagatggacggtcagctgggcgaccctcgcggtcaggcgggcgatctggacctcagacgacccactgtcggtgggactcctctggaaggcagggaccctgctcaggtcagtgcccttgccgcggtagcgagcactgcatgggaagtgtggggtgcaggacttgaacagaataacctccgcgctccgataccgtgcgtttcctggcaatccaggaagtcagacgcacgctactcacggacgtgcgagtgttaagagttgaatatgcgtacctgatctggagagatggaggtggtcctgtccgaaatacagagggcgagctcctcacttgcgtgagcacaacgggacctggcagacgcaacagtgaggatgggtatggcttagatacaatgacttgagatggtatgtagtgatttgcgcccacaccgcggagacctgcaaggcctcagcgcagagtcaggccactcacggtgggactgcaagccctgcagagacgtgcacgccgcgagatacgccatgtcggtcagctccttgctcaggtaccctacttcgaagacctcaacggggcagcacacatgcatgtgcaaggtcggcatgagggcgacaagcactgggcctggcgccagccgtggagaagtggattacgttcccgctttcgatccacaacatcggcagtggtcggggggctcggggaggccctgcatggccggtcagcgcctggggctggttctacatctcataatttcctatttgcatctcattccagagtggtcggaggaacgtcgcggaggatgtcgatggtcgcaacctctccgctggtcggtactgctgcacagcggggagtctgggccccacaagnnnnnnnnnnnnnnnnnnnnnnnnnnngttccagacgaagcactccggcttttttggagctcgcctgcccagccacgctgcccgtgctccacgagccagctcgggcaccgcctcgcccctcacaacatgtagggggatgttatcgggaggttgctgatgcagatgtgggcttaggagcatggtagcagctgggcccccaccccccccacacctgcctttacctcaccacccgctcgtcccacggcaggcgtggcggccacgcnnnnnnnnnncggtgagtgcatgtaacttccaagccagacatgcaaaccagctcaatgcagcgaatgtttatatcccaactgtgcatactaccacccctnnnnnnnnnntggtgagtgcatctggcttctaagccagacatgcaaaccagcacaatgcagcgaatgtgtatatcccaactgtgcatactaccacccctnnnnnnnnnnnnnnnnnnnnnnnnnnnnnnnnnnnnnnnnnnnnnnnnnnnnnnnnnnnnnnatgttatcgggaggttgctgatgcaggtgtgggcttgggaccatggtagcagctgggccccaacccccccacacctgccttcacctcaccacccactcgtcccacggcaggcgtggcggccacgccctcggccccgccccaggcgcgggaccgctggaacatcacgtactaccccaagggggctgacgcagcggcgttgcagaagcagtggtacatcatcgacgccgagggccagaccttgggccgcctggccacgctggcggccacgcacattcgcgggaagaacagccccgcctactccccgtccatggacatgggggattacgtcatcgtcatcaatgcagaaaaggtggccgtgacggggcgcaaggagacagacaagacctacttccgccacgccgtcggccgaccggggagctggacggtggagacgctgcgggacctgcgcaaggtcagcgatgaggaatgggtggggcgtttgagagggtgtgccgacattatcatgcgtgtgaaagtgttcatctggagcgttgaccatatcgctggcctgactgtcccagcaagggccaagcctggagcggctggttccctccccttctcaaccaccctcccaccctcctctcaccatttatggcctgcagcgcatcccggagcggatcctggaaaaggcgatccgcgggatgctgcccaagggcaagcttgggaatcacctgttcaggcacctcaaggtggggagggggtggtggatattgttggctgtgtgcatgtgcactgcttgctgcctggcaaagtgtgatctttagagaacctgcgtgcaattcaatgccgacgcttctgtgcatgctcacccacgattctgcccttcttgtacctaataacacaggtttacaagggcgccagccacccacacgtggctcagacgcccacggacatcacccgccacatcaacctgagaccctcggaggtggctgccctgaaggagtgagcatgcaggatgcacgctggcacgctgtaaagaattcgccaacagtgtgtctagagggcagcagggattgaggtgtcgcgcatgggctgtgcatcacgagtgtcagagccgaagggtcacctgcatgccaagaatctggctgctgagatggcttggcgaccaggagcaatcttgatcccagcacgagccacccgagcgtcctgccagagaaggctggacgccttccacgtggaactcaggactcagcacccgtggccgcagagttggtcgcccggctgcgggccgctcgctgtttcctcctctcctgggctttggccacccacggcgccggctcggtattggtagggtcccgctcgcagcgtcggtagtactcgctccaggcagccgtgtaggtgggtggcatggccccacccttgaggaaggaccagccctggcctgccctggactcgcgccctgcgtggaggcgggcagagccgcttgacgcagtggtgtgaggcgacggatcccacctgcctgtcccggattctcgcgccgcccgcatgtggtcgggagaggacaactccctgccacgccgtccagtccatgagcatgacccggtcccacaaaagcaatcccttgctcgacagccctttttcttatcgcacatgctgctcgctgggcgccggtggcatccagagggaactcgtagatgagggctggcagccaggtcgctggatccacggatttcaggtccttcagacccagccgcagagtctgcaggcgccggctccgttcccggaacgagcaaaggggggcctggatgtaccgtgtgcctgtgtggcaagcagacgtgggggtggtggcgaccctgaaggattgccgcatgccccacaaaacatcatccactgatgcagacgcactgatgcagagcgtggcctgtacgccccgcaagggaggctcatggtttccttnnnnnnnnnncgtagacgcactgatgcagaccgtggcctgtgcgccccgcaagggaggctcatggtttccttgagaggaggagacatgtgcggtggccgggccccaccgctcaccatccagggtagcatcccacgcaaagtgggtgtgcccaaagatgtggatgtcggggcggagagccgtcacgcgagcctgcagggcatccgacccagacacggaggggagctcggggaagaacaagaaccgtttttcggggaggagctcctgtgcgtgtttggtgtggagtgcgaatggtttggtgctcagggataccgccgccgcggacatggctggagggtcagaggggaccagggccccagannnnnnnnnnatgctcagggatacagccgccacggacatggatggagggtcagaggggaccagggccccagatggcagtccatggtcgcggcatcgtccactctgtgcgacccttgcatgcctggccccatcagggaggcctccccttgctcctgagcatgagcaggtgtccctgaccagcagacctcgccctccactccacttccgccgaggccccacccacgccccacctcccgaggcaggaagtgggacatggagatgacgtcatgctcgcggaccccggccagcgccgctgcccagccctccccctcgttcttcgcgtcaaaccagcgcgccaggcccggcccgccgacgctgccggcgcccgggatgctgtcgggccagacacaggcggagtaatcggagaaggcccacgcgtggcgcttgccccccatgccgggctcccggtcccaggaggcgtggtgccagctcagcagcggcaccacccaggccgtgccgtgcaggaggaagggccgggtgcggacgtcgtactcccggcacaggccctggatctggtccagctttgccgccgagtcgtgcaggcccctggctcgatccacgggccggacccacagctctgtgtattgagggtggtttgtgcgtgcaagggacacagggagtttcaagaaaaagcaccatcttgcagatcaggtaaggacgcaacactgagggtcggtgacaattcttccccacctccaattccttcctgcagtgtgccaggaagcatgcaacccgtatcagcatgcagatgtgagcctggccacaccagcgcaccgtggttgccggggacgtagacgaccatcccaaaggcggaggccagggtctggaaggcccattccacgttctccagcttgtcagaggcatcgccggcaaagaggagaacatcatccctgcatcgagagagcgtgcctgccgataaaccctccgctggacacgacatcatggcactgagcgactcccagctgggggctggaatggttggacattgttcaacgatcatcgtccatgctcaaggccgtaccaaaccaaggtcaaatcgtactggaaacagcatgtaccaagggtctccaacatcaaggagcagcgacgccctgcacctcacacgcacacggtggctccagctgacatctccctcaggcagtctttattggctggggtgtccacatggagatcgctgactgcccatacccgacacacacggggttcggtggtgctctgagtcgccgctgacgccatgcacaagcgtttggctgggctctgccgggacctcccatgcatgtggctgggctgggtaggcagggtaggggccacagacggcgtccatgtcgcgaaacgcgcaagaatggctggcattccacagattctgcgatcctccacgtcacatcatgagaacgagtgaacatggctgcaggcaacaccccgatcgcgaggaaggaggcactttggcccaagcatgacgagagcggtcgagcaacccggggtatgaagcgtttctatgtcaattatggtcctaaatcatgtgtatggaccattggagattgatcgctcttcaaccttcgatgagagcttgcattcatgggattcatcctgtggccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggcatttgacacaccgtgccttggattcgaatcccgcgccgtattctcttgtatgtgcgagcaatttcataggaggccttcgcactcagcctgtaatcccactctccgtggtgcttccggcgaagatattctgcgttcatccgtacagcctacgcgtgcaagtcttaactcgcaggggccgatcaaacatcttgtaatgttgtagacgtactccacaccttgatctggtgatgatgcgtggtcccggaacgacatatgtcgcttgcaaccgctgattacagctcaggcgacccctgcaaacggccggaagcaagaggagcatcaccatggcgagcatggacacgctgctgtgcggcggagtggtgtgcaacaacctgccgtccctgtgctgcggcgacaaggagcccctgctggagcccctcgaggtcgacggcagccggttcagccatgcctctgtcctttggcagcgtaccgcctcgaggctctccaccaaggcggaagagggagcaaaggggaaccaaatcgtgctcctcctggagtccttacgaaaaggagaggtgttagcattccaggcaaggtggatggggagatcaagggtgtggggaggcagagccaatgcccttccaagtgagcccgctccagctcgccgattcaaaggacatgcatcccccctacccctctgccacgcagatcacggtgctggtcaccaccctgcnnnnnnnnnnccgaaggacatgcatccccccaacccctctgccgcgcagatcacggtgctggtcaccaccctgctgctccaggcctacatcatcgccctgctggtgctcaagtttaccaggcaccagacccttgccgtgctgcagcagcagcatcgctggttcaaggcacagctgatcctgtatgcagtcacgatgctggcgaccttgtacgttggcatccggctggctgctcgcttgaggctcatcaggaagcaggcccaaaaagtctggtgggtcctagtgctgggtggtgaagcctgaagatcccgtgtgcggtggtgggatcgccgccgcctcgtggtcacaggcctttggcggcatgaccggcgccgcccagagctggggccctcagactctcaatgccatatcggcccctttcggtgcaggtcgcggcgccagaagatcctggtcattgacgctgtggtcctcctgtgcacccaggtacagcgagcggcagcgagcagggtgcccatttctgcagcatgcttccagcggcctgccaggcccacctgccacgcctgctgttggctttcccctctgctcctgatgtgccttgaccctgttcagaacgagagccgtcatcgccctctcctcatccatgcgccgccctgcagttcatgcagcaagtctgggcgatggtgcccctcgtcataggcctcgtgcgaaagtgctcctggttctcaaaagacgtcagcgcctttgcattcctgcgggagatggccctgatcacggtgagggtggtggggtgtgactggagtgtggtggtcgaggccggggtatggtggtccctgtccattcggcgaggccgactcgcggccacttggagatatcagtggcagggagtaccagggccaggggtcttctaccggatgacagcctcactcggcccaaagcccactgcccctgctttgccacaggtgctcgcgtggatgtgcagcnnnnnnnnnnggtaccagggccaggggtcttctaccgggtgacagcctcactcgacccagagcccactgcccctgccttgccacaggtgctcgcgtggatgtgcagcatggtgcatggcatgacacggtggaagggaaagggcgcctttgacattggtgcaaagcccaagctcgtggtggacttgcccatacgtgcccagctgcggctgcacatacccctcattgtctacaccgctgtcgtcatggccatgaccctcgtccggctgatctacagggtgcgcttgcagaggtggacgtgaggaagggtttggccggggtgggctggaaaaagatctatggcggggttcacatctgcatggtagagaggtgagtctgggaacatgcccgaatgtcgtcccatcaggcgacatcgtcagcacnnnnnnnnnngtccatggcggggtccacatgtgcatggtagagaggtgggtctgggaccatgcccgggtgtcgtcccatcaggcgacatcgtcagcaccgtcccgacaccctctgtctcccctccttaaatctccaggaaacctctgtgctggccgatattccaactgggcagtgtccaacggggaagttttcatgcagcgtttcgacaggtgagaccagcatcgagctgggtgatggatgccagaggcgcatgcacgtcctcgcactcaacggttcccacctcctcttgcagctgagaaaaccgccatcatccttgagaccattggcctgctggggtacagcgggatatacctctattacctctggnnnnnnnnnnatcctcgcactcaacagttcccgcctcctcttgcagctgagaaggccgccatcatccttgcgaccattggcctgctgggttacagcgggatatacctctattacctctggcgagccacacgagaccacaggcgactgccctacgcccagttcaggctgacgttcctttacctccgcatgcatgtgcgtgggggggtgaaaagggatgaatattcgtcaaggattgacattgatggggtgcaagtaccagggaaggttgaggataggttttgctggcctggcctccgcatgactgtgactccgcttacccgagaggacctgcctccctgggtttcagaactctccctcctactccacaggcacggcacgggaccttcatcatgggtttcatgctcatcaccattgccatcgtccaggcaggtccagggtgggcagggccaccatcttgtcatgctgttcaccgacactgtgcagagggacgagcctggctccctgacccccacaatgcattgcggtgcaagggcctgagattggaggcaggagttgctaaggcccgttggagcatatcaactttagatccctttctcttcgtcccgtcttcagttgatagagatcgattcgtgctggacgtacattgcactgcagtttggcagcgtacccacccaagttgctttcaccgtgagtctgctgttcctggcttctaaacgtcgggcacggggggaagggacgttctggcggccacacccagggtttggctatcactagcattttgcatgcgctcaccatccctccctcccccctcctttactaccctcatcccttaccgccttcccctttgccaatgcacccagatgctggtggtaatttttgccatcctgctcaagccccggaagcgggacctggggcacactctggaggtggggcgctggagctggttcatggttggctggctcatgcgcctgccgcagtccgaaagcgttgccacgtcgtgctacctccctcttttgcctcaccacaagtaatgtcacccctgctcgatcccgtgcctgcgccgcacaggactggtctcacgaggtggcctggaccgaggaggaacgcgacgaggtcctggccgaccgtgcgcggcagctggcctccagcaccgagtttgaggagtctgagttcctgcccctgcccggcctgccgacgctgcacatgccggaggtcacggggcagctgctctccctggtggccgtggacgaggcagagcagcacgtgcctagggtggccatgctctgcttcgagaccatggtcaagctcttctatttctgccgcctggcttaccgcgtcggggtgagcacgcagggagagaagggggatgaatgtctgcctgccctgctcttgaggcgtaattgagtgccgggacaggtcaccgccaacgtcacagatcagccgctgtgtcacttcctttagatcattatgttcctcccttctgccccacaacatcacgccaccagacggacgtgcccatcagtgtggagcacgggctgagcctgttccccggcatggtcggccaggaggtggtggaggaggtgctcaccgacacgcgcgctttcctcgcctggggtcccggcacgctggtggtgtccttccgcggcactgccacgcgcaagaacatcatcaccgacataaaggcgagccgggttcggatgctaaaaggaggggaggagttgagggcatactggtgtggtccctgggcaaaggggtcttaggattttgactcgctcctgcctgccaggggtacactgccttatcaggcaaggagggcggagcctcagcacaatggtcctgatctaccactggtccccttctcgctggctaggctctgatgcacagcatcaacagcgacgcctgaccccggccctgcagctcatcttgaactgcgcattgcaccccagcagcgtctgcgcctgccatgcccttcttctnnnnnnnnnnctgccaggggtacactgcctcatcaggcaaggagggcggagcctcagcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcttgaactgcgcattgcaccccaccagcgtctgcgcctgccatgccctccttctcgaccggatgacacccatccccaagacccatcagcttgcgcaaacacacatccacccactcatcccccttccccacccagatctggaaggtggcgcaccagccgcggcggcgcaacaagctggggcgcacgctgctggtgcacctgggcttctaccgcgcctggcggcacaacggcttctctgagcgcctgctggcccgcgtgtccgagctggccggccccggcggcgaggccgagggccccgacggcccgccccgcgtccttttcaccgggcacagcctgggcggcgcgctggccgtgctggcggcaggggacctggcgcgcgccgcgcccgccctcgcgccgcggctgtcggtctacacctttggcgcgccgcgtgtcggcaacggcccctttgtccaggagttcctgaccctggtgccggactgctgggcgatggtgaacgaccaagatccggttccccgcatccccaagggctggttccacaacgcgggcaacccagtgctgctcaacccgcgcggcgacctcatcatccgcccctccgagttcgacgtcatctccatcaacacctcgggcggcgtggccgcacaccacatgctcggcgcctacgccctttccacctacgccgtcatgaaggagcaggtgggtgggtcagcgtctcgagggggggggccggagtgatggagaggggatggagtgatggaggggggatggaggtcggagtgctttcttgctccgggaaaccctgtcatgcaagcacggaatggggtggctgggggcgggggacatgggcgcagcagggtaccccttccccgccctgaccagacaggcacgactctggcctcgaacaaccccccaccaaccccctgcccgcctcacgtcggacagtttggcgaggacaaggggctgcccggtggggacgcgggggtggtgaccctcgccagccactttgacgtcatggagaccctgacgctgagcgtggtggagaacaaggtccaggtgggtgggcccggcgcgggctgggtgttgtcgaaggcctcccagcgcacgatgcatcctttgagggtcctggcacccgatgtggaggcagctcgggcggtggnnnnnnnnnngcgagtgaaggaggggggatggagttcagactgctttcttgccccgggaaaccctggcatgcaagcactgaatggggtggctggggggcggggacatgggcgcagcggggtaccccttccccgccctgaccagacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcgtctcatcgcacgatgcatcctttgagggtcctgccacccgatgtggaggcagctcgggcggtggcacggtggggggaggcctgccaggcgccgccctcccccccgaccccttgcctggctgggcagaatgcaggaatcgccccgactccccaatcagcccggagccacctcgacccatggcatgcaggactcgagcgcctctgcagcggtactgaccacacccccgtcccaggccgaggtccagcggggcgggaagaaaggggtggcggtggcgaccagggaggtgcccaaggtggaggcggacgccctnnnnnnnnnngcccccgtcccaggccaaggtccggcggggcgggaagaaagggggggcggtggcgaccatggaggtgcccaaggtggaggcggacgccctggagaggcaggtggatgccaaagaaggctcggccgcagggtcggggtccttgacggatgtggagctggggctggagctgcagccaagtacatcaccgcagccaggaccctgatgttgggttaggaggcatgaccggggccgcacgttgacgccacctgttgcatgcttgagccggccaaatggatcgacgccacactgcatactgcttgtaccctttttatacgcgcttttgatgactaactgattgtgaattgcactggcttcatgtactcccccccttttgacccacctgccgatccgatccgaggcgcgggcgcgtgctagatacgcacgggcatctcgtatactatgagttgctacgtggtgatcctgtcccgcgttgtcgggggtcgatacgctcccaatggttcgccgtactcccaccacgacatggcgttctgcgggatcgtgctcctgcgcaactgcattcccctgtttcagagggactccaggccggtggtggatgccacacaagtctccacgggcaccctgtcggggtccgtgcacatgcctgcgcacccagatgtcccccaaaccgtgctggaagacgaggtggaggcccagaagcaggcggcgaagcaggtatcctcgagagtgctgctccgcatggaaacaatgacgtcagcgaccgtcatctggctgcaggtgggaggttcggtgaggagcatcatgcattttgaacatgtacaccactaggtttgcagctgtttgggctgcctgggtgttgttgggttcgcgcggggtggggagtgacagatgtcaaggtggtttcactgtcggcatgggtgggagggcagcagggctgctctgctccgcccccactcctccccccaccctgacacaaacgaagaatcctgattgttacagcttccggaactcacccgtctttgatgtgcaggttggcgtcgccctctcctttgcccttgtgaacgctttcaccatcacaatcttcctgcagaaattccagtacagcaacgacctgcagatcctgtcgcagctgaccagctggtttattgtacagctggctcttgtatcggtattttttttcattttgctgacttgcgctgcgtcctggtttcagcgcgtctggaagcggcagagcgcccaccgtgtgtggtgggtgctggctttgagggagttctgtgggtggtgtgctggtagcgatccgggctcgccaagccatggatggcggtgccgaggggggccctgactgcactgactgcacgtgcaaagctgcaaacctgccaggattggtcatcatgcactggctccgccacaccctccctccaggacccagcgccagcggctctatgtcttggatgctgcagttttgatctcacttcaggtgtggctgacaccggtctgggagcagccacctgctcactgtcatgcttctctgcctccatgatcagcaagccggcatgtgatgccctggctgcctacctgttgctgccatggtatgccggccgacaacacgcccgtcacccacccgcttgcagagcctcgtgatggcgctgctcatcgtctctcagtcgatagcaattgcagtcccatgcccctggttcaagcaaagcgtctccctgctgtccttcatccgatggacgctcacgaactctgtgagcaacggtgctgttgggcccactggaactggggtggatgctgcgactcggtcgagtgcagcgcaaacaaccatgtgccaaatacacacgcttgttccacggtgttgctgctgctcatgtgatccagcctctgcgcctctgcatctcgtcgtgccacttcaccgcgctggcctgtcttccaggcctcgatgcggtggcaccatcctgacctcattcttcggcctccagcacacactgatctgtcttcagcccacccacctgcccgaccccatatccattcagatcctggcgtggatgtgcgtgatgatgcgcggcatgtgctggtaccgcggcagtgtgcagctcccggaccccgaccgccagctcaccatcgatgcgccatggcggaggcaggcctgggccaatctgcccaccctcctgatcttcctcagcacggagacggtggtggtcgccaagctggcgtaccgctggatcgacgtgcaggaggcagtgggcgtgccggcctgccgcacctacccctatgactgcaccccctccacgggcgagtttgtgatcaacattatcaccaccgtctgcctcctcgtgtacgcggtgtactacatctacctggtggtccaggcgcgggccgaccacgccaaggtgcccttcacacgctaccgcgtcacctacctctacgtccagatgcacgtgagtgcgcgcgggggaagaaggggggggggaacaggggttgggggaggagagattacggtggcgttaacggtgtgggttaggtgtgtggaccaaaaggggggccggggctcgtgctgagttcaatgaagcaagcattgcttgggtgagtgcaggagtgcggcaccctcggcgtcttcaccttgtgctcggggccacaatggaacctgggcgtgcgatagaacacctgtgccccccctctccagcgtgcactgtcctgcatgagtggtgcacgtggtagatggcatgcccgcaaacccttttgcaggcgcggcatggaatattcatcgtcgtnnnnnnnnnngtgtgctggggcccacaatggaacctgggcgtgcgacagaacacctgtgccccccctctccagcatgcactgtcctgcatgagtggggcacgtggttgatggcatgcccgcaaaccctctcgcaggcgcggcatggaatattcatcgtcgtgctgctcctggtcgtcagcaccgtgctgagggtgcgcctaaggcattcgagggcccttcccagggactgtgcctgagagggggggggccgagggatgatgtgctcgcaatggcgcccagcacgcatgccttcaccagacctgctttcccccttgccccaacgcatgggcagtttgtggagtccaagtcgtgctggtcctttgtcgacatccagtttgggctcatccccacccagctggccatcaccgtgagtcaacccttcctctgggagttcccttatctggacctgctgcgcctccacggccccgtggatgcagctttccgggccacatcctgccagtgcttaaccagctcgccccaagcccaagctctggctcgtgctacaccctcccctgattcgcctctggtcccctgtcaagaggctgcccccgccgcccccctcccacaggtcctggtgtgcgtggtttccatcctcaccgccccttgcagcgactccatggacaatctgaagcaggcaagctctgaccaagggagggggggagggcgactgagcactgcttcctcttgctgagacactggcatgctgggctgcagtgctggtggcgcacaagtgcctggcagatgcctggccccatggcaaggcgaaccctcctggttcccctggacggctgctcccctctcctgtgcctctccctccctccaaacccctctgacgcctcagcacttcttccccccacaccccttccccccccccgcagcgatggctgatggaggtggcctggagcgagccgcagcgcgaggaggcgctggcggatcgacacatcgagttcctgtcccgacagggcgaggaggccgccgccgcggccgagggcggcatgctgggcacgctgcgccgcatgagcatcggcctggtccggccctccatgagccacatggcggagcaggcgcagggggcgttgcgccaggcgatggggggcacggcgggcaatgcccccggcgccacgcccatctccgagccacggctggccatgctctgcatggagacgctgctgaagagcttatatttctgcaagctagcctaccgactagaggtgggtgggtgggtgggtgggtgggttggagacgcccgtggttggggacatcgatggcgtgctcctctgcattcctcactctgccgtacaggaagttggcctggcactttgctggaatactagcacggggatgcgtggcttgggatgtggcggtcacgcctgtcgcgtggatgattggcatgcatttgccagcaaaaccctccaatgcccctgaagccttgcgacccctcagtccccactcactttccacacaaacttgccgcctacggcctcgcagacccccgattcgccggtgtcgatagagcatggcctgagcctgtaccctgacctgcaacatcacgagctcctgctggagcccgccaccgacacacgtgtgctgctggtctggggccgctccaccctggtcgtcgccttccgggggaccgtcaccaggaagaacgtcctgaccgacctggaggtgggagggaaaggggctggatgatgcgagggagcacagcagggggtgcaggcctggggaccttgccgtggacacggaaacagaggcccgcttgtccttggctgcgtgagtgggcaggggagcatcggtgtctgtcgtgtgcctgggcgagtttgggagaggcaatgtcttgggaccatcctcctgacatccctcccgcacacccgcaggcttggtcgacgccacacctcccgagcaggaagaatgcctacggcnnnnnnnnnnaagtgttggtgtctgtcgtgttcctgggcgagtttgggaaggcaatgtcttgggcccctcctcctgacatccctcccgcgcacccgcaggcttggtcgacgccgcacctcccgagcaggaagaatgcctacggccgcacgctacgcgtgcacgccggtttctaccgggcgtggcgcaccgccgacctcggcgaccgccttgtctctcgcctggcacagctgctggagggctgcccccacggcgccaggccgcgagcgctgttcacaggtgggcgggtggtgatgggagtggggagcatgcgtgtggggtggggtggctggagaggcccaggtcatgttgattacagcccaaaccatactcctccgcccggaggggtttacacctgcgctggcccgacgctgggtctcnnnnnnnnnncacagcccaggccatactcctccgcccggaggggtgtacacctgcgctggcccgacgctgggtctccagggagtgatgcgattgtctgcccgtcctatcactgacatcttagcgtccctccttccctccacccaacccatccgagctcaggccacagcctgggcggcgccctggcggtgctggcctccatcgaattcgtgcgacgtgcgccgcagtacgcggcgggggtgtcggtgtacacctttggctccccacgcgtcggcaacggcccctttgccacggagcaccgggcagccgtgcccgactgctggagcgtgatcaacaaccaggtgggtctgatgggaaatgggatggggaagacgcgtgggtgtgtgtgtgtctgtgactgttttggggtcccagatgtcccacagatcctcccactccaaggcatgcctcggcggagccctggcaactggcggtgcttgccactcgagctgcgggccttcgatgcgcagccctgcgctgctgttcgcccctcactccattccattcgtacccgcatgcgcctgcgcggtgcatggtcccctccccaacaggaatcccttaccgtcgccgatacatccctgatcagattcgttccacactctcgacccacccacaacgtcaccccccccgcccccaaaacaccaatcccaggaccccatcccgcgcatccccaagggctggttccacggcgcggggcaccgcgtggtggtcacgccgcgcggcgacctcatcatcaagcccagcacgctggagctgtcggtcatcttcaagtctggcggcgtagcggcgcaccaccgcctccccaactactccctgtccctcttcagcctctttcgcgcccagtttgacgccgccaagaagatggagggcggcgcgctgggagtcaccatcctggcgggccggctggacgtggggcagaccctggtgctgcgctacgcggggctgagggagatcatggacgccagtgagcggcgcatgcccatgcccgtggaggtctaccagctgcgcaaggccagggtgggtggctttgatggggcaggggggtgctgtgctgtcgcttcaggaaggcagcccattggagtttgggagaatgcctggcggccggttctgggctttgaggaacgccctcgtgcttcccaccgcatcatcagtccaaaccccggacccgactcccacaacagaaacgggcgatcgcgcgcgtggaggagcgggcaatcagcggcacctccacgactttctcacaagatgactccgtcatcagcgagcagaccgccctcgagctggtcaagcaggcgggggccatgggggaggaggatgtgctgggtgacacctcggtggtccgggacctgggcggcaagcgggtgctgggcacccaggagtagcaggcggagaaatccagtgccctaggtccaagctgcgctccactcccccgctgacggccatcaacttttcctcggtcgcaataacagcggctgccctgaccaaaccctgtggggccgatgaagacccctgtaccgatgtgtatactgtgacttgcacatatgtatcgatctggagcgtcggcggcctgcagctgttgctctctgttgcctctcttatggcgaaccccacatctgacgctctagatttgcgagccatcacttctctgaagtagggcaaggtggccgaaagattgatcaaataatcttcaaacctttcccttagctttgattatgttctgtcgagatcctccagccttcccccgtgaccannnnnnnnnngttgcctctttttcttgtggcgaaccccacatctgacgctctaggtttgcgagccatatttccctaactcagagtcttgttaatgatgggctcatcatcgtccggggtaagatgggttggggtggaaatcattccatcctttaggacgatgggtcatgtcctgcacccaacggctggatcagcgaccacgtcaggaagaagggggggggggcctaactctccaagagacagcggctggaaaagcaaaagaacgcatgggagatacaatgaagtatcgggtagaggagtgcattgcatggaagggtattgatcccaggcctgcgcgggctgctcatcctgcacaagttcagcaggtgaatcccctgatccagaccactggtacgctctcagtcgtgatgtcccgactatcggggatgccgagtcgcagaataaagcctgagaagcaatgtacatgccggagttgggtctggaataggtggccctggaagattccgaggactgggcccatcccccctgtacatcactagtctcggtcattcaaagtgaatggcagcaagtcccttgaacaccctctcactcatcattatctgtgtgtcactcagggggccacttctctgaagtagggcaaggtggccgannnnnnnnnngttgatcaaacaatcttcaaacctttcccctagctttgattatgcacattcgagatcctccagccttcccccgtgaccacgagattattgaggggggcggccacgtgccaaaatcttctgactttggttctggcttcgaggcatgctcgagtctctgagtagctgatatccgaggtacaactgcagacttggagctaaagtgcgccaccctaactcattcgaagtggctgttgacctttgctttgacgctctatggcagaggacgacgatgcgaatcccgatacactccagatatggtgtggtgggcattcgcgcggctgatcacgcctccactccgcctgcagcgactcgaacacagccatatatgtcctgaaccatttgtagggatggaagagtgtactcaagactcggaaccgggcctcggcagatcaaggcgcaattcgctcccgttgaggcaagcccgggtgtggcagagaaggggaaagtgggtggtacgtaccaggacttgcaagagctggaatgcaagcaagtgcacatacgactccctatcaacaggcatatactgttacgctgttcatggaggagtccacctgctctccccagctctgtgaccgggaagctgccatgaattttctgagggacccagagcgaccacgggccatccaggtgcgagattcgcttgccaagtgcctcgccctctgcaaagttccgtttgaacgcctcagccgagcacatgggtgcggctgcctgttgtacaagggctgtgcagcatggattgggcaagcctggggcaacacgggtgcaggtcacatttgtgaagaccgcctcaccccaaaagtatcctccctccccgcccggaaaccacactcaaaagtatcaattactgagggacatttcgccgacatccatccctccgcattgcatcgaggacatgatgctgaagacactgggacctgtcatggggtactgtgatacacggagaggatgaggggtttgttccggcagcaccccaaaacaccttgagtctgctaccaggtggatgcgtgatctcattctgcagacagtatcagcttgcagaccaccccacatcacgccccctccccatcccgtgtggccccaggtctgatctgggtcctgccctggatttcaagtcctacatcctccgccagaatcttaggacgggttcaagagtgaccgtcctcttttcaactgatggcagcatcactgctgtcaccactgctccaggggcatcattcaacgcagtggaggtgggcctctgagatttccatggctgtatgcatgctcaacattatctgggtttgacatagtctgtcgctgaccacacaggttgcgagctgggctccctcagtaatctgccatcccccccgttcagtagaaggcgatgcaacacactgtccgacgggcaaccaccgcctcctcccttgctgcagtgccacccggagctgatcacgcaaagtccagccctgtgtgctggtgtctttgaagtctatttgcgggagaaatctgtggcacctcttgccagagatgcctggattcgatcagtcatggccccagaccggggccagacctgaagacctctttctccacatcgacactgagcagccctcaaagcgcactctccatatatccgcgatgaagtctggaacaagttttccacagcagggcatttcctcatctctttcccatttttcaaccattcttctatgctttcagcgatatgtatattggccgcaaagcccagaacaagggaaatgaacaccacgtgttgatcgagtcgctcggcgggtcgggggtttggaccggacgctagttccttccgaggctcggcctttatgttccatacctaacagcaagggcacccgcagattcaggcattttcaagagcctcggcgtcgtgcctgctttcttggggtttgaggctcccggtgtcacaacgatgtctgagatacaggaaccggcgacgggagcgatcttcccgagtaccctgagaccttggtgcgcgctcctcatcattgagcaaaccgctttgaatgcgcattatatacctttaacataatccactgcattaccatgcagggatggaggtgtctacaagaacttgggcgcgggtccaaggatcatgaaagtcgctttcatcagcatcaaggtatggtatggatagaactgacgagaaatacccacctaacaaatcagttgcggatcaatttatgtcgtcacatacacagttggcccatgcaggtttatgcggtctcgctatacgtacccatcgagcgtctaccactagcatccggaacagctctctctgaagctggatctccacgagtgattcaggtgtgctgctccacccctgcatgtccgacgtttgaacagcaggtttattatacaaccgtgagacaagattcagcaaattcccctgctctcctgccccagatgcaactggccaggaatattgcaggcagtcagtttagtgacacgatgagaaagtccatgggtccatcgatgaggtgagtctattgtgctaagatcgatcgacaagtatgtcgaggtgacaggccaagtacctcctgggttggtgtaaggttggattgcgctctcagttcacaagataccatggtgatccagtgctcctcgacccgttcccatccatggcagccaggacctcgcaagtctgaccaagttctgcgactttataacacagcagcagctgcagacggggacggtaatcaccctcctgctgggccctgccagcgaagtcgacgtcaatgtggaccaagtttctgcagtgtcaggaggtgacatgagccaggtatgcaaatatggatcatgacacccccaaggatgttttcgcttgtgttcctttgcgagtgtatatgtttaggatccaatcctgctatcttgaaaggagttgccagctcttgtgccaatgctggcatgggaaagcttaccctttcacccctcttcatacaggccaagccacagctcagcctccagagtgaagcattctgtgcttccctgctccagatctatctcggtcccaagtccgtcattccagaggccaaaaaggcctggcttgccaatgctgtgagggggtaacctgtcggcaaagcaatgcaatgcacgggaatacccttgttcctctaccgggcttgcgccggttgctcgcagcttcttcccgcaaacaggataatttgtggcgcagtttgtggcctcaaggggcgatccaaggggggggagggaggggggggcggcgcggactggggtttgtgacaacannnnnnnnnngggataattggtggcgcagttggttgcctcaaggggcgatccaaggggggggaggtaggggcgggcggcgcggactggggtttgtgacaacaacaacaacaacaacaacaacagtctcgcgtcttgcacagcaattatagacggccaccccccaatgctgtgttacggaggtctaaacagaaatgttctcgcatccgttccgtcgacagggtgctggggtcggaaggcgaccgcagcccaagccaggcagtcggttgacgaccatccgactgcccgaggccgaggttctaagccggcatcgtgactgcctcatgcgttgtgcgggcgtgggagcgtggtcgggatagcaccggtgggtcattcatgaaaactggtgggcactagctgctgttggccctccatcaaggtgtgtattgggtgagctgtttgggttggtgaggatccctggcgtcgcgtgtcgtgcgaagctgtggataagaccgatgttgtttcggaaactccgcccaccctggccacaccccttgtccaatgcagcgacaaaagtgggccagcacagcaaggccagagtacgcaacagaacccttacccaatggacactaacgttgtggcgaccagacgatgctttcccgacctcgagacctcttgcttccgcgggtcaggtgaatgtggtgattggagtggattgtttcgttgatccgtattcaacaggcttagatgcgatcgaggttcagcataaggaggctagttcaaaggtggcaattgcaactcagaggnnnnnnnnnnaaatgtggtaattggagtggattgtttcgttgatcagtatacaacaggcttagatgcgatggaggttaagcatatggaggccagttcaaaggtggcaattgcaactcagaggcggaaacatacatcccaccctgtgctttcttgccccatgttgtaagaccctcgaatgcccccggtgcaactcgtatcagtcaacgagctggcggatgatgagaacgagaattgttaggcgcggtggagtgcggcggtgaacgagtnnnnnnnnnngtgtggtagggccctcgaatgcccccggtgcaactcgtctcagtcaacgagctggcgggtgatgagaacgagaattgtcaggcgcggtggagtgcggcggtgaacgagtggcggacggagctcggcgaggcgggcatgacaggcagatatgggaaggtgcgtgaatagttgaatgccactttggagggagtgtcgaaggccagcgcagtgtccccaagcatgcgtggctccaccaacacacacacacacatacacacatacacacacaaacacaccctgtgcctgcaatataatgaactttaggtgatcgatgactacgcgacaacctccgtcaagacgacgtggaacggcttccggggtcttccgaagaagacgaagaagacgatgcagcagcaggagcgtgtttgtaatgccctgcgaccgaccgtggacannnnnnnnnnaaagaagaagacgatgcagcagcatgagcgtatttgtaatgccctgcgaccgaccgtggacaacatcgtcgccgtcatcacagaatcgcgtacagtcggcgacctgttcgccaacttccacgccatccggatggtggaggagttcgagcggnnnnnnnnnnnnnnnnattacatgttttttccaggtgggcctcgtgtgttgacgatcagaggggtttgggaaatgagtgatttgtaggcacaccggtgctgtggtttccttgtttgatagggaaaggatggtcccatgtctgctcgtagtgtctgctggtttgatcaccactatgtgaagctgtctggaacacgttgccacagacgggttgcagcggcatgcgctgcnnnnnnnnnnttggctgctggtttgatcaccactgtgtgaagctgtctggaaatgttgccacagacggggtgcagcggcatgcgctgcagagcagatgccaaagaactacccacccatttaccccgcccacccacggcgcagatgcctgacgctcatttggcgacctcgcgaggcacccggcggaaatgcgggtaccgatgcatgggcggcgttcttcctgctggccgagtccgtcgccctctttcgggagacagtcgagccggctggtgtcgacctccagccgtccgacacggagttcatcagcccctttgtccacgaggcggcnnnnnnnnnncccgacgcaagggcggcattcttcccgctggccgagtccgtcgccctctttcggnnnnnnnnnntatttttggcagaacgctaagctggagctaggggtgacgggaaattggccacgccactgcgcccgcgcagtgctgtgtgtcagcttcgcgaaccctctggcgccaacagaagactcgaacgccgcaccccccctgccgcccgcaaccccagcgactcgcacgggcgcagctgcagagccaagcccggacattgggccaggctcgccgaccccagccnnnnnnnnnntacttttggcagaacgccaagctggagctgggcaccaagagaaatgggtcgtctcactgtgctcgcgcagtgctgtccgtcagcttcgcgaacnnnnnnnnnntggcggtgcagcagcacccctcatcctggacgccgcgcccgcccagccaactccagttccgggcccgggcgtccccacagccnnnnnnnnnnaacgccgcgccccccctgccgcccgctaccccagcgactcgcactggcagctgcagagccaagcccagacattgggccaggctcgccgaccccagccatgggccccgcagtctccgcagcgccatcgtcagcccctgacgtcatgctagaccagccggccccagtctcggtcgccgacggcggtgcagcagcacccctcgctccggagttcacgcccgaccagccaaccccagttccgggcccgggcgtccccacagccnnnnnnnnnnnnnnnnnnnnnnnnnnnnnnnnnnnnnnnnnnnnnnnnnnnnnnnnnnnnnnnnnnnnnnnnnnnnnnnaccattcacacaaacgcaagtggactggaccgtccaacttcgccgctgcatgccgaaaaggccgacgtggggcctgtgggaacatcacccacacctctgcctgccgctggccaggcgactcctcgcggagcgcgagaggcgacagccggccgcgccagctcccgcgcaggctccagagagcgcgccacaagggcaggcgggcgaggaggcgacgcagcacgacgcaaattgcccagatgtgagtggcgagggacggctgggaatgcaggactgtgtggagatctgtggtggtttaacacgcttacttctttgcaccctcgagggggcggccaggggtttgacagatgggtagcacagctacacatgtattcaccagccccctcgtaccccacatgcacaggttggtgccactgcagcgtccaccatcgccgccgggctccagcgcctagttgaaggccgtgcgaagcagcacgaggcaaagaaggacgagggcatccctaataggcggcggggccttggaaaggcttgacgggcggcgctggccaagcgcaaggaggccgcggcgaacgccgccggcggccaggccaaggggcctcagaagccgccaccgctgcggcacattgggcggctgttcagccttctgccctgcaggcagggcttcgaggcggtgnnnnnnnnnnctgacaggggcggcgtggcgaggatgatcgggctgcagcttcccaccgagaaggagtggagaatatacacagaggtcgaggtgagggatgttgccaaatgtcattgtggagaagcaggttctgggatgtagagatgtcattcacttctccactttaagcctgggctgccttccttgggaaactttnnnnnnnnnnaagaggctgacggggctgcagctacccaccgaggaggagtggaggatgtacacagaggtcgaggtgagggatgttgccaaatgtcattgtggaggagcaggttctgggatgcagagatgtcattcacttctacgcttgaagcctgggctgccttccttgggaaactttggtagggttgcccataattggtcaatactctgtggaccgttttgcagtggtgttttgccgtggcagatgcctnnnnnnnnnngtgctgttcattactctgtggactggtttgcagcggtgttttgccatgggagaagcctgaaaccacttctgcccatcctccgcatcaaatccatgcacgtccctgcaatcccatgtactgaaattcctcaacctggacaaggtattctcaccgagggctcaaagctcaccgccaagaaacgcatggcggtcgaggcctgcctccactgcaagcgggaggagtacgaggtggaggtggacgaggacgggaagctcaagaaggggaagaaggcggcgaggacagggaagacgggagagaagaagacggactggttcgtccacatcgggtgggccttcttcaccctcctgttcaacttccggcgctttgagggctgcggc

SEQ ID NO: 48283 - DNA, 72 bp, Chlorella protothecoides
atgggcattttcgatggaggcccccatgcacggtggcgaaatgacatccatcgttgcaagccacaatgcacc

SEQ ID NO: 48284 - DNA, 774 bp, Chlorella protothecoides
  modified_base (424)..(433): a, c, t, g, unknown or other
gccgcgtcctcgaaagccggggccaggagcgggcgcaggtccagcccggcgcggcccaggctggcgcccgcgtacatggccgcctccatgaccgaggccagcgcgccgccgtcggccaggcgcggcagctggcgccggatgtgcgccacgtaggcctccgcacggcgctgcgcccaggtgggcagcacgtcggagtggggcgcggggccgcccgcggacccgccgccgccgccgccctccgccccgtctccaaacacgctgcagtactgtgtggccacgtcgtgcagatggaggcgcaggccgttggtggcgcggcgcagggactcgtaggccggcccgccctcctcctcggcctgcgcggcacaggtggccacccaggcctctcgccgtactaggaactcgaggcgcagctcgcgctcgccgnnnnnnnnnntgccacccaggcctcgcgccggaccaggaactcgaggcgcagctcgcgctcgccgaagcaggccaggcggcgcaggaagccgacggcgcgcaggcactctggcagcgccacgtccgcctccagccggcgcagcagtgcgcctcgcatggccgccgacgcggcgcgcgcctcggccgccagccgcctgaccaggggcaggccgccgtgcagggtctccagcttgcgcacaaaggcgcccaggtccagggcctcgtcgtagtggcggttgcgcacgcaggtcaacatgagggaggggacctccaggatgtccagcatcacattgtggtgggctggaagggggg

SEQ ID NO: 48285 - DNA, 201 bp, Chlorella protothecoides
ctctcatttgatcggggtcatgagagcattggaatcggtccgagatcaggtgacgagcggcttctcctccctaaaaggcagccctaggtccgcggagggcaagagggctttttgagctgacacgcgaggccgctgcacccatggtggtgtagtcgtgattcgccctcaccgattgctgccatggccgcacagggatctgtt

SEQ ID NO: 48286 - DNA, 61 bp, Chlorella protothecoides
gcaggtggggcaatggcagcggtgggggggtcctggaggggcccagctggggcggccgccg

SEQ ID NO: 48287 - DNA, 22672 bp, Chlorella protothecoides
  modified_base (2723)..(2732): a, c, t, g, unknown or other
  modified_base (5109)..(5118): a, c, t, g, unknown or other
  modified_base (6368)..(6377): a, c, t, g, unknown or other
  modified_base (6663)..(6672): a, c, t, g, unknown or other
  modified_base (7025)..(7034): a, c, t, g, unknown or other
  modified_base (7639)..(7648): a, c, t, g, unknown or other
  modified_base (8115)..(8187): a, c, t, g, unknown or other
  modified_base (8858)..(8867): a, c, t, g, unknown or other
  modified_base (10638)..(10647): a, c, t, g, unknown or other
  modified_base (11014)..(11023): a, c, t, g, unknown or other
  modified_base (13341)..(13401): a, c, t, g, unknown or other
  modified_base (13777)..(13786): a, c, t, g, unknown or other
  modified_base (14387)..(14493): a, c, t, g, unknown or other
  modified_base (15183)..(15192): a, c, t, g, unknown or other
  modified_base (15544)..(15553): a, c, t, g, unknown or other
  modified_base (16049)..(16058): a, c, t, g, unknown or other
  modified_base (16304)..(16313): a, c, t, g, unknown or other
  modified_base (17621)..(17630): a, c, t, g, unknown or other
  modified_base (18753)..(18762): a, c, t, g, unknown or other
  modified_base (19173)..(19182): a, c, t, g, unknown or other
  modified_base (19705)..(19714): a, c, t, g, unknown or other
  modified_base (19958)..(19967): a, c, t, g, unknown or other
  modified_base (20416)..(20425): a, c, t, g, unknown or other
  modified_base (21018)..(21027): a, c, t, g, unknown or other
  modified_base (22101)..(22110): a, c, t, g, unknown or other
  modified_base (22228)..(22404): a, c, t, g, unknown or other
cccaccccccacctcccacccaaccccccaggccccagcagcggaggcagaagccatcatagcgcgccgcttcccggtgccgcggctcaccgtctgcgaccagaacggctcccaggcgcgcttcctgctggccaagctgaaccccagcgcgacctaccagtccagcgctgcgctgtccagcgaggtcatcatgaccgacgacgtatcgctgtcagtgttcacggagcacctgaagaagctggcggtgcagagctgagaggagtgagggcgcatgccggccaggaaacacctccatgcgccatgcacagaccccttggctttcgcctcgtcactcccctcactgatctcgcccgaaccccctagacttggtctgtgttgcatgctagcacgatcgacgcagttcccagccgagacgaagcgcgggtgggccatcgaactccggaagcgcgagttcgacgacccacggtggggggcgggtctgaacaccactcgcgtcccgtaacagcccggatcccgcagagcaagtgcaagaagcaagagacacgggtaagagctccgcgatccgcaagcatgaggtcagcatggacgcaggccctgctgctcctggccgggacggcatgggctgtgtcggcagccaacaccccgggacggcaagtcaccatcgccggcatgcggctcaacacgtgggcgtatcaggagaagagcgccaccaaccccctggatgatatctgtgagtaccccctcgaggcgagggccaggcgagtcccccagcagggcgtcagcatgctcatgcggcactgcgcgcccataccctcgccattccatgcaggttgaatatcctcggcgcgatgctaaacagtgcctcagctcaacacctcttgttccctctacatcccacaatgcagccctggccctatctgcatctgcggagactgcggtgctgtgctactccacgtggtaccccgtcaccacatggaacatgtttgtccacgtcccctccgtcgcctggcccaacatctggtgagtttcaggggtggcttggtgcttgagagtccatcctgattcaatgcgcttgctcctgcaccctctgccgttggcaggcccatcactcaatgcggaagtgtcgcctgcgccagcccctgcgcttggagaatcgcgctggccatgacatcacccctccccccccgtccccccacacacatcaggtacttccccatgagcaccctgataggcagctggcccctccaggccggggacaacctggtttgcgagctgtgggagtgcgacggcggcgtgggcgggtgtgacccggccaagccctccctcctgcccaacgccacggcgggcgacgaccggctgggggagctgaccctgggcatggacgactacgccgcgcagctgacgctgaccagcagcttcaacaccagcgccacgaacgccgcggcgggggtcatgctggagtgcgacaagtgctggcagctgtggagggacaacaacggggcgtgggtgaacccctaccgccagggcgacctccccgcctccatgcggagcggggcgggcatatcccccccgcccgcgccgcccgccggcgcggcggggtcctggctcgtggcgggccaggccggcgcggcgccagagtccggagcagcgcccaaggaggacgcagccaagcctgccgccaatgccccggtcgcagccgcacccgccccggcgaccagcgccccgcgggcggccgcgccctcccccacgctcgagagcggtagtccacggtccacgccgagcgcctcccccaccgcgccagcgccaccctcgcccgctcggcagcaggtcctggcgcccgtgccctcgcccccggccccacaggaggtcacctccttcgatggccccgacgagagcccctcgccagtggagcagagccctgcgacggccgagagtcccgcgccggccgacgcgccggtgaagggcggtggcctggccacaggcgtcatcgccgccatcggcgcggtcgtcgggctcctcgccctgctggccataggcactaccatctactgcgctcgccgggggaagtgctgcttcggacgcggcaaagtctcgtgagtttcaatgagggtatttcagatgccgggctgcagaggggttcttgagggaccagtgagagggcggcccggcgcatgcaccatgtcagaggtcctttgcaccctacatgagccctccttctgcggtgtcctagttagatggggtattccagtattcctgggcaccctgcccagcacacccctctcacacatgcacaaacacacgttcgacctcttcccaaccaccatccccaggcctgagacggcgccatcggacgccgaagcgcaggcagaggacccagccctgcacgtgaacgtgaggaagccgaagcacgccctgcccctgatgagggcggccaatgccagcgcggccaccgtgacgacgccctgggcgccagacctcctggagggccgcagcgacccatgaattatgtggaagtatgtcggcatgcctgaccgggaatagtgttgttatttcattgaagcttgttaagtgccgtcaaataactccatccttactcctcccttgaccctgctgtgtgcttggattcatgtcgatgtttaacctgaagtacctggtcggcagttgtgcgcgagaacgatgttcattactgcgaggaacgggatgctgtgaggcacagcgcaccnnnnnnnnnnaattgaagcttgttgagtgccgtcaaataatcccatcgttcctcctcccctgaccatactgcatgcttggattcatgtcgatgtttaacctggagcatctggtcggcagttgtgcgcgagagcgatgttcattactacacggaacgggatgctgtgaggcacagcgcacctccatctcgtcaccgtatcggggctgcagtgtaccacaggcaatgtgatcgggagggagctggcccccaaggtttctcggcatgggggagctagccccggaggacgcggtgcaccgcacacgcaccgtcatcctcatcgccgccgcgtcgatcttagaaaaggcacggaggttggagcgtgctgggggatgtggggatgcgacggcaacccgcatggcgccgggaccgggccctcgctaccccggtcgcagagcgtcgagccccaatagcactttcaggccggtgccccaggctcagccctcagcccccagccctcagccctcccacccctccaccctacccttccccccgcagtgcgatgagcagatcctgcccgccctgtacgcctgggtgggggcggccttccaggccacccccactcagctgggcaacctggccctggcccgcgccatgatgcaggccctggccagcccgctgggcggcgtctcgagcgccctggccccccgcggcgccgtcatcgccgcgggctgcctcatctgggccaccttcaccgccctgttcggcacgctctcctcctacgccctggccgtccccgtgctggccatgaacgggctgggcctggccctggtcatccccaacgtccagagcctgacggcggactactacccccccggggcgcgcggccgcgcctttggcgccctctggctcgttatcagcctggggggcatgctgggcgcgctgtacgccaccaacatgggcgccgcgacgccgctgggagtccccggctggcgcttcgtcttcgtatccgtcgccgtcgcctccgccggcgtgggtctggccaacggcatctgggtgcacgacccggggtacgcagggcgggccgccgccgcgcgcgaggccggcgcctcgctgtccagcacgctgcgggccatgggcgcgggcgtgctggccgtggcgggcatccccaccttcctcctcatcatcacgcagggcatcgtggggtcggtgccctacgcatccctcatcttcctcaccctctacctccagctggcgggcatgagcgacgcacacgccagcctcctggtcgccgcctacctggcggggggcggcgtgggggggctgatcggcggcgccgtcggcgaccttgccgcccgcctctcgccggggcacggccgcatcctggccacgcagttcagcgtggccgttggcatcccctttgcctgggtcatcttccgggtgagcccgggcaccgcctggtaaaggggttttcgggccgggtatgaaggggaagggaagggaatgggaagatccgtcggcaccccaaatctgctctctcgaggagcgctggcctcctcttgcatgaccctgcctccactctgccatcgggccaaccctcaccctccccaccctccaaaggagctccccatggatggcagcacaccgacctttgtgctccacctgatcgtcatcctgctctttgccatgctcacggcttggccagggccctgctgcaacaaccctgtgtgagtcggtggttgcagcctgacagggggattctggactatgaaggaaggggagtgcaggaggaaagaggtggcttgtgtgctgcgctgtatggagtatgtgtcgcgctggcacggctggcatccctctcacccagcggatgttcggagctatccgacgcacccccagcagcgtccccgggactcttcgcctcccacctgactcgcagctgcccctcgcctcgctgccccatcccctccctgaaaatctcatcccccctctctgcacatgtttcaggtttgccgagatcgtgcctgccgcgcagcgcaacctggtctacgcctttgaccgctgctttgagggcgcggtggccgcctttgcagccccgctggtgggcctgctggcagaaaagtggtacggcttctctggcgccagcaccgtgaccggggacagggagcgggacctggcaaacgcacgggccctggggtcagcgctcctcgccttcctcgccataccctggttcatctgcctctgcgtctactcaggtaccagtttgggcgtgtcttgagagctgactggggttcgggcgcaggtcccgtctcagccacactgccatgcaaggggattcgcgcatgcagccgtggcaggcaatggagccgagtgttgtctgggcgcccgaccaccacccaatgccacccacccannnnnnnnnnccagccacactgccatgcaaggggattcacgcatgcagccgtggcaggcaatggggctgagtgttgcctgggtgcccgaccaccacccaatgccacccacccatcaacctcgacccccgctccagatgaagcatttctgttctccccccgcccctcccccccacaagggctgcactggacgtatccggaggacaagcgcaaggcgctgaagctggagatggagctggcggagctggagatgcgagtgtccggcctgtcctgggacgaggccggggaggacagggaggcgcggaggggcgccgccgaggagcagcggctgctggccgaggagggcaggcagtccaggccgcgttcgcccccgaagcccgagaggtctgccaggagcaggatcggcgcggcgacggtcgcggcgccggtccagggcctggcacgcagcccgcgggcctctgcagcgaacctacggggcggcgaaggcgccgaggccggccgagccgggtctctgcggagctggcccagtgcggtcagcctctgagtgttgcagggagttggcttcccaactccccatgcaacgctgggtatgcaccgggtcccccgactcgttgacctcggctgatacttgacatcacatttaccttgcaacaacccccgcccaaggctagggggactgaattttgtaggaaactggcacatgtcactggaagaaataagaatctactgtgtccatgggagcttgtgtgtggcaaagtagctttgggctcagtccagggctgaggaggggggcaagccacggacgcaattccaaacaaggcatacattaatgcccgagcgtcctcccgctctgtgcgcctagcccaatctcgcaattcccctgagtctcaaggctgtgcctctcatcgcctactcagcacggcaaggatgagggccacctgcgcacggcaggtcccagggagaggcgaggttggttcatggctctcaggtataccaaatctgcagcctgcacctcagggacaaagcggccccttgattggtatcatgctccccaactatgcatcccgggtctctacccaccaagagcacatgggtgagggtgggattgaagccggaggggcttcccagcacgctctcaaacacttggaccagcttcttgaggactgagcgtggtgatggtacgggacagagtgagttccggcgttctaagggataacatcataccagttgtggatttcgtaatgctgccttgagctgtgcannnnnnnnnnatgatggtacgggacagagtgagttcgggcgttccaagggataacatcataccagttgaggatttcgtaatgctgccttgagctgtgcatccccaccgatgcccaccgcacacacctggctgcacactgtccaacagcagagggtggcgggaggaggagaagcgctccagggcgacgtacgcgatctgtacgccagggatgcgaagggagtcgatgaacggacggaatcatccgattacatgtctcctggtactttggatcacactcccgaggtgcaccttgaacnnnnnnnnnngatcatccgattacatgtctcctggtactctggatcacactcccgaggtgcaccttgaactgcgccaagctcagcacgctggcgaagatgaggagggtgggagtgatcagcaggcccagcggccccaatccgcccagcaccatcgcacgtgatgtttgaatggaaacctttacttcgagagaacagtctgtaaggttatcctttggcgcaagccttggtctatatatgaagtgcttgcaaagtgacgggacgcgttcgcgcgtgcgcccagccacagctggttttgagtgacgactcccctcgcccataccttgaatgctgaccacccttgctgaatcacgaggggatactgnnnnnnnnnnaacagctggttttgagtggcgactcccctcgcccataccctgaatgctgcccacccttgctgaatcacgaggggatactgcagcacctgatgcgaggaaagctcagagaatcaaacatcatacttgtcatgcagcccaacagcgatgtattcgcacatgctcaaccagcgtccagcacagcgttgggacctttcacgccgcctcggccttggcagcaggctggccctcgtcagagtctccagcctcctctgtctgtggcagtggaaaaagagcattcacccagtcattggacaggatgttcttggggtccagccgccgtcgcgcggcctggaaggcagccaccgggaacctcctccccagtctttgcctcagggcctccagctcggcggcatcctcagggggctccaccttggcccagtgctcgacggcgtcgtacttgtcgaacagcgcctcggagacgagggtcctgtagcgcttgaagctgtggccggggcggtggggtgggggtggttgagggggccagtggtgagggaggtatgatggacctttcccgtggatcattgagagaggtatacatggacccgtgaccactgcatcctcactcnnnnnnnnnncgtcgtgagggaggtatgatcgacatttcccttggaccattgagagaggtatgcatggacccgtgaccactgcatcctcactcccacatgtcctgggccccattgaaaacagacagcacacacctctgcacgacggcgtccctgcgccgctccccctccgcgtcgccgtcctcgggcacaggcaggtactggatgatgcccacccaggagaagaggtcggccgcgccgccacgcgcggggctcatggccgaggcgctgcccgccgtccagcgctgctcgatgggcgcgggcgcgggcaggccttcccgctccaccagggccagcaggtcacgcgcgtaggccaggtcggcgcccgcgggcgcggcgcgcgtgcccgtggcgaagcacgcctcgctcacgcactgctgcccgccgcagtcgaagcccaggacctcgtcgctccagcccacgcggtggcccgccgagcnnnnnnnnnnnnnnnnnnnnnnnnnnnnnnnnnnnnnnnnnnnnnnnnnnnnnnnnnnnnnnnnnnnnnnnnnggcggcctcggccgcgttcacgcgtcgcacccagcccgcgtccaggggcgcgtgggcgaggagctcgtcgcgcagctggaaggcagacagcggtgcggcctcgcgctccgagagcaggcgcgcggtgacggccagcgcgtgcagcgccgctgcggggtcggctttgccttgtcccgccgccgccgcagccgccgcgatctccgcctcggcgcgcgcggcggcctcgggacccgcctccacgctctgcacgaccaccacggcgtcggtgtgcgggatccacatgtagcgcaggtgccgcgcggcggccaggcgtgtcgcgtgcgcggcgcgcacctgcgccgcgctttccacgctcgtcgtctccagcaggcggtgcgcggggacgcagcgcagcgtcagctccgccaccacccccaggcagcccaggcccactctggcgagccggaagagctccgggtcggactcctgtgcgtcgtgtgtgtgtttgagagtggtcgaggctctgcaatggcaggttcaggactgggagtctcttgcacgaaatgcagcgctcacaccgagtgggtgtgggccagggcagtgtgcacgatgctactccagcaccggcaggtggtggccgtcgtctcatgaccctttaattccacagccagcctcccagggtgaccctcctnnnnnnnnnnccttgcacgaaatgcagcgcgcacaccgagtcggtgtgggccaggggcagtgtgcacgatgctactccagcaccggcaggcggtggccgtcgtctcaagaccctttgataccacagccagcctcccagggtgaccctcctctgccatggggccacttcaccacctcacggtcctctccacaccctcaccccacctcactccccgctaaaccctcaaacccccaacagacacacaggtgctcacctccgtgaggtccaggacaccctccgccggggtcaccagcttcatgcccaccacctgcgcgtccacgggcgggatgcccgcgcccgtgccgtgcgcgccggcctgcacgaagcccgccacgctctgctcccggatgctggcgtagttttgcagggtcagcccgtgctcgcgcaagcgcgccgccacgtcggcgatgcgcgcgccggcctgcacggtgaccagccgccgctcggcgtcgatggacaggatggcgtccatgtgggccaggctcagcatgccctcctccgagaaggccatgccgttgggggagagggcggagcccacaacacgcagcctgctccctgtttggggggaggcggagagaggattgggggcatgaatcttgatggtggtgggccactgtgttgacccagctgtcgagtgagggggaggaacagggggggggaggggctcacaggagagcctgccattcgctgccatggctgtcagcgtggtgaactccacaaccgttcaaggtacgctcgcgtgacatcggccaaaacagcatgcttaccaagcaggcattccatgcgcagatccatgacatccttttcccaataccaccccaccgtacgcaccgcctttgtgtgcgaggttcatgatgttctccaggtccttcaggctctcgggctcgtacaggcggtgcgccaccacggtgtgtgttccgctccagttgctgaactcggccttgggggtggcgctgaggatggggtcccggcgcgcaaagcccgagtagtagctggctccggccgccccgaccaggagcactggggtggggcattgcgttgggatgagggggggggttcgtgagagggccggggctggtactgggacgtggagggatacatgtgtgcgctttggatcatcgaacgacttccagccgcatcgccgcacgtgggggacgatgccaaagctctgggccctggcagcccctccaccaatccctgatgcaaaagtaggcagacaggcacccacctccagccaagatgttgttccgcttcatggcccggagctcctcaggagtagggggcctgaaggggtggggtgcatcatggggcgcaggccgggaggctctcgaggagaaggaccttgattctccaccacctggagtgagtggggtttcgggccaaagatgagcagccagagactcgacagttctcgatggtccacccagtccacatcctgcatgcatgtctatcctctcggcaggcactcacccttacaggtcccaagcacacgcctcaggaggcgctgaaggctccgaggagcatgtgaggtgctcgccatagcccgcccaactcctgccccctgaagatagctcacaccccacgctaaggccgcatgtaaaatcctcgtatccgacagacttcaattgtggttcctcgacgatggggctcccctcgaccactgacattgtatcggtgggttcggattgttcgcgcccaggcgcgtgctggcgtgtcaatctcgatacgaaccaacctgtccnnnnnnnnnncatccgacagacatcaaattgtggttcctcgacgatgggctcacctcgaccacggacattgtatcggtgggttccgattgttcgcgcccaggcgcgtgctggtgtgtcaatctcgatacgaaccaacctgtccctgaacgctacgcacgaatgcgaactctcaatggctgacgatcctgatatctgcataaacctcgcgcaatgaatctgagggtgcgaggccctcggggactggctaccttgccaagtgagtggggggcctgttcttcctctgggctcctcgtccaggcgggtggagatgcaattgaaccgcactcccctgtagaatccattcctatgcaccgcaatcactccaacaaaaagcttnnnnnnnnnncgagatgcaattgaagcgcactcccctgtagcatccattccgatgcaccgcaatcactccaacaaaaagcttgcgtgcaggcgtggaccccaccacctccacctcggagtttcggaacttgctggaatccgcgaccggcatccccgccctccgacaggaggttctggcaggcttccccccgaggcccctggacctgaccagcgatgtgtcgatcacggttctgggcatcaaggcgggggacatgctgaccgtaagggaaagcgtccaggccctgcgggagccagccggcgaggagcagcacactgagaccgcatcagaagtctccacactgcatgccatggaagcgatggtaggacgtctgtggggtggtgcaaggttgtgctgtgtctggggccagcactggggattggcgcacttggcgctctgtggctgcgatgaggacgtcgcctccaatgtggggcatgctcctgcctcaccagtcaggcctccccaacccgatgccttcctgatatgcacaatgcccgtgcaatcgcactcagagcatccctcaagatcgatgcaattcatacatcttccacaggatgaggacgaggcgctggcgcgcgccattgctgcaagcctggacgagccagcggctgcctcccaggcccctcctgcgcagccccgccccgcacccgccgtttctcggcccgccacccgcatccacaccctggcaagcgcgagcgggagggattctggcgaggcgcacgccgcgcccccgcccggcgccgaggtgatgctgccggacggcagctgcctggtgcggcgcgtgatcgacgcggacaacagctgcctgttcaacgcggtggggtacaccatggagagcgggctgcggtacaaagctcccgtcctgcgccagatgatcgtggaggcggtactggccgacccagggcagtggagcgccgccgtcctagaaaaagaccctgttgactactgcgcctggatcgacgacccacaccactggggcggcgccatcgagttgtccatcttgtccaagtgagcgtgtgtctgtgttttggagggggggggtggacagtggatgaggggggtgattattcaaggggaagccggggggaggatgggtatctgctggtgggttgcaaagcccgtggagggaggtgagggcaacagcagtgtggtggaggcatgaggccacggcaagcttctgtcctgtgactggccggcccctccctttccaccgtgcaggcggtacgggcgccagatcgcggccttcgacatccagacgcagcgcctggacctgtacggctccgagcacgccgactacaccgagcgcgtgctggtgctctacgacggcctgcactacgacgcgctggcggtgtcgcccttccccggcgcgcccgaggacatggacgccacggtgttccctgtggacggccctcgcacgcacgaggtcatgacggcggcggggcggctggtggcggccgcgcacgacgcgcgccagttcaccgacaccgccgccttcacgctgcgctgcggcgtctgcggtgctggcctgcgtggcgagcgcgaggcggtgggccacgccaaggccacgggccacgccgacttctcagagtactagtggagttttcttaaagggtgtgagtgtgtgtggccggggggggctgatcgtcacgctctgggtctcggtgaagtggccccgtagggccgagagaagtggtgcaaggcggggcgagatgcatgctggccatggccatgacgcggcaggccgacgtagacgccccaaccgagacctcctctcctggagattgtccgcactgagcctctgcgacaccgtgcatatacacaccgctgacacacccgctgccgcccttacttcttttacacacaaactcttgcttgccctgcctgccccgggatcatagcaggcactctcattgccacgggtgccccattgcaagcactgcacctacaacataggaatgtggggcaaccaatgacacacctccagctcactcgggttccatggccttggccagcccctgcgcaaaggcccgctttgcgtcgggggccacagggtcttgacccaggtacatctcgaacaggcccttcaccagggtcggggaggcaatggtgccagcctggggggatgggtgggtgggttagggagctgtgtcagacgcacgatggaaggtggggaaagctggctcctgcacagcgtcggctcgttagcatcggcactgcaatggctggcgatcgacaaaccctcccagccctgctcacacagcctctcgatgccccttgacccctgccatttnnnnnnnnnnnnnnnnnnnnnnnnnnnnnnnnnnnnnnnnnnnnnnnnnnnnnnnnnnnnntccgtgcccctgtggaagcccttgctctcaaattgcgccgcaaaggccggcagggaggtggagtccccagcctgggggaggtgattggtagggcgacgtggatctcatgaggcccagacacgctcagaagtttagatcatgcagggcttgaagtgactgatgccttgcagtgaagataacacgaaaccagggcaccatacatcagccagccaatgatgagagagcacgagggttctagaacccagtgactgcaccccttcccgccccagccaggaggctggagggccgagcgccacccttcctcacacctgctccatcacgggcgccaaattctcctccagagcatggagaaatcggctctgggtgacgagccggnnnnnnnnnnccgtggatctcatgatgcccagacacactcagaagtttagatcgtgcagggctcgaagagactgatgccttgcagtgaagataacacgaaaaccagggcaccatacatcagccagccaacgatgagagagcacgagggttctaagaacccagtgactgcaccccttcccaccccagccaggaggctggaaggccgagcgccacccttactcacacctgctccatcaccggcgccaaattctcctccagagcgtggagaaatcggctctgggtgacgagccggctggtgatgacgatgcggagcgtcctttccaaatcagaaccatggatcaggactgaggaaggtgggggagcgaggtaaggaaacgcggaaagggggatgtagacagtggatggggaggcgatggggtggtcaagattgtatggtccaattgagttgtgggtgccacacgtgtagccctcacaccacaagcctccacccatgcatggtgaccgcaccatcaaacatctggctgagagggagttcttgtccctcggcagtcgccttcagtcgtggcacgtccacatagagccccaggctatagactgcaaagaggataggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacactcactgtccaagttcttgaaccctgccagcttcctactcctcactctggaggatgatggaatgaacagggtgtcgtcacaggcaatccaactggcggagtacagctgtcgtggaggatgctcagagtggtctcaccccctcgccagaccatctgcagatctcacaccccacaaccccagcgacggctcacccagtgccgatcaggacgggacagggtgactgatcagcacgcaggcaaaagtcgcctgggtagaaagtgcctgtgcgcggctctttggttgcagggggagcatcgcggctagtatcttggctgaggctgatgctgccgaacggagtgtgcggccgcaccgctgggggcacggcagaatctagcctcaacttcttggcatctccccgggcgatgaacatcatgaaaggtagttaaatctatgctggtctgatgctgcgatgggagggatgcatgccgtgacatggggagagatttcgcatcggatcctcccgatgatgttctgggcgcatcacggcaaccccgaaaagcagggtgacattctatactttgaagtccaccgctgaattggaattgacagatgcaaacttcgtcatgcttataagtgttcccttgtgcaaggattcattgtcagcagggcggtatgtgtgccgttacagacacattcatgctgctggnnnnnnnnnngagcagggtgacattctgtactttgaagtccaccgcagaattggaattgacagatgcaaacttcgtaatgcttatacgtgctcctttatgcaaggattcattgtcagcagggtggtatgcgtgccgttacagacacattcatgctgctggctgaggatctcctaatagcaacttgctgtcttgtagcaattgccaaaagatccccacaaatcagtcctcttaacaaatgctattactcctacatgtcctagcacatagctgtggaaatcactttaggacgctatctgaacacactacatgcgagtgcatctcgccaagacttctgttggaatgaacactcttgtaaatacannnnnnnnnntgcaattgccaaaagattcccacaagtaagtcctctaaaccaatgctattactccttcatatcctagcacatagctgtggaaattattgtaggactctatctgaacacactgcatgccagtgcatcttgccaagacctctgttggaatgaacactcttgtaaatacatcaagcaagatcataaagccattcctcttgaccctgctctcgctggttggacgtccagcacaacttcaatgcgtaatcagatagtcgatgcagcagtgctgctttgcagaagatggcggcgggattctctccttgagcttcgctaggtgactttaaagatcgtttgcccatgccaaggttctgcgaaggttgaggtagtgtttcgcaaggaatgatagcagctatagaagcagcatggtacgggtgccctcgtgattcttgatgagtgcagtttgatgccatatgagtgccccagtcatcagaagctacccagaggaagcgattggagnnnnnnnnnntagcatggtacggatgccctcgtgattcttgatgagcacagtttgatgccatatgagtgccccagtcgtcagaagctacccagaggaagcgattggagtgtgcagccttccaagtcttcagaaatgatttttcaggcaagcacaatcgcaggtgctatagctgaaacttcaagcgcaggcctcacatacgctgtggaaggagccctgttttcgaacatcgacttccatcacatgcatggattgcannnnnnnnnntgctgtgaaaggagccctgttttagaccatcgacttccatcacatgcatggattgcatggtagcctgttgcttgtcgacggctggtacccactgcccctagaatagaacattacagcatgagctgctcagcagcttgcacttgtttgtcaacctcctctcaactcgatcaggcactcagggttctcagtagtcagaggagtgactgaatcggacggcagctggacctttggtggctgtccctggtggcagtccccagtcggcgtcatggtgagaaaagcatgaacggttgcaacccccatcaatcacactcagcatgccatgtgtaggttcacaccatcttgccctcacgagcctctctcaggtgcacacagcgcgcttgtggatcgagaccctcggtcgccagccggctgtcgtatgccagggcgcaaaatggaagttcacgtacgccccttttgacccgggccgccccgactcctcgcgcagacaacccacaagctccagtggtggcccggcctctccctctttcaggccacaggccccgcaacgtagcagggcgctctcgaaatggtggcactcaaactgcagaagcgcctggcggcgtccgtgctgggatgcggtctgcggaaggtgtggctggaccccaatgaggtgaacgacatctccatggccaactcccgtgagtccgtggagggtatggataagggatgagggccgcgatgagcagccagcggtgggcggaggcgctgcccggctcgggcgcagtcgggcatggcttcccgccccgccctgtctcggctcctctgcgcctggcacggcctgggagcccggtcatggatgctgtgggaatgcgaagctcttcctctgctgtcccgctggcccggcgagtccctggcggataggcccggcctctcgtcgcaaacgtttgggctgacggcccgccccctcccctctccatcgtcacagggcaaaacgtccgcaagctggtgaaggacggattcatcatccgcaagcccgagaagatccactcccgctctcgcgcgcgtgcatcggcagaggctaaggccaagggccgacacactggctacggtgcgtgttttcctcacgacggagggggggagattggtgggcactgctgggcgtacatgaagcccctgggtctttgtgagggtgtgtgaagttcacagcagccctctcccacagcctctgtccgttcctggatcgtgggatgcatggcatggccccgtccccctccacaccaccttccactacttcaccccccccccctccatcccgggcacccacatgcnnnnnnnnnntatggccccgtcccctctacaccaccttccactacttcacaacccccccctccatcccgggcacccacatgcaggtaagcggcgcggaacccgcgaggcccgcctgcccaccaaggtcttgtggctgcgccgcctgcgcgtgctgcgccgcatgctcaagaagtaccgcgactccaagaagatcgaccgccacctgtaccgcgagctgtacctgaaggtcaagggtaacgtgtacaagaacaagcgcgtgctgatggaggccatccacaagcagaaggcggaccgcattcgcgagaaggcgctggccgaccagttcgaggcgcgccgcgccaagaacaaggccatgcgcgagaggaagctggcgaggagggaggagcgcctggcggccggcatcgtcggcgtcaccgacgcccccaagggcgccgcgcccgccaaggcgtgagggcctttggggcgggcggcggggtccggcggcgggggatgtcccccggccggcactggtcgccctctcaggctcgcgtctctgccacttgctgtaagctgacaaggatactcttgcggcgaccgctgatggggtcgaggggggcaggagggtagggcttgttggctgacagggtgccggatgaggtatcagagcattgtgggccccctggggccgagacttcatgctgcactgcagcaggcaatcactttgggagaacgaggggattgtcgcattgggcagccacacagggagcatcaggtttgcaagcagcggaatgagcggtggcggagacgtcacccgactcccggcagcctgtccccagggttgatctgggcgaggtgttgggagtggtggtggtgtgaggagagggtcggagggggtgcgccgcattgtgtcgccctgggctgcacatggccatcccttggcctgtctccatgcagcgcggcgacaacagcaatcaggaggaggagttgggggagggagtcgcccaccttcgacatccagtacacccaccttgagccgatcccccttccagtcgatcatgtaccgcgcctctggctcctcgacgccagcgggcgggggcgcggccggggcgctgccacccgcgccatcccgcagcccgctgagcaggatcccccnnnnnnnnnnggcgggcgggggcgcggcctgggcgctgccgcccgcatcatcccgcagcccgctgagcaggatcccccccttggtagcctccagtatctcctggctctgaacaggcgtctcccggtacacgtgccaaacgggggagccatggacaatgctgtgggccagcctctcgccccacgccctgtgctgatcggccgggatggaggcccagaggctctccagggccgccatgtcaggcatgtccagctccagctgacgggaggaagggagggaagaggtgggggttgggtgttggaggaacttggtgggaggagcatcaggcacagcaggggctcgaaggtgcagcaagggagggcaacaggtttccagaggccaagcgttgcactgcacccactcctgatcagtgctcctgacggnnnnnnnnnngctcgaaggtgcagcatgggagggcaacaggtttccagaggccaagcattgcaccgcacccactcctgatcagtgctcctgacggctctagagtcctcagcgctgtcttgccaaaccccctcccccccatgcgtgagataccaagtccgcaccttgccctacctctatcctgctctccgggacgcccaccgccccagaaaggatgcgggcgtcggataagcgcaggccagcctcctgcccaatcgtcaggatccattcctggatgtgggccagcgcctcctgcttcgacccgtaccttgtaggaggggaggtatgggcgctatggccatggcatgctggcatgaacaggcagagaggcatcagtcttggtgcagaggacgagcaggagcggcagcaatcccttgccatcaagatctgatgactccattaaacatcagtaccgggtcttacttgacatcgaacaaccagcgacagcgcaggccgcacaccggcgacactgggcgaggtcgaggccgtctcaggnnnnnnnnnncgccatcaagatctgatgacaacattaaacatcagtaccgggtcttacttcgaatcaaaacaccagcgcgctcgcaggccgcacgctggtgacactgggcgaggtcgaggccgtctcaggccacgcagcagtgaaaggggcagcttgcaagagatacaatgtccctgggcggcatgcaacgcaggcattgcggcctttatatcgtggataagctgaggtagactggtgctatgtggcgatcaannnnnnnnnnggtgaaaggggctgcttgcaagagatacaatgcccctgggcatgcaacgcaggcattgcggcctttatgtcgtgaataagttgaggtagactggtgctatgtggcgatcaagtgcacgactgcttgcatgccatgtggattgctaggagcacgggttttaaaaccagcatcaagagactgccagggacatatgcagaaactcggccaatggtgcaccccacaatcctcggtacactctctgaaaatgtccctttcaagttttcaaggcatgcagagaccgaagcggggattcatcttatgaccgattgcacaatggggccatcgcatggcctgacgccccagtcttgcgtctcgatcggattgcctaccctccagacatgatgtctgttgaagtaatactagatagaaaccgctctctaacgaccgtccctgtgcacctgaatactagnnnnnnnnnnactggccaatggtgcaccccacaatcctcggtgcactctctgaatgtcccttttgtgtttgcaaggcatgcagagaccggggcggggattcatcttatgaccgactgcacaatggggccatcgcatggcctgacgccccagtctttcgtctcgatcaatcggattgcctgccctccagacatgatgtatgttgaagttatactagatagaaaccgctatcgaacgaccgtccctgtgcacctgaatactagaatgtccagcagccaccgacgcagaaggggaagactcagggttgtagagccccaatagaagaatctgcatcttcatggcagagcagcgtaggatcctccagggttaccctttctgagtgacccagagactcctcagcatctgtctctgtctccacactgtctgtatcaacaccttgtacttggcagtgattctgaactattttatagaatacacaatgttccatccaaggacggcaggcctgccagcatgagacacttgacggtcagaaaacaagatgagttattcaaaacatctagaaaatggcagtcagaccgttgctttccatatttttccaagggtgnnnnnnnnnnaaaggggaagactcagggttgtagagcccaaacagaaaaatctgcatcttcatggcagagcagcgtaggatcctccagggttaccctttctgagtgacccagagactcctcagcgtctgtctctgtctccacacggtctgtatcaacaccttatacttggcagtgattctgaactattttatgttccaaggacggcaggcctgtaaaaatgagacacttgacgatcagaaaacaagatgagtcattcaaaacatctagaaaatggcagtcaaaccgttgctttccatatttttccaagggtggtagtgctgcaaaatggctttgcttggagccttaacggcacaagctttgggatggcggtggccagctttgctccagcttgataggagagctctttctaggtagcagtggctgcgagcttgcgataggaggcagatgttgcttttttgcctggcgtacgcgatggcgtttttgacagtgacagtgatggctttttggattgaggaagtgagctttttcttcgtggaggaggcgacctccttgctgtgggtgttggtgcagtcctcttggtgagcttggaagacatcttggatactggttgccgggtgatctttgttgtgggaggtgatgccttttttgacgtggaaggcgctggtttccttgttgagggagacgcatgcatcttttgtgcacaaggtggggatttcttggctgaaaggattggaaccttcttcaagggagggggggacgttttcctcgaaggtgatgctgggggcatcattgatcgaggggatgggacctttcgtggtggaagaggtgatgccttcattggttgaggagatggggccttttgtgatgcaaggctcgtggacttcctcggtggagggggtggagactctgttggcagaggtggcggggacttctttggcggagcgggtggggattctgtgggcggagagggtgcagacttcatcggtgaaggaggcggtggcaaaatgaatggaggggggggtaattcagtaggaggagggctgagaaacttctttggcggaggtggtggagactctgtcggcnnnnnnnnnnccttcctcggtggagggggtggggacttcgttggcggcggtggtggggactctgtcggcagaggtggtggggacttctttggcggaggtggtggggacgtcattggggaaggtggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacttcgttggcggcgggggtggggactctgtgggcggaggggatggggattttatcggtgaaggaggcggtggcaacatgaatggagggggtggggattctgtgggcggagggctgagagacttcttgggtggaggaggtggtgattcggtgggcggagggggtgggaactcagtcgatgaaagacatggcgacatcagtggtcggatctgttcgtgtgaggtaggtgttggcttcctcaatggagaggaaggtgcctgctgtgcc

SEQ ID NO: 48288 - DNA, 361 bp, Chlorella protothecoides
  modified_base (102)..(293): a, c, t, g, unknown or other
catcctcctgggactggtatgctggcgcaatatctggtggcttgcacaaaactgccggcgtgtgcatgctggagggcgatggagcgcgggccaaggagacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtcgccgcttacctggtccagtgagctggggtggcagtcgcattgggaaagctgggtcctacattaa

SEQ ID NO: 48289 - DNA, 61 bp, Chlorella protothecoides
tttgatatcgtttttaagagtatggctgggggccactggggcagttgtagcctgtcatagc

SEQ ID NO: 48290 - DNA, 61 bp, Chlorella protothecoides
ggcaggccagtgccgagcagattgcaggggaagggaggtgtcgctaccaggggcctggctt

SEQ ID NO: 48291 - DNA, 61 bp, Chlorella protothecoides
cgcaaggtggggacgatccttacgacccgcaacagcagcacctgtgtgctcgctgtcttgt

SEQ ID NO: 48292 - DNA, 231 bp, Chlorella protothecoides
ggcagaggtgtgtggggctgtagttccacgtagagcgtagaggtcctatggggcttattgccgacacttctctcgtagtgcactggtaataccaccttgatacatggcaatggagtttcatcagtcatcccccaatgctgacacctcatacaggctacagtgcacattgaagggctagttatggtcgaagtcctcgacaaactacggctgagactgcttagatatccgata

SEQ ID NO: 48293 - DNA, 61 bp, Chlorella protothecoides
ttgaagaaggctgggccgacggatgaacaaaccactcaagtagttgaatgtagtttgaatc

SEQ ID NO: 48294 - DNA, 69 bp, Chlorella protothecoides
agtgcagagtctgcctcgtcagtaatcccgccctgtccgcatcacggcagcatggagggctctgagttc

SEQ ID NO: 48295 - DNA, 61 bp, Chlorella protothecoides
ggctcgcgccgggcccggctgccccgccaggacctgcaacacccccaggtgctgccggcac

SEQ ID NO: 48296 - DNA, 61 bp, Chlorella protothecoides
tccaccagtaaaagcttaacgaagccgcattaaagggtagtaggagagcgatcatgtccat

SEQ ID NO: 48297 - DNA, 76 bp, Chlorella protothecoides
atccacgaccatgacaactcccactgctggctgacatgcctggatgtgagtgctgattgttggtctgctgcgccgt

SEQ ID NO: 48298 - DNA, 605 bp, Chlorella protothecoides
  modified_base (150)..(378): a, c, t, g, unknown or other
cgctctgccccgaggtgagcttcccgcaggaaaatggcaagctcctcggtgccagccagacacctcaggacctgtttcttcaagctctcacatgcaccctccagcctgtctaaagccatgctcacccaccaacaccgcccccgtcagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactccagtgagtctttgctggggtgtaaggggttgcaagtgtgcatttattgggtacacgtgccgccacatgcaccgtcactgggcgtctgcatgagtacatcaaaccggaggcccctggcctggcgcgattcacgcggagtgcccgaccgagtcggcggcccattgctcgtcgcacctccccggtcgatgatctcataccccagccgcccagcccgtcgcacccga

SEQ ID NO: 48299 - DNA, 61 bp, Chlorella protothecoides
ctcagacatgaagccatgcagcactgattctacggcatcaccctattcccaccacaactgc

SEQ ID NO: 48300 - DNA, 73 bp, Chlorella protothecoides
aaagggggaatagaggagggacaggagggtgaacacagtatcaacgcaggacaacaggtggaggggcaaggga

SEQ ID NO: 48301 - DNA, 67 bp, Chlorella protothecoides
cgcgctgaaggacgtaagacttgactgcggcgtaaagggtccaaatctcgagcgccagatctcaact

SEQ ID NO: 48302 - DNA, 61 bp, Chlorella protothecoides
caatcttcccatcccgcccctggcaggcggaggcgacaagggctgagctggaggctgatag

SEQ ID NO: 48303 - DNA, 73 bp, Chlorella protothecoides
actgcaaggcgctgcgcgcacagcgctgggaggcccagggccgtcgcctgccccgttgcggggcccacccagc

SEQ ID NO: 48304 - DNA, 68 bp, Chlorella protothecoides
ggggaccatgggtgcgccaacatgtcccctcaggcatgggtggcagaaggtggggactggacggacac

SEQ ID NO: 48305 - DNA, 61 bp, Chlorella protothecoides
tcgaccatcgcatccctctccaccggctggtactgacaatcacacggcaaccccttgctgc

SEQ ID NO: 48306 - DNA, 61 bp, Chlorella protothecoides
tgcagaacagacgatgatattgaagagtcaactcgacagccataataccgactgcagagca

SEQ ID NO: 48307 - DNA, 99 bp, Chlorella protothecoides
gcaggacggcccagggggcaggtctgaagcggcgctgcaagggccccgcctggcgcagccacaacccggcgtgacctccgtgccctcgcctcgcccagg

SEQ ID NO: 48308 - DNA, 69 bp, Chlorella protothecoides
cgcgccgcccgccacggggcacaggcagcactgcggcggcgcggcgcggcccgggtcgggcccgtcccc

SEQ ID NO: 48309 - DNA, 17866 bp, Chlorella protothecoides
  modified_base (3889)..(3898): a, c, t, g, unknown or other
  modified_base (6780)..(6789): a, c, t, g, unknown or other
  modified_base (7830)..(7839): a, c, t, g, unknown or other
  modified_base (8229)..(8238): a, c, t, g, unknown or other
  modified_base (9890)..(9899): a, c, t, g, unknown or other
  modified_base (10220)..(10229): a, c, t, g, unknown or other
  modified_base (10293)..(10302): a, c, t, g, unknown or other
  modified_base (10706)..(10715): a, c, t, g, unknown or other
  modified_base (12106)..(12115): a, c, t, g, unknown or other
  modified_base (12359)..(12368): a, c, t, g, unknown or other
  modified_base (12740)..(12749): a, c, t, g, unknown or other
  modified_base (14240)..(14249): a, c, t, g, unknown or other
  modified_base (14556)..(14565): a, c, t, g, unknown or other
  modified_base (14651)..(14863): a, c, t, g, unknown or other
  modified_base (15037)..(15046): a, c, t, g, unknown or other
  modified_base (15215)..(15246): a, c, t, g, unknown or other
  modified_base (15418)..(15427): a, c, t, g, unknown or other
  modified_base (15957)..(15966): a, c, t, g, unknown or other
  modified_base (16509)..(16518): a, c, t, g, unknown or other
  modified_base (17088)..(17097): a, c, t, g, unknown or other
gcgccgccgccaccagcgagctgggggagggcttgggcgcggccagacccgcgacgcgcggcggcgtgccggggaagtgcgcgcccaccaggcccaggctctcgtagccgtgggaggcggcgggcgcggggctggcgtagtcgttcgcatcgcgcgcgcgggcgctggcattgccgccgtgcccaatctccaccatgccctccagcacgtgccgagcgccggcgtgagcgcgcgggtcaaagtcgccgccctccgtctgctcggaggtggcggtgcaggggtccgcgccgccgggggcgccgccctgcccgccgcccaggccccaggccgccagctcgccgcccgggccggacttgccgatgacgtaggaggccagcggattgtccacgctggtgccggccagcgggcccagcccgcccaggcccagcaggccctccagcccctgctgctggccggggtggtgctgatgctggtgctggtgctggttctggtgcccggcgtggtggtgcagctcgcccaggcccggcatgtgccctgcgccggccatgctcggggcggtgctggacaggtaggcctggagcaggtcggggtggtgcaggtgggcgtggtcggccaggtcggggagggggggcgtgaagcctggggtggggcctccccctcctcctccaccccctccatgcccggacagcaggcccagggcgtccaggtagccggggcccagcagctgcatcaccgagttcccgaggtggccggggccctcgttggggcccaaatcaacgcccatgtccatgggagggcgctgcgcggggggcggggcggggaggcacggtggcgtccgaggtattctcggacaccacaacgatcacagggaagatgcggggccagccgaaagggcttcagggcatgcagggggtgtgatcggggcccgaaacgcaccttgggtgggttgtggacgctgagcacaagccggtatctggcaggcctggtcgcgtggaagggtcagggcctgctcccgttgccccgctcccgtcctcctgtggccaagacaatgtaatgttggggttatgctgggcagggtcaagtcgggcccagacaagatggcttggggcggcggggaagggaggtgccgcgcgcctccttgacctacactcctcccgcacatggggtgttacctgctttctgatagggggggccggtcagaatcactcgcacgcctgagacaccgtgctcaatgctgcaaccagcgtgtaatgcgctctcggtctcgatcagcacggactggggcccatgctgcgcgaaggggggggggccacgctccgacacctggtaaggcaggggctggtgggtgctcgtcgaaagacctgacgacgcggagcaaggaaggattagaaactcgggtctcatccaccattgacctcctgactccctcgacagggatgctcactcctgtgcgggatgcagtccaacgcggggatgccatgtgactcgctcggagggtcccaggtggcttgggtctccaggcatttgaccctggtaaacatgcactgaggaatactcattctctctcgcacaggaatactctgggtgctgaatgccccattcagggcacagcgagtcccatatataactgccatgcggcagtaggctgccaggggtcccatgggaggctgctgctcctccccagacgatggcagacactccctgacacctcgtaccaagcgagacaaggagcgacagataaaaacctggcaggcctccgggataatatcggtccgcagcgcaggccacaaggtaacaatctaaatgcatgctgtgcatcatgatcgcctgtgacgaagcgggcgtgttgggttggcactcgcgacgaggcgcgcaccctgttccggcatcatcatgcagaggccgtgcctcctggcctgttacagataccgcccctcatctcgtactcaggagttgccggaggaagtgaggacggcactcaggaatgcgcgtgtgctggatgcagcgggcaacaacctgcagagcatcccggactgggtgctcgaagccagcagccttaagcgcctgctcctgcagagcaacgcactgcgtcacctaccgtctgggatgtcccagcttcggtccctccgcgtgctaaacttggccagcaatgccctcacgcacctgccggatctccaaggcctggtgctcctacaggtcctcactctctctcagaatcacctggaggaggtagaccccagcatcggatgcctcacagccctcacgcagctcgatgtgtccggtgagctggccgggcatgcagagatgaggagagtagaaaatggtgctgcattttccacttacttgttttgccaatgatgtctgggttggagattggagtcggggaggatccagaaaacgccaccgagcaccgctgccacacccctatccatcaggcaacaagctgaccaggctgccgcccaccttgggcaagtgcatggccctgacggaagtgcttgcttctgacaacaggctcgtggaggtccccattgagctgggccgactacaaaagctccagacgctgaacctggagcgaaactccttggccatcatcccgccagccgtgctggtgggctgcatctgcctgcagacgctcctgctccagggcaaccccctcacgtcggagcagctcgcggccactgaggggtatgcagactatgaacagaggcggcagaggaagtatgacaaagtcctcgccaccaatgtcctcacatcaggcttcacagaagccattgaccgtgacgtcgctgtaacgtgaccagaaccctggaatggcttcagggtttggattgggaggctgccagactcatgatcagtatgggcaccagcaaaataggtcgatgccccgacctgtgcaatcttggcgggaagcgtcataatagtagaacgtccctcacctctcgacttcgcctccaagttcgagctccctgccgggctctgtctcttttcgtgacagcgaagaaccacaggacgcaggagacttgcacaagatggtgcgtggcgtgggccgggacggcgaccggggcgccgcactggaggcgaagccagcaccacgcgagtgtcgcgacgctggctgagcctgggcaatgccgtgatgtttctagcttgcggcatggcatcattccggctgcccactgcccgcgcgatgcttgagacgccctctacggggcaaggaggcggacccgcactgattttggcggggcacctcgggggacttcgctgtccccgtcgtagctttttgtgactctttcgggtcatttcgctgtgtgcatggaatatttccgacctgcgcctccccctggatcgccgttcgcaggtgctcgcctgcgatatcgacctgctgaaccctcctaaggagctggagaagcgcaagcacaagcttcaccgcctggttgcctccccaaactcctacttcatggatgtcaagtgccaggggtgcttcaacatgtgagttatgggcgcgcccctgacctgcgggtggcgactcatctctctcccgtgcttggacgatcgcggctgatgtagagccaggatcatccttttgaccccatcccgacccctcccctgcgcagcaccaccgtgttcagccactcccagaccgtggtggtgtgcactaactgcaacaccgtcctgtgcgtccctaccggcggaaaggctcgtctgaccgagggtgaggaagagatcagggttgcctgtggatggggcagcgaccctggtcacagtgcagagtgtgcatgtttgtgcctgcacacataccttggtcctgcatgcatctctcgtgcggcgcttggcctacatcccacacccctgtctcctcctctccaggctgctctttccggcggaaggctgnnnnnnnnnncctcgtgcggcgcttggcctacatccctcacccctgttcctccactccaggctgctctttccggcggaaggctgacagctgatcgtctgtgcccctcccgcctacctggaggccatggctgggtgtgcactgacgtctgtaacgctgccgctcttctagcaccagttgggcttcaagctggaaaacggagtatcatgagggtcgtgggtcctggtgggggatgggagctgccttgtgaggcaagctgggtcggcacaggggccacagtggcatgcgcaccagcgccgccatgggtgccgtgccaggtcgctagccagcgcgggggtagaggatgtcgtagtgccccgggcggtacagtaggtggacgctgggatccacgggcgctgcacctgccaggccctctggcacaaaatcgtgcatgtcaacgtgggcttcgtccctggcaccgggcccgccgtgcccgccgggcgaggcgctgcggtccaggtacaccacgcgcagtggcacctggagggaagggggcattgcaaggggggggttgccgatcagcagcagggcaaccggccagggggctcccccaaccaatgagccagcggcagcccctgcagtgatggaccatggcaacctgcctgcagcgcgttggtgagggcgacaatgtgcacatggtcgctctcctcgtccatggggtccacaaagcgctggcagaaggggccgacgccgaggtcactcatgccctgccaaggtgggggggtggaggaggtgtgggcacctgtgtcatcgccggcatcgcagtcgtgctgctgcttcagggttggtcttgctgcacggcccatgggccccccacacaactcaccattatgaagggctcgaagaagtctgatcgcctccggatctcgcagctggtgatcatccgcatgaggaacacgacgtagttgctgatgtactctgttgggggaaggaccggtttggcagattgcttgagtaggctcaccattgttccactgggatccagggttgcacatggtcagagtcaacatgctgggcgcagcaagatacccgtccctcttctcgttgcgcgacttgccagagcacatgttctgttccagaatatcaatggacaggggctccacagggctcccgatgtttctgaccatgtcaagcatggcatccatgggagtctccatcactggcgtggggattttgaagcagggtcgtcagagcttccggcatgctacccgcagagttacaaccattgttgcccagtacaaattgtcacagcctgtgccaaggtgaggagcctgcagggcgctccataccccccatgccctgacccacccatctcctcatagccagcctcggtcagctgcttcttgacttccgccagccgagccagaaccctgcggaccaggggagaggcctgacacggtcagcatgcaaccacagtgtagtgacgaggacattggatcaggcgctgtcttctgaatcagttctggtcaggttgcacctcctcttcaaggccattcaaagggcaccctgcacgaaggccatccacgcttcaatgccgcactccacacctatccttctcggcgtcatcccccatcagcagcatccgctcgatgaaggcaaacacaaaggagcgaaagaagcagttcccgtccccgcgcgtccgtcggatgaggccgtaggccccctccagggtctggatcttggacaggaagacgggcgagccggcggcgtactctgccgccagcgaggacaggggctcgggctggcccaccagcgcctgcttcccgggtccggcctcgcggatggtattctcccaggcgataatatcggcgtctgatggccggtccgggaagagcgggccgccgggggccgtgccagctgcaacctcggaagcctcgatgggggcacccagcatcatcgcttcgctcgaggagacgctgggaggacaggacgatgggggctgggctcggaacgcagcaggccctggcagggctcaggggggcagcttgatccattgcccctggcagactgtctcctgcaccctctcggcaatgtgggccagtcggcgaacaggctcctcctggcagcatgagttctcctcacacccctctcacccatgcactcaccgggccagctctggcgccccctggctggtacccagcgtgctgccctcatcgacgctgttgctactgcagcctggggccatgcacggatcagcagtggatcccacgtgctgggatacggagggctccgggccaaagttggagcccgacaccccggaggtctccccgaaggcttggctggctgttgcggcaggatgcgccgacacggacgcccctccttctgccgtgttcatgctctcgaataccacctctcccacggatgcctcgggtgtggggcgcgtggaggaccctccaaagacccgagagcctgtcggggagctgtggccctgggcgataggcgcaccgtacccgctgcattggctgctggacataacactcacttgaatagcagcgcaagttaaagagcaaactcagacctgaccggctccagggccgatcagaggctgtcgttgccgtggttctgggataatggaggcttgcagatgctcctcgtcctgatctggagagtgctttcgggtaggtttgtacgacagtcactgagttcaagcttcgagagtatgccagtgctgtgctcagcgtgaagttttgtgatcactgtttcggcagtcgagcgccactttcttgcggagagagcttccgagattagggttcgatgggcgggacactgcggcattagagccctaagcctgtgccgagggatctcgctcatcattaattgttcgaaacacctggctctctggactgtcaacaggnnnnnnnnnnagcattggagccctaagccactgccgagggacctcgctcatcaataattgttcaaaacacctggctctctggactgtcaacaggcttgatgaaggttgccagcctattctcgggagcaggggcgctcgacctgggtctgcaccaggtacgtcctccccatgcgcgcgctgatcgttgatgaattctgggttacgatccaagcgatgtgaatgctaattcactcattgcgcattgcttgatcccaggctgggcacgaagtcatcctgctgtgcgaggcggaccaaggcgcccggcaggtgatgctgggggtccctccggccccccacccaccgttgggaaactcggatcggagcatgtgggggttgaatgaggtgggagggtgcccatacccctcatctgaccccccatgccccatttacacctccatgcatccctgacgatcaggtgctgacctctgcgttcccgggggtgcacatcaccgaggatgtggctgccctcgagcgtttgcccgaggtgggtgatcggacgggcaggcatggccggggtcgctgggtgtgggtggggagtgggccgagggctttgttaccgaggtttcctggccaggtgtgtcgagacgggcaggaggcatggccgacccccctgacccagcagcaggcaggaccccatcatcacgcgcccctgtgtgcactgggcacatgaatctctccctgcattcaccccatacccctgcacccacccccgccgcgctcaccaggagacagaactgctggctgccgggttcccctgcatcgacgtcagccgggcggggctgcgccggggtctagagggcaagtccacgggcctcgtgcgccacgtattccgcctgctgcgcgtcgcggcccgagcccgccgccctgtgccctgggtcctgctggagaacgtgagcgagacggtcctgggtgggtgcggggggttgcctttgatctggccctgctccccggtccgactaatgcagccggcctggcgcccatgtcgcgcgccgctccccactcccctcccgtnnnnnnnnnntttgatctggccctgctccccggtccgacccatgcagccggcctggcgcccacgtcgcgcgccgctccccactcccctcccgtcccaccgacccggccctgccgctcgcaggtggaggcgctgctggaccgcgccaacggcgagccccctgtgatgcagtacatcgcccgccaattccaggagcttgggtatggatcctgggcgtaccgggtggtcaactccgcaggtagctggctggcggggtgctgccgggggatggtggagggatgattggctgggggcggaagttcccgggctaggagtggtgggtgtgagtgtcgacctgcagaggtaggactgatgcatggcggcgccgacttcgtcgcgcgctgggttgcggcacggcgcggnnnnnnnnnngatgattggctgggggcggaaggtcccgggctaggagtggtgggtatgagtgtcaacctgcagaggtaggactgacgcatggcggcgctgactccgtcgcgcgctgggttgcggcacggcgcggcgctgcaagggcattccttctccaggggatatcggtgcagcggtcgttcggcagctacttcccccccgcccctcgtgctcctcacaaggctttgggctgcccaaccgccgccggcgagtgttcattgtggcctccatgcacggcgatgcccgggacgtgctcctggcccaggtgagggattgtgtgttgctgcaagcgctccgtgcgttgctgcaagcgccagatgcgtgtgggagggttttgacaagggtgtcccgggcgtgcacagcaggcgagccatgccggtgcaccagactacagctctgcgccactccatcgatgcagggcgccatgggctgcccggggtcctgcaagcacctcttcgacggccagctgtgctacagctgctactgctcctcggatcggtcggcgcgggaggtttcctacgccatcgacctcggcaacgcgatgtgggtccctggaagggggggtggagcgggtgctcgggcaggagagggggaggttcataagccgagcaagctggctgctgtcccgaaccagggccggccagcctcaggggtgcagcgatgggtcctgctgcgcatccagaatggctgcccaaccaatccgacccccccgcctctgaagcctcacgcatcttcctcgttccctcctattaccaaactcacagctcgccggcgggggaggacgtggtgcccacgttcaccacctcaaacgaccgcatgctgctcctcctttcctccgggctcagcggaatgttgcgctgtgatgatgccgagcggctgcaggtgacggggccggggaaacttggggacacaaggctgggtggggatccctgctgtggcacatagtggaagcgtgcttgctgttatctgtgctgtgttgccgaggggccaagtggatggagtctgcaccctgtcagggatcgacgttggccccttgcaagccccacctctaaaccttgtcgcaaccaacagggcttgccggagggctacaccaagccctgctggccgctggcggggccggggctggggggccaccgcctggcgcgaccccgggacgtggatgcagagacagcggccgccaagcgctgggatctgctgggtgggtgctgtgcgtcgggctgtggtggagagaggccgccgcgcatgttgtgggcttttatccagttggtcctctcccctcgcggcaggaaacgcggtgaccgtgccagtcgcgcgctggctgggggagcgcctggcccagccctacgccttcaagtaccagaccgcgggggtcagcaaccggcggatggatgcacttgtccgggagggaatggcagatgccgggccggaagctggcaggtgggtgttttggtgagaaattttgacatggtgagccgttggctggacactggaatccatggttgcctgctgcacccctgcactggctagacctgggtatgggaaagatttcggccattggagagtcattgtggtgctgaatatccccattttcaaacacgatctggagattgctgacagtgaannnnnnnnnncgtccgggagggaatggcagatgccgagccggaggctggcaggttggtgtttgggtgagaaatttgacatgatgagctgtcggctggacactggaatccatggttgcctgctgcacccctgcactggctagacctgggtatgggacagatttcggccattggagagtcattgtggtattcagttcccccatctttaaacacgatctggagattgctgacagtgaaaccagccacgttggtcatagcacgccatatcatccctttctccctcctcaacacggcgcaggccctcccccaacctgtggagctttgtgtgcctgnnnnnnnnnncggccggcgagatcgaggtcgaggtcgagggcatggaggcccccctccccgacctgaccacggnnnnnnnnnngatgagctccaggaggcggtgctcttcccctacctgctgtcccgcccaaagcccgccgtggccggcgaggtcgaggccgagggcgtggaggcccccctccccgacctgaccacgggcgactggctggaccccgccaccaatgcggcccgcgaggccacggccgaggtcatcctggcccagaccgacgaggcgggccgggaccgggagctggagaaggacatgtttcaggcagcgctggtgcatcgggtgaggcagcgggtggcctgccctggatcttggtggctggctttactgcccgcatgagtcgctgcatgcacatgttgaccctcagagcacacgagggggtagcacaggcagtggtgctggcacataatcctggcactgcaccccccaaccccacccannnnnnnnnncagggggtagcacaggcggtggtgctggcccatggtcctggcactgcaccccccaaccccacccaatcccccgggcaggcgcgcaaggggcagctgtcgggcgtggcccgcctgcagaccccctgggacaaagaggcctggccccgcgccgggtggtgggtgcgaggcttgggcgcgtttgcggtggaggacatgtcggagcaccccgtgcccacgccctttctaccgctgggggacttcatcggagaagtggggaggtgtgcggagggggagggggggtgctgtgaggggtcaccacaggctggggtgtcgctggggtgggacctggaggagggtctgccagggcacatcaccaatgtcgccggtgacagggccccccccctcatccccctttcttcccacaccacaggccggccaggcccgaggaggtcgactcctacctgcacaggatgcaggagcgggggtgggacgcctcgaacaccgtcgcgaagttgctgaagaacaatgcacgcttctcctatgaggtgggtgcatgcgctgggggaggggcctatcagaccagatcttttctgtgctgtggtgtgtgagagtcgagacgcgggctgctgcatgacgggcaggttgagaggaaaggctccgagccttccttgcaccatcatgagagctagcgtgacactcgactccacaccgaccaccccctaccttccttctgccctcgctccaggtgcgcaacatctcgcgcctgccgggcctgctctcggacgccgacatgatcggccccctgtgctgggcgctggaccctcagtcgggcgcatggtggcctgtggaggtcctggaccccatgtcgctgcccacaggtgactgggatggagggcaggggtgcgcaggggaggaatggactggctttgacacgaggcaggacacccagggacagtgttcggaacacagcaatgcactggaccaccatgcaggccggacgctgccgcccgaggcactcgcagatctcagctccgagcagagggttgcctccctgccgtcgcacgccgcctcggcggccatggcccagcaagtggtgcgctcattcctttggcgagcagctgcggccgtgcgtccctcaaactgcatgttgcggcagtccaagcatgggcttgccgaggagactgagctggggctgtgtccgccgcaagcgctccaaggggtgcattgatgccttcatgtcctccgcctcctctccctgactgtccctttcaggcgccagaagacaagcgggtgttggtcaactacctcccagtgcatggcgccgtctggcaggtgacacgtgtctcatggtggaggggacgaggctgtcagaggagatccatcgacgtcagctgggcttccaagaagtgcannnnnnnnnnagtgtctcgtagtggaggggacgtggcagtcagaggagatccgtcgacgtcagctgggcttccaagaagtgcatgggcatgcccgtgacgagtggagacggggtgcagtgaagtctgcctcgcgctgttgccgtatcctccctctgatctagcccaccctggccaggtggctgtgagcgtcgcctgtgctttactgaaagtgtaagcacttgacccaccctcccccgcctctcacacacgacannnnnnnnnngtactgggagtgtgagcacttgaccccaccctcccccgcctctcacacacgacacagtggcgccatccggacgacctcatcccatacgaggcaaaccttgcagccaaggagagcgccgcatctgcggccatccggtcgggcaagttcaagcatgctgagaagctgagccaggcgctggcaggtggggaacaatggggggagttggattttgaccagtcatgtgcttggatgtaagcctggttgctgcaggtcactgcgacctgtaacgatgggcgagacagcaagtatgatcctgcatcccttgattcatgcttgcgggtgacccctgtctcaacacataccccccactgcgcaccatctggtatcccagcnnnnnnnnnncgcttgcggtgacccctgtcttaacacatatcccccactgcgcaccatctggtatcccagccgcccagccccgcccccaaattcatcccatgcagacgcgcgcgcctcgctttccatcctgaagggtcggcacacgctggagggcgaccgcatgcggcgcacgcgcgccgccgcggccgcctcggcggtgaatttgaagcagcgctgtggcggctgcaagacctgcatgaacctgctggcggggcagcgccgctacgagtgcctgacgcagcgcatgaaggccgccgcgctgtccggccacgccggcgcgcagcttgcagtgtgccgtgaggacgcgctgggcgcgcgcgtgcgcgtgtggtgggacggcgacgccaccttctactcgggcgtggtggcgcactacgacgccgtcagcaccgagcacaccgtctgctatgacgacggcgaggtgggcatgcacaagctgtggcagcatgacgagcgcatcaacgtggagtcgggggtggaggagtggccgcgggaagccgaggcggccaggcagaagctgcgcaccgcacacgacctgctccgcgacaagaagcgcgtggtgagggtgtgttttggggggtttgggagggggttggaggaaaccatttccctctgggaggttgaaagcggtgcagcatcattccagcctgccctgctgcaccatcttagagcttgtggtggaggatgagatttccggtcctcggtcctcggccctgcacagagtactgtgtgctccaagtccactgctcctgcgggggctgcgtcgctagcagcgccctcgtgaggatggccggccggctcaacgcccacccccgcccaccctgctcccaacctgacagggctccccgccgtcggcagcccagctgccggcgctgggcctcagcgactatgagcagaagcgggcagagctggtgcgccgcaaccggctcatgttcgagcagacgctggcaaacggaggggaagcggggttggaggggccgggcagcggcgaatctggcgtcgcggcgccaggggagacggccgtggaggggcccgcgagcctggcagggggagcatcagggccgagccaggactggtctggaggcggccagcggccagaggcagtggtatcggtgtccctccctgcaggcgcgcctgtccaatccgccccaaagcggaagcactctgccagcggcaagaagggcggcagcaagaagaagaaggcgcacggcggcgcggccacgtgccctgccaatggagccaaggcgggcaatgccctggacgctgagcaagggcccgcgacgccgacgcccacccagcccaggaggagcctgtgcgtgctgtgtcggaagactgggggcacagcctgcatggtggtgagcaggggtgggtggtgtggggcagtgcatggcggattcgacgcacagcaggcccacggcttgccacatcgaggtcatcacatacagctcccatcgctccacnnnnnnnnnntgcacagcatgacggctcaggcccacagcctaacacatcggggtcatcacatacagctcccatcgctccaacccctgcagtcgtgcgtggggtgtgcagcggcggatgtcacgccgcccacgctctcccactccacgtgccgagggcgcgaggcggcgcgcaacgacgaggacccgctgcaggactggaggtgccccaagtgccgcgcagcgcagcgagagctgggacccgagcatgcgctgcgggggctcgccgaggcggtccttgtggcggcctgagtgacgcggtggattgcacaagtttgaannnnnnnnnntacgccgcctacgctctcccactccacgtgccgaggccgcgaggcggcgcgcaatgacgaggacccgctgcaggactggaggtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccaggatttgcgagggcttacttcttttgagtattgcctactcttacttcagcaatgcaatgatcaccagtgcaggcctaaggcaactgtcatggatgcgcctctgacatcttcccctttcgagtgatcctgttcaccttgtttgagcacctttgacatcctacacgtaagnnnnnnnnnnctccaggatttacgagggcttacttctttttgagtgttgcccactcttacttcagcaatgcaatgatcaccagtgcaggcctgaggcaaatgtcgcgcctctgacattttcccctttcgagtgatcctgttcaccttctttgagcacctttgacatcctacacgtaagnnnnnnnnnnnnnnnnnnnnnnnnnnnnnnnntgtcatagcgattcctgctcaccctgcgccagatgaggtccaatgcacgccagtcagctagaattgatgcagggaatgaagagtgctggtgggtgcatgaatcacagcgtctcatcaatcctaccagccactcatggagggcacgccttctggggtgacaaagccacagctnnnnnnnnnnggtcatagcgattcccgctcaccctgcgccagatgaggtccaatgcgtgccagtcagccagaattgatgccggaaaggaagaatgctggcgggtgcatggatcccagcatctcatcgatcctaccagccactcacgccttctggggtgacaaagccacagcttttctctcagtagctttcaggctgccccaggctggccccaggctctgcgggcccaggcatcggcgccagccagcagcctggtgaggcacagcgccagaccgacgacgagcagcacgaccgcgaccaggagcccggcccgcaccagcaccctctgtcgctgctgccgcagcctcagctcccgggcggagggcgcgggggggtgactggggccggcggggcgcgctgcacggtggcccagcttcctgccgtcgtccaccgctcctccctccccagccgtgcgctggagcaggcccgtgcgtggcttggaggccgccggccccccagccgcagcagggacgccgctcgcctcgtcaggcggcgccggtccnnnnnnnnnncggcgcgggggggtgactggggccggcagggcgcgctacacggtggcctatcttcttgccgtcgtcgaccgctcctccctccccagccgcacgctggagcaggcccgtgcgtggcttgggggccgccgggcccccagccgcagcagggatgccgctcgcctcgtcaggcggcgccggtcccttggcggcagcagcctcggagcgcgccggcccaggcttggccctgcaggcggcactgcatggcagcaggcggagggccacgccgtcctcgacccggggctcccgcccgctcctcgccagcagcgcgcgtgcctcgacgcagggcatccgctgcttggtcgccttgcaggcgcaccgcaccgtcaccagctcctggcaggtgccggacccgggacaggggcccccgtggcatggctctgagagtgcgggacggggaggcttctgttgggagggctggcatcgagggacacaagcacaattacacaggtgccagggctacgctcgtgtgggcaaggagagcctcaccgtcgcatgtccacgctnnnnnnnnnncggctctgagggtgtgggacggagaggcttctgtcggagcggctggcatcgagggacacaagcacaatcacacaggtgccagggctacgctcgtgcgggcgaggagagcctcaccgtcgcatgtccacgcttgcgcccgattggtgatacctcgctggcctacggatacacatgcatggccatctgcccatgctcaaggcagcccacccccctccccggaccacaccgacctcggcaaaggtggggacacaggggcagcgtgcggagacagacagccccgcagctgcgcaggtcgcggtctggtcgggactcctgaccagtcagctgcgcgcaggcgatgctgagcgtcgacttgccgcagtggcatgcctgggaggggggcgaggggccggggggtacggggattgagaccagccatggctttggattgggactcggggacaaactcgtggcgagcgcagccccacctcgatgcagcaccgatggcacgcagtgcactgcagcagggagccataaaggcgcacactgagaccccctcgcaagcgcacctgctgcaccagctctacacannnnnnnnnntaggggcatggagaccaggcaaggctctggattggggctcgggggcaaactcgtggcgagggcagccccacctcgctgcagcaccgatggcacacagtgcactgcagcagggagctgtgaaggcgcaccctgagaccccctcacaagcgcacctgctgcaccagctctacacacactgggcaggcgtccgggtggcaggcgagcgggcaggcgtgcgcgcacgccccccgcgccaccccacaccggcgcgtgcagggcgtgcagggtcccgcgtggcaggcgagcgcgcaagcatgccgcccgcacgccagcggcttatcgcagggcgcgccgcaggcgtaggggccgcttgcgctgcagggcagctgccgcacctcgtggcctccgaggcagggcgccgcaacagggtgcatgcaaggcgggcagggcgtcatcgcctgtccatcccgcacagcccgctccgtcgcctctgcggcggccgacacgggtccgcttcggtcgacgcttcggtcggcggaaccactcgccgccgcggccccgcccgccggtggcggccggggggcggcgtactctgccactgccgtgggagcggcgtcatggcacgcctcgctggcgcacaggtgcccgcagggcaggcgagtgccgcagggcagcgggcagggcggacaagggccgtagtggcaggcatgctgcgcacgctgggccgggtccccgccggcgtgtcggcacggcgcagggacggcgcacggctggcggcaggcgggggggg

SEQ ID NO: 48310 - DNA, 72 bp, Chlorella protothecoides
aagatgtcctgcggtggttgttggtggggggagacaactgtgatgcgtctcagggccaagaccatccttgat

SEQ ID NO: 48311 - DNA, 80 bp, Chlorella protothecoides
catggccacccgcccagggtccatgccgacgaccatgtggatctcggcttccgtgaggggtagtccatgtctgcggtgag

SEQ ID NO: 48312 - DNA, 61 bp, Chlorella protothecoides
agatccacgccttttccgtcccccatcaacaccccgccaatgcgcaggcgctgggcctcgc

SEQ ID NO: 48313 - DNA, 380 bp, Chlorella protothecoides
gaaagtgcacatcttgtgtggacgtgaaatatggccaaccaggtcaaacaccaagaattcgtcaagatagatgctacatttccgttggaataccttggaaggggagctttcaatgaggaaggctgccccaagcgcgggctgttcacgctctcattgtgcttgaactgggaacacccaccatctagcatgaattatctaggataccgttacgtcctcagatccatctctacatgtccccacagcagcatactcagatgtccgttagtcagcatgacactcatgcgtacagcttcaggtacgtcccgcagatagattgatgtgtgtcgcatgtagcccaccgtgtctcggtgttcgccatacgtggaatcaggcttcacaaa

SEQ ID NO: 48314 - DNA, 13986 bp, Chlorella protothecoides
  modified_base (355)..(364): a, c, t, g, unknown or other
  modified_base (546)..(555): a, c, t, g, unknown or other
  modified_base (891)..(900): a, c, t, g, unknown or other
  modified_base (1060)..(1069): a, c, t, g, unknown or other
  modified_base (1645)..(1654): a, c, t, g, unknown or other
  modified_base (3202)..(3211): a, c, t, g, unknown or other
  modified_base (4786)..(4795): a, c, t, g, unknown or other
  modified_base (4867)..(4876): a, c, t, g, unknown or other
  modified_base (5029)..(5133): a, c, t, g, unknown or other
  modified_base (6001)..(6010): a, c, t, g, unknown or other
  modified_base (6486)..(6649): a, c, t, g, unknown or other
  modified_base (6728)..(6737): a, c, t, g, unknown or other
  modified_base (6819)..(6828): a, c, t, g, unknown or other
  modified_base (7015)..(7048): a, c, t, g, unknown or other
  modified_base (7480)..(7489): a, c, t, g, unknown or other
  modified_base (8585)..(8594): a, c, t, g, unknown or other
  modified_base (9283)..(9292): a, c, t, g, unknown or other
  modified_base (9854)..(9885): a, c, t, g, unknown or other
  modified_base (10097)..(10106): a, c, t, g, unknown or other
  modified_base (10208)..(10217): a, c, t, g, unknown or other
  modified_base (10319)..(10483): a, c, t, g, unknown or other
  modified_base (11628)..(11637): a, c, t, g, unknown or other
  modified_base (12838)..(12915): a, c, t, g, unknown or other
  modified_base (13383)..(13392): a, c, t, g, unknown or other
cgccgcctccccgccagccgcgccgggcggcgccggactcacgctgcggcggacagctgcgggcatcccccccccgccgccaccgccgccgtcgggtggcggcgtggccttgcgtttccggggtacggcgcctgccgcaggggcggcgggcgcggggtcggccggcggctggactgcgggcaggttgtccaggctgggcgtgccgtccaggtcctcgtcatcgctgtcgtcctcgtcatccaggtcgtccaggtcgctgtctgcggtggaaaaaggggaggaaagagggtggagggcgcatccgtgatgcaaggcaggccaggatccgaacggcaagctggcacagagcagcgcnnnnnnnnnnaagggcgcatccgcgatgcaaggcaggccggggtccgaacggcaagctggcacagagcagcgcgcacgctccttgctgagtccccacgttcatcctcgggcaacccaaagaagcagttgttggggatgctatctgtgccgccagtggcaatcatcaggcccccccaggccatcagcgctacnnnnnnnnnnaccacgtccctcctcgggcaacccaaagaagcagatgttggggatgctatctatgccgccagcggcaaacatcaggcccccccaggccatcagcgctaccaacaaagctctccctcccaaggaccatggcacacaggcctcaccctccgcgtctgaatctcgcagccccgtgtcgcgcatcatcttcttgatggtgcgccgcacggcctctggccgtgccgcgccctcgtcgtccgagtcgctcattggcctccggctgcgcagcgagcatgacagagggatttacattggtgaaccaacgtcacggctgggcaagtggcagcgctctcaaacatnnnnnnnnnntatgacagagggatttccattggtgaggcaacgtcaaggctgggcaagtggcagcgctctcaaacatcccgcgcaatgctgcttcctacaaaaccttggctgggaggacccgactcccagcaaacagttcccaccttcgaacagggctggcctccacccnnnnnnnnnnaccccgactcccagcaagcagtcccccaccttcgaacagggctggcctccaccccgccctccccctcatccgcctccatgtcgaggtcgtcgtcggccgcctcatcctcatggtcccaatcctcggcctgcagagagggaaggccggcagtgcaaggtggggtgggtttgggagcagctccacgaggggccagcatcgcattggtcatgtagcagaaaggtgggccttgccgcagcccctcgagtcctggttcacagcagccttcagtctgtgtctggcaccagggcagaatgaagggaccaagtacgctccccacaccttgtcgtctggcccctcgtcctcgcctcctcctcctgcatgccgctgagctgacgtactgcccaggggctttcttgctgctgcacgttcatggtggttggtgtggtggagcggatgagagccggctcacgacaaacctgaggcgaggccctcagctcgccagacaactgatgaggctccttgtcttgaaccccggtcaatctgtgctcccaatacacgcaggcaggaccatcccgcacgcccctgcccctgcccagnnnnnnnnnnctgaaccccggtcaatacttgcttccaatacacgcatgcagaaccatcccgcacgcccctgcccctgcccagcaatggtgttaccttgtggggcggtgtgggaggccgccctggccttgatccccttccactcctcgtcagagtcggcgccatcctcatcacgatcagcgccagagggcagggcgggggcgtccacgtcggcgccggaggcttgcagggctgccacaaaccgggggttgatgcgatcgtgctgctgcctggctgctgccatcgcagcctctgcagcctccagcctgcacggtggatccaggggcaagcatgcgtgacatgattgaagaggcactgggttcacgggctagcatagaggctgcaacaccctagaagtgtcaacagcttgatactcaattgtcccggcatgaagccacacaagagcccctcccaccaatgacctccctcacgtttggccaggcctgccggtctctggtcgaaagttgtaccattcctcaacggggatagccacgaaatcgttgctccccctttccttgaccagcaggaactggtttgacccgaggcctccctctggcatgcccctataggacctgaccccctcccgtctcagtctgaggcgccgaggcttgggcccagccctgcgcagaggcacagcacaggtgtggggatccctggcgtacaggagaatctattgcaatcatcacaccctccagcgtcctgccacctcacgttctgggtgggggtggcccggcacgggtgagccctgcgggaatctcctctgcttccatctgccatggcgcggcgctggacgcagttcccagatccggcagctctagtgggaatcgaccaatgaagtgctgcatgtacgcatggtctgatccagccgcgcgaacagtgaactgctgtgtgggagcggacatggtgatggtccgcaaccagatcaaccctgtatctaggacgcagtcgacatcaagaaattttgatggtctgtagtttaagggacatgttcggtcttcgaactggaagccggggaggcgagaaattggcgtcgcgctcttttgatcagatggctttctgaactcattacagggcgccacggccaggcagatgattgtcaggtcttaaggcaggttcttgacctgtgctgccaagtctgatgcatccagcttcttggcggcctcctcaaactcagtgaagtccaggctcccatcgtctttgcgcttcagaaccctctgtgtgccaggcaggtacagaatccttggcaggatgacctgaggagcctatttcatgcccatcagcaccctgttcacaaactgcaacatcctacagatcaaaccctgagaaatgggatttctcatcatctctcacctttagcccgccgcaatctcctatccccatctcagcctgccgtttgcagtacttgagatccaaggccctcttgttcctgctcgttggtgggaggagtattggaaggtagatctatcaatgtcaagggcatatcagtacactcaaacactcatgcttccctggcagtaagtnnnnnnnnnnagagtattggaaggtagatctgtcaaggtcaagggcatatcagtgcaatcaaacactcatgcttccctggcagtaagtgccacccacttggcctggttatctgtgctttgcttctgcaaaggatgaggtgaagggcgtcattttcatgcggtcgacattatatgacgaagcactgaacttcatgtctcgtcatgacatcaccttgagccgtgtcaggaagtcgctcccctcgaaggcctccgttgctttctgatcagcagccagggcagcctcccgcctctccttgatgatctcaaggacgtcggtaccaggaaacttaaagatgtcaaaggcttggctgggaagtggagtcacactccacaaagcagcagggagagctaggaataggcgcctgggaatctgcggaggctggcttcggggtggggactgatgacctccctcactgcagcatctgaccgtccggcatggatttgcaaatgctctcatggtataaaatgcttacttgctcgttaggatttaggaaaggtgagctgcattgccgaggaatgatctgtcttccggcaatctggaggattggcttcgcatgcgcaggagatggaaacggtggcgacctcccatgaacatggacagcgaacagagcttgaaggcagcaaactcccaactccaagccgcaacatgtgtaatatcctttgttaggacatggaaaagagacattacactcttaaccaccacccttgtttaagcccatggcctaccaagcatgcacgacaggtgggccatagggcggtcacacgaaacgttagtcctcgagatgctgaggtacaacgtgaggcggccatgtccaggatccgtaaagctcgcctctatcagcagaagactgctgaggcacaggtctgatggctgggtctctggctggctggtgctgtggttcccaggcgtcgattagtttgcagaaaggcctggctacctcctgccaaccgtctaatttcgaattcatgagggttagatttcagtgtttgtcacccctcggtacatgatggtgcagaatgtcaaagatagcaacaaatccactggagcaaaagaggcagcaacatatgcaaggggcaccgtcgacggtgacgcagcccagacagcggctgcacctgatgcagcacccatacaacaagctacacctagcacatctgctgcagggcagatacgctcaggaccagagaatgccgatgcagcgccagtgagggtaggtactggtgtgtgtggtgccttgagatcggtgggcataggaggatctctggtgcaaggtgaagcgcatgcgtctcaatgctggatgcagacccctgaaccccttctgaatctttccaggccccaccaggtgcatccagctctcagcttgggcaaagtcggcctctggtcccaagcaatgcgggtgatgaggcggggtccaacccaagatcaacttcagctgcctccaccacagctgctgctaccagtgacgggagtgcgtaccagccctccgtgtcgacttggggactcttcccgcgccctgctgacatcagcaagacctatggaggtgggctnnnnnnnnnnctgcgctagcacaataccggaggaacgtggggctggatgttgatcctgacgctgcggctgccgcacagaagnnnnnnnnnngcggaggcagggtatctcggtttgccctccgctcttgcagatccttcgttctcaaccccctttgcccctccacgcagggggccggacgctgcgacccggcgccgcgctggaaagcgccgaggcggccgccgcgcgcaccgcgcgcatcgacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggtggacagcggggccgggtacttccgggtggggcagctccaagccgcgctggccgagtgagatgacggaggatttggctcagggggatgttgcccttgagagagggtggcacggatgcagtggttgtgtgacgacagctcatgtgccatcaacagtccttgcgtctgtttccctgtcgctggcccaacccccccttgcaccctgccgacctttgatgtgccccctgccctcgagccgcccaccctcgcccgcccaggtaccaggcagcgggcctcctcgttcctatgaaaagcgcggtggggggcgacgccgccctgggcgccgcactttccctggactcgctggggcgcggcgaggaggccgcggagctgtacaaggccctgcgctcgcaccgcaaggcagaggtggccaaggtggccgcccgcatgctcttcggcttcaaggcggccgagaagctgaaggtggcgtccatggggtccctgtcgcccgccagtgactggacgccctacttccagcgcatcgcccggcaggacaccgcctggggcgcggcgggcgtgccggcccccaagaaagccgccggggaggaaagcgcggggagtggcggcctgcgcacacgcctgctggggtggggtgtggcgatcgcgctcgcctccccctgcctatggctggcgtggcgagtgtactcccaccagcacggcccctgaaacccctgttcgtgcggtgctctgaggatgtttcttcccgcaggcttgcccaggttgcacgtgaccggacatggggaggactgtccctggcgctgtcatctgtgtacagagccagcacgttggtcgcatttcaacctggcaggggcaaggctgcagctggnnnnnnnnnngcggacatggggaggactgtccctggggctgtcatcggtgtacagagccagcacgtcgctcgcatatcaacctggcaggggcaaggctgcagctgggcgtcggcagctttctcgtgctggggataggtcaggagcggtgggcccccgcgatgtcccgcatgaggcccggcacgatgcgcagctgccaggcgggccagcgcagagtcgaccccggcagctcgctgctggtccggagccagtcctccagctgctgagcatgccctgtgcctggggtgtgtggttgcggagggagaggaatagcacacgaacggagtcgaagaagggcgagggaggtgagccaagcatggtgtgcggggtcggcacacaaagcctgaggggccggaggacctacacagcactgcgagcaccatcatccccccaccccaacccccccagcaaccagaagcccaccttcctgccgggcccaggcccgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctggccgtgccctcctgtgggtggagagggccgcgaggggtgtcagggggggtgctggggacacgtccactgagacnnnnnnnnnngcctggccgtgccctcctgtgggtggagggagccgcgaggggtgtcagggaggggggtgctggggacacgtccactgagacnnnnnnnnnncccttccacccccagcaaccagaatcccaccttcctgccgggcccaggcccgcaggctcctcaggcacgtgtgccgccgccctcccagcgcctcagtcagggcgaggcttgtggccacgccgcggccgacgcctggcaggcccacgaattcacgcaccgcacgctcctccccgcacagctcctccgnnnnnnnnnnnnnnnnnnnnnnnnnnnnnnnnnncagggtcgagccgcctgcgcccatgggtgcccatggcgcccagccctccgcaggcctcctgaacaccaccaccttgagcgccgcagccagctcccgagcgtcgtacaggccggcgatggcgcgctgagtcagcgcgtcagagaagccaaagtactggggcccgctgatgcgctggcccgtccggtgggccaggcacacggctgtccagggctgggtgggggtgggcccctcgaactcctggccgggacccgacagggctcggatctgctggtggggaggcgacagatgggacagggatcggtcgaacacccctgggcagtgcagcagctggcactttggggagcgggcaccgcaggctcgggctgcaggtaccgctccagcatgcattcgcagggccatcgccgcctcccaaacacaccgaccttgaacacnnnnnnnnnnagggaggcgacagatgggacagggatcggtcaaacacccctgagcagtgcagcagctggcacttgggggagcaggcaccgcaggctcgggctgcaagtaccactccagcatgcattcgcagagccatcaccgcctcccaaacacaccgaccttgaacaccggtccagcctcccccaggccaatggacatctcgtactcgcgcccaaacaccgtcttggaggcacggtagcccactgggtaggcgtggtggtacaagcagccaggggaggaccagtacctgtctgcccaggcggctcggtggatgcagcccaggtcccacaccgtcacacctgacccattcagggagggtgcagcgttgggagtgagagtcacagccagtcatgccttcgcccctgtcacaagaacccacagcccccagcgtctcccacacttgccgatggagcgcagggtgaagggggcttctatctcgggaccggttcccagctccatctcggtgaaggccagtctggggcggcgcaccggggccgcaggctgggtggccgccgcagccgtctggacggcagccgagctgggggtctgcagccggctgctggatctccgcggcgcacactttggaggctgcagggaggcaaggggcttgcatcagacccggaaggagagtggtcggccccctctcaatgcatcctagcaccgatcactgtccacctgtgaggcctttgtctttttgagtggcggcgcctgcagggagccgcgtcgggtcgtggaatggttgcactgatgtgtttgtaagatgcctaacgagcgcagcctttcggcgtttgcagcgatccggtgcgcccgcatctcctcgtactggttctccgacggccccatcatggggtgcagggtgccagtcaagcttttaaggaagcctcccgtgtcatgctgccaatccggcgatccgacagtattcctatctgcgataaaagggtttatagagcttgatcttcgctgggatggacacaaggttgggtgtagtggttgcgcgccggttcagcgcaacgtactcggagcaggtggcgacaaatcgtatatattcttactttcctataaatgnnnnnnnnnnattcagcgcagcaggtggcgacagatcgtatatattcttactttcctataaatgttccaatccttctcattgtctagaaactttcgacggaaatcttctagcacccttcgagagacgggctcgccactcctcccgctcgcccacaaacagccacatcgctgccgctattgaggtggaattcccagagtgctgtcagcccagcaagcttgcatcacagtggacctgctcacagcgctacctgcccgttgttgtgccctccaccgtgaccccagtcttcccgcttgttcgcccgaaggcgagcagcggagcgcatgtagtccccatttcctcggcgcatatcaataagactgccctgaagccgaagcgacatgggcaaggactattatgcggtgctaggagtaaggaggggttgcgacgacgagtgcgaactcaaaaagggtgagcctcacgggcaaaggggagtggagaggctcatcccatgctctctttacctcgcacgacacccattcattgtatcttgggaatgaagatgtgccacaacgcttcacggcatctcgcatcgcctcaatcatgcagcataccggagactggccatgaagttccacccggtatgtgtgtgatgggccgatgactggggcccctgctgcatggtgtagtccgaatctggggtgggggggggggggttgggnnnnnnnnnnggatgactggggcccctgctgcatggtgcagtccgaatctggggtggggggtggattgagattcctgcggttcctcagggagcgcatggagtgtagagccctttcggcgttgtcctgcgtccctgcacagctgtccaccgggcaactcccctcgctcctgttcccaggacaagacccagctggacaagcaggactgcgagcagcgcttcaaggaggtgatagaggcctatgaggtcctgagcgacgccaggaagaaggccgcctacgaccgctggggggatgccggggtcagtggcacgcacaccgccttcttcgccacggccttctcggccagccccggcgacacgccctccgcgaagcgcccccacccctgccccgcctccagcgcctttgccggcttcgcggcctgctcctccgccttccagcacaattttcagcaggagtttttctcgaccttcagcgacatgttttcgggcgacgcgccgcaggcgggccagccctgtgcgcctggaagggccttcccgggtgaggcggtggggggagcctgcagcgcagctggggnnnnnnnnnnnnnnnnnnnnnnnnnnnnnnnncgcaaccccccctcaccttctgcatgcccccaagcaggcgccgccgcgcccccagtgctcaagaaggacgcggcgatcgaggtgccgctgcactgcacgctggaggagctgtaccagggtaccaccaagcgaatgcgtgtggaccgcgcggtgcccatcgcggattccgccaccggccggcgcagcgaggtgctgacggtgcaggtcatgcnnnnnnnnnngcggtggatcaccgagacggccccgccgatgagttgtcgtggaggaagcgtcggcggaaggcatgccctcgcggcacccagccgtgctcgcctggccccgannnnnnnnnntcggtgggtcaccgagacgggcccgccgatgagttctcgtggaggagtcgtcgtcggaaggcatgccctctcggcacccagccgtgctcgcctggccccgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgcgtgtggaccgcgcggtgcccaccgtcgagtccgccactggccggtgcagcgaggtgctgacggtgcaggtcatgcctggctggcgcgcggggacgcgcgtgaccttccccgagaagggcgacgtgcgccccggccgcatccccgccgacgtggtgttcgtggtcgaggagcgcccgcaccccagctatgtgcgggacggcgccgacctggtgtacacccaccgcctggcactggtggacgcgctgtgcggctgcactgccctcgtgcccacgctggacgggcgcgagctggcgctgagcgtgcagggcgtggtggcccagggcgccgagcgcttgatccccggggagggcatgcccctgggcgccggcgcgcgcggcaacctccgtgtccgcttcgacgtccagttcccgccagcactggatgcgggggcgcgagagatgctgcgcgccgcgctgccgccaggcccgctcgagggcgaggcctgagcgagtgcgccgaggcgcagctgctgctgcgggctgcagcgacgctggccgcccgaggagggctggtcctggacagagaggcgccgagcaggcgccccagctgaccagggccccccccgctgcgccacccgtaacaccaccacaccattgtatgacgaccaccgaccatgtaccttggcagccctggtcctccccgcggcccgacggccgtgcagcctgcgcagcagagggcacggcccccgacgcgtcccgacagacctgcgccgcaccgaatctccgcactgatacccacctgcaggtgacacgcaagaccccccttccccgcaggggtgcggtgcccagcttgagaatgtgactgcgcaccacatccctgccctcatcacctcttatccctccctgtcgccctgtcgccggcgccgatgcgctgtgcatgtacacttttacagctgagaaggagcagaggcacgaagggtttagatgtttctgggtggttcaccgcgtcaggcagaggtctgggaagtttctgctgaagggcctttgtgcagctgttgccgtgcggggatttgcggccccggagcctgctgctctctgtgccgttcaccggcctcactcctggacggtcaacacgagggccagcacggcggcgaggtaggcnnnnnnnnnnattgtgcagctgttaccttgcagggttttgcggccccggagcctcctgcattccgtgccgcccgccggcctcactcctggatggtcagcacgagggccagcacggcggcgaggtaggcggcgtaccaggccatgagcgcgccgcccacccagcgcggcaggcggcgcgcgcgcgccagggccacgcccaccagcgccagcgcgctggtcacggcgcaggccatgcccagcgcggcgacggggggcagggccacggccagcgcgcgccccggcgcggcgggcagcgcggtggcgaaccccacgcccaggcccagcagcgcgttgaacatgggccccgcgaagcaggcggtcatggccatggaggtgccgtgcgcgccgcgccgcgccaggctggcgttggtcaccaggtcggccagggagttgccccaggccaggacggtgacgcccaggaccgcgggctgcacgcccgacagcacgccgaagaactggaggaggcccaccagctcgttggccgccaggttgatccacagcgcggcgacggcaaaccccgccagcgccaccagcagcgcgcccagcgggtaccccgtgcccagcgcccagtcggggggccgggaggccagcacgcccgggtgcgtcagcacgcccgcggcggcggccagcgccgcgcccgcgcccgcggcggccgccaggctggccgcgtcgaagcgctggagcgccaagttcagcgcggagggcgccagcagcgccgacagcacgaaccagccgcggcgatacgcgtccttctccaccagcgggaccgaggcgcgtagggcgaggacgaaggggcgctccaacgcccacaggcagagcgcgagcctgggttggatcgccgaccaggcccgcgtcgctcggtcgacgggcgcgcgccaccaggcgtcggggagcgtttgggtggaggctgagggcagggtgcccggctcccgagtgcacggaccgggctcaggcccgtacggcgccgagtcgggcagcgcgcccgagggctgcggcgtgggcggcggggccgggccggaacggggcggccccgtcgagcgcccggtccagaggaactcgtcgccggccccctcgccgttcccttcgcccccgccgcgctccatgcggtccagcttgaactcgtagacgcggggcgtgctcgccccgctcacgctctccagctcgctccccgnnnnnnnnnnnnnnnnnnnnnnnnnnnnnnnnnnnnnnnnnnnnnnnnnnnnnnnnnnnnnnnnnnnnnnnnnnnnnncctcggagtcggaggcgtcgccgccgcgcaaccccgggcgcaccgcccccggcggcccgcggcgcggcgcggcgctgatgccccgcgcgatgtagctccgcgactccgccacgtcggccagcgcgcggcggcggtactcccgcaccgacatctccagcaggtcgcggtaccggccccgcacctcgaaagccgccagggggggagcgtgcctgtgtttttggcgtgtcaggggggggagggagtgagggaggcttgagggcggcagggatgtttgcagtcgtgggggtggagagtgcgcggggtgtgacgcacctggtcatgagggggatgagagccaacaaccagcagaacagaacatactacatatgtaaggccgacgcctccaggcgagcatggcatcaacatccaagaatgcagggccctggtggagaatggcgcaggtccctctctgtgccgtgcccccagccnnnnnnnnnnatgcctgtgtttttggtgtgtcagggaggaaagggagtgagggaggcttgagggtggcaggggatgtttgcagtcgtgggggtggaaagtgcgcggggggtgacgcacctggtcatgagggggaagagggccaacaaccagcagaacagagcatactacatatgtcaggccgacgcgtccaggcgagcatggcatcaacattcaagaatgcagggccctggtggagaacaactcaggtccctctctgtgccgtgcccccagccgcacagggctggaagcgcaggacaaccaagcccactgcgtacggtccagcctggcaaccttcccccaaacacacacacaaacctggcgccgggcgcgcccctggcggcctgggtgctcatcatctccacactgctcccgtccgaggcggagcggcccgaggtgggggtgaagaggtgcgtcgccggcggcagcggcgacccgcggccagggtgtgcggagggctgctgtgccgcagcgggccccgcggcggccgcgtcgcccagcagcgactccctcaaggcttgcgcatccgcttccgcgccccccgtccccgccgccgcggcctcggcc

SEQ ID NO: 48315 - DNA, 11174 bp, Chlorella protothecoides
  modified_base (642)..(651): a, c, t, g, unknown or other
  modified_base (881)..(901): a, c, t, g, unknown or other
  modified_base (1350)..(1359): a, c, t, g, unknown or other
  modified_base (1843)..(1852): a, c, t, g, unknown or other
  modified_base (4799)..(4808): a, c, t, g, unknown or other
  modified_base (5138)..(5147): a, c, t, g, unknown or other
gggtgggggtgggtgcggggggtgtaggaggcgtccagaatatccaaggtggccgggtcagtaccgttcgactcgttcccctcgctaccagacagcctgagatgctgccctcccaggcatgcagcgtccggcacgcccaccgctggactccatccagcacttccccccgcatcaccttgcctcttcctatgagcatctgcccacccccccttcccccccaccccaaccagtcccggagcaaggcagacctactcgatggcgtgctggccctcttccccccccgcctccaccgctggctgctgaacaagttccccgagccctccgcctggctggccgcccgcctcgctttcacgcgcaccgccgctgtctggtccatggtggggcacctggtgggtctgggcgatcgccacggcgaaaacatcctgctggaccaggcctcgggggacgtggtgcacgttgacttctcctgcctctttgacaaggggctgaccctggagaagccggaggtcgtgcccttcaggccagtccgaggaagagggggggggaggggttgttttatgtatgggggaaagaggacggcacgtggcttccgcgtaagggcatcggcctttgtgccaacatccccgccctcaaaccctaccnnnnnnnnnntgggggaaggaggacggcgcgtggcttccgcgtaagggcatcggcattcgtgccaacatccccgccctcaaaccctaccccctccccaagcaggctgacgcagaacgtcgtggacgggtgtggcgtgacgggcgtggagggcgtctttgtggccgtctgcgagctgacgctgacggtgagcatgcaggggttcagttctggggggggggggggggggggggggtggaccnnnnnnnnnnnnnnnnnnnnngatgtcaagcagtcgccagagcgtcgtcaaacccaagctcacgcgggcatactctcttcatgttcgctcgccaccgcaggtgctgcggcggcaccagggcaccatcctgagcgtgatggacacctttgtgcacgaccccttggtggagtgggtgcgtgcgggggccaaaaaggacgccgacgccgggaacccgcacgcccaggatgccctggccacgattcagggtgggctgggcgactgattgttacagggagggtcagtaggaggtcgggccctccggggttcttgcgtggcgggccagtgtggagcagtccgacttgagagcaggcttgcaaccagggtgggcggggctcaatggggcactcaggttttgatccgggccgcgctcggcacagtgtgggacatattgtcaacgaaaccaagttcattcgcccctgccatcactacannnnnnnnnngaggaggtcgggcactccggggttcttgcgtggcgggccagcatggagcagtccgacttgagaggagggcttgcaagcagggtgggcggtgctcaatggcgcactcaggttctgatccgggccgcgctcggcacagtgtggggcatgttgtcgacgaatccaagttcattcgcccctgccatcactacaggccggctgcagggaacgctgctgggtgtgagctccaccccctgcctcccgctgtcctgtcagggccaggctcggcacctcatcgaggaggccagcaacaaggagaacctggggcagatgtacatctggtggatggcctggttctgactggtcactggtggaaagggcggcggtgtgtggctggcaaagatctctgcgtggtagtgcgctcgtggagggaggggcccatgccatcggacgagcgctcctgcctcagggctcgacatctcgtccatcctctggctcgctgcctgcnnnnnnnnnntagggcggcggtgcgtggctggcagaggtctctgcgtggcagtgcgctcgtggagggaggggcccacgccatcgaatgggcgctcctgcctcagggctcgagatctcgtccatcctctggctcgctgcctgcctgcttctctgcaaatgggtacagaatgtacagtgcgatgctgccgtccctcgaccctgtcgccagcaggccagaggcaggggtgccaaatgccaggcatgtggcggactcggtgtggtactgcatacgtggggcaggtgggcaggagtgcgatttgaagtgcgcggaggatagagagagggttgtggtgccttggtcatgaacggcatgctgaggtcttcctccctgcccacgagcctgagattgagctccaggtattcaaggtgcatcttctgcaatacagacacccctgagcactggatcagatcaattcactgcattccccactcaccgcgagcgacgccagcggccgtagggaggggaaggcaaagaccctgacccgcccgtcccagccaccgagggcgaggagcctgccgtcggagcgcagggccaggcagttgaccccggcactggacagaggaaccctcgtgcccctgctgatccggggcgcagcctcggcccattgatggtcgtcgttgtgggaactgccgtccgacgtcggggcagatgtcctttgatccacctcatgctccgtttcacgctccgattcacgctttcctccaagctccagcctgaaggggagcagggcagcccgcgggccggcagccacgcccctccccctcgctgggcaacgggccagcgccagcaggggctgcttggacagcgcgcagctcgccagcggggccggcggctgcgccagccgccacagggccagcatcccagactcgtaccctgccaggacgtgcgggccgtctctcgtgctccaagcacaaaaggccaggagcgaggtgagcatgcctgctcctttgggggaggggacatcgacaacacgccgcccggagcccgtgcatgccactgcaaaaccctcggcatgcggcaggaccagggccgggacgccggggcggaggcctggcaggggggcggctgcctggtcggggctgggcggcagaatgagggctggggcggcaaaggagtcgccttccctttgaatgtgtaccggattgctcctgcagggagagagcaaggggtggaatgagagtgagcgttctgggcgaggggagaggatcttggtctcctcctccaggatgccacgctgcaaatgtggaggcgtacagcacctgctcatgaaagtttgaacctaggcgcacctggtctcgccgactcctcctgccccgggaagcaagtcgtccgccctgtgcacttgggctgggccactgcggccctgcgacacgatccacttgcctcctggatctccgatcagtccaaggatcccagagagagggtcatggagggcaagactgttcacggggcgcatgctttccagagaccagacggtgagactgccgtctgcatgcctgtgtccatgtgtacaagtaccaaatgacctcctcgggatttgttccatcccatgagtgcatgaaaattcagacttcgtgttgtactactggctcgtggcagtgtaaccgccaaatgcggacacttcgtccatgaaagcccaccactatggagtgggttatgtgccactggcttcttacccagcatacagcacgcctcgatcctcctggaggcagatggattgaacttcctttccttgagctcgtaggactgcaaagggatcggggacagggcgctcggcatcgcatcgcgccacctcaaggtccctgtgtcggacgcttggcacgaggggcagtggcaggtgcatgcccggtcgagttgcggaccaacgctttttaagcagtgaaaacgtattctaatatatagtgtgagtgcctcggcttcagcgaaggagcggatcatatacacaaaggtaaccatgcaatggaccggagagagcgcgcggtaataccaccattcgaacctgtcgcatcctgatccatggcagcactccactccacacctccagcgctggggtaaaggcgtgagcagcatatacctgacgtgcgagcttacaagacatgttcaaaggaattgctgagggagcagacggccctcaccgcctgctgccacggcccctcccgcgcccgccagacctgcccccacggggcttgccgcggccgccgctgccgctcctggttgggccgctcctggttgagctcctggctgcgccggacctggcgtctcccgccttggctggcgatgccttcttcccatcctccttggccagcagggttgccacggtggcgtccaagctggcaatgcatttcctgtgccgggtaggggtgattgcaattggtgaggtctaattaaagacggattccatgcttgcaactgctgcagccccaaaggtccatgtatatactccaatgcatcctgacgtcaggctgagacgccaaaaccgcacatgtcatccagccatgcgccagactctgcatcaggcactctgggccgaaccagtgctccccctgcaaactgccagtgaaacacacctgtaggagacatcctccacgctgccatccgggcggatgaggtggaagcatgaggtctggcgaccatcatactccttgttctgcagttggatggcagccacgccacctgccagctgcgagggccgggggggggaggcagagagctgttgtaatacgcatgtcacccccagcctggcgacaccaggctgctgccggccccggtgccgccagcacgatacaccaagtgatgcacggcgaaacatcctgtttgagccccaacggcatcaccccaggcagccacacgtccctgccaggcaccttgcgctcagcatcggggtgtcctttcttgatcagctccaggaccatgtgannnnnnnnnngtccagtctggcgacaccaggctgctgccggcccaagtgccgccagcacgatgcatcaactgatgcacggcgaaacaacctgtttgagccccagcggcatcaccccaggcagccacatgtcactaccaggcaccttgcgctcagcatcggggtgccctttcttgatcagctccaggaccatgtgaaactcgtactgcaaggaggatgggagggaagatggggtgacttgcttggttggatcccacaccccatgcctctatccctggcatctcagacaatcgggaaccctgcaccccatccaagcgtaaagcgcacatcgttgaggttctnnnnnnnnnncggggtgacttgcttggtgggatcccacaccccatgcctctatccctggtatctcagacaatcggggaccctgcaccctatacaagcgtaaagcgcacatcgttgaggttctggtagctcctcagcttggagtgtagaccctggtagtactcgtggagggccgccccgttctcaaatgtacggtacccaacagtgaccggctggctggtggatggtggctcgacctccatggcgtcgctgccctcatcagcgtcgttcccctcgtcggtacgttgcttcttggcatccacaccttccacctcaggctcctccaagggccttttggaggcctcgtccaccccggcctcagtcatgacggcggtgtcactggatgccgatctctcgtcaatgagtgcggtgttacggatatgcaatcctttaaatcaagcaaacagggcgaggtaccctctgtacagataaatgagtgcaaggccctggccccgttctgtctggttccatacctcagcgccctggtattttcccgcggagtgaaggcgcggtggaacccgctcagacggcgacagtgagcgcatgcatgattcctcggctctctggggcgcccacgtatgcatgtagtcggcagcggatagaccactcaagcgtagcatcgcattgcagcacctcgctctgcgttgccccacgcagcatcgagttgcccggacgaaccccgcattccgcaggcgtactggtgcagcacttccacttctggtatcgaacgccattatcagcagctcctgaagtagatcactccagcaccatattatctatccaagacatctactaaatacacgcgcacgacaagaatggcctgctgaggtggagtttagccatgagcgatggcaccctgcggagggtgaaggctcaattccaagtatccctgcatcctgcgctgtcagagacgagcctggccggagtagaagagctgctcaatactttgctgctcaggtttgtgtccctggggtgttaccttccattgctttgtgtgagaacttgcccttggaactggtgcttggggactgctgcagggttcaagtttaccgagctgggggccccttgtacagattcgtgacggtatagcatagaaataaaggcacctatggagtctgcattgcgataacagcaagcagccttcgttctgagctcattgttcatgcctaccacccaccaagcagatattccgaggatttggggggcatcgtgttggcctatgggagcaccacactcgcctcccaccatggcctcattcaaccatactttccttacacccatgtggacgtgggggcgaccgtgacgctgttcaaccccaagcccgggtgccgattgggtgcgcattgcgtgtgggtttgcagactcatggtgtactgatttgtttcacttttaatgggtcactgctctactgctgcttttatgggaactgagctgctgtgctggatcgtgcatccttgcagagtggatctctatcttcctgtatcccatgcctgagtctgcctcgacgcctcccctccacaccctgcaagtcctgcccaccattcctccattcctaacagtgggcgttgtcaacaaggtgggccgcgacttcattggtctgctggtcgcaggaatcgtgaatgcgtccatcggcgccgacgcgatccgtgctgacctggcatcccgcccagcccagtctgcctgggtgtccctgtgcaacccccgccatgtcatcagcatagggaccactgtggtcttcgatgtcctcaggtagggtgctatgctgttgggatgggggttgaaagggccccccccccttcactccttgcctgtttaggggaggggcttgcgagagcactaccacagctaatgctgaattgaactttagtggccatttaatttcaactggatttctgacaaggacatccgccgcagcacaccatgccgacaacactcacaccagcctcttcacccttgatgtttttcaaccaccctcgtcgcgcagtgtcacacagacgggtcagtttgtgagtctcaagggagccctccgagagcccgacaccggtgccgtggaggtcgtgggataccccgggcagccgaggaaggaggtggcggtggcggaggaggcgcataaagaggagaacggcaagagtaccgcgaagcgcaagcggcgggagagcgctggagatgcggctggtgaggaagcccgggaaaatgggacgaagaagaaaaagaaaaaggagaagacgaagacgaagaaacgcagcaaggacgagtgaaaagtgcagccgggccgactattgaaagctctgctgctgagaagtttcctgtttggctggcagatgctcaccaagtcattcgtcctccactctcctgtggtccccccatcttgggccccttcttcactccctgtactgacttcgccctggtgcaccccttgactcgcagcaccccctcaagacttttcctcgacacaaagtgtactgagcgtatagatagagctgcaattcctgttcagtgggagtcaaagctgtggaaggctggaagaggggccaccaggtagactccccacttgctgcttttccaggagacaaaagaggccccggcatttgaatagtagttgagtggtcacttaatgtctagaaactccttaggtacttgactgacgcgagatagatgagggaacaacctcttgccgaagatggtggcctcaggcatccctgtgccccccaaaagcatctgcgaggtgccattcctgggtcgatcgcgagcgcaggggctgccccagacccgccggctacaaccccgatcctggctcctgaccctgtccttttcggctgtgcgaaaaccacagctaccttcccaccatcctttaccagggccctctttcttcgccagtggccgtattccccggacactaccgccaagatggtgaaggtgcgcccccggtcgggcagcgtgctggatgaggtcggagagaccccggcattcaccactggaaatgattgcgatgtgcagatgccattgtggtggaccccgggtggccgctctcttcgcctgcatactctcctcgccgagtgcctcgcccgccgcgcacgtcgcaccactcaccctgtcccttccctgcgccccacagttcactatggacgaggcaagctggctcttcggattggcgtggcatgcatgagcaggcattgtcatgccgtgtatggatctccgcaggccgtggtcggacctcgacaccgccgggcctcgtggccgcccctcaaaaccgctcactccccacacctccacagatccgtgccctgatggagttcaaggacaacatcaggaacatgagtgtgattgcccacgtcgatcacggaaagtctaccctgactgattccctggtggctgccgccggcatcattgccatggagcaggtgtgtgcgtgtgggagggcgatttatgctgagacaagagttggggctgagggctggtggatcaggctcgtggtgagtgcaccactgccctctgctgccttgcctttgcccttggccggcctgctgccatgcctgcacccacctaccattcccctccttcgtcaccccaggccggcgaccagcgcctgaccgacacccgcgccgacgagcaggagcgtggcatcaccatcaagtccaccggtatctccctgtactacgtcatggaggacgaggacctgaagggtttcaccggcgcgcgcgacggcaaccacttcctgatcaacctgattgactcccccggtgcgctcgacttgagagaggggggcagttcagggtggctgggcacctcctgtgccttgtgcacaggattggcagtgtgcgatcgtgaggcccgttcaggcgcctgcgccagcaggtccctgtcagttttgccccctctgcatgtgctcacccatggtacttgcatgcaccttgaaccctttgccacgaatctcagcccattcacacacagctcacccccccatccccccaacccacaccaacaggccacgtcgacttctcctctgaggtgacagccgcgctgcgcatcaccgacggcgcgctggtggtggtggactgcattgagggcgtgtgtgtgcagaccgagacggtgctgcgccaggccctgggcgagcgcatccgccccgtgctgaccatcaacaagatcgaccgctgtttcctggagctgatgctggacccagaggaggcctacctgtcctaccgccgcgtgatcgagaacgccaacgtcatcatggccacctacgccgacgacgacctgggcgacacccaggttggtccttggtgtgggtctgtgggtgggggagggagggaggaggggaaggctggccctggcgacacgctcctgcctggtgtgtgcagggttggggatgcattaacctcggaccccctcctcccctgcgcaccccctgcgcttcattcctcatgactccccctcccaccccccggagtcactcaccccaacaccccgacccccacccaaacccttcaggtgcaccccgaggcgggcaccgtctccttctccgccggcctgcacggctgggccttcaccctgacggtgtttgccaacctgtatgccaagaagtttggcacggacaccaagaagatgatggagaagctgtggggcgacaacttcttcgaccccaagaccaagaagtggaccaagaaggagacggggtcggcctcctgcaagcgcggcttctgccagttcatttacgagcccatccgcaccgtgatcgacgcggccatgaccgactccaaggacaagctgtgggcgctgctggagaagctggaggtgctgcacctgctcaagtccgaggacaaggagctggtgggcaagccgctgatgaagcgcgtgatgcagacctggctccccgcccactccgcgctgctggagatgatgatctggcacctgccctcgcccgcccgcgcccagaagtaccgcgtggacgtgctgtacgagggccccctggacgacgcctacgccagtgccatgcgcgcctgcgaccccgagggccccctcatgatgtacgtgtccaagatgatcccggcggcggacaagggccgcttcttcgccttcggccgcgtcttctccggccgcatcgccacggggcgcaaggtgcgcatcatgggccccaactacgtccccggcaccaagaaggacctgtacgtgaagacggtgcagcgcacggtcatgtgcatgggccgtcgccaggaggcggtggaggacgtgccctgcggcaacaccgtggccctggtggggctggaccagttcatcaccaagaacgcgacgctgacggacgagaagtgcgaggatgcacacaccatcaaggccatgaagttcagcgtgagccccgtggtgcgcgtagcggtggagcccaagcacgcctccgacctgcccaagctggtggaggggctgaagcggctggccaagtcggaccccatggtgcagtgctccatcgaggagacgggggagcacatcatcgccggcgcgggggagctgcacctggagatctgcctcaaggacctgcaggacgacttcatgggcggcgcggagatccgggtgtcagagcccgtggtcgccttccgcgagaccgtgaacattatgtccgaccatgtggtcatgtccaagtcgcccaacaagcacaaccgcatctacctccaggcccggcccatggaggagggcctggccgaggccatcgacgagggcaaggtggggccccgcgacgaccccaagatccgctccaagatcctgtcggaggagtttggctgggacaaggagctggccaagaagatctggtgcttcggccccgacaccaccggccccaacatgctcaccgacgtgaccaagggcgtgcagtacctgaacgagatcaaggactcctgcgtggcagccttccagtgggcctccaaggagggcgtgctggccgaggagaacatgcgcgccatcgtgtttgaggtcaggggggtggttttggtggtggggtggaggagaggggggggg

SEQ ID NO: 48316 - DNA, 64 bp, Chlorella protothecoides
atcgcgccccacatgatgagggcacccccacggggggataccccctaaatgaggcactctgccc

SEQ ID NO: 48317 - DNA, 80 bp, Chlorella protothecoides
actttctttatattgcaggcggagtgatgcaggcgtgaagtggcatgcacacctgcaggacctgtgccaggtagacccct

SEQ ID NO: 48318 - DNA, 61 bp, Chlorella protothecoides
caggcgccccactgcagcgcggaggcctgcacccccgcgccagccgccaccgccgcccagg

SEQ ID NO: 48319 - DNA, 15477 bp, Chlorella protothecoides
  modified_base (505)..(514): a, c, t, g, unknown or other
  modified_base (1060)..(1069): a, c, t, g, unknown or other
  modified_base (2154)..(2163): a, c, t, g, unknown or other
  modified_base (2471)..(2480): a, c, t, g, unknown or other
  modified_base (3322)..(3331): a, c, t, g, unknown or other
  modified_base (3876)..(3885): a, c, t, g, unknown or other
  modified_base (4097)..(4106): a, c, t, g, unknown or other
  modified_base (4407)..(4416): a, c, t, g, unknown or other
  modified_base (4834)..(4843): a, c, t, g, unknown or other
  modified_base (5412)..(5421): a, c, t, g, unknown or other
  modified_base (5674)..(5683): a, c, t, g, unknown or other
  modified_base (6094)..(6103): a, c, t, g, unknown or other
  modified_base (6260)..(6269): a, c, t, g, unknown or other
  modified_base (7586)..(7595): a, c, t, g, unknown or other
  modified_base (8281)..(8290): a, c, t, g, unknown or other
  modified_base (8357)..(8366): a, c, t, g, unknown or other
  modified_base (9803)..(9812): a, c, t, g, unknown or other
  modified_base (10323)..(10332): a, c, t, g, unknown or other
  modified_base (10591)..(10600): a, c, t, g, unknown or other
  modified_base (10956)..(10965): a, c, t, g, unknown or other
  modified_base (11286)..(11295): a, c, t, g, unknown or other
  modified_base (12222)..(12231): a, c, t, g, unknown or other
  modified_base (12429)..(12438): a, c, t, g, unknown or other
  modified_base (13929)..(13938): a, c, t, g, unknown or other
  modified_base (14879)..(14888): a, c, t, g, unknown or other
  modified_base (14979)..(14988): a, c, t, g, unknown or other
  modified_base (15192)..(15201): a, c, t, g, unknown or other
gagggaggggggagggggggattggggagtgagggggggtcagtcgccctcccaggcacccttgggctgcgggggtgcggcgctgtggtgggcagctaccacatgagagtggtgcaggagacatgctaccacacaggaaccaaaacagatacgcaaccacagcccccaagcaggccgcggcagcgcaccaggcagtgacgctcgccctgcttgatggtggatccggcaaaagcgacgtcgccagagaacttcttcacgggcagagactcgccggtcagcgcggcttggtccacctgggcgagagtaagggcaggcgggagaggggtttcagcagggtgtcaggtgcacatgcattatggtgcgtgttctgcaggaggacagcgtggcagtgcagagcggagtcgcatgccgtgatgcctgccaggcatgaacagcctgctctgggccccaggcgaacaggtggccttgcacacacacctggaggggagtctcgtcgttggcgtgnnnnnnnnnnttgccaggcatgcacagcttgctctggcccccaggcgaacatgtggccttgcacacgcacctggaggggagtctcgtcgttggcgtgcaccggggcgacctcgccctcaaacaggatcttgatgtcggccggcacgatgtcgcccaggcggacgatgatgacgtcgccggggacgagctcggaggcgtccacggtcttcatttcgccgtcgcgcagcgccttggcgcgcggcgccagggctgggatggagacgtgatgcgtggtgagggggggtggcgagggagggctagggcatcaaggcaagggcgggtggttgccatgtgggagggcatgggctggcccctcgtccctctctatccctcccccaaaaccacaaaagctcaccactggcgagggccttgatggccttgtcggcattggcctcctccacgtaggagatggtggagttgaccagcaggagcgcgacgatcagcgcgaaatcggcatagtccagcagggcgatagcgatgatggccgctgcctccatggcccaggacagggggttcnnnnnnnnnnaaaatcggcatagtcgagcagggcgatggcgatgatggcagctgcctccatggcccaggacagggggttccacatgtaggacaggtagacctgcaggggggaagggggtgtggggcagggtaacggaggtgttaaattaatcacaacgggatccaggctctgcgggtacctcccaaggacccccacccgctgccggggtgtgcgcgtctgggcactgcctacgcacacacccgtagggttcctcaccagaatggggttcctggtctcctccgggagcttattgtatccataagtcttcaggcgctcctgcacctccgcggaggtgatgccgtggggggtgcactgcgggagggcgaggcggggggacgcggggtgggatgtgcggggtccgccgggggttggcggagctgggtggagaactggatgcgcaccgggtgaacctcggtcccatcatcgaggacggcatgtgtgccctgcgtaccttgaggatctcgaaagcctccacctggctgactttcttgaagtcgacctcctggtcctcagccccgccatctgctacctttacgcctacctcccctgcacagtaccgcgtggtgggggagtgagagacatgcgtgcaccttgattctccgcggacggatacgcgccgtccgcggtagggttgacgccctttggacgagtctgcaacccctgacagccactgcaggggtagcggagcgaagcgaataccggacgcggagtttcaacgataaaatctcaccgttttgcgccatggtgacccaaaccgatgtttcggtttgcaatggaaaggccccgagaaccccggccggagcatacttgggcaaccctgacctggccttctcttcgaccctggaactctatatcccacggatgaaaatcgcacgtgggtgggccctgggccgccgcggtcttccccagctccgaatgcacttgccccttgtacgtcgagaagggaaagcacaacaagtgttatccggtatccacctgcggcaaatgcggtctcctctgacagaccgtccatcgttctcggaaatttggttggagcctgcgttgtaggttttccnnnnnnnnnnatacgtcgagaagggaaagcacagcaagtgccatccggtatccacctgcggctaatgcggtctcctctgacggacagtccatcgttctcggaagtttggttggagcctgcgttgtaggttttccgccggatgtcacgaccacgtgtcgtcagatgaggcaatattacaggcaggagaaccagcagatcatctttctgacataatatgccgtaattgtgtacttgaccgcgcaattctgcatggcagataggcgttgcggagccatttattccctcaaaatctccccggctttcatcttctggaaaccnnnnnnnnnncgacaggcgttgcggagccattcattcccacagaatctccccggctttcatcttctggaaaccctcaccatcatcaagctgtcatgagctggcagcatagcaaggagctggagcagtgtgcagcagaataattttgtgatgcatcacaagtaatggtgcccaattggttgtgggacgacaactcattgcgatgccctcgttgacttgagaaggacagccgcgatcgtactcagcggtgtggatcacacacacatgcgctaaaagcaaaatctgatcgccttgaggatgcagtaccgtttgattatgttcttgcatttaccttggtggagacccgccacccaacggcacatccccaccgagcccatacccgattggctctctcgaagaccatgatgaagatgaatctggatccgagtcatgagatccatgcgcataaagatggaactgcatacttcaacagcttctgttcgcctcgttgaatcctaaccttgggtgtgtcgaaggccggcgtgccggccgcagccccgggtccgacggggtcccgcaccatgcgcatcggtggccctcctcacctctcagacccaggctcttggaccttctcaagatcttctacaccattatcatgtaaaataatgccttattcaatctcctgacgctcgtatgggcatccttcgattgatcttcttggtatctgggctgatctggggcctgcccctctgttccgcccaggtgcggctcatggtggcgcgggagcagccgcatcctgccaaagttagagatcgaaatgtagaccatcaccctttgtggggggtgattggtctgcaggccacccagctgtctgnnnnnnnnnnttagatcattacccttggtgggggatgattggtctgcaggccacccagctgtctgaaggcggagtcacttcgggtcaacgccattgagggctgtacatgtaaaaacgctcactctcaaccgggactctccccttgcttgctatatccccagaccagcctcccctcccacaacctcactgccccaaaccactgctgctgtaggacaacttgaggtattacacatcgaatggaaagatccaggagagcagcaacacctgccccacctccgtgtttgcggcctgtggccccacctgggaggtgaggcagagcaccaccggccacttccgaatcgttcccatcaggcccctggcggtcgtcaacagcgtgacgctgcagtgcccagagggtgtgggcatctggagtggtgagatggtgtcggtggacgctgtgtggactgggtttggtggggtcatgattctggaggagcactgtctcggattgagggcagattgtactgctgaaatcttgaaattaaggatgggccacatggtcctggtatgctcacnnnnnnnnnngtgagtctggaggagcactgtctcagattgagggcagattgtactgctgaagtcttgaaattagggatgggccacatggtcctggtatgctcacaagcagacgcacatttccttgtacaaggtttggagtgaatatgccgccagaattgatttgtgagctctgtctgcgctgagtagtccaacccggtctgcagacctcaccctgattcccnnnnnnnnnncggtttggagtgaacatgccgccagaactgatgtgtgagctctgtctgcgctgagtcgtcccacccggtctgcagacctcaccctgattcccacctccaaaccgaccaacaaaccacagccctcacacccagcctgcatgcttcagccagcctcaccaaggcccctcacaccaccccttccgaccctcactgtccctggcgccagatgatggcgggatggagctggccaccggcactttcatgcagcaaaagcccaaggccgggatgcccgcgggctgcatgcaggggcaggcgggccagnnnnnnnnnntcggcaccttcaagcagcaaaagcccaaggccgggatgccagcgggctgcatgcaggggcaggcgggccagtcctgttacgactacagcggcgtggccttcagcgccgggggcgcgggtggtgtcaacaccctgcgcatcagcacccagcagagtgggggaacatgctctgcgctctacacggtgggctgaagggagggctcctgccccgggggggggcagtggatgccatgaggatgaaggggccccgacgtggcggcaggcgcagggtgccgagtcaactgtcattcatgttggggcggtcagtcatatgcagagtgttccatttgcacatcttgctcaccggccgctaccacccttccgtctcgcctccaccgccacgcaccctgccctcccctgcgcagctgctcttcgccaannnnnnnnnntgaggatgaaggggcctcgacgcggcggcaggcgcagggtgccgagccaactgtcattcatgttgggggcggtcagtcatatgcagagtgtaccatttgcacgtcttgctcaccggccgctgccacccttccgtctcgcctccaccgtcacgcaccccgccctcccctgcgcagctgctcttcgccaacaccgacatcctgggggttgcccccgtgacatacaccgcgcgctgggtctgggcgacctcctcggcgctcagctcgggcgggttccagtcagtggccatgctcctagcatccgccatggccgtcgttatagcagtggcctgacagacggaacaacgtagcccgggccattatggtaagctggcacaaggtgcaggccaccactggtcctgaaacaacgcccaattcccatgctacaccaaagatatgctgtcaacccctcgtttcgcacccttatagctgcatgtcaacgcaagagtatctacaggggtgcatccatcagacggaaatacgacaaccaggagacgtgggtatgctgggtgcgctctcagtggcagtgtgcnnnnnnnnnngggcgtccatcggacggaaatacgaccaggagacgtgggcatgctgggtgcgctctcagtggcagtgtgcgagatggagcgggggcagcctgtcacggaagcaaaccagctggcagattctacgcccgggtggccaggcaggggtgacattcacggggcaggtcgctctctgccacggtctggggagaaggagatggggcgcagcccacacagcggcccagcaccagccttttgagtcggcgctcagagcgcnnnnnnnnnnaaaggagatggggcgcagcccacaccacgccccagaaccagccttttgagtcggcgctcagagcgcggacttggctgtcagcttctgggccacgcgcttgcccaggtcggcgtcgcactgggtgaggtagcccacccagacgcgccggatctcggcgttgcacccatcgtccagcagcatctcggagatgcgcgtgatgaagcgctcctgcctggctgggtcaaaggtgcggaacctctctccaggctgcggaggagtgccaggagtgagggtaagaagggtgcacatgaggaaagggccgcgcggctccttggtgtgctgcgttgatggtgtttctgtcgagagcgtgacggcagacatcaatcacacttgagcatgcgttccattgcctgctcggcccctcccacatgnnnnnnnnnngggagtgagggtaaggagggagcggggtgcacatgaggaaaggaatgcgcagctcctcgttgtgctgcgttgatggtgtttctgtcgagaacgtgacgacggacatcgatcacaattgaacacgcattccattgcctgctcggcccctcccacatgnnnnnnnnnncacacacacacacagaaaaataataataaaacagaacccatgccacccacctgctggaagttgttctccttggggatgacggctcgctcacggcgcccggccaggggagcggtgaccaccgggtacttctcagagttgcgggcggggtcgtagcgcgaggggaagtagttgacgtcctcggtgcgctgcatgaagttcatgacgccgtcaaagtggttgttgtggtgcgcgcacttgggcgcgttgaccgggagcaggaggtagttgccgcccaggcggtagcgctgggtgtcggagtaggagtagatgcggccctggagcagcttgtcatcggagtaggcgatgccggggacgatgaggcccggattgaaggccagcatctcgttctccgcaaagaagttgtcggggttcttgttcagcaccatgcgccccacgggctgcagcgggaagcggtcctcgggccagaccttggtcacgtccagcgggtcgaactcaaacttgtcctcgtctgcagggtccatggtctggatgaacaggccccactcggggtagtccccggacgccaccgcgtcccacaggtccgcggtggcgtgctggtggttggcgccctgcacctccgcgatctcctcgggcgtggccaggttggccacgccgcaggagggccgccagtgccacttgatcagcgtctcgcgcccctccccgttcaccagcttgaaggtgtgcacccccgacccgatcatgtggcggtagtccttgggcacgccctcgtcgtccatgaggaaggtgaacatgtgcatggcctcggggtggtgggagaagaagtcggcaaagcgccacggctcctggatgttggtcttcgggttgggcttcagcgcgtgcaccatgtcggggaacttgatggagtcgcggacgaagaagacggggaagttgttgcccaccatgtcgaagttgccctcgcgtgtgtagaacttgaccgcaaagccgcgggggtcgcgcagggtctcgggggacccccgctcgtgcaccacagtggagaagcgggcgatgatgggggtctgcaccccgggcgcgcgcaggaagtcggcgcaggtcaggtgggaaatgtcgtgggtgacctgtgtggtgtttttttttgggggggggcagggtctatgaggggatgggtggaatcgtgtcactgggcacgcaagcagccatggactgcacacaccaccactgccatgtggcaatgggcaaccagagcgaccactgatctgcagtaggaaacacttttgacaagccaccatgcacagcagtgcgaatgcccctcgcaaccannnnnnnnnncgcaataggaaatacttttgacaagccaccaagcacagcagtgcgaatgcccctcgcaaccacaccaccaaacacgcccacctcgaagaagcccttggcgacggcaccgcgggcgtgaacgacgcgctcagggatgcgctcgcggtcaaactgcggtggaagggtgacttgtcgtccgtggatccattgcataggtgcttgggcaccaggaacacggcggggatacagcttcccagcgagtacatgcaagggattatgtcatcatccatgctggccctacattctaacaccctgaactcacgtttgacagcttctccaccaggtggtagtcctccaggaggaccgggcctgaatgaatgttgcgggggaaggcgagatgatgagtggggatgcctcagacaccggcccgtgagggtcaggagccggcacacgatctggagaccggaggaatcgaagatgccccgtccctatccggcgtcgtcactccccagaccctactcaccacgcactcccacggtcatggagttgttgttgttccataccggcatgccggtgttggtggtccaatgggtggagttgtactccgagttggggcgatactgcagggagggggaggggggtgagggggtgggtcgttggcatgatgtagggtgcttgccctatcaggcagacacaatcatggcaannnnnnnnnngtatggcaggtggagggtgcggttgctccccctgacaactggtggaaaatgcccttcccttcctctnnnnnnnnnngcgcggagcagaccatgccgttcgtcctgagggaagatcctgggcagacgacacgagccacggtccatcccaagtccggaatgggaaaacagaccttgtagggatccatagcgtctaactggctggttctcagtgcttgaagcggtgtcaagacggaataatatggcaggtggagggcgcggttgctccctctgataactggtggaaaatgcccttcccttcctctcgggggctgttgcgaaatcggccacgtcagcgatgtaggttcgcgtcgactgcgttgacccggggcagctcggtttccacccatagcacgccccgcatgagtcgtgttgcctgagtggaacgaacgttttcagggcgagctggccacatgacaccgttcgggtagtatccatatgcgattggtatattacattccctcgagaatacggcgaccccttttcgtgtccaccccctcgccactcggcgatggcgaacaagagggctgcagacaaagtgcgtgcagggatctcacatgtgcactcagggctcgagacaggcatctgaaacgtttgaagctttcctttgcgttccacaggaagtcaagatgcccaagaaacagctgtacagggccagggcacacagtaatcccttgaacgaccaattctttgacgtcccactctcccccaaacatgtcaactggtgagcttgggcaggaggctgcgtgacttcctgacacgcttgaggcattatgcggtgtcagcatcgatttctatcgtagagtcaaggaaacactctgcagggctgagatttacccagaagcatatgcggcggccgcagcggcagggcagccccctcccctggttcgtttcgcggacgttgggtgtgggttcggtggcctcacggtgaagctggcggagaacttcccgggcaagctcgtggtgggtatggagctgcgcgacaaagtcacaggtggggtgccatcaggaggatgcctgctcgtattggtgccattcggagtgggtcgacattcctgctacgagaggtgtctgcactctgtgtcgatcactggaatgaattggatgcgctggagcaaagcatgcagcacgaggaccctggatccctgaagcctctcaccgattgcccatcccagcctcccacccccttccaatcaccatgcagagtatgtgaaggctcgggtcatcgccctcaggctccagtcgcccggaagctaccacaatgctggggtggtccgcacaaatgccatgaagtgcctgcccaactactttgccaaggggcagctggagaagctcttcttcctctttgcggtgcgatgagatctctggggtgcatgcggggaccggtcgccttcgtctcgtgtctccctgccgggcactgttccgcgctgcgaagtgatgggaggtagcagccttgcccgctcacccccctgaattnnnnnnnnnntgcatgcgagggaccggtcgccttcgtttcgtgtctccctgacgggcactgttctgcgctgcgaagtgatgggaagcagcagccttgcccgctcacccccctgaattgtcgtcaatgcgctcacgggctggcatggtcctgagcctgtatgttgagcagggcaccacccttactcctcgctggcttcacacccgtgcaacactgcccccgacatgtcgccaggacccgcacttcaaggccgccaaccaccgccgacgcatcatccagacaaccctcctggcggagtacgccttcatcatggcaccgggtggcatcctctacaccatcacggatgtggaggaactgggcatctggatggtgggccggctgggtgatggagcccttgggtggggtaggagttgcatgcatgagggaggcctccttggtggagacggcccccggagatcctcatgcacatcgtagcagccggaagtggcacgatgcatgcccgccacgattgacacaactccannnnnnnnnnaagcccttgggtggggcaggagtggcatgcgtgagggaggcctccttggcggagacggccccccggagatcctcatgcccatcatggcagccggaagcggcacggtgcatgcccgccacgattgacacaactccagccaacagtctgcgtccggtcagcatgcccctcccttctcctgcagaaggagaagctggatgcgcacccgctcttcgaggcggtgcccgaggtggaggtggagcgggaccccgcggcagccctnnnnnnnnnngtgcccctcccttcgcctgcagaaggagaagctggatgtgcacccgctcttcgaggcggtgcctgaggaggaggtggagcgggaccccgcggcagccctgctcctccaaggcacggaggagggtcagaaggtggctcgcaatggcgggaagacctggcgagccgtgtaccggcggatacaggacacgtgaggtctgagccttgtcgtccttgcggatgcgatgtgcactggggctcgtgatccgaaccagtagacacctgtctttttcacaagagtatgtgctttcggagaacaaggccagacatggcatcctcacgtgccactcttcgatccttcgatcattttccctcggcacnnnnnnnnnncccagatatggcatcctcacgtgccacctttcgatccttcgatcattttccctcggcacatgaggattatccaatgtcttgaaggcactacgaccgacaatgtaacgctgacagagagcaggtgccactttacgtttgaaggtgggtgtctcggccaacacgatgtccacggtgaggcatgttgctcgatgtgattctcatatggggcgtttacagttttcctctctcatgatagtgcaggtgtagcccggattgcggggaactttcgtcctgcgaccgcacgctcatgcggagcgacatgccggttgcggccctgcaccnnnnnnnnnncagggcattcacaattttcctctctcatgatattgcaggtgtagcccggattgcggggaacttacgtcctgcgaccgcacgctcatgaggagcgacatgccggttgcggccctgcaccacggatgaagcaatgttacagatcttatcatgtagtctaccttgactaaaaccatgggtggctcccgaaagcgccatgccaaacgcctgctgacgcccgagctggcccgacctcatcctccgggacggcggtccagcccaagatcaccctgctccacctgccgcaccccatcctcgccaggatattccgtgcagtgtgggatcagtatgtagacgaattggatgaagctgattatccatcagctgccacatatgagggctctgtcgatccaaggaggtgagcacctcctgaggagtggtcggctgatctattcactctctgcgcacagcccattccccagcccatgaagatgctcgtggctgaggatccagacaattgactccatgacggacatcacctgcacattgctttctcgcagggtgctgcccctgctctgcatggctgccctggcagcctgcgccctgttggggtggtggcgataccgccacctgatcgatgaagctattgtgggcccctgccggaaggagttcaaggtcctggccctgcagcgcttggcggtcgcgacatcgctgaacggcagcaaggtccattggaggcacccgcccaggctccgcagcttgtggctggtcccgctgatcacggacgaacgggccaccaacctgcgcgcccgcagcctacacctggtttcggaagaagacctgcgggttgcggccccgccctgcgccttggagagcttgagactgcacttggagatggtacagcgtgagttgatcacgaagatgcaggagctatcgagcctgccaaacctnnnnnnnnnncctgcacttggaggtggcaccgcgtgagtcgatcacgacgatgcaggagctatcgagcctgccaaacctcagcaccctcgaagtgcatgtgcacgagtgagagcctggacgctgaatggtcggcacggctccctgcccctgcagccctggctgtcctccactgcaagctcgtggcccggggaagggcccgacgtgggnnnnnnnnnngcgctgaagggtcggctcggctccctgcccttgcagccctggctgtcctccactgcaaactcgtggcccggggaagggcccgacgtgggggtgcgcctccttgcgccggccagaccctgcctcagagaaggtgatacctgtggtcctggtggtgtcttggtccccggtgcaaggccgggctccagggttgggagctcgacctcgcacccaggcagggctgccacctgcccagatgcgcccctccccaaaaccctctgcccaccctcccgtgcgccccggcacaccccgcccacgcaggaagcccctgtttgcctgcttcggctccgagccccagctggcgtgctggagacggctgcgcagccttggcttgcggtaccccactgtcagccggggcaagggcccccccctccaatccaccgtgcactggaggggctgccggaggtctgccccgacctggtctccctctcgctccaggacgccgacgtgacgccgccgcccagcctggcccggctccccttccagcacaccgtcgccatcgatgatcccttgctatgcctgtttggactggcagacctgccccacctccactcgctgactctgggcgtcctctgggtggggacgcactccccacaccctggagcagcctgcgccttgtgggccctgtggacgtgctggagggacagctggagcgcctggggccgggcccgcgctgcctggccctcaacatctcacgcaggccgtcgtggggcgaggaggaagagctggccccgccctggccccccctgcgcgtgctccaggtgtgctgccccgcctgcgtccggctcaagctcccacccgggctgggggtgctgagctccgcgactgcgaatgtgagcacagcgagggggccacgaccttccccgaagacgccaggcatggtgaaacctggcacaccgtggcgactgtcaagtggccccccggcctgctggccctctgcatcatccgcagcggcgtggatggccccgggcgacgtccccgagacccaccccggtctgcgcctcctggcctgtgtccaggagcgccgctcgtgctggaacgccctcccccgctgctgcgttgtgcacatcgaggccgagccctggcatcagctggccgccatgcccgaggcacagctgtccccggatgaggtggagggagcgcaggagtggtccagcctggaatggaggaacgacgcctgaagcactaccatcactgcctggaggaggcccagccgctgatcggctgacgagggctccacccgtcacactcccgcatgcgagtgtaagacctgctcgctgcagcgctgccctccttggcggtggagggatgccggagagcagcgaggggggatccacctccctggcgcgctgcgaggccgacgccgtcccaggcccgccctcatcacggcgacgagtgggttgccggctgaggctgcagcggtggtgcatcgacgatcagaccctggtgcaatgnnnnnnnnnncagggggctgcctgcgaggtactgctctacctgccagggctcccagaggatgggggagcgggcgccctgctgccccttccccctcagcctgtccagctccttgatgaaggggtgccagaaggaggcggtgccccgcttcttctcataggccaggtacagggtgaggcaggccagctcgctgagcttgctggtggtcagcagctcggccagggaggcggagtggaagatgcggtccagggtgaccaccaggcggtcggggacgcgcaggacgacgtcgccggggagggccgagcgcgaggccaccaccgtgtccagggaggcgccgtcgcgctgcagggtctccagccgcacgccctgctcgggcaggccgttctcctgcgatggtatgtgggaggagggatccggctgtggcactgccccgggaggggatgctgtgggcaggggaggagggatccatgcgcggccccccacctggagccattgtacgaagcgggagggcgcggaggttggcgactcggcagcggctgcgggggtgcatcgccgaggtctatgggccgatgccgtctgtgaaaggagtggggaggcgtggctggtgtgacggagccacctggggtcgttctggaggtagcacgaaaccctcttgccacgcacccggtaccggcgaaagcactgcctccggggcagggcgcagggccgcagctgggcttccagcgctaccatcgctccgtgggtctggagtactcggaccacagaggccggatggggatcgcggagccatggaccgggatgcatccatcgtgcagccctccctgctttgccgtgctgcgcacgacaccatcatccgactccccatggtctggtggggaatgtggacctcttcagcgagcaagcatcgacgtcctggacagtttagcacaccttgcccggtgaccatcggaccnnnnnnnnnnattggtctggtggggtatgtggacctcttcagcgagcgagcatcgacgtcctggacagtctagcacaccttgcccggtgaccatcggaccnnnnnnnnnnactttgagcaattaccttcatttgatgagcagcacgactcctcccctgatcccctgtgggatggaaaagatcagcttcacctgtgttgcaaccttacgactgggttcatctcttgtccaggcatggccacgcttggctgaaacgcaccttttacaaggagtgagcgtcaaagaggtccgatggtcaccgggcaaggtgtgctannnnnnnnnngagctgatcttgtccatcccacaggggatcaggggaggagtggtgctgctcatcaaatcaaggtaattgctcaaagcgccgtggcaggcttgggtcagccggtgctccaaccccagttcataccaattcgccagtggtggtgagggcactgtggagcatgcattgcaccagggtctgatcgtcgatgcacaaccgctgcagcctcagcctgcaacccactcgctgccgtaatgagggcgggcctgtgacggcgtcggcctcgcagcgcgccaggga

SEQ ID NO: 48320 - DNA, 61 bp, Chlorella protothecoides
cagggcgcactgggagatggccgaggtgcgaccgccaccaccctccacccaaccctggccc

SEQ ID NO: 48321 - DNA, 61 bp, Chlorella protothecoides
tcgtcccgcgatgctccgtggacccagggtatgggggtcgtgtggtgcagcagaggtgtga

SEQ ID NO: 48322 - DNA, 70 bp, Chlorella protothecoides
cagctgcacccaggaaagagcgggatgggaaggaattgatagcctcactgggcacgaacttacggcaggg

SEQ ID NO: 48323 - DNA, 72 bp, Chlorella protothecoides
tggccctgccgcggcaagccaggcaagggttgcatgcgtacatcgctcagcccacagaccagctccacaaag

SEQ ID NO: 48324 - DNA, 383 bp, Chlorella protothecoides
  modified_base (108)..(298): a, c, t, g, unknown or other
cttggtatcaagcagcacgctgcatgccgcgtggagaaaactggagcatgcagaccaccaaaaaaaaggccaggagtaccaatctaccttcttgtcggtgatgaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagacatgacaccgacccctccgcgcgaggacagcatctgcacagatgaagcccggaacccccagtcccgcccactgctgcaaac

SEQ ID NO: 48325 - DNA, 61 bp, Chlorella protothecoides
gcgaggctgctgcttcatcaacccctgccaccatctcagccagcctgctgagcgccccatg

SEQ ID NO: 48326 - DNA, 229 bp, Chlorella protothecoides
gctgaacatcacacgcactcccaccacctgtgtgcatggcgtgggaaacccatgacagtgctccgctggggttcctagaggcaaacctcaggtgtcggcccctccccggtcctgtgtcgcggattcgtgcaggagggccgaagcctccccgtggccgcattcgttgtgcagcatccccacacccctccacccccgggcacaacaccggcagtggtgctcacctgcgcaa

SEQ ID NO: 48327 - DNA, 71 bp, Chlorella protothecoides
cccgcccttgccatgagcagcgcctgggtggccaccagctcccgtgtctccctctccagccgggcctgcaa

SEQ ID NO: 48328 - DNA, 61 bp, Chlorella protothecoides
aggacaaggagcactccgtggtgagtggaatggaaagtcggtctttggtgcacaacttttg

SEQ ID NO: 48329 - DNA, 129 bp, Chlorella protothecoides
ggctgctgctgaacgtagaccctggtcttgcccctgtatcatgtcccttgcatactgtcgacgagaacgatcgaacctatcccagggaggacatgcccatgcccagtgcttgtaatacaacagagggaa

SEQ ID NO: 48330 - DNA, 61 bp, Chlorella protothecoides
caagctggcggagctcctgaaggccaactccagattctctaccaaggacctgaccctcgtc

SEQ ID NO: 48331 - DNA, 61 bp, Chlorella protothecoides
ggacgcggtgcctgtgggggcaaggggggttggggaacgttgaacgaggcaagccgctctc

SEQ ID NO: 48332 - DNA, 77 bp, Chlorella protothecoides
cccactgtccagctgtcaaacacaaaaatcgccccccctccatccaccccaggtactgcctttcgtacattccttac

SEQ ID NO: 48333 - DNA, 61 bp, Chlorella protothecoides
ccgctgggggaccaaggctacactgcatcggcacgaggcacgcaatccttgccaagacaac

SEQ ID NO: 48334 - DNA, 66 bp, Chlorella protothecoides
cgacagcacctgtgcagtggtggtcgtcgtcgttggaggattggatgtggagttggatggagggaa

SEQ ID NO: 48335 - DNA, 61 bp, Chlorella protothecoides
gtgcatgccgaagaggccgaagtcgggtctttgggaacatcatccgcacctctgcctgccg

SEQ ID NO: 48336 - DNA, 80 bp, Chlorella protothecoides
ctctggcattgcatctgcccacctgccgccatgcgagcatcctcttctcccgccggtcgtcgatgggtggggccgccttc

SEQ ID NO: 48337 - DNA, 61 bp, Chlorella protothecoides
ggtggactgcacggtcaccacccagtctggcaagcaggtgcccgcgcagtgggcgcgcctg

SEQ ID NO: 48338 - DNA, 61 bp, Chlorella protothecoides
accacgttggaggcgttgcggctggccaggtacccgtccatccccgacctgtgtcgtgtgc

SEQ ID NO: 48339 - DNA, 85 bp, Chlorella protothecoides
tgcaatatgtctgtcccaggagccctcgacgagcagctgactgtcatgtttacaacccccctcttccctttttctccttctcaac

SEQ ID NO: 48340 - DNA, 74 bp, Chlorella protothecoides
atgtcccatggtattctcctctctacaattcccccccttcccgcccccccaaacacctcagctgctcgctgcct

SEQ ID NO: 48341 - DNA, 61 bp, Chlorella protothecoides
tttcagctgggtgcggctccctcgcctgccgtgatgcgaggggtctgcatccgagcgttca

SEQ ID NO: 48342 - DNA, 70 bp, Chlorella protothecoides
gagaaggttctgagctgcttggccaatctggtgccaaagcgtgtccaccttttcttcaggacagctgcca

SEQ ID NO: 48343 - DNA, 65 bp, Chlorella protothecoides
ccgagctggggcctaagaatcaagtctcctcacatgcgtccaaagttccctcttctgtttacctc

SEQ ID NO: 48344 - DNA, 62 bp, Chlorella protothecoides
acgaacgtcttgcagcctgtcgaatcctgggggcagttctaaacccctcctcgagagggatg

SEQ ID NO: 48345 - DNA, 61 bp, Chlorella protothecoides
tgatggaggtgcccagccacgtgttcgagcactatgcgcgcgacgtgcagggcctggccct

SEQ ID NO: 48346 - DNA, 61 bp, Chlorella protothecoides
ggatgctcggccttggagagtgtggcagggtggccactgggaggggagtgcctggggtcac

SEQ ID NO: 48347 - DNA, 80 bp, Chlorella protothecoides
tcggttttcgcacacccagctcaccttacccacacatcgacccattttaaagctttctcgtgctcttctcgaagctgggc

SEQ ID NO: 48348 - DNA, 457 bp, Chlorella protothecoides
  modified_base (89)..(328): a, c, t, g, unknown or other
cccggccgctgtttgtacctgcacccggcgttgtgtccgtcgctggcagtctgttcgctctcggcttcttcttggtcgtagccagcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgccatagtgtgcacaggctgcttgtcgaccggggaagggccagctacatcaagggcgcccacctgcggcgcgacaggtgctgctactgctggtttgaatttattgcctttgacgtgaggcatgctg

SEQ ID NO: 48349 - DNA, 110 bp, Chlorella protothecoides
catcgcgccaaggcaggttctagattgggggctgccttgggagggggagtgagtgtgctccgcaaggtgaattcagctctaccatgtgcgtccagggagacatgctgtgc

SEQ ID NO: 48350 - DNA, 10475 bp, Chlorella protothecoides
  modified_base (331)..(340): a, c, t, g, unknown or other
  modified_base (908)..(917): a, c, t, g, unknown or other
  modified_base (1200)..(1209): a, c, t, g, unknown or other
  modified_base (2242)..(2251): a, c, t, g, unknown or other
  modified_base (2370)..(2379): a, c, t, g, unknown or other
  modified_base (2542)..(2551): a, c, t, g, unknown or other
  modified_base (2810)..(2819): a, c, t, g, unknown or other
  modified_base (4341)..(4392): a, c, t, g, unknown or other
  modified_base (4566)..(4575): a, c, t, g, unknown or other
  modified_base (4773)..(4782): a, c, t, g, unknown or other
  modified_base (4931)..(4960): a, c, t, g, unknown or other
  modified_base (5132)..(5141): a, c, t, g, unknown or other
  modified_base (5313)..(5384): a, c, t, g, unknown or other
  modified_base (5664)..(5673): a, c, t, g, unknown or other
  modified_base (6035)..(6044): a, c, t, g, unknown or other
  modified_base (6129)..(6138): a, c, t, g, unknown or other
  modified_base (6624)..(6633): a, c, t, g, unknown or other
  modified_base (6994)..(7003): a, c, t, g, unknown or other
  modified_base (7941)..(7983): a, c, t, g, unknown or other
  modified_base (8172)..(8181): a, c, t, g, unknown or other
  modified_base (8272)..(8281): a, c, t, g, unknown or other
gcgaccagaggcagggctggccggacggggccccaggcccgcgcagtcacaaacacaacagcgtgcacccttgcattcgatccaaacagcacagcacgcacacctgcccggccgaggttgcccatcatccaggtagctggccagaagccggaatagaagtcgtcgccgggcatgactgccgacacctccaggtacccgcctgcagcagagcatgggggccacagcggtcaggttagggagccgggcacctgctcattgtaagctcctcgggtagaccccagactgattatattcaggctcgcggcagcttcattcataaaggcatgctcannnnnnnnnngagggtagggagccaggcacctgctcattgtaagctcctcgtgcagaccccagactgattatattcaggcttgcggcagcttcattcataaaggcatgctcaacttagcgccacgtttaccggaccctctcccatcaaggcacagcagccctggaggacatggaaaggctgtcctcgctggccagtccccaggctaggaaccagggcccctccaaacctgtgaagcagaacttgttccaggagctgaccatgcctgagacaaagggcatggccacagatgtggaactgccgtccggcgcctgggagatgccctgacccacccccttgttgatggtgatctccagcgacccgcctgcaagccgtgtgagtgattgagtgagagagctgtggcaggatgtggatatcgtgttgcgaatggggtctgaaacagcaaggagaggagcttagtagatgcctggtagtccgccaggggcacaccgagactgattatggctcaacactttccaagggcctgtgatcgagcacagtccagtcgtttatcgagccttgcacctcgggaagctcaccnnnnnnnnnntacgttccaagggcctgtgatcgagcacagtctagtcgtatatcgagccttgcacctcgggaagctcacccccagtggcgacctgctgagcagtgtacacctccatgtcagatgtcggttggtaatagagctggacagttggagaaggaggtaggggtttgggcaacggggtgcctcgagtgtccccttgcgcaccaactagttaacaacacagaatccagatcccatggctcaaccccttccttccctggtcccgcaaccccagctctcccacattctctgnnnnnnnnnnatttgggcaacggggtgcctcgagtgttcccttgcgcaccaattagttaacaacacaagatccagatcccatggcccagccccttccttccctggccccgcaaccccagctctcccacattctctgcagtccacagggggtcgttctgatacaccgcgaggcccctgccgtccttgttgaactcgtcagacatgaccaggatgaggttctccttggctgcagaggcacatccacccagctcggtcgaggtgcagaccgccatgctgcaggctgtggctgggctatcggggtcaatgttggcagccaggttggaggacgtgccggtgtccaacagctgctgcgtgcaaggaccggtggtggccgccacatgcagcgccagcaggcctgcaggggagggacagcggggtcatgggagttccacgagccagatcacagacgaacatgactcttccctgctacgccatcaacaataacgcgcctgcgcatatcactagtgctatgtatgtcatcatctggtttgcctacgacagagtgacgcgcaaagtccgagggcagctgcgcttatcaaacattgcagagcatgtctacattatttatcataaagcgatttaaacatgcatgccttacttctaactgcatgccgcagagacatcagtcggtcgtgagagctggagcgacctgcgcactccatttgaacgcgtcgccgtggcctcaccggtaccggctcccctctatccattctcagatgtgcttaccggaagcaattgccaaggcataaactgagtaaaaataggttaaatgggatcgtaaatgaccaacggccattctatgggcataagggatgaagggagatgcattgtagttgatgtaaggtggccatcctcgccagacacagttcacgttatcgtgcaggggaaggatacgggccattgaatgcacaaggcgaagaatttagcaggggttgtacagtctcatggccatccgagctgcgagcggcaagggagggtagtttggcgcaagattcgtttcatcnnnnnnnnnncaccggctcccctctatccattctcagatatgcttaccggaagcaattgccaaggcatcaactgaataaaaatatgtaaaatgggattgtaaatgaccaacggccattctatgggcatnnnnnnnnnncagttgccctcttgtggtcggtacaacaacaccaaacctgaagatcaaagtgaggaggggaagatacttttgagcaggggcggaagtaggatttcaccaagtctgaaaatctcagggcttgctccccggccttgaagttcttgggccatgctcctcgacccannnnnnnnnnaggttgccctcttgtggttggtacaacagcaccaaacctgaagatcgaagtgaggaggggaagatacttttgggcaggggcggaagtaggatctcaccgagtctgaaaacctcagggcttgctccccggccatgaagttcttgggccatgctcctcgacccagttgtcctcttgccagcatacgtcccgtcatgcagagcttctgccgtaaaagaagagccaaacccttttcccttcttatgttggtcctcactacggnnnnnnnnnncgtcctcttgccagcatgcgtcccgtcatgcaaagcttctgccgtaaaagaagagccaaaaccctttcccttcttatgttggtcctcactacgggctcaccatcgtgtccgtggatgggaccccctttgcgaagagggtgctcacgtccagaaacacgcctgtgccatccccttcgtccgccttgaacgtctcacagttctcggcagcgcagactgtgagtagcggacggcccatgttgggtcggaggctgtcacgccgcgctcaaactcagctgctggccagagcccacgcacgagtgagacaggagaggagacgagtgaatcttctgatacacgtgggagaggtgtgtcgagcacaagagcccggaaggagggtttatcgtttggcgcgccctagccggccaggtcctcacgtgacgtggccttcgtcacggagctcggttctgggagtttcctcgcacattgatgccctggacagtgcctgtgactttccaatatttctcattttattgtacttggtacacatccggaagatttggagtacatcgcaacccggctttgcgatggtcgacctgaagcactgtcccagcgcgccaccagtagacaatagcgatgtgccgctgttgcagcgcatgaaggagcatgcgatagagttctacgaagcttcgcccgagcagcaccgacagtgccttcggaacacattcaacaaggtctgtctagcatcggggtggaacatagggccagcccgaccccgctgcgcaatgtgcctccaacttcatgcgaatgcccagactacagcagcgcctgaatcccttcattactctgatcacgcagtacatgtccaagctgagcgcggccaccgcctcggagaaccctgtgaaacacagtgacctacacgtcagcgtcacaactgggcagcctactcctgctggcagcagccccgcctcgcaataaaactgcctctcattgccctggcagtcagacttcacccaatatctggtgtagcttagtcctgagggattggacatctcttgcaatgactgtattctatgtattctctgaggcattactatgctgaaactgtcttcgtctcaatactgagagcatattttgtaatgattaagaacagagcagcagtgcgcaccctatggagccttgtgccatacattttgcaggggcgtcttccgattttgtcgtcattgcattaaaacagagctggagctgaatccagcagtgtttgaggcaaggaggcactcctcagtgtgggttgccaccgcacacttggtgggccaacaggtggcagaggtgcaaagcgaggaaggttgaatcaattcctgattacaacatccagcctcttggagtgtccctgaatatctatgggcaggagctgccacctaccctgacaggcatctgccgtgtatgcctatgaactaggttggggtctaataacatgcctgcccttgtttcgagctagagacatcagggtcgatgatgtcctggacgagcacaaatgcttctgacnnnnnnnnnnnnnnnnnnnnnnnnnnnnnnnnnnnnnnnnnnnnnnnnnnnntcatccgccccagtaacagatggtgctgaccttgcccatccataccagtatactaggcccacagcacatgcgaagcacctgtttccatcccaaacctgtgcttgcttgaaaatttcatctggcccagctcaagcgtggtggccagggaaaacgaccatgtgggtgtcaggtcannnnnnnnnngtgcaccaagccgcctcttttccgataggcttgatggttacccgacaaacaagaagacctggtgcgctcagaagcaattgttgaggcgcgactctgcgcatggcccatccgccctagtgacagatggtgctgaccttgcccatccatacaagtatactaggccaacgagcacatgcgaagcacctgtttccatcccannnnnnnnnngagggtaaaaatgtgggagggtgataagtgcacacaaagatcgatggaaaactggtattgcgatacacatatggctcgggcatgtagttttaaactcacagctgctcctgcttagcgtccttgtaagggctctaatccggcaccctcannnnnnnnnnnnnnnnnnnnnnnnnnnnnngacagtcaccaggtcgaataatgttaccacgcctccaagcaaggccaacactttcaacacgcaccgtactcttggtattttggaagaggtatgtctatggcattctgagtatataaatgggtgtcccggaggactgtcgtgatgtttcgagatccgaaaataaatgcgaaannnnnnnnnncacaatcaccagatcgaatactgctaccacgcctccaagcaaggccaacaatttcaacacgcaccgaactcttggtattttggaagaggtatgtctatggcattctgggtatataaatgggtgtaccggaggactgtcgtaatgtttcgagatccgaaaataaatgcgaaannnnnnnnnnnnnnnnnnnnnnnnnnnnnnnnnnnnnnnnnnnnnnnnnnnnnnnnnnnnnnnnnnnnnnnngcacttttacgaattgggattatcttgccctcctgtaaattgtacatgcatggcttgaaacacactgatgatatgggaggctcgagggatcgccgacggagcccagccttgctccccttgttcatgttgtctgcgctctcggccctgaccctgatatataccatcccgcgactccaggaaccccacatcggcgtcacaattatttttaagcccttccagcccctcataaccaacactggtgttgacgtcgagggtctagaggtagagagccctgtcgccnnnnnnnnnncaaccccttccagcccctcatcaccaacactggtgttgatgtggagggtctagaggtagagagccctgtcgccccggtgctcagcccttcgagactgccagcctgtaccctagaccagccagccatcgacattgtcctcccggacggcagcctgcacgccatactgtggctgacgtggctcaacgttaccgtagactgctccggtgcgagggctgacggtcattgaagaaggtgcttggaaattttgacctctgtagtgcacgtgattgagagttgtcaggcgtggtgtggtctgtggagcccgagggcgggcgcctcacacccaatatacaactcacagggaaggatgtgttcatgggccnnnnnnnnnngttccccctttcccaacggatcttacccctccacataccccacaagtcctctatacaaccgactgccatcactctgatgctggannnnnnnnnntccgagggcggtcgcctcacacccaatatataactcacagggaaggatgtgttcatgggccggctcatccgtataaagacacgggacgaggtgagcctgctcttgctaaggttgccaaggagttccagccaggctgctgcccaccacatggatgttctcatatgcaatggacaacgtccttccaggggatgtgacagtaagccccttgccgttccaaacccctcaaacctcccccccattcccccttcccaacggatcttacccctctacataccccacaagtcctctacacaaccgactgccatcactctgatgctggatgccgatgtcatccccctccatccgcccttactcacgtggcgccacctacaggcactgatgactccggggtgggtccagcgggcggctgcagggcagagtggcaagcggtgggttgctggtggactgtctggctgtacaaggggtgagccccagcctctgggtggnnnnnnnnnnacagagtggcaggcgatgggttgctggtggactgtctggctatacaaggggtgagccccagcctctgggtggaggctcagctgtccttggtccctcctccatcctcctcccagattgcacgactgccgagacttcaaacctacctgggagatagaggaggcgcggagggagtatcagcgggatgcagcccaggcttcaacccctgctgcgcactccgacggatcggccaaggcgcagcaacgcgccagcaccgtgcttgcctgcagagcggcggtgacgagggagcctcttcctgctggacacacgcaaggcctcttgcggcgggaggtcaaccaaggtgaggaggtcgacggtaaggggnnnnnnnnnnccccgctggacacacgcaaggcatcttgcggcgggaggtgaaccaaggtgaggaggtcgacggtaaggggggcctggtgttgagcccggcgtacgacctcgggtaacagcaggaaccctggaggcagtctcaccgactcatcccgagcttgctcgcgcttgcagacaccttgatgaggctgagaggcaaggggatggacgtctcggtctgtaacgcctctccacgtgcgtctttggatggcctggcccattctcgtttgggatgccgtgcgatgcttctgcatgcaggagccgccactccagggtttgcagctgagcccgcagccgcaagccgctgctgtgcctggcccgtgcaaagcgtcgatgccactgcagccaaagctctcgtccccaccgctctgcaggcaaaactgtgctggggtgccccctctttggcggcggctttggcatccacaccacagcagcagcatacaccctgctgctcagctgcagtaccaggctggggatactgccctgcagccaggacgtcagcagacaggagagggtgtggtggtaggggaaactcgattcccaatgcaagatcctccagcccctacaccctggatcccatcccttgggactcgacgctctcgtgagagtagtgggaggaagcaggcaacctacctctcccggcccagaacgagcacatccttgactcctgaacacctcatgcccgtgcctctctggcagcttgtgagggttgcttgcgcccgctcttggctcggcagtgtgtgcattacaatcagactcctgaacagtactttgaaatacattgctgtgaaagagtagtctttgcgcccctgacagggctggaaccatcagatgatggccaaaagtaggcaagggggcttgcggcgcttgaacgagcgcctttgcgtgagagacatgccgtactgattnnnnnnnnnnnnnnnnnnnnnnnnnnnnnnnnnnnnnnnnnnnccgggtgccaggatcagggcgccatcccgtgtgatcagcctgatggggagggtgggaatggaggcggtgagtgtgtatgtggcctctgtgctcattgtcgacacaggtcctgcatcccaaggtcccccagggcagcaccagtcgccgctcacccaattgccgtctccccgcgcttccgagccagctctnnnnnnnnnnaaaaagcctttcccagtttgcggtccagccctggactatgccagaacaacaacccggtcttcgctcacatactcccgttcttcggccccgnnnnnnnnnngcacaggtcctgcatcccaaagtcccctagggcagcaccagtcactgctcacccaatcgccgtctccccgcgcttccgagccagctctgccacctcggcaaatcgcaccattccccacgaggatatgcccagcctgttgggggttcagcggtagagggacagaggagtcggttttactggatcgaaacctccatcccaagcatggtgtgacgatgcatgcgtcgcaagtccactgcatcccggcacgcggatgctaagcctgcaggcctggcctcgccagggtcttcacgcctcgataaccttgccaacctccacccacccacacggcgccctgcccacagttccggctttcctgcccccggcccctgctcaccagccaggggacctgaggaagacctcagtcccgttcccgctgctgctgccgatcagcgtggcaagcacggagcgcagacgcggctcagcgcccatctgcgtcagcacccccgccgcaatctcgtccggctgcagcagctccgcggtcatcttgccgcgacctgaatcagatgtgtgcgtgtgagtggggggtggggggggaattgttggcaattggacatgtcaggccaccctcctctaaggccagatgccctcctctcgaccacactggcatctgccttgcaaggaccactcctgcgccatctacaggaaccacgcccgccacccccccacgacagccctctcctccctcactcacacaggcgggccaggatgtggttggccacctgcacggtgtccggccgccggatagtgccgagcacgtgcaggggggcccgcaggaggcgctttcttttcagcaggcatgcctccaggaggaggagcgccgagaccagctccgcgtcgccctggatcgactcctcgctgccggacactgtgaggatggaggttcgaggggtggcttgggcatgcattgcaagacggtctgaaaggccgggcaacaagcggcctcactgtgctcccttccatccattcagggccacgaaagggcaggccagtgagagcgtgggctgcagatgactcggcaaccaccgcttctaccttccaaggactcccccccatccacacgcaacaagaatcccaccaccctgagcgcacgcaggatgcggctgaggatgatgacggagtcggcctctgccacccccgcctcctccagcaggtcgatgctggaggggttgccgcggacatggcgcagcagcaagtccacaccgcaccgctcccccttggccccgttggccccgccgtcggccgaccccagcacgtctcggctgcccagactggcgccgctcctcgtcaccaggcgcccggccacctccttatggttcgcgtcggggtcggccttgtcccgcaatgcgtccttgccattcgtctcgccgccctcgccgccctcgccctcgccctcgccctcgcccgcctcctccggctccagccccgggggcgcgcagggccccaccacggtgacactggaccccgggggcgccagcaggtgcagctgcgccatgagcgaggccaggcggcgcgagggttgcgcctcgctgtcatcgcaccctgcaccccactccagcacgacgatgcggcgggggcgggcacccccccgcgcgcgcggctcgacgtcgggccggtgcggcgccgcttgtcccgcctccccccgcgccagctccacgtcgcccacgccccgcacggggtgcagcttgccgctgccgtgcgcgagcaggaccaggcccatgccctcgtgcaggggcatgtcgtcgcgcgggttcagcgtggcgccccgccccgggctcaccaggccgatgcaggcggcggcggggtagcgccgccgcgctctggcgtacgtcgtgcccaccagcgcgccgtctacgggcaggacgcgaacccaggccccgccccgcgtctgctgcagcaggctggcctgcaccgaggccacccccggctgcgccgcgctgcgtgccagcagcgcgctcagcccgccgaccagatccaggtcgtccagctccagggcctgcgccgcggcgggcgtggcggggtcggccagcaggtcggcgagcgccagcacggagggcgcccgcgcccctgtccccgcccccgccggcgtctgcaggatgacgttctggggcctgggcacgtggccgcgcgcccagcgcccgtcgcgtcgccccgccag

SEQ ID NO: 48351 - DNA, 80 bp, Chlorella protothecoides
cggggccggaggcggagtgcgaggcctgggcggatggttggttgggggggggctgcagggcatggtgtgttgtcatggcg

SEQ ID NO: 48352 - DNA, 69 bp, Chlorella protothecoides
tctgtattggcaaactccactgtgccgggcgtgccagcaatgctggacatgccacgcgggctggcggcc

SEQ ID NO: 48353 - DNA, 61 bp, Chlorella protothecoides
ccgtcagcttgtccgtcacccaggaagacagatgggggcactgcctggtgtcctcgtcgtg

SEQ ID NO: 48354 - DNA, 61 bp, Chlorella protothecoides
tggcgcgtgtctctggcgctggcggccgcctttgccctcgtcctgggcgtcggctccatcg

SEQ ID NO: 48355 - DNA, 79 bp, Chlorella protothecoides
gacaggttcaggggggcggaagggtccccgcagggtgcctggggctgggcccccaccccaggccccgggtcctggttgt

SEQ ID NO: 48356 - DNA, 79 bp, Chlorella protothecoides
atccggttggcctgggcattgatctctctctggagacgctcattgtatggatgctctgcgtcgcgaaatgggccgtgac

SEQ ID NO: 48357 - DNA, 85 bp, Chlorella protothecoides
ttgccccatcttttccccctggggaagccccttgcctccaaccccaccccccccacgtcttccattcctcaaggtcgcatcgggg

SEQ ID NO: 48358 - DNA, 61 bp, Chlorella protothecoides
acatgaggtcaagcactcgtcccagcgaacgcctcgaataaccccaccaaaaccacctgca

SEQ ID NO: 48359 - DNA, 61 bp, Chlorella protothecoides
cgagggaaaaaagtgagttgtgcaaggtgtaccccccctccaaggctgaatcacaattcat

SEQ ID NO: 48360 - DNA, 79 bp, Chlorella protothecoides
caatcagcaatatcaaagccacatgtcgccacccctacccttccgccagagttcagtgagggcgaggagtggcgggtcc

SEQ ID NO: 48361 - DNA, 61 bp, Chlorella protothecoides
aaggctgccacaggaagagattgctgcgggtggaccccctggcagcaggccatcgagtata

SEQ ID NO: 48362 - DNA, 257 bp, Chlorella protothecoides
ggcaagggtaacagtcagctccgcaccacgagcgcacggacaggggcgggcctgtcccccggtggaagcgcatggcactggacacccggggtccccgggcacgcggagcagcggcgagccgtcgccttccctcagacactgccctgcacaggccctcgtgactcaaacacactggcacatcaagacctcccacagcctgcaccagagcattcaaccaaacgcgaggcccccgcaacccttttcctgcaccccccccc

SEQ ID NO: 48363 - DNA, 74 bp, Chlorella protothecoides
acgcctggcaacgcggcacgcctcccaaagaggcggcgctgacaccaggggcgcagctcgatgtgttgctgcca

SEQ ID NO: 48364 - DNA, 61 bp, Chlorella protothecoides
catcttgggcacatacctttgctcatgctcacttccagaccgatggcatctcctcccgaaa

SEQ ID NO: 48365 - DNA, 126 bp, Chlorella protothecoides
ttcgacagatcgggtaactcccacagagtcgtcctcccgaaccgccagcccctcagatggtggatttgcagggttgcagtgagtctgacaactctcaacaaacatattcagagcttggcgctggtg

SEQ ID NO: 48366 - DNA, 71 bp, Chlorella protothecoides
gtctggctgtccatcagcctgttccaggagctcaaggcgatgaggattgcacaccctgtgcaggtgctggc

SEQ ID NO: 48367 - DNA, 4766 bp, Chlorella protothecoides
  modified_base (87)..(96): a, c, t, g, unknown or other
  modified_base (797)..(806): a, c, t, g, unknown or other
  modified_base (1115)..(1124): a, c, t, g, unknown or other
  modified_base (2438)..(2461): a, c, t, g, unknown or other
  modified_base (3422)..(3431): a, c, t, g, unknown or other
  modified_base (3748)..(3757): a, c, t, g, unknown or other
  modified_base (4233)..(4242): a, c, t, g, unknown or other
ttctacaatggagacaataatgtgattgctcccgcatcgagcacatttgctccgactacatccgtccaggtgtcgtctgcaatcatnnnnnnnnnnattggaagttgccgcagattgcgccactgtggaggtcgcagaccccgtgtcaacaagtcccagcacctcctccagcccaggcgtcccctccagccccagccccagccccagtccatcaccatctccacctccacttccggctgcccccacaggatatgtcggctttcgtactgacggaacaatctgcatcctggacgcatacgtggaaacaacatatgctatcgttgaagctagttgcaccttctacaatggagacaataatgtgattgcttccgcatcgagcacacttgctgctccgagtacatccgtccaggtgtcgtctgcaatcatcacttatatatcatgctccgcggtgacttatgccatttgtaccgtcactgatggctctacggtagtctctgcaccaggcgagatattttatggatagaccaacctcaagaccatttttcagaagatccacgagggtgctgacctcccaaggtatacctctgccatgttcagcttttccaccacttgcttattgcattgtgtggtactgttttattactccatccatcacccccgtcctggcaccctgcaatgtgtccagtaaaaatagcagtcaattgtgcgctcagagtcccaagactgaagtatacagacgtcgcgcggcacaccgcatgatcttgtgcgggagcgtgggcaagtgatctgcccctgtnnnnnnnnnnttgcttattgcattgcgtggtactgttttatcactccatccatcacccccgtcctggcaccctgcaatatgtccagtgaaaatagcagtccattgtgcgctcagagtcccaagactgaggtatacagacgttgcgcggcacaccgcatgatcatgtacgggagcgtgggcaagtgatctgcccctgtcgtggctccccttggaagttcggcacgcgatcttgctccgaggaatggaaagctgacacaggaaacagtcttgcgagggaaaagcgcagcatgatggtccaggaggcggacgcacgcccccnnnnnnnnnntagggaacagttgtgcgagggaaaagcgcagcgtgatggtccaggaggcggacgcacgccccctgctttccgctcgcctggtcccccccgccggtggtctgcaggccggcgaggttttgactgccgtcctggagatcctggcaccctatcccttggccctcatagaggttgacatctccttggtgggcgtggagagggtggacaccgcctatgtgtcccgagactggcgagcaggggtcccccccctcaacactgacccccgccgcatccagcggcacttactccagtcgggcctgtgtgccgcctgccagacggacctcgcaaaccccgagctccgccgcttcgtcatccagtgagtgccctgcagcggggtgaagggggttttgaggtcaaagcctcaacaatctcacaacctcctccaggcttcacgccctgcccggccgcaagggcatgatgccagcacctccccggccgattctactgagtatcattctccgctctcacccgagctgcccttgactcccacccccccccacacacacacaccaaatcacacacaggagtcgcctgccgtcgtggctcccacccacctacatggggaccgccctgcgggtggcctaccagctgtcggccaccatccggtaccgcgacgcctcctcggcccacgagtcctccttcgccgcctcccccctctcgccccccggagtctcgccggctcaggccgtgctgcagcacgccgtgcgcgccgccgtcgtcgtcctgcccgggcccgggtcgggcggccgcgccgtgctccgggcgctgctgagcccccgcctggcccagcccaccatgcggtgctgggaagtgggggcggggaccgacttgacccaggccctggaccacctggacgccctggcgcgccaggagccggagcctgaggctggcagcgacgacgagggggggggcggtgcgcgtatgagcgccggtgaggaggatgttgcgcaccccttgcccagcgaggacaaggccgccagcggtggcgaggtgccggaccccgcccgcacctttgcgctgaggtgtgctcctggttgaatcgctgggccggaccccgtgggcgcgggggcgaacatcgctcccgctttgtgccgctgttggggaacccgcctgcgccaccacgactctgctggcatacatcatcaatgccctctgccgatgcaaacgggaccccctaccccccttccctgtccctccccacgttgctgcacgtccccctttcctttcctcgcaggctgggcgaccggccactggcgcgcgtgacgctgctgccccgcnnnnnnnnnnnnnnnnnnnnnnnnagttggagcagcgcggcagcctgcgctgcatgcaggtagaggcggcgctggaggcggaggaggcgctggcccccggctggcgcgccggcggccgggcgtggcctgcacccctgatcgtggccgaggcgcgcgaggcggtgccccacgccgccagcgtgggcctgcagctggcgctgccgcgcggggcgacgcccagcttctgcacgccgctgtgcacgctgggctgggcgctgcgattcgtgttcaccgccgtggggcagagccccgcgcgggacccaggcagcacgccgtggcggggagccaccgagaagctgacctggcgcctgcccatcttggttgtcgcccccgggggaatcccgggggaggagcccaacgagtactgaggggggggttggtgaaagctggccagtgttccaggaccagtccttgttaatgatgccccagcaccaaaccgctgtccctcccgccctggccccctccgggcattcgattgtgtctttctgagcatgttgcagaggaggggagtgggggtcggtcgaaacagtgcagggccaacagagtgcagggccagggcacgggaagaaagcgtgacaactgcagcaacagtccgggttccagtcagaggagggttgagggggtgcgccggcgcaggggggaacgcgtatggagcaccccaggacaacggccaggagaaagggctgagagtttattgagggacggcgctggtgagggcagagcagccccaaaggtcgatggcaggaggtcatgcggccccctgcccatctggagggaaggcattccatgacgtgtaggatcggatccagcgtggggtgacttgtgggtcatcgtgcattgagccccagttgcagcttgagagcgggcatcaggtgaggtgctcggagaggcggcggggggaagtcaaggtctcctcttttccattcatcctcttccacagtcgacnnnnnnnnnncggcttgtgggtcatcgtgcatcgagccccagttgcagcttgggagcgggcatcaggtgaggtgcttggagaggcggcgggggggagccaaggtctcctccttttccattcatcctcttccacagtcgactgatcagatgaagccggtctgcatgagcgccactcccgctgctcccacggtggccgacagggcggcggccagggcagcctggcggtcgacagaccccgcgccaccacgccccgtcgcctcgagcagctgtgggtgggatgtggagcgtgaatgtgaagttgctgggcatcacaccgacctgaagcannnnnnnnnngggggatgtggagcgagaatgtagagttgctgggcatcacaccgacctgaagcaatgcttgtgcgggcctcgcacacctccctcccccctgattgccaccccagggcctcgcgccaggccctgcacgaccccatgtggtcttgcctgggccgtggtgaggttgccctgaatgtctgccccccgcatctcccgcacaagcgccagggaggcgtcccactgccccgcctggttgcacacacctggatcatggagtggcgtggttggatgtcagcgaggagggatccagactccgcctggaggaagacaaagcaccctctcaagcgcatgcgtcccgacagagggtggccagtctctcccgcgtccacacccctcataatgccgcgtccacccccctctcagaatcccctcccccccctctgaggaacaggaagaaacaagaacccaccaccaaactcgctcacccagcagcgcattgnnnnnnnnnnaaatccccttcccccctcctaaggaacaaaaagaaacaagaacccaacaccaaactcgctcacccagcagcgcattgtagacgtgaacattgggctgcagcccctcctgcgccatgcgccgccgcacggccagcgcggcgcgccagtcccccgccacgccgtgcgcggcgacgaggccgcagtaggcatagtggcgcggtgcatgccctgcggcgcgcatggccgccaccgtggcctcagcctcggccgccagcccgcgcgcgcccagcgccgccaccagcgtctcgtagctggcggcgtcggggtccgggatgcgggcaaacagtgcgcgcgcttcgtccacgcgccccgccttgcccagcgccgacagcgcggtgttcagcatgacggtgttggggcgcacgcccagcgcgcgcgcgcggcgcagcatgcccaccgcctcgcccgcgcgccccgcgcgctcatacaccgacatcatcgcgccgcagaccacgtggttgacggccggcggagcggaccgcggc

SEQ ID NO: 48368 - DNA, 61 bp, Chlorella protothecoides
agattgtgtcataaaagaaactgctgccccacccctccaccactcacccgtcccactcaca

SEQ ID NO: 48369 - DNA, 73 bp, Chlorella protothecoides
gcgcacacccttccggaatattgaatctgaacggctcaagaatttgtaatctgacaggctcatttcaacggta

SEQ ID NO: 48370 - DNA, 61 bp, Chlorella protothecoides
gcaacatggtgggctgggaggctgtcggggtgatatttgacggtgtgatgttttgctctcc

SEQ ID NO: 48371 - DNA, 139 bp, Chlorella protothecoides
tgagtgctgagcttgctgcggagaacaggttcatgcagaacttgttgggtctgcatgactgattccgttgtgaggcaattggggagttgacagtcgacccaccgttggattctcagcagagaatattgccctggtatcc

SEQ ID NO: 48372 - DNA, 61 bp, Chlorella protothecoides
cggcgcggccgccaggtgggccggcaccacgtggggtgggtggtcaaagttgtagacgatg

SEQ ID NO: 48373 - DNA, 6784 bp, Chlorella protothecoides
  modified_base (152)..(161): a, c, t, g, unknown or other
  modified_base (2257)..(2266): a, c, t, g, unknown or other
  modified_base (2508)..(2517): a, c, t, g, unknown or other
  modified_base (2818)..(2827): a, c, t, g, unknown or other
  modified_base (3242)..(3251): a, c, t, g, unknown or other
  modified_base (5003)..(5012): a, c, t, g, unknown or other
  modified_base (5615)..(5624): a, c, t, g, unknown or other
  modified_base (5881)..(5890): a, c, t, g, unknown or other
  modified_base (6246)..(6255): a, c, t, g, unknown or other
  modified_base (6498)..(6717): a, c, t, g, unknown or other
cacaccgagcaggggctcggggacgacgcccgacgccaggcctccgtcaaacgaggcgcccagcgtcgggggcggtgcaggaaaccccccaggacccacggcgccgagctgctgggcgtcggcaaagcccgccgtctcctccccctcctccnnnnnnnnnnagccgcgccgccgcggccgtcgccgcgcaggcgtaggtgtcgggcggcaggcgcagggggggtggggtgagggctggcggcacaccgagcaggggctcggggacgacgcctgacgccgggcctccgtcacacgaggcgcccagcgtcgggggcggcgcaggaaacccccgaggacccacggcgctgagctgatgggcgtcagcaaagcccgccgtctcctccccctcctcctcgcactcctcggcccggcggatgccctcagacagcgcctccaggccacgcaccaaacgccggctgtgcaccgcctccagctcggcgtcggtggcggggcgggacggcagccgcacgcagcgctctgtgttgggtcgtgcaggcgcgtgggtttgaagaaaggctggggaacgaggggtgaacgggctcgccagaaggccgtgaccgccagatcgccgtccaccgaccccacgctgccctgtgcccactggcagccactgtccctcagcacgatacacaccccagagacacccaaacacccactaaaaatacccaccagcaagctccgcggcctgcaggcgggcccacacggcacgcaggcggtcggggcgctccgggtgtgccccgccgcccgagctggggcacgcctcgctctcctggtgcagcagcatggcgtcgtcgtaggccaccaccgtcactgcgtcgcggcggcggggccgtggccgtgcgtcggccgcagtgtaagcaacggcggaaacattgggcagacacgtgtcgacgctgttcgcaaggcacgggcccgctgaattcgtcgcgcgtcgcgagaggggcgtcgggtcaaacagggagggcgtgtgagcgtcgtcgtgcccacagtcctgtggatgacccaggaagaaggaagggcgggcgcatgagaagggcaatgcctgctgattgaacgccgcccggcccgtggtagtatccacgccgacggccccttccacccagggttccttggctcctgcatacagacacacgcagctggtcctccacccacccacccaccaggcagacgtcgtcccagaggggggcggtgcagttgacgcagtggcgaggcgcgtcgtagtcctccgccccctcgtcttcctcgtcctcatcgtcgaacatcgcggcgccggggtagaaagcgtaccgctcgtacgcggcatccagcccggggccggcctcgctcggtcccaggtccccggaatgcaccgccccctcctcgctactgctggaggcgtgcatggcgtagacggatggcgaggggctggtgaagccggccgggcgcaggcccgcctcgcccttgagcacgggggagtgcggctcggtggcatccatcctgcgcggcagccgctgaccatggacgagagggagggttgcgtggataccagtgagcctttcgacatccacattgcttgaatctggtttgtacaagagtcatgatgcaaaagggaccggcaacgttctccatgcacgcgaaatcccagtgccaacgggcacactgcctttttcagtaccccaaagccaggggcgtaatcaaatgttgcccccacctgcgacctccggaggggcgacttcccggaagcgaggggagtttgatagggcgagcgggggcttgtgagcgtgcccaacagcttgtcaggtgtcaaggaaagggggaagcgggcggaagagggaaatgaggcccgctatggggagctcccgcgctctgagcaccgggatccgcgcggctcccgctcacccgctccgctgccgggcttccttcgcgccacagaccggcctttcggggtatggggagggaggtgcagggctgccggtcctcggcaagggcttcctggcgcttcccccgcccagcccttgagcacgttctagcggagcgacaagctcccggggtcgatcgctaggcctctccaagctgggcaagcccacccagggcaagagtgagacactggccatgacttcatcccccgcctcaagcctgtgcgtccgagctgtcacgaggaatgtatcatgctgtgttcagtgaggaggcggcatcccacgcctgctgtcttgccagtgttcagtgaggagcaatactnnnnnnnnnncctggcacaagaccagaatatgcaaagcgtttcttaatggtctgataacagagctccccctggtacgatatctatctcattgccctcgacggctgggctccagtgcgcctccctacaaggcatgatgtgcacactgctgcacatcgtccacagccccacccaacccccacgatcgatactaccaacccaccctcacaccgagtgttccagcccccggccactcactctctgccgcctgctcnnnnnnnnnncacaaggtatgatgtgcacactgctgcacatcgtccacggccccacccaacccccacgatcgatactcccaacccaccctcacaccgagtgttccaggccccggccactcactctctgccgcctgctcgacagcttgcttgaccttctccagcactctgtgctggagcatgcacagcgtccacgccgccctggctcgcagagcggcgtcgggctgcaacccctcgatggcggccgacacacgggcgcgagcgctctcaagggccgccccaacggcagccaggtgctctttctttaccgccnnnnnnnnnnatccacgccgccctggctcgcggagcggcgtcgggctgcaaccccttgatggcggccgacacacgggcgcaagcgctctcaagggccgccccgacggcagccaggtgctctttctttaccgccaggggcttgggctgctcggtgtcggcgtctgaagaagtgttgagggagcggtcagaggcctcagatgcaggctcttgcaatgatagccagcattgttgcatgccagcaggtgccaggaccaccggcggtctgctgagcaagaaaccacgcactgccacttgtgcaccttgcggatcccaggcctcgaagcggtcgcagatggtctgtaggtccttctttccacccagcagcatctgcggtggggtgctgccgacatggctgatgagttggacaggtgactgctgcccctttnnnnnnnnnnacgatggggtgcggccgacgtggcttatgagttggacaggtgactgctgcccctttctgaaaggagggcctgggtgcctcggtgccaccccagcacatgtgattgcccaggcatgcaggatgtcgccagccaacccctgccctgcaccacccgctcccttgcctgcactgcgaagaggaggcccgtgggcggaatgctgccagcgaccgacacctggaaggcgtcggcgggcgccaggtaggcacggatagcctcgcacgcacaccgatctgaccccgacgcgccgcgctgcgcgcgggcgccgccgcacccaattaacacgtctgccagctgaacgcaggcctggccctggctgcgcggcacatccagcccctccacgaagccataagtgtgcagcagctccgtgtcagacaggtccccgtaggtgaagaggatctcctcgccggggctgatggcgcgggctgagtcgaggtgggttgcaagggagtgaggatgatgggtggtcggggaagaggtcggcaaacgggtgtagagagctattatggtgtaaggaggaggacacatgattgcggaggaaagagacagggctgggaggggattgcagggggcgacggggaggggctgtctcctccatgccgatgggctgcagactgcagctgcagatttgaagaatgcggattctcagcatgccttgcgttccatcccctccccccctgccctgacccgcagtcccagatgcataaccccaaacaccactcacaggcgagcatggtgaactcccccgggatgcgctcgccacccgccgtcctgtctggcgtaaatcggagctcagtggatctctgctctgcctggctggagtggttgaccatgtctatgccgggcaacaggtacagctcacagcctgtgtggaaaaagatggcgagcatgctgaggccgggtggagtgcacccctcttgagcgagccttggttgaccagcgcatccccaggctgtcaacgctgtgctgcgacggctcaaaaagcgagcaggctcggggagatctggcgtacagggaaagagcaaggccattacaccgccccgcccccttccttcccctctccaacctaccgtcgctggtgccacccgtcacccagttggtggcctggaggtggaaggtacgggactgcaccatgccggccgcccaggcaaagcgctcatacgtgaactctggccaggcctgggggtaccgggacgccagctcccgtgcggcttcctcatacaactcgagcccagcctctcgcagcccggggtcaatgtctgcagcaggaaaaggggtaagtgaggagggggggatgtatggcatgccaagtggcgcaaagctcgccagccaccaaggcccttgatgcggatgcatactggtagatgagcactcctgcctcagatgcggccatgcacaacaagaagcatgcgtcccaaaggatgagcaccccctgcccaccagtttccagcagcggcgagaactcagcctcagaccaggcaaaggggcagtcgtggctggatggcatgcttgtaatgtgggcatggaacggcgatgcagctccctgtgatgaggcgtaggggcatgtcatcgctgggtgttgggcaggagactgtgtgcgaaaagggtacatgccggcagtgccttcggtctgctgtgcccgcgacatgcccagggtccaaagagaattcccccccacacacaccgccacgccaaaaccacgattgcctttgcgcnnnnnnnnnnaaatttctccccacacacacagccacgccaaaaccacgattgcctttgcgctttccgccaggagcagcatcgtggatgccagaaaggagttgggttgggactgcagtgctcgcatggcaggtgcctgggcacagtgcgtgttgcatgacgggagagtgatggggcggccgaacagcagggagagaccacgcgatgggctgtgccaagggcaaccacacagtgctccggcccggcttagctaagatgccctcacctcgctgggactgctgggcacgtgcatgcatagcggggtgggtatgcggaggagcagctccccctcggcgatctctctggtcgcgatgatgcccctatatcctccttctgtagttccaaagagatcgatgtcggcgtgaacatcgcctccattacacgtgatccattgccgcaggtcgggggtgctgccggtggctgacatatttgcgcgacctacagatcaagcaatcgaagcaatgttctgccacatttcctgtcctcttcccacttgtagagcttgcttacttgtcaaaacaagccatgatggtctaccatccacatcgtatgcattgggtgtcagccaagcgcgcnnnnnnnnnnccatatttgcgcgacctacaaatcaagcaatcgacgcaatgttctaccacatttcctgtcttcttcccacttgtagagcttgctcacttgtcaaaacaagccatgatgatctgccatccacgtcgtatgcattgggtgtcagccaagcgcgcgcccgcgccctgcaggcattcttttttcggtaatatctagatttatgttagtaaaatcccacgacagatcgccgcccccccccccccaagactgtctaatcacannnnnnnnnncggtaatatctagatttatgttggtaaaaacccacgacagatcgccgaacctcccccccccccaagactgtctaatcacatctaaaaatctcaaatcatttgcagacaatgcgcgggatgcccccattgttggagccccccgagggccctttcaccacggccgacatagtggccgccgaggccacagttcgcagtacccactatgaatggcccgtgacgcaggcaaccattcctacggagcgcgtgtatgacgccgtgcgcggcgagagacgtatgttcaggacgtcgttccatcggaaagcccacgccgctatccaggttccgtaatcacctccaacggaaggcccgtgtgatgnnnnnnnnnncatgttcaggacgtccttccatcggaaagcccacaccgctatccaggttccgtaatcaactccaacggaaggcccgtgtgatgagcatgcagcccgtcccctttccgctgcactcagtaccagctcttcaacacacgcacaggactggttgtcagtcgagtgcttcaggtgcgcctgtggtccggggaaacctgagggggtggagaaggacagcgccagccagcatgaggggcggacgagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgaacttatccctgccttgcgcaacgcagcttctcacactgaggcaacgatgctgggattgcgaaa

SEQ ID NO: 48374 - DNA, 104 bp, Chlorella protothecoides
gtgctgttacagaggccccctggtcttttgtggggccggggtggggctgagagatcagaaggacttgctcagtcgatgcaatacctgactggctgtgagcacct

SEQ ID NO: 48375 - DNA, 61 bp, Chlorella protothecoides
gtgccttgcatcaaacgagctgccacaccaccatgtccagcaaacagcctgacagactctg

SEQ ID NO: 48376 - DNA, 61 bp, Chlorella protothecoides
cccgcttctgtcacattcgatgtattgggacccagacatgagcactctgtaggtactgatg

SEQ ID NO: 48377 - DNA, 61 bp, Chlorella protothecoides
ctgtgcgctcagggcctcagcatccttccatctgatggcatcccagatgccaggcagtgcc

SEQ ID NO: 48378 - DNA, 61 bp, Chlorella protothecoides
tctccctgaatatcccggtcctctccaaatagccattcagactgcccaactcattcgtgag

SEQ ID NO: 48379 - DNA, 77 bp, Chlorella protothecoides
cacatggtaggaggcaatgaggtgaaatatcaccacatcatgcgacctggatgctccacgcgcaatgatggaccgct

SEQ ID NO: 48380 - DNA, 61 bp, Chlorella protothecoides
tcctcattggggcaggctgggagcacagggcgggggggggcgttgacctcatagccttcag

SEQ ID NO: 48381 - DNA, 86 bp, Chlorella protothecoides
tgccgcgccgcgtggcggtgggtggcgtcgagtcctcatcttctgcgctggaggccggcagtaaagcggccgccagcgaagcgcac

SEQ ID NO: 48382 - DNA, 61 bp, Chlorella protothecoides
cgaacccagcgtggccccaccctctcccctcggccccaggccccgccggaaccgtgtgcct

SEQ ID NO: 48383 - DNA, 61 bp, Chlorella protothecoides
ggacctgctccggaaattatgttcaaaggcacccccccttcttgaaatccatcctcagctt

SEQ ID NO: 48384 - DNA, 61 bp, Chlorella protothecoides
acacggcttgaacgcgagaggcaggggggctggatgtggacatctccagccaggctgtagc

SEQ ID NO: 48385 - DNA, 101 bp, Chlorella protothecoides
cgcgctttcttaggccttgacagctaacgatccagctgcttggctaggaaatttactcttgacttacaagacacagcttggttcaacatgaaatacaacga

SEQ ID NO: 48386 - DNA, 61 bp, Chlorella protothecoides
accgattccgtgcgcgagcggccccccccctccccccccccaatcaggttcaagtcttcca

SEQ ID NO: 48387 - DNA, 132 bp, Chlorella protothecoides
acaaaggcccctgtagtatatttatgttcatttgctcgttattaattgacgctgtcacctccacgcaggcgtaccgaccgcagcactcgggttttatcctccgggggcgcacctccctcatcccgccgcttc

SEQ ID NO: 48388 - DNA, 72 bp, Chlorella protothecoides
tcctcagcacgcgacgggtccccccatgccgaggcatggggggagcatggccccgattcgcactcgactgcg

SEQ ID NO: 48389 - DNA, 65 bp, Chlorella protothecoides
tactgccgagcctgttgttgttgttgttgtattttggggtggggtgatgtaatggatgaggggat

SEQ ID NO: 48390 - DNA, 62 bp, Chlorella protothecoides
cttgctccaagatgcgacgcctggaacgataacctgacaagcacacacagtgaatgtgcgtg

SEQ ID NO: 48391 - DNA, 61 bp, Chlorella protothecoides
gggaagcggaagcaatgggagcgtccttttagtctgatgccccgccacaagccaggaactg

SEQ ID NO: 48392 - DNA, 101 bp, Chlorella protothecoides
aagacaccctctcgtgccagccgacgggccactgtggaaggcacttccacccacactccatccagggatctgcgctggagactcctctcctccacccctcc

SEQ ID NO: 48393 - DNA, 62 bp, Chlorella protothecoides
ttgccctcacttttgcgggcttagacccccgccccccccaccccaccccatcacagtgtggc

SEQ ID NO: 48394 - DNA, 64 bp, Chlorella protothecoides
gccgcactgctcggcatctccgccggccccgccgcagtgctgggccccgccgcagtgctgggcc

SEQ ID NO: 48395 - DNA, 25656 bp, Chlorella protothecoides
  modified_base (321)..(330): a, c, t, g, unknown or other
  modified_base (831)..(840): a, c, t, g, unknown or other
  modified_base (1585)..(1594): a, c, t, g, unknown or other
  modified_base (2033)..(2042): a, c, t, g, unknown or other
  modified_base (2361)..(2370): a, c, t, g, unknown or other
  modified_base (3278)..(3287): a, c, t, g, unknown or other
  modified_base (3636)..(3645): a, c, t, g, unknown or other
  modified_base (3991)..(4000): a, c, t, g, unknown or other
  modified_base (4572)..(4581): a, c, t, g, unknown or other
  modified_base (5020)..(5262): a, c, t, g, unknown or other
  modified_base (5334)..(5343): a, c, t, g, unknown or other
  modified_base (5571)..(5580): a, c, t, g, unknown or other
  modified_base (9345)..(9354): a, c, t, g, unknown or other
  modified_base (10674)..(10799): a, c, t, g, unknown or other
  modified_base (10858)..(10867): a, c, t, g, unknown or other
  modified_base (12082)..(12091): a, c, t, g, unknown or other
  modified_base (12596)..(12605): a, c, t, g, unknown or other
  modified_base (12695)..(12704): a, c, t, g, unknown or other
  modified_base (12933)..(12942): a, c, t, g, unknown or other
  modified_base (13016)..(13025): a, c, t, g, unknown or other
  modified_base (13324)..(13333): a, c, t, g, unknown or other
  modified_base (13763)..(13772): a, c, t, g, unknown or other
  modified_base (14469)..(14478): a, c, t, g, unknown or other
  modified_base (16391)..(16400): a, c, t, g, unknown or other
  modified_base (16729)..(16738): a, c, t, g, unknown or other
  modified_base (17203)..(17212): a, c, t, g, unknown or other
  modified_base (17336)..(17345): a, c, t, g, unknown or other
  modified_base (17453)..(17462): a, c, t, g, unknown or other
  modified_base (18061)..(18070): a, c, t, g, unknown or other
  modified_base (18153)..(18162): a, c, t, g, unknown or other
  modified_base (18236)..(18245): a, c, t, g, unknown or other
  modified_base (18611)..(18620): a, c, t, g, unknown or other
  modified_base (18687)..(18696): a, c, t, g, unknown or other
  modified_base (19248)..(19257): a, c, t, g, unknown or other
  modified_base (19539)..(19548): a, c, t, g, unknown or other
  modified_base (19778)..(19787): a, c, t, g, unknown or other
  modified_base (20528)..(20537): a, c, t, g, unknown or other
  modified_base (20769)..(20778): a, c, t, g, unknown or other
  modified_base (21231)..(21240): a, c, t, g, unknown or other
  modified_base (21738)..(21747): a, c, t, g, unknown or other
  modified_base (22252)..(22261): a, c, t, g, unknown or other
  modified_base (23445)..(23454): a, c, t, g, unknown or other
  modified_base (23984)..(23993): a, c, t, g, unknown or other
  modified_base (24477)..(24486): a, c, t, g, unknown or other
  modified_base (24641)..(24650): a, c, t, g, unknown or other
  modified_base (25539)..(25593): a, c, t, g, unknown or other
gccatgagcgccgccgcggccgccgcggggtacccgctgcacccggccccgccgccgggggcgggggcgctgcagctgccgccggcgctggtgggcgccaggcctgcggacgacgccgaggctcaccctgccaagaagctgcggacaggtgtgttgctttggggccgggtggtggtctcgcggagcgagttctgggagggtcggttgagggcgctgggtctgggcgttggcatgtgcttggtgtgtttcaggtggaaaggaatatcacgtgaattgcggggtgtgtgcaggatgactcgtccatgcacaatgttcacggcnnnnnnnnnnggcggacgacgccgaagctcaccctgccaagaagccgcggacaggtgtgttgccttgggggccgggtggtggtttcgcggagcgtgttttgggagggtcggccgagggcgctgggtctgggcgtcggcatgtgcttggtgtgtttcaggtggattggagtatcacgtgaatcgcagggtgtgtgcaagatgactcgtccatgcacaatgttcacggcgtgaagccttgcattgtgttcccaaccgtgcaggcagcggggggcctggggaggtcgagcatctgggggaggggcaaggttccgacaaggtgagcagtgtgtctgggacttgaggctggagtggccagtcgggagatgaatgcagtctgatgtaaatcttcatgccaggacgtcgaccttaagaacgcgtcgccaacgtgaagcaactcagcagcccgtgttcctggccactcagaactcagcaaatcacatttctctctcctccacaaccatgcagccaccannnnnnnnnngaccgtgcaggcagcggggggcctggggaggccgagcatctgggggaggggcaaggtgcagacaaggtgagcagtgtgtctaggacttgagcctggagtggccagtcgggagatgaaggcagtctgttgtaaatcttcatgctagaatgtcgaccttaggaatgcgtcgccaacgtgaagcaactcagcagcccgtgttcctggccattcagaattcagcaattcacatctctctctcctccacaaccatgcagccaccactgtccagctctgaggctcgtggcacgctgtttgggtccatctcaggcgacgcagagaggggtccgggagagcagggccaggtgaggggacgtccatgagatgattttagagtgggggtcgtaatggctgggggcctgctatatccgttggcataggtgctcggcgggtgtgtgcctggactgcaatcaaaacgccttgttacacaagggatcctacccaccctgactgtgcctcggtcatcccctcccaccatcgcagactgcgccgctgcttgcgtacccaggcgtgtccaatgcgctgctggggctaccgcagctgggcggcctaccccccgctcccggccctcatggcaacaaccagccactgccgccctcgcaatgagggtgctctctgctcagcctgcgcagtagtgcaaggtgtagagctcgattgcacgtttggccccctgatctccatctttagctgccgcttgactcaacgaccnnnnnnnnnngccgcagctgggcggcctggcccccgcccccggccctcatggcaacaaccagccactgccgccctcgcaatgagggtgctctctgctcagcctgcgcagcagtgcaaggtgtagagctcgattgcatgtttggccccatgatctacatctttagctgccgcttgactcaacgacccgaccctgttgccctttctcaatcgctccatcgtctgctttcaagtcatgtacatgtttttgttcctgagtaaaaagagagcatggtggggctctaatggtcaaggatttgcactcgagataaagcaatgagtttgaagccgtttgacagagcttcaagttggtcaataatgttggatctgtgcggcgtataggttgtcatcgtcgcccgtcggcgtcagctgttgctggcaaatacatcgacgaaatggtatgtgccgtcggnnnnnnnnnncaaagagagagcatggtggggctctaatagtcaaggatttgcactcgaggtaaagctatggatttgaggccattgacagagcctcaagttggtcaataatgttgggtctgtgtggcgtataggttgtcattgtcgcccgtcggcgtcagctgttgctggcatatacatcgacgaaatggtatgtgccgtcggccattgagcgaactcccacgctgcagtcacaggcggcacacgtcacagggttgaaggtttccgcatcaagagcacctgccattttgggatctgcgtcggcatctccctcctctgccattgctcgttnnnnnnnnnntgtcacagggttgaagggttccgcatcaggagcacctgccgttttgggatctgcgccggcatctccctcctctgccattgctcgtttctttcctcgccttgccttaccaccgggctctactgaatactgttgcactatctcgctgtctatcctgcgtcatgaggatggggttgaggatgctttgtgagtactcacaatgtcccaaatggatgtcatgacgtgatcatacatggtcaggagtgcacgcagcgccagcaatctcgtctgccctgctcagcggcatggccactgaccacaggggttgcgagcacctgcagttcatgacaaacatggctcggaactggttgtgagcacctgcagttcatgacaaacatggctcggaactggttgtgctggtatgcgtgctgttggcactccaggcacagtgttgtaaagcactgagggcagctcaggatggcatccgagcggcgtcctcctcgtagctttgacacccatgcctccgacttgtcatctgcctcggggtcgaagaactcaggaggctctgtcgcctgcctggagccgctttcaccctgtttagagtcctgatcagagtcgtcggatgcctgacccgacgagccgcatgttcctgcggcagggagccggttgctggaggcatatgttgaagtcatgtcgggcacaaaagtgtgcatatccatcattgcactccaaatactgtcacaccttcgtcatcagagtcccgtccgtcgtcttctatgattgtgtcgtccatatacacagcctcctaccaatcgtggactccgcaatgtgaaaaacaacgcacgatacgtgttgtccctagatgttttttcaacgttctatacgcgctcgcagagatggcaatccaggctgtgcgtagtccatagtccatnnnnnnnnnntgctttcaccctgtttagagtcctggtcagagtcgtcggatgcccggcccgacgagctgcatgttcctgcggcagggagccggtcgctggaggcatatgttgaagtcatgtagggcatttaagtgtgcaaattcatcctcgcactccaagtattgtcacaccttcgtgatcagagtctcgtgcatcgtcttctatgattgtgtcgtccatgtacacggccgcctggcaatcgtggactccgcaatgtaaaaaacaacgcacgatacgtgttgtcccttgatgttctgtcaacgttctatacgcgctcgcagagatggtaatccaggctgtgcgtagtccatagtccatnnnnnnnnnnatccagagggactatcgagatcaacaatccccgacacctcgtcgatccgagacccttcgtctgctccagtggaacattgaacgggggtataagctgcctggaatcattgaggagctcaaacaaatagatgcggatgtgattgcgctgcaagaagttgatataggatgcgagaggagcgggtctttggatacaggtaatctttgggtgtggagagggtgtgtgctcggactcccttgccagggtggattggtatccaaatttcccatcaaccttcacccgaaaacagggaatgaaattgccaaggctctgggtctgaactatgccttcttctgtgagtttgaggagnnnnnnnnnnctggatacaggtaatctttgtgtgtgaagcgggtatgtgctcggcctcccttgtcagggtggattgttatccaattttccatcaaccttcacctgaaaacaggggatgaaattgccaaggctctgggcctaaactatgccttcttctgtgagtttgaggagctcaggtctccgctgcggacgccagagctccaggtattggtgagggtgcgtgttggaaaggacgagcttgtgtgcactggaagcagtctcaggagtggcatacccagtgccatcctctctcaatgcctctgtagggcggaggagtccatggcaatgccatactctccaagtttgacattctagatttgggcctagtgcagcacaggtgaggagctgggaggatgctgggtgctcagaggggcatgtagtgagtttccttggctgggttcctggtcattcatctgccatggaggctcaacgtgagtcttctcttacgatcctcaccatctattggcagtgtgcacctggtggactggaacaatgccgagaaacctagggcaaggctggagccgcgtcgaggggagcgcgcgnnnnnnnnnngcatgggaggttcaacgtgagtctcctctaacgatcctcaccttttattggcagtgtgcacccggtggactggaacaaggccgaggaacctagggcgaggctggagccgcgtcgaggggagcgcgcggtgctgagggctcgcatcgcagcgcctggcaccaacctcgtggtctactgcgcgcacctggaggtgttctgcggggctctcgtcaggatgcgacacctggcagacatattcaatgacgccaggagccagatcgaccaggtgtgtcggaggtgtgggtagagggatcttgggggattttttcaacagactgtcacatgggttgtcacctgtccatggacaagctttcttgcttgcatatgaagccgtgctgggggtgtgccatcggtccactacatcagctaacccaagaatggtgtgccagctgtacaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggaaactcatgatcacacctccaccgaccaccaggttcctgggcagcacggagggagaggtgtggcaggnnnnnnnnnnatggaaaggaggatcttgggggattctttaaacagaatgtcacatgggttgtcacctgtccatggacaagctttcttgcttgcatctgaagccgtgttgggtgggcgccatcggtccagtacatcagcttacccaagaatggtgtgccagctgtacaacgccaggtatgtgttttcagggagatcctgtacccaccactcccttggcgtcatattcacatgtcagggnnnnnnnnnncagggaagtcctgaacccaccgctcccttggcgtcatattcacatgtcagggctgtcctaggatagccatcctgggggacatgaataccatggcacatggagtggcccgcctgtcgccatcctactgctgcgatcgcatgcggttcaggtctgtggagcgatccttgctggcacgtgttctgccttgcactgctgggagtgtgcacgacaggatgtagcactactggcaacgggaaactcatgatcacacctccaccaagcaccaggttcctgggcagcacagagggagaggtgtggcaggacaagatcctcagcgtgcctgatccacggtattctgagccctatgccgctgacgccttggcaccaaacccacacatactggcgtggggcctcccgccgcaagtggctcttggcgccctgaacccgggcttctcagacccctttgatgccaggaatacagtcacattagataatcccaagtatcgctggggcccctggtcgctcatggctgggaagctggactggatgatgctacgccagctgacggtgcacagcaccagcctggggaatcaggggtacgggctctccgatcatgcatggctgtgtgctgacgtgtcggtctagcgaacgttgtttgtgggtagaaaactgtccaagtgacctagactgtgactttcatagattgactctgacatcgagtattcaattcctgaagagatctctactaaagtcagcgtgacatgtaaacactttccgtcgtcttcgatgtactttgacagacatggcacaggcaggtggaagtagccattttaagattggctttgctttcagagatagtagcacgcaaatagtgtacaaatctccgactgatcaggaatggtatactatcaatcaacaaagtaatgcacagctgtaccttcagtggctttcaagatgcaacagactacgaagcctgtgttggtgtgtcatgcccagcaagggtgcggacaacagtgggatgcggcggagtacagctttgaccaccgctgtaagcggcttgagcaatgaagctcagaggaacagtgtccaagagtgacacgcgattactgctctgcatgcaggctgcgactgtcattgaatgcctgaacatgacttattatctcctgcagcccgtccttgccgtcgccatcaatggcaatgaagcgttctgcacggagatatgtcattgcaaaaatagttgtgaatcgatgtgcctagcaggggcatacaatatcatccaacccagagcgttcctgcacctccactcactttcagaatcatagcgttcacggtagtacttctcacatatcatccagacgcatgacccagcaacccagttgtcattcttcatgtgtttctccagccagccgtacacctgttttggaagagggttatgtgtcatcgtggcatcgtacaagttattttgaggatgccattgacgaaatattagtttcagcctccctggatataataacaagccagggcttacatgttgaaggtactgccggcgcgcgtcatacttctcatcccccgttccaacctccgtatggctgaactcagacaacacgaggggttttctcaagacgtcctgacaagcctttagatgagcatcgagccacatggttgtccacgggttcagacccttcttattctgcaagagatgaaatggggaggaacgaggatctaacaattttctacagctccatcaccgtgtcaattctcacccagaaatgcaaacctagcacccgtcgtcaaccaaagacacactgtggtacctgagattcaatattccacaaatcatggtagatatggcagcatgcaaaatcgatgttgggatgggcggcgttcgtcaggaagttgcagccctccatgaggaggccagggttaagatcaccaacacggaatcctggacacgaaaaagatgaattgagatttgaattgatagctgttaggtttaacgagtgaactcaacactgcccctacaaatagcttcaaccagttagcctcaccagaaatatcactagtaaagaagccctcagtgtctactgtgataaggtgattgctatcttgtgacctgacaaagtcggacgtatctctgatccatctgtcgagggtattgctgtctttctcgcctttgaccctgggctcatttgcaatggaccaggccaggatggtgggatcattcctgtgagatatgggatgagccttattcaataatatttctgacaaaatcttgattgtcaataatccatgtatgccgtgctcgtcaagtacaaactcacttatactgaaggttgcggtattggttagtcctgttgaggagtttctgtatgtatgccttaaagcgtgactgagccgggccactattgaagaatctgttttgaggttcccccttccatggatctcccccacctacgccagcccacctatatgatgtggagaatgaacgatatgagacaacacaactatacattcaacgaatgctcttaggaccacattaccgttgcaaaccaacttactcggcgtattgtgtgagacctccatacgctggccagaaattggtgaggctcatgatcagcttgatcttactcttcgcagcttggtccaccacccagtcaagtccatccgctccaccttcttcgatgaccggctcataccagggtgcctctggtgagctgccaggaacttcttttgctccattcttttggatttcttgccagccattgccatcgttgtgcgcccatatacggaggacatttatgtgcttcgcggcagcggatttaatcagcctttgaatgttagctcggccacaatcagtgggaaaaccgctgtccggattctttctcctttcctccaatccttgcggagagtctgctccatgtgactgcggcaaggtgcagacgaacgaagctaaactcaaaggacaggtaaagaagcgctacaccggcatccgaagtagatcctcaccactcctcacaccgcatcgataatctgtagcaacccattggcttacctgtacatgatagcagtttgcccccataatcctgaaaggttggccgttgagctcaaggcgatgagttacgggattgaccttgacgaagtgagacattctctgttcgtcgtaagtcgcactggagatctcgacggtatttagggaaggatgatactactgcgaatgcttcgatacggaagaagggtaatgattgcggtgaaatggaaccttgatgcgcaatccatcagcttatgtatagtagaacataagaaggcacaggaagccatacacccccatcatttttgccagcgcagcgtatcgcgtatcttgcgcataccccgctgcggctgtgtatgagaaagatcctccgcagcaccaccatgagagggaaacattacactaggaattttaatgatgaacaaagtctgaccagaggggcttggatttgaggttttgggcgcaagtttggtctggctgcacactgtttccggcatgtcggtaaatctcatagggggaagattctagtcgagtcccggcccggtcaagcacgaaacgcgcttatgcggaaggcattctcgcaaaacaaacatctccacatttgaaatttctttggacgccagatacaccactcagctcggcgatcgctgctgtcggtaaatggtacggaaagcctgcgtacgagacgacggaactggcgcacgggctgcaaagtgaaaagtttcaaactgaacgaagaatgagtaaaaaggtacagnnnnnnnnnnctttactgatgcttaaggtctactttgaagggcttgaatttaaggttacatgcccaagtgtggtctggctgcatgctgtttccggcatgtcggtaaatctcacagggggaagattccaatcgagtcccggcccgggtaagcacaaaacgcgcttatgcggaaagcattcgcgcaaaataaacatctccacatctaaagtttctctggacgccaaatacactactcggttcgggcgatcgctgctgtcggtaaatggtacggaaagcctgcgtacgagaggacggaagtggcgcacgggctgcagagtgaaaagttccacactgaacgaagaatgagtaaaaaggtacagcatccaacatcacgtcgacttaaaagacagaaatgtcttatagaaggtgccatggcgcataaaagccgagcgaagtctcgcacagagtgcgacgtggctcgacgacatgtacatatctcgcagcattcggaaaggcaagagccggcaactatgcttaagctcgatccagctagttagcttggtgtcgcgggttgcatgatggatactggcggtacaccgcatcggcatggtcgatgacttgctgcagtccgtcctttccatcgccatcaatgataatgcaccttcctgtgggggattgaggaagaaagttctggaggatcgttttaaacaaccccgcctcttgcattcatagagtgagctctctatacagagtagacacgattctcctccatctccattgccactcactttcttcatcgtcatgtccctcggcaatgaatgtttcgtctgatatcatccataccacagatccaatgacgatgccacgtgggcccatgttgtcctggagccacccatacacctggcggggcaaacaaatggcatcattgagaggatcttgacagatgtacttgaaagacgcaacactgccgtcttgtatggtccctagcatcgttcctaccccctcagcacaccttcttgaggaagtcttggcggtcggaaaaactttcgtccttaccctttcgctcactgaactcagagagaatcaggggtttattcttggacaacttcccctggcaggccttcaggtgaacattcaaccacgtcttgatccactcctcccgcttcttcttgtcatgctgcagcatgggatggaggtcatggtggaaggtccatagcgtgtgagaacagcacacagccggcaagcacaaagcatcctatcacctcaaacctgccgtccaagtcatcatgggcacgtgcctggatgctctcctctggccacagatcctggtacatgtgcatgcatgcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagaggccggtagccacaacttcagatatgtttcgctcaacatgagtctaaagcctannnnnnnnnncgatgcaccttcctgtggtggattggaacagcaaggacaagagtaacatatcggaggcttctccctccccgggagtctagcagacatagaataagctacctaagcagagtagacacattccctcctccgctgccacagtcactcaccctcttctttgtcatgaccttcttcaacaaacttcctgtcagatatcatccacaccacagatccaatgacgatgccacgtggacccatgttgtcgtggagccacccatacacctggcggggcaagcgaatggcatcattgagagaatcttgacagaattaccttgaaacacacaacactgacgtctcgtacggtccccagcatcgttcccaccctctcagcacaccttcttgaggaagtcttggcggtcggcaaaactttcgtccttacccttttgctcactgaactccgagagaatcaggggtttcttcttggacaacttcccctggcaggccttcaggtgaacattcaaccacgtcttgatccactcctcccgcttcttcttgtcatgctgcagcatgggatggaggtcatggtggagggtccatggcgtgtgagaacagcagacagccggcaagcgtaaagcatctcatcacctcaaacctgccgtccaagtcatcacgagcacgtgcctggatgctctcatctggccatagatcctggtacatgtgcatgcatgcaaagtcgatcgtctcatggtccacattcttgatgaagtcacatccatcctggagctggcctggattcagataggatgccttgacacctgcaaacagatgggtaggagaggccagcagccacaacttcagagatgtttcgctcaacatgagtctaaagcctatgaaaccttcatttcaccccagtctcccctcctcaccatcctgatctgtcaagaagaacccctcgacatccacggtgacaaggtggttgctgtcctgcgacttgacaaacttggaggtgtctgctatccagttgttcaaggtgcgcccactggggtccccccgccccctgggctcgttggcgatcgaccatgccaggatggttgggtcgtccctgtgagcaaagcatgtagaatggacgttcaagtcgtgatcttgagatgggtcccaactgtgtgagtgccccggaatgctcttcagccaggctttgaccccccaagccttacttgtagcgcacaccgtcccgcttgnnnnnnnnnnacaaataatgtagaatggacatttaagtcgtgatcttgagatgggtcttaactgtatgaaagccccaacatgctcttctgccaggctttgaccccccaaaccttacttgtagcgcacaccgtcccgcttggggttgggcctgttcagcaggtactgtatgtaggctttgaacattgactgcgccttgccattgctgaagaatatgttctgcaactcccactcgctgagatcagatttcttggacgcccacctgcagtttttcagggagaggcccatgacgcggcatcccagctgcgtgctgttcgtacactgcaacaaagtcccaccactcacctggcatactgagggatgccaccaaactccttccagtggttggtgaggctcatgatgagcttgacaccattcctggctgcctcggcgaccgcccaatctaggccatcaatgccatttgggtcaataatcggctcgaaccaggccgacccatctggattggtgaggacctccnnnnnnnnnntgcccacctgcactatgacagagagaggcctatgacgcggcatcccagctgcttgctgctcgtacactgcaacaaagtcccaccactcannnnnnnnnntttgtgccattctggatgctgttccaggtgagctcgttgtgggcccagatgcggagcgtgttgatccccttgtctgcagcagccttgataacgtttgccatgcggcctctaccacttccattgctgtctgctccatgttgctgcacatgatggtcgagtgtgagaggcgtcggaagatagcaagagggggctgcccagagtcttgcacatgcgcaatgagattgtcacnnnnnnnnnncaggccatcaatgccatttgggtcgatgatcggctcgaaccacgccgacccatctggattggtgaggacctccnnnnnnnnnngtagtaagaaggggctgcccaaagtcttgcacatgcgcaatgagattgtcaccgaagttgcgcacgagtggtcggccatcgcagccgacagtgcgaacctgaatgaggtggcaattggcaccgacaatcttgaagggtttcccctggaattccagtcccactccatcggaggtgagcttgacaaaatcgctcatgctggcgcaagcggtgatcccgaacggtcaaggggcaatgaactttcgatacgattccctttcaagatccagatttcaatggcattatgaggcgatcgagcccgnnnnnnnnnncacggacaaggggcaatgagctttcgatacgattccctttcaagattcagagttcaatggcattatgaggcgatcgagcccgtttatatacatatacgggcagcatcggcttcatgctgtttcgatttgaaggcgcaggcagctgatttcaccgacacgcagcgaacgcggcagaatcttgagagatcctttttatggagtagaacttggtcaatttctgttttcttggcttcacctggatctgatgtatgggaccctcatagcatgttctatatatgaagatcacagctgcggcgccagatatggtcgtctcgcgccaaaggggagatgcaaatccccccacgacatagcgcctttcgaactctggcttaaaattccacataatatccgccaaaaaaacagaaaggcagttcgtcacggggacttcccnnnnnnnnnnccttgagagatccttattatgaaggggaacttggtcaatgtttgttttcttggcttcacctggatctcaagtatgcgatcttcgtggcatgctctgtatatgaagatcacagctgtggcgccagatatggtcgtctcgcgccaaagaggagatgctaatccccccacgacctagcgccttccgaaccctggcttgaaaattccgcataatatccgccaaaaaagcagaaaggcagttcgtcacggggacttcccacgtggtcacccaccgcagtactattcccgcccaatccagcttaattaccgaggtctaatgggatcggatgcgttctggatggtatgaacgaaccgacggaggttgcagattttctagaggctcatgtttggcaaggaggctaaaccgccagtccctcagtagtggtggtctggtacatcaagggaggagcctgacgagtagcatagggttgcatgaactacattcatgaaaccttcttgctgtttcatgctgattcatcctgtgttcaagctggcatgcaatgtgcaagcacgataggcaattgtcattcaagtgatgttgaccagcttgccaccaaacccctcaccgatgtcctgttgcagtgcatgagttttgagctgtccctggaggcagtggcaactcagactcacaaagctctccacgtctccccgcccgtcacatnnnnnnnnnngaaccttcttgctgtttcatgctgattaatcctgtgttcaagctggcatgcaagtgcaagcacgataggcaattataatgcaagtggtgtcgaccagcttgtcatccacccccttcaaggatgtcctgttgcagtatatgagttttgagctgtccctggaggcagcggcaactcagactcacgaagctctccacgtctccccgcccgtcacatccatacacagcacggatgatatgttacaagaccattcattcacgaaatctcgccacggttctcgaccaaaacttgcacagagcacttcaggcagcggcagactcggccaggggtctagcctcctcagcctggctgggcgcggggctcttggaccctgtgaagtggctcttgagccccgaccagcactggtagtaccccctctccatggaggacgagcccagcgcttgcgccgtcagacgcggtgtgtagtacctgccatgagatggagtggggaaatagtatagatgtgacaaaagtgttgacatcatgtggtgcctctgatgtctgagggaatgatagctccaaacgtgtcgcacaccagcacgacccagccgacctcagtcccactccatcctcgactgggcggctactcacgtctcaaacatgaaggccagcgtgtccctgggcaggtgggctggctcctctgcaaccggcaggatggccttttcataggaaatcgtgtctgggccatggggtgtcatgcacatgtgcaggctgctgccgcctgtgggaaagcaaggcgtgcgaggattggatcaatgcaggcgtgggctcagcaggagatgcagcgcctttgcaaggagctagccaaatatgagacacgagccttgcatggttcacaacacaccatcgagtcgaagtggatcagagcgagaccgcacagagtcgaccccacaaacaccaactcgtgccagcacagcatgccttccagagtctttgctccaccccgcccacctggcttgaacccgccggccttggcatcgtactcccccctgatcagccccatgaactccgacatgatgttgcggtggaagtaggggggcttgaacgtgtgctccgccaccgtccagcgcgggggaaagatgacaaaatcggccacagccgtgcctgagtgaggaaggcaagcgagacaccaaggtgttggtgaggtggcaggccaggggaatacaggcagtatgctctctcccccatctcactccccttttcctccccattcccacctgggatggccgaggggcaggtcaacacggtgaagatggaggggtctggatggtcaaaggccacggcgttcatggggcaaaatctggacaggtcgtactgcagggtgaacaacagggctagggtttgtcaaggggatgtgtgagggatgcgggcccccacactctatacgcccaactgtacaactctacattgtcatggttggtttcagacccaagacacaaccccctcctgccctctgccaccttgtagggcgcatagttcccatgccaggcgacgacattgtagggtgagaagttctgatcggctgcaggaagtggagagaatgttcaaacttgtgatggaaacatgccgcaacacgacgacagagcaggcaagtgcaacctccccatcatccagagcctcaagaaagtacatgtaggcccctggatcaagacgatgttctgggccattgtcttcccacgtgcaccaccacacagtgccctcccttgcccacctgagaacagctggccctcgaactttgtgatcacagtgtagtggcattgcctgtcctcgaaccaagccaccggcgtctggaagtcgcggggattggccagcccattggcacctggatcatgcaacgaaaaggggagagacacatcgacacaagtataagcacctannnnnnnnnntggccatctatttcccgcatgcaccaccacacagtgccctccctcgcccacctgagaacagctgaccctcaaactttgtgatcacagtgtagtggcattgcctgtcctcgaaccaagccaccggcgtctggaagtcgcggggattggccagaccattggcacctggatgatgcggcgaaatggagtgagacacatcgacacaagtataagcacctagtgtgcgagagacaaggaagtactctccaagattggccaaaggtaacagagctccaggctttcaatattgccctgctccccttttcctccccagcttgagactctccccgcannnnnnnnnntcaaaggtgacagagctccaggctttcaatatagccctgctccccatttcctccccagcttgagactctccccgcaatactcaccaataggacccaggtcaggcagcacaaagtgccctgcaaagacctccagaacgtatccgcgtgccctgccaccttccacatccacagagaagcgcatgcctcgctgaattacagtgatctctccgggtgccacccgtagctttccaaattcggtggtgatgcagagggtgcctggcagagaaacattttagagggtctcagtagaatgtcaaaggatggaggtgtgggtgttggctcggcactgggaccctgatgtaaaagtttagtcatgaagaattatgctgcatgagtattaaacacaccacatctggcttccatggcatgttggatcaccatcctccaacacaatcaaagcacccacctagctgggggacgatgagnnnnnnnnnncaattctagagggtctcagtagaatgtcaagggatggaggtgtgggtgttggctcagcactgggaccctgatgtaacagtttagtcatgaaggattatgctgcatgagtattaaacacaccacnnnnnnnnnngtttagttgggacagtgagagaaatgggaaggcagcggtaatcgtcaattcaggcacaaaccgtttccagttacaattcggctatactggcatactgaagaccttctnnnnnnnnnnacagatcaccatcctccaatacaattaaagcacccacctagctgggggacgatgaggaagtctccatcagcattggcaaggcaggagtcgcccatgtctgcagaggcagcgtacatgtggatggcatacccatcctttgcagccgcactatttagttgggacaatgagaggattgggaaggcagcggtaatcgtcaattctgagacaaaccgcttccagttacaactcggctatactggcatactgaagaccttctcctcatccaccagctcaagcaacacagcagcataagccctcgcaccttccggcaccacacactgtaaagaggcctcgcacaaagtccaccggatcctcaggaatggggaagggccgccatctacaggggcaggggctctatgcgatcaaaactgctgcatagtgtcgtacaggccataagtcatagagcaatgacgagacttgttcagcatcacactttgacaccttccacatgctactaagacctgtacctgagttggttgggggtgatcgtccctgttgtaaagttggcagacagagtctccacagggaagtttaggggatggaatggctcgtgggtgacnnnnnnnnnnagggcaggggctctgtgcgatcaaaattgctgcagagtgtcgtacaggccacaagtcatagagcaatgacgagacttgttcannnnnnnnnngtaaagtggaggtgaagtaaaggcctctgatcaccaatgtccctgggcgcctccctcatgaaaccctcccgctnnnnnnnnnnataaagtggaggtggagtaaagggctctgatcaccaatgtccatgggcgcctccctcatgaaaccctcccgctccttacgtgcggggcgcagtgaaggctgtgccagacagctgctcggcgtagagtccatagggagcttcctgcaacaagggggggaattgacataccctgatcacgctctggaacagccagatctgcccgtttcggcatgtcggacctttggcgcacccgagggttgttttggccaacaggcagactccctggcaaagcctctgactcgaaatcgttccctgcatacggttcagtatagttccaggatcaaggaggcgggtttcgaggccccacaaggtcatggtgatttccgnnnnnnnnnngatggatgtaacgatgatgcccgagtgctgccctccgacaagttgatgagtctgcatgccgcgggannnnnnnnnnaacggtttagtatagttccaggatcaaggagacgggttgcgaggccccacaaggtcatggtgatttccggtcgcgaacgacacagggctccgatagcttaccgaaaccgctctgatatctcaacgtgacgaccgtcttgccgttcgcggagggtaccatggtcaccaaatgggtgtaacgatgatgctcgagtgctgcctcggacaagttgatgagtctgcatgccgcgggaccctcgcgtgtacccgagtgccgcggcccatgatgcgtgcgctctcgtgaccagcggggtcaggttgttggattgccgacggctattggacagtgactgagatttgattctcatggcatcgccatccactctgtcaggggatgaacgttttcctgagctcctgcactgttcaggatgaggaacccttgaaacttctggtccctcacttcatgcaggcattgctgataccctcagaagacggatccatggtttttgaaacccatccctcggggtgaaactgcaactggtacatgtcaagataccaaagaagtctctccagnnnnnnnnnngtaaacccatccctccggatgaaactgcaactgatgcatgtcaagataccaaagaagtctctccagtggctattttgcgagccagacatttctcagacgattgtataacacccagacacccaataacttgaatcgtgccagagatgcatgccggaggggtacagcgcccatcattccaccaagggcctttattcaagggatcgcagagcaatacgcgatttatcaatcatttccgctcaataacgcattcaatctgatcacttctgtgcacgcttgatttannnnnnnnnncttattaaagggttcgcagagcagcacgcgatttatcaattatttccgctcaatcacgcattccatctgatcacttctgtgcacgcttgatttaccttgggaccttgtcgtggtggcgtgctcgtcggtgcccaagaactccgctgctcgtaacatagtcagcctcgcctctttttcacaagaatccaaacaccatagtccgagcacgacgacatgtcaaagtcgtgccnnnnnnnnnnaatagtcagcctcgcctccttttcaccagaatccaatcaccatagcccgagcacgacgacatgtcaaagtcgtgccagggcctgtttgtggaatttgtgaaatgcctgcgagaatccgactgcatgaaggcaagcgtgctggccttacattcgtggataatgggcgccctaatgcgagcaggcggggccattccagctccatcgtaccctccaccattatatgccccgttcaggtggagcatcgtagcgtcacggagtgcgccaaggtcagcgaggagtgtgcgggcctgcgctacaccttcttccggtgcaagcatggccagatcgatccgcgcacccgcataaagggcaacaaaggctactgagccgcggcatggcccgatcaggctgtggcgcgctctcctccccgccgaccgtctgcctgcggaggggcggggatgcagctggtgccagggccaggagggcagctgcagccaaggggcgcctggcggggcctcgctctcccaggcccaagcaggacgtgcccaagccccgtcccacgtcagggaagacagcccgtcagaaggagcaagacccaacagatgcagggccaggctttgcccggctgcagaagtttgcagaggcgcttgagggactcacgcccacgatagacagatctcctactaccactgcaatcgccgatgtggtatgctggtggctcaaggataggcactgcacctctcgtgtcttgcatgtgccttnnnnnnnnnncaccactgcaactgccgatgtggtacggtggtggcccaaggatagggactgcacctctcgtgtcttgcatgtgccttgtgctgctctcctcctcctgtgatatcgtgcacctcggcgtgtccctgctatatcctgaggcttctccatctatcctcagggaggtcagcttgggtctgcagaattgaataatggaaggaaaatcgcagaacggaagagggagccggtggagatnnnnnnnnnngtcggtgtgtccctgctatattctgaggcttctccatccaccttcaggaaggtcagcttgggtctgcagagttgaataatggaagagaaaccgcagaacggaagagggagccggtggagatggacgagacgactgcggccctggcagcgcagttccccttccagctggacgatttccaggcaaggggctgtgggggagagggtgtgtgcaaatcatcttggttctaatcaactgaacataagaatggcagagaaactaggatctgtgtgctgcacagcgctctcgcacagctgcctttttgatgggatgggtgcgccgtgttgctcattcatccacagcttccctcactttaaaaccccaaaccccgccaccccatcccactccgacatctctattcccagatcaaggccatcaagtacattgtgcgggggcggtctgtcgtggtgtcggcannnnnnnnnngcagcttccctcacttttacaccccaaaccccgccaccccatcccaccccgacctctgtatccccagatcaaggccatcaagtacatcgtgcgggggcggtctgtcgtggtgtcggcacccacgggctcgggcaagaccgccatcgccgaggcctgcatgcgccacttcctgggagcggggcggcgcatcatctacaccacgcccctcaaggcgctgagcaaccagaagctggtggagatgcggcagcgattcgggtgcggtccaaggctacttgccatcccggcgggtcccagggcagggttgggagagggcgatgcccatccgcggtggttgacggccgctattggagcgacgtgtgaccctctgcactggtggatggtactattacgggccgtatgctgggagagtttctgtcgagaacgttgtgcatcgggaaccgtcctctccctgcacacagggtggaggcggtggggctgcagaccggggacgccagcgtnnnnnnnnnncagagggcgatgcccatccgtggtggttgacggccgctgttggagcgacgtgtgaccctttgcactggtggatggtactattacgggccgtatgctgggagagtttatgtcgagactgttgtgcatcggggaccgccctctccctgcacacagggtggaggtggtggggctgcagaccggggacgccagcgtgaacatcgccgcgccgctggtcatcatgaccaccgagatcctgaggaaccagctgtaccgcagcaggacgattgcgccggatggggtggagggcgctgaggcagcgacggatgccgccggtgatgatgacttcgaggtgggtggggatcgtggggtggacaattgaatctaggccgatctttacgttgtggccgagacgatggccatcgagcgttccaattccgagcactgtgtcaaaaaggcacatgtccaatgcagcgaggaaagcatgaaggcctcccaacctctctcatgcaggacgtggccctggtgnnnnnnnnnngattgaatctaggccgatctttatcttgtggtcgagacaatggccaccgagcgttccaattccgagccctgtgtcggaaaggcacatgtccaatgcagcgaggagagcgtgaaggcctcccgacctctctcatgcaggacgtggccctggtggtgctggacgaggtgcactacctgggcgacccctggcgcggcagcgtgtgggaggaggttctgatcaacctgccgccccacatcctggtcctgggcatgagcgccactgtgaagaaccctggtgacctggcgggctggatcagacaggtggatggggagggtggggtggtgggtgtgtgcagggggaggaggacaggatgtacatgggtgcggcagctggaagtgagtgagccctccctcctgacccctgacccgctgttcttcaggtccacggcgagtgcagcgtggtgagcagcacgtaccgtcccgtcccgctgacctggcactactgccacgcggacgccgagctggcgcgcgcgcggctcaagcccctgctggcgcgcggcgggcgccggctgcacccctccctcgttcaccccagcgcgcgaggaaagcagggcgaggccggcgcggcggccgcgggcgggcagcgcggccgccgcgtgctggacgagctggtgtcggtggtggaaaggacggaggaggacgactggctgagcgtgccccgggcacgacgtgtgccctccatggcccaaggcaggtttatgatggtcgtgggtgggtcgacagatgacgaccggcagaaacggcacctgccggtcagcctactggcccagccccaagagttgcatcagctcatgtattccctacctttgtccacacccctctgcacgtgcagtggtccggctgctgaactccaaaggcatgctgccggcgctgtggttctgcttctccaggcgggagtgcgacctgtgcgccatcgccctccccacccagggcatcgacctcaccacgcccaaaggtggggaggcaacgggtgcagacaggtgcagtggtctgccggtgccccttgcaagtcagatattggggcaatgccagggtatcagaagattacccactgctgaattcaaagccctcgtaccttccggcatcatggtcactcccatgactacgcctcaccgacaccttcaccgctcccctcctccctgcagnnnnnnnnnnccaatgccagggtatcagaaggttacccactgctgaattcaaagtcctcgtaccttccggcatcatggtcattccatgactacacctcaccaacaccttcaccgctcccctcctccctgcagagcgggaggccatccagaggcacatcgacctggcgcgtgagggagcccccgaagccgtgagggaggacctggtgccgtccctgctggccggcatcgcctcccaccacgcgggctgcctcccggcctggaagaccttggtggagcacctgttccagcaaggtggggttttggttgcttcagctgcctcagcctggaccgcgagccatgctccgcacggagctcctgattgggacattctcatgaccagaggtggcagcagctctctcgtgtttgatggtgttaaaagctcattgcatgcactctttcaaaccatggctgcgatcgtcagtcacgattcccgacaatgtcgactactccgccccctccccttgttggacaggcctgctcaagctggtgattgccaccgannnnnnnnnntctgttccagcaaggtgggattctggttgctttagctgcctcagcctggaccccgagccatgagctgcacggtgctcctgattgggacattcttatgagcagaggaggcagcagctcttctatgtttgatggtgttaaaagctcattgcatgcactcttttaaaccatggctgccatcgtgagtcacgttcccgacaatgacgactactccattcccctcccttgttgaataggcctgctcaagctggtgattgccaccgagacgctggcggccggcatcaacatgcccgcccgcacctccctcatctccaccatgacccggcggtcgggggaggggtttgccgcgctgcggcacaatgacctgcaacagatggcggggcgggcggggcggcgtgggtacgacaccgaggggcactgcgtggtggtggcctccaagtgggacgagcccagtgccgcctgggaggtcctcaagggcgggcccgannnnnnnnnntgtgtggtgatcagcgtgggatgcaaggggtcccgagctcttctgctgttgggttacgacctgcccctaccctatacacatatgcacacaccaagtcgtacactcgccagcccttctcctctccaccactgcagttcagcgcggggtacagcatnnnnnnnnnnacccctggagtcccaggtactggggtcttgaggaggtgactctgggcttgtacggtgttgttgagtgggacgatgctgcatgctgtggcaggggcggaagtctgcagcgcagagcctcggaaggaacaacttgagctagagtgtggggggttgtggtgatcagcgcgggatgccctggagcaggggggcccgagctcttctgctgttgggttacgacctgcccctacccaatacacatacgcacacaccaagtcgtacatttgccagcccttctcctctctaccactgcagttcagcgcggggtacagcatggcgctgagcctgctggccacgcgctccctgcccgacgcccgcgctttcctccacaaatcgttcctgcggtacatgggcggcgcagccacgcgccagcgcctggcggaggtggccgccctggaaagggcggcggaggacctgcgacgcgagctgggcgcggcggacggcgtcgggtcggagcccgagctctggcagcgcttccgcgcggcgcaggaggccgcgcgctccgccaaggcggcgggcaggaggctgcgcgccgcggtacggaccgcgcacggcggtgcgatggcggagcgggtcgcggaggcgcggcgcgagacgccctgccccgccgtggcgctggacctggaggggcggctactggaccctggggccgggcccgattcgctcgctctgctccccgcctggctgctgggccccagcgaggtggacggcaaggatgacggctgggaggctgcggcagacgcagcgccgggccccccccgctacgtctgcctcggcgccgacaaccggctgtacgacgtgccggcgcacgcgttggcgggcgtgcacccctccgtccccggcgggcccccgnnnnnnnnnnnnnnnnnnnnnnnnnnnnnnnnnnnnnnnnnnnnnnnnnnnnnnngctggcgcgggggagcagcgtcgccggcgcggggtggacggcggccgggccgcaggccccctc

SEQ ID NO: 48396 - DNA, 627 bp, Chlorella protothecoides
cccccctatccccccacacccgccctcgctctgcagctacctggaggcctgcgagtctgggtccatgttcgagggcctgctgcccgaggacatctcggtctttgccaccacggcagccaacgcgcgcgagtcgtcgtggggcacctactgccccggccagagccccagccccccgcccgagttgctcacctgcctgggcgacctgtacagcgtggcctggctggaggacgccgacgaggccaacctgagcgtggagacgctgaaggagcagttccaggcggtgcgcctgcgcacctcccagaacttcacctaccagcagggcagccacgcgcagcgcttcggccagctcagcatgggcacgcagtccgtggcggagtacctgggcgacgccgagcaggggcctgccgcgtggcgccacgccggggccggggcgtgggtgggtgcccaggtggccgacgccggcgccgagtcttctcggcgccggcgcctcggtccccagggcgctgtgccgcagcgcgacgccgacctggcgccgctgtacgcggcggtgtggcgcgagggaccggcaaacagcgccaagcgcgctgaggcggagcgcgcgctggcggccgcgctgggggcccgggc

SEQ ID NO: 48397 - DNA, 15569 bp, Chlorella protothecoides
  modified_base (1462)..(1471): a, c, t, g, unknown or other
  modified_base (1777)..(1786): a, c, t, g, unknown or other
  modified_base (2013)..(2096): a, c, t, g, unknown or other
  modified_base (2493)..(2502): a, c, t, g, unknown or other
  modified_base (4225)..(4234): a, c, t, g, unknown or other
  modified_base (5176)..(5185): a, c, t, g, unknown or other
  modified_base (7072)..(7081): a, c, t, g, unknown or other
  modified_base (10774)..(10836): a, c, t, g, unknown or other
  modified_base (11064)..(11073): a, c, t, g, unknown or other
  modified_base (11201)..(11210): a, c, t, g, unknown or other
  modified_base (11585)..(11594): a, c, t, g, unknown or other
  modified_base (12822)..(12831): a, c, t, g, unknown or other
  modified_base (13170)..(13179): a, c, t, g, unknown or other
  modified_base (13567)..(13576): a, c, t, g, unknown or other
  modified_base (13764)..(13773): a, c, t, g, unknown or other
ccttcctggcggccgagcgttcggcgggggccggcggcgcgacgccgggggaggccgcgccggacgcttcggcggcgctgccgctggccgccagcaccgcctccccctcggcacgaacggagcggaagaggtaggacagcgcctcggacagcgccagccccgccaggcaggcggcggcgggggccagcaccagcatgagccggacctgtttgttgggggcgtgggggtgaggagaagggggtggtggtaagggaggtgaaaagcgggtccgatgtaggggggtagctgttaccctgtgacctcgcacgagaggggtggagtgcagggttcgagcaaggtgtatgcgcggcgcccttgagaagctgccttccaggtgtgcactgacgttccactgtccaatttaaagagtgaaactgcacaccacaagtcctccaactcgtccttccacaacagcaggagaccagcctccggcctaaccctccccacagccccggcctttcccgatcttatcactgtgtacccctgcccaaccaccaatccctcggctcctaagagacctccccagaaccaactctccaccccccccctcaacatccctgcatctgctcaccatgaccccggagaagtagacggcggtgacggcgtagagcaccaggaacaaggaggcgtcggtgagcggcgtgaaggccgcgaccaggccggcgggcgccagcagcgtaaccaggtgcaggtcgttgtagtacgagctccaggccgggggctggtgctcgctcacgctggcgatgatggggatgtacttggaggcataggtggggtccagcagcgacaggctgcggcctgggtggagggggggagaatgaagggggaacagggagtgtgatgtgggtcgccaggcgtaggggctggggggagggagcgagtgcagggcaagcaggctgcagcgcacagcgtacaggtgggacggtcccgggatggatcacccagagccctggcaccagctccgggccccccatcctgggatgagccgctgcccctttctacccatgacctacctgtccagccaaaggtgggggaggcagtgacgtacccggtgaccagcaccaggatcacgccagccacggccgtgccgacggtccacacgacgcgcttggccgcctcgtacgttcgtggcggcagcgtctccttgatccactgcaggcgggatgggggtgggtgcatgtgagtgtgtgggatggggataggggaggggactcaccaacagcgtggcatggaggaaggagcaaggccgtggtgccgacgcgtgagcatgcctgcctgcaaaaccctgcaactcctttgacagcctcccgctcatccattcgtgcgaccaccggtgaaggcacccccagaactcgacccctccccccaatcccacaccagaaagacaccaccgcctccaccacgacaccggcgcaccttgatnnnnnnnnnntcccagaccccacaccaaaacgacactacagcctccaccacgacaccggcgcaccttgatggcaaatgcggcatgcaggatgccaaagacggcaaaggacgcaaagtgctcgctcatcaggaccgcgttgaagccgatgacggggatgttcactggggagggaaaggggtcgttgtcgttgggtgatggggaatgcagcatgggacactggtctgtgggcagcataaagtgtggcgggctccgtcgcaagaccgtgctcagcgggaccgcgtcacacgtccacgcctgacgcacagccatcacagnnnnnnnnnnaaaaggggtcgttgtcgttgggtgatagggaatgcagcatggggcactgatctgtgggcagcaaaaagtgtggcgggctccgtcgcaggaccgtgctcagcggcaccgcgtctgacgtccacgcctgacgcacagccatcacaggcccaggcacttgcctgcactccccgcccctgcagaagccggaagccctggtcaagtcgccctctcactcacccagaaccacnnnnnnnnnnnnnnnnnnnnnnnnnnnnnnnnnnnnnnnnnnnnnnnnnnnnnnnnnnnnnnnnnnnnnnnnnnnnnnnnnnnnccgccagggcccccaggatggcaaagggcgcgtaggccacgtagaggccggtgctcacccggcccagcacaatactggccaggcagtggatgggcagcaggttgacgatgaagctgtaccctccccaggaggccaccatgtagaggtagccgaagaagagggcggtggcccacctcaggctcgccgtgttcagggtctggtcagagagggttggaagggaaatcagtgggggatggggattcgttcccgtcgaaatgagaggttcgtttgggtgatgggccagatgtaccagcctgaatgcccatgccccagtaggcaaagcctcccccaccttccctttcccattcgtcacaccacctttcaaaaaccctttgccccaccttgacgtagaggaagnnnnnnnnnncgaatgcccatgccccagaaggcaaagcctcccccccccttccccttcccattcgtcacaccacctttcaaacaccctttgccccaccttgacgtagaggaagaagacggtgaccagggcggcgatggcaatggactccaggtcgtaggatccggccacggagcgcgagatgtaggaggggatgatggcgatgaaggcggcggaggccagcccggccccgtcaccgcgtacctcgcgcatgaagaagaaggtcgccagggcgcacaggccggagaagagcgggcccatgaacacgcagatctggatgagtcgtgttttgggggggatttggggtggggtgagggttggagggatggggggtggcgggggtgacagggatggccagggtgacagggatggccggggtgacggggatgggggggtgagggatgaaggtgggcatataccatgctggcatgggcagaggccgccaaacaggagggttggagggccgctgaacaacagcaggcagccgcatggcagtggtagctttcagggcgaggaggtggagactggaatgctgtttgcaaagggaaggtgtcggaccacgcagtcatagcatgtccagccgatcagccccatccgaaactcattccagcctcacaagcaccaacaaacccacctcctggatgtggatggggctgcgcagtgcctgcagaaccttccatatcaagccagcagtgaagatcaggccctgggaggatggggtgacagggattgggggactggcgtttgcgaggacgtgattcataccgtggcagccccaagccatggcgtgcccgctccctgggctgggccctggcacttggccctgcatcaataagcacacggtgtccttctccaatggaatcatagcccaaagaacaccccttcccagcgcatttcctaggatagactcacagggtacatggttccccccacgatgcggcccagtgggtaccaggtgaaagagtcgaagaagttccaggtcttggtgaagccctcctccgtcaggtaccgtgtgacacggtagttgaagtatggatcgaactcatggatgacactttcgtacttgatcaccgagaaaagccggacctgacggcagggtgtggaggggcatcggagggatgacctgctacatagtacagcaagaacgtggggcattcctagtgcatgaacctccaggatggctattatattcccagcttactgctgtggcaagcaggcagatggcgatcagggtgaggactgtcgtcaggctggccgcagacgagcctgggctccgcttgtcgctcttcttcgacccatcagtggaggtggtcgcgactccagacacgggcggcgtgttggatgcgtctgtcatcgccgggacccgatcagatggcgcctagagcatgagcgggggaatcgctccggcagtgcacgccgggtgatcgaagccagcaccacacactgccgtgcctcaaagtcgaaggcggctatgtgatcctttacttccggtcaagtactcgaggtatgcgcagcgctcgtacttgtatgggcccatcggaccccaggagcagattctcccatttcccgcacagcacgcgccgttccctccccactttggagtgggtgcgccactcctttacagagcggtcttctgatcagctctactgaattgtctaccttcattttctacaaggttcaccagcctcgcacgaannnnnnnnnnatgcagagcggtcttctgatcagctctactgcattgtctaccttcagtttctacaaggttcaccagcctcgcacgaaaccaccctcacggtctcgagcgccgtaggcttcgacctgctgcaggcggcgccgcagggcggccttgccttcctccagcgcctggcgcaggaggggcagcggcacagagccgccagcctggtcccgtggaggatcgagcattgccgcctgtcgccgtttgatctccgccctgatctcctccaggctcatgtcctcccagacaggttctggagcgggtgctgccccggccggcccagcttctcctttggaatcgctgtgcgccgcctccatgtcccactcgtcccaccatgcaaaccctggctcgtgtgcaggcagtgccgctgaagctgcagcgaggtctcgcgtgcaggtggcggccgccgcttgcagtgcatggaaggctgcagcggtggccggggtccctgtcttgtcggggtgcaccaggcgggcgaggcggacgtactgccctctcagctccgcaagcgttgtccttcggggatcgaggtcgaacacctgcacaggtcatgtgtgggaaccccaagatagacaaagacggggccatggacagccagggctggctggctccgtcccgaaaaccaatgcaccgtttgaccgtgcgcacaccttccagatcgcattagaatcgtgtgcagcaaggagggatagagagacagtaagctgacggtgtcgaagtgagctggcatcggcatcgacccttaggaggcgtgagcattctgccaggttcccgaccgccaaggcctccgtcgcggccaaaaggccgttgtcgacgcgagatgcaatgctgattatgtttcgaattcaataactcaaggattgtgttgacagaacttcttaaaagtgggcctcaggctcgagtcgtcacggnnnnnnnnnncttgtcgacgcgagatgcaatgctgattatttttggaattcaacaactcaaggattgtgttgacagaacttctgaaagtgggcctcaggctcgagtcgtcacggacttcgagcctccctggaagtgaaccaaaggacgacctggcaatcccaccacaccagtgcatgtcggtgtgtcggccttcgtgtgacatcacattaccatgaaacctgtgctggtgtccaagatcgcccgggttcaaaatcaatttacgttaggtactgcaaatacacgcaccgatactgggagacccccaggagcagagcaccagcacccggtttaggcgcaatagctggccagatcatccactgctcggaatcttggcgtttgcacgatttgtagtcagatctgtctgggagccatggggttctccagcagcattggaccggcgctcagtgacgcagccgcaagggccagcgtgtatgtagaggacaacagtactgccgtggcggtggcaggaggcctgactgccctcggcgcaatcacctacctggccacccgcaagccgcgctctgactaccaggtggcacccagctccttccagctgggagtgggcaacctgaaggagggcgaggtccagagtgaggtgagggacgggcggcgaccctgtcacaagacggccgatctagtttggttctaaactaacatagcctggatttgcccagaagcagtatgagacgaccgctttggcgacgttggtgcactgagcccggcgtgatcacccaccctccgtgctcgagcgatcccaggtcagcgcgtactacagcgagtacaacaccctggagcgtggcaagggtgcgcaggtcgccaacagcaaaaaggtcgccgactttgtcgacaagttttactccctggtgggtccctcgggagtcgggtgatggaggaggggcatgaactgttctgaaaatgcagggcgtcacgatgtactgacatgcgcattgtactgactcatatgagcccagcacattggaaggtgttgagttctttgagaatgcttgccatgtgccgagccatgggggccggtgcaaactgatggcagctagggggctagagaactgggagcaggacatccaaactcgcacctgcactatctcaatacccttccccgataaaaaaaccttctccctgccaaggtgactgacatctacgagtggggctggggccagagcttccacttctcccccctgctcccccgccacacctgggcggcggccgaggcggcgcacgagacccgcatcggcgccctcattggcctcgcccccggaaagcacggcctggatgtcggctgcggcgtgggcggccccatgcgcaccatcgccacctcctcgggcgctaacatcaccggcatcaccatcaacgagtaccaggtcaagcgcgcgacataccacaacaagaatgtgagcttgcgaggggggctgaaggggagtgaggtggtggaagggggttggtgtgctgcctcgagggtgaaaggcctttttgatgcttctttcgaccaggttctgggattgcaggggcatgaggagcataccccaccagcgtctgttcctcaccatccctccacctgtccgcatcattcgcagctgggagtgagcaagcagtgccaggcagtgcgcggcaacttcctggacatgcccttcgaggcaaacacctttgacggcgcctacgccatcgaggccacctgccatgccccaaaggtgtgcaggtcgttgtcggtttgggggaggggcggcagtgacaaggctgcgggacagggcttccagcagcccatacctggaaagcagggtcctagacggtcagggctccaccatgggattgaggccctgtgttttgcatccccctcgaacaccnnnnnnnnnncagcagggtcctggatggtcagggctccaccatgggattgatgccctgtgttttgcatccccctcgaacaccgccctcactggatccctggccctcaccgactctcccctgatcgcacccaccaccctcaacaacagcaccaccctcctcctcatcccccctttccacatagctggaggaggtgtacagcgaggtgcaccgcgtgctgaagccgggcgcgcgcttcgcgacgtacgaatgggtgtccaccccgctgtacgactcgaccgacgtggagcacgtgaagctgatggacgagatcgtgatcggcaacgggctgcccgacatgcgcacctgggcgcaggcagaggccgcgggcaaagccgtcggcttccgcctggtggagtcgcgcgacctggccatggcccccgccacccaggtctcgccctggtggagcgagtccggcgcggtgctgcagccccacgtgcccgagggtgtcagcgtgaacccctggtacgcgcggctggggcgcagccgccgcctgttcgccgtgttcgcccacttcaatgcctcgctggtgtgggtggcggagacgctgcgcctggcgccgcggggcatgggcgagatccacaagatgctcatggacaccgcctttgcgctgatcgacggcggggagctgggcatcttcacgcccatgcacctactggtgttcgagaagcccgccgagaaggaggcggaggagtgagggaggggctgtccgagggcggcgacggggggtgggagggcgcgcggacgatcccgggtggtattgccccctcccagcaccgagtcgccgtgcacaatccaccccggcgcgccacgtgagatccgctgtggccgcccctgcttcgccactgcgcagcttaccacagtacccctgcgccaaactgtgcactggagaactgcgtgtcgatgtacagaggagaggtgacactgggcatgggatgcggggaggatggggctggggtcgcagcaccgcatggggtcggggcggcaagcggcgtgacctttgcgtgcctccggctggtagcgtgccatgatcagccgagacacacgcctcgaagttcgacggccccacacacggtgggcgcgccgtgcgctgcaaccatgatcagcgatacgtgctgccctccggcggctgcggcgccttgcggttggaggaggaggccatctcccgtcgcagctccaccagcaccgtctccatggtgtagccccggttccagcgcgccagcaccgagaagccgcgcgggtcgacctcccccgtggggcccacacacgtcatgttcaccctcgtctcgaagcgcactttgggaggctgtgggtgggcgagtggggtttgcatggggaaggggccgactgaaaggtcggggggcaaggcaggcactgccttgggagctgaagaatacgcccgtgagcaaagggccaagccagtgcagcacagccctggagctaccccaggatggtcgtgcagagtcgcctgctccagcacatggacatacccttgccctcggtcactcagccgaccacaccaacccaaccccagagccccggtctacacaaggcacccctcaccctgtcgggatagctttcgtcgcagtagatcttcaatgtgtatattcgcccgtcgtgcaccgtctgcatgagcacagggcagtgtgaggccttgtttggagacccaaactcaggatcgcagaacgactagggtgccaaggtgtcccacagaccctcggccccttccctcacgccaagacgcacgctgggtggaccaatgatggtgcccgtccagctgcgcatcatgatgtcatccgaggtgtccatgccatagctcacggtgccatcgcctaggcccttctcccccttctccaactcctccaggagccggaagttccgcggcactgcgagcaggtgtcgggagcgtcgtttaaatgaaagctatcaactgatatcaccgccaagttccgatcaccttgtgtactgagtctcccgtctcgtcggtcgcacgccaccccactcaccgacaacactgcccggagttcccccgaatgccatctttccccgatggccacctggatgctttggaaaatcagtgattggtaaccttgaaccgagcacgcacaggaaagatcgcgtgccgtcggtgacacgaaatttgggtccctgccccaaggtcgggtctcgtcactgagctggtggcgggaggggtcttggtgggttggtgaggaacacaaactccagcacacggccgttcttggcatgcagtagggtgtagcctcaaaatggggttttgtgagagtagatacgattggaatgggatctcaactcggcctctgcttagtctttccagatgaggtgatatgacgcactacgttcagcgcacacctaaacttcccatgaccgctgtccaggattgaaatcctggtgatcattactccctacttgatggctccacatacacaggtcggatcacctaccccgctcgttgccacttcccgagagcctgtcccttttgtgaaggccagcggcacctgtgtagcttcaacacaagccaggaaaatctctgacagcctcatcgtcctgcatgacagcctcattgtatgaggtcaagcatgtatgagagtatttccttctaatcatggcaaagactgtggtgattattgagttgttcaaagctcgtaatcgctagtccatggcagatcgtttgtatccagtgacatcctccaattgtagtgaccatgcctggcgtgttcaggcagggcgttggacatcccaccacattattctcaagcgaatatcaagcgagaacacccagctcacttggagtcccaaggcctggacgttccaaatctcattcactcaccagcatcctgaggtattctgcctgttgattccgatctcgtcgaccgagggcgcgcggattcgtgcaccttgccttcctcttcacataggaacagactgaggccctggtgctcttgaaagtttaaataggccggccaagaggcttactttgggcccagcgcatgttgtaggagagcttcagcccggggcgacaccatggtgtggtgcagtgcctgcacggcagatgtagagcccgacacagaggccggcaatggattctcgtgagtcgaatgctgcgcaagggtcgtttaagaggcgtttcagcgtgtccctggtacgcatggcggtttcatcgtaccgacaacaatccgcctcaacccccacccccccaggtgctgcccccactgcgggcgcgtgctggaggacacggccttctccgccgacgtcaccttccaaaaggatgcgggcggggagagcacggtgctgggccagttcgtgagcgagaccgggcaggccaggggcatcggccgcatccatggcggccgcgtgtacaccagccagaccgattcccacgaacgcgcgcagcagaagggcaggcaccagatcgcgcagctggtggaggccctgaagataaggccgcgggaggagagcgtggagtccgcgcaccgcctgtaccggctggccctgcagcgcggcttcacgcgtgggcggcggaccaaccaggtggccgccacgtgcctttacctgctctgccgccaggacgccaagccctttctcctcatcgacttcagcgacaggctgcaggtggggtgggtggggcgcccagcagaggcagcccgnnnnnnnnnnnnnnnnnnnnnnnnnnnnnnnnnnnnnnnnnnnnnnnnnnnnnnnnnnnnnnnacgctgggctcggtgttcctgcagctggcccgactgctgcgcatggaggaccaccccatgttctgcaagtgggtgcttggcatgttggtggggaggcagtgctgtgcatgatggactgtcagtccccgcaggaacccgcttcactttccctctcttcctgaggactctgctgtacataccgccacacaaatttccctccctcccccttccaaccatgcacacacaggnnnnnnnnnncgcgggctccgccccgcccctgggtatgtgctgctgtgacacgcgctggctgcgcctgtagcaccacccccgccccccttcctcaaccctcctcgcgacctggctcgattcacagatcaatgtcttcnnnnnnnnnntacacgttggtggggaggcagtgccgtgcatgatggactgtcaatccccgcaggaacccgcttcactctccctctcttcctggggactctgctgtacataccgccacacaaacagcccgccctcccccttccaaccatgcacacacaggcccatagacccgtccctcttcatagaccggtacacaaatctgctgggactggagcaggaggtgtccaaggccatcgctcacaccgccgtccgcctcgtggcgtccatgaagcgcgactggatccagacggggcgccgcccctccggcatctgcggcgccgcgctgttcattgccacccacatccatggtgggggtggggtggggagtgggttctgaggggggggtnnnnnnnnnncgcgtcaaggcaagggctcccccccccctggcaatgcgaccatgcctgccgtgcaaagcactgcaagtgtcggcaggttggagtcgaccgccgcgccacctttcgcttcttgctgggccctgccccttcagtacctcccgcatgagaatcccggggtaacctcgtggcccccgccacccgcccttccaagccctcccacacacacacacacataatacacctgcccatccacaggcgtgccccggaccaagcaggaggtgattcgggtggtgaatgtgggcgaggcgacgctgtcccgccggctgcaggagttcagcgccaccgacacggggggcctgacgctggaggggctggaggaacggcacgagcagctggtgtcctcccaggaccaggcgctggcgctgccgcccccggcgacgcagggcgcgcgtatgatcaccgggcccagcggcggcggcggctgcgagcacatcagtgagtgtgggcgctgttggaattgttttggaagggagttagggcagccctttggaggtccgagaacaagtccaggcatgacgtgggccgcggcacgacttcgctcccgcaaagctctacggcgttgtttagtgctgtgcgatcaccttgttgtcactccacacacacacacacaccacaccaccaccaccacacaccacacgccacacgccatcccaactcacagaggtggggcacccgccgtttgcgcacggcatgtgcgcgacctgctatgttgactttctcaagcggacggggggcctgcacggcggggccaacccgcccgcctttgccaaggctcgcgagcgggagcagcaggccgccatcctggccctggaggccccgcctccggcccccgaggaggagggggaggagaccgaggagcaggccgcgctggcggcagacatggcccaggccctgcgggcggccgagctgcggcccttcaggcgcctcctggatggcggcgacggagacgaggacgaggacggggaggcagggatgggcggcgacgaggaggcaggcgcggaggagcgcagtgcccgggaggtcgtcctcgacggtgccggcacccctggtgctcaaggcgaccgggtgacacggagtcggggcctggccacggccgggctcgcgacagcagccactccatcgccctcggccggccagggcgccaaagcagcgcagcgcgggtcggtgcccgaccccgccgcccctcggnnnnnnnnnnaactccttcgccctcggccggccaaggcgccaaagcagggcagcgtgggtcggtgcccgaccccgccgcccctcggcttggggaggcgctgtcgccaggcccaggctcggccccctcgagcagcacggccggcgcccagccgaccgagggagccgccccgcagacctcgccggcgtccgctcagtcgaagcggccccgcgccgtcttccagcgctggaagccgaggaaggcgacagctgcgtccagggagagggggggaaggcaggcagccggcgatggggagtcggggatcaatccagagccagccccgaacgcagagcagagcgctgatggagcgtnnnnnnnnnnaggatgaatccagacccagcctcgaacgcagagcagagcgctgatggagcgtcaggcgggactgcgtctctgcccggcagagtcgacgctggcggggacccggccagtggcagagcaggccagcctttgtcaagctgcgtcgaccagacaaccgtgagtggcgcggagctcatgctgttgccccctggggccggcgacgcggcggccagggcagacggggaccaggacggcgccctatctgacatccccgacgatgacatcgacatgtacattgcagatagcaccgaggtggggctgggtgttgggacctagggcagtttcaccaacattctcaggcgtctcctttggagtgaactcgacacagtcctggaaaggaggccggggcgcnnnnnnnnnnatttcaccaatattctcaggccactcccttggagtgaacttgacacagtcctggaaaggaggccggggcgctggggcctccctttgagaacctgtggggagccacatggtctagtgccgtcccgctgtaccgctccaacccggcatgcgccatgccccccctggcactcccaggtggcgttcaaggannnnnnnnnnagtggggggccacacggtctagtaccgtcccgctgtacctctccaacccggcatgagccatgcacccctggcactcccaggtggcgttcaaggaggagatctggaacatgatgaaccgcgactggctggagcgtcaggcggccaaggcggcggtggcggcagccacggagaaggcggccgccgagcagcgcgccgcacaggaggccgccgaggcggcgggcgtcgcgtacaagcgcagtcgggggcggcccctcgggtccaagagcaaaacccgggccgagtcggcgctgccgcccgccgagacgccgcaggaggtgggttgctgggagggtggagggatgtggggatttggagggggtggggactggatgaagacacagaaaccatgccatgattctgagccttgtcatggagtcgaccaggactggcatgcattcatctctccgcatgcacttgccatcttgcagctccccctccgcgccacccaccccggcaccctgcacccacctccaggcggcgatgcgcatgttggacaaccgcaagctttccagcaagatcaactacaacgtgctcgccgacctcttcgacgacgcgcccagccctgcgtcagccgtgggaccgggggccggcggcccagaggagcccaggcagcctggtgccgaggcggccgtcgccgccaagctcagcgcctcccaggaccggcagagcgccgcgctgagcgcagagctgcgggccagccggactgcaggtgcgaggctgtgtcacggatgtttggttgtcgagagtaagcggacgggtgtgacgctctcatacaggacaggatggccgctaccggagcgccagggacgtgatctgtcagcgatgctgtctgacatgcaccccttctcctatcccgtggccatttcccatgccaggcaatcccctgggtgggcttggctcgctgcagaccgggtccctgggctccctccgacccagcgggctcaacacctccctctcccgctcgcggctgagcggcggcgtggcgacccgggcgcgcccctccggcctgtccagccccaagggcgacgcgcggcgcgtgcgctttgcccccagctagccgccgctagtgtacactgcccttgcctcctgtcgccccctggccatcctgcgccgtgccctgttccggtgcataccaactgtatgtcacaattcgttctcacctgacgctgtacctccctttcttttcccttccccattacgaggatcgttgtatgaatccattgcggagcatcgccttgtcaccctaggtctggacttctgtttgaagattagcaggaggggctcaatgtcccaccagcaggtagcaattagcaacatgggatgatttgaccggaaagaataggggctcaggcatggagctgatgacagagtgaacccatgcaggatcggggctgaggctcggaaaaagggcgcggctgcatcacaggaaggcttctgccccaaactccgacgggtcctgccacgaggggccctcgtcctcccaggtctgcccggcgccctgccgctgctggacgggttgctgggcctgggcagccgcatcgatggacaggaggtcgtcgtctgcggagttttgcatggacgctcgtgagggggagtggcgagtcttcatctcaacctgcccgcaagtcggcggactgagcgcagggatgaggctgagctcgatcatgcttgcgtcacaaggcgatccccttgactcaggcccgtcctgctctccgaaggtaccccccacccacccacccaccaccctggtgcgtgaa

SEQ ID NO: 48398 - DNA, 61 bp, Chlorella protothecoides
tgcccgtcctctgcctcgtgcctgtcctctgcctcgtgcctgtcctctgactcgtgcctgt

SEQ ID NO: 48399 - DNA, 700 bp, Chlorella protothecoides
  modified_base (106)..(358): a, c, t, g, unknown or other
  modified_base (428)..(602): a, c, t, g, unknown or other
ctgctgagctcggaatccccgtgctgccgcatcgccgccgctccgcacgcaggcgcccccgacgcaccgcaaccgaccccacctggtctgtacggaggaaggcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccagcaaggcaccaaagaggaccagggcaccttctttagcctgcaggctcacctgtccctgaggatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagggcagatcatggtacagaggaaggcaggggtagggcggggtggggggacccgttgatgagaaaggttttgcgcggacaagagtcgtactgccgct

SEQ ID NO: 48400 - DNA, 61 bp, Chlorella protothecoides
tgtacctggcgttatcgccaccgcgggtgcaccctgcatggggcactccatgccatcttct

SEQ ID NO: 48401 - DNA, 102 bp, Chlorella protothecoides
tgaaacccaccaccccagaaagtccagcccaggccacacccgcaccctgcacccagcatgctacactcaaatcgctccctcacctcggcgacgactctgggg

SEQ ID NO: 48402 - DNA, 7525 bp, Chlorella protothecoides
  modified_base (684)..(695): a, c, t, g, unknown or other
  modified_base (762)..(771): a, c, t, g, unknown or other
  modified_base (3429)..(3438): a, c, t, g, unknown or other
  modified_base (5090)..(5099): a, c, t, g, unknown or other
  modified_base (5921)..(5930): a, c, t, g, unknown or other
  modified_base (6284)..(6293): a, c, t, g, unknown or other
  modified_base (6940)..(6949): a, c, t, g, unknown or other
ggccgcggcccgcgccgcgcaggcctcggccgcgccgtcccaggcgccgccgcgctcggcgcgctcgcggtgcagcagcgcgaactccaggtcgcggcggcgctggtccgcggcttggaaggactccagctcgctctgctcggcggccagctccgccagcttggcgtccagctggtccacctggggcaggatggagggcgggtgtgggtttgttttcgggtacgcagaagtgggggagcagggggcgatgcttgcggggacggagggacggcagccagtggcagcagcaggtgggagttgcggagggccatgcatcctggcacgagagcatcgctgggatgcaggactgcccgctgtgcattctgcctggctggcacatggttcagtcccgtcttaagaactccccagcatagaagccagccaacaccaaaactcccacgccccagcatcattcatggcacacagcacccatcctgcctgccctccgcccacccttccaccacacgagtccctcaccaggccctggatggtctcgcgcttggtctcgcactccgccatcagcttctcggactcgcggcggcgctcctcgtatacacgagtgcccccgatctccttgagcagctccaggcgctcgccgtccttcatgttggccatggccatgatctgtcggcgatgggggggggnnnnnnnnnnnntgccttactgcggagcggggaagagtgcagtggggttttggcgctgtgggatgcaagatgatgctgnnnnnnnnnngtgtagacggtgggtgaggcatgggagctggcgcgctgtggggcccatggcctccgctgagacgccacgatccagatcagtgacgccagtcgtgtcgagaacagcacctccctcccagcgcatccgtaccttgccctgctgcaccacgtagtaggggttggcacgggagaagccggccgtctccagcagactcatgacgtgcgccttgctgcagagcagggaatagtgcagtggggtttggcgctgtgggatgcaagatgatgctgtgcccagcagcttcccctcgtgagcccctggatctaagggagaagctgcgtgggaccgctgactcagcaacatgcccagccctcgcacagccaccgagcggcactcacgtgaccactcgcttgttcagctggtactcatccttcttcagaccgatggagcgtcgcagccgcacctcccgactgtcgatgggcaggcgcccatcgctgttgtcaaacaccagctccacatacgcagaggtcaccgcattccctgctccttcctggtagggtggagggaagcatgtgccacatcaatcgccagccctgggccagacttgtgtcagtgccgccgcccatgcagattgcaggttgtcaaggcactacggcaggactggcagataaggcagctcagccagcgcagccaatatctgccaacacccacatgcagcaggcgctctcgatcctcttggcggagggtggtgaagaggtcgtttagcacaaagcggatggctgcacaggtatggaggatggcgtaatggtgtaagtcaggaggcacagttttgcaggggcagcgcatcgattggcttccatgggagcctcaccatggaagaagtttgactttccagcgccattcgctcccactggcaagtgtgcggacgtggggaggtgactgtgagggcggcatggctgctagaatcaagagaacggcgcgatccacttccgcgacatgcggcccaccagttggggctggagtcccgcgagcacagacgcattgtaatgcactccgaatactgttccgcttgcatgcgtatgacatacctacgacgtttatgttgttgctgaagagctcggtactggtctgatccttgtacgacttgaaaccctcgatgatcacctgcgagggtattgggatcccaaatcgacctttaatcatgcattatgcctaccgggcttgcgcaatgcgcttccccacggggatcaggcttgcctgctggatgtacatcgggactggctctcaacgttcacagtgtccgtgcacgcatccctgccgcgacaagcgcatcaaattgaaggctatagagtgatgagattgatgcgcccgctcccggggccatgcagtgctggcccgacaccatcacctccgctccgctgtgatttcgaattttcggagcgcattttgctcgcgccacaaattcgccccccaagggggcaacaacaatttgggtgtaacgcctccattattccccacattcgcaggtagaagtgacattacctcgatttataccatcaagcatgtcatctagctttgtcgccagtgcttgcaccacaatcccctgtctccgtccgcatggcacatccagatcggggcatgccttccatgccatgcaaagggggtccatggggccaccaaacgcgaaggcgcgacgccgaaagcatcatcatccgcataggatgccaacatgcaaggtcggtgaggtgagagctatcgcattacctctcccccaggtctccaactgggcacccaatgaggtcatgcaccccctcattgcagggcgttgcgagtgtggatgggccaccggcccctgcagctggggtcgtgccccaggagcatgtggcagccatcagggatcccactgcacatgcgcttttggccagggtgcagcgggtggtggttagccacccccgcctaggccccatcaacactgcatttgtgggcccgcgccagccggaccccagccgaccccaggtgctgctcctgcacggcttcgacagcagctgcctggagttcaggcggctcctgcccctgctcgaaggccacgtggatgtctacgcgatggacgcggtggggtgcgggttcacaggctcatccggactccccctgctgcaccccaccaccctcggtgagcagtgtagaggaacaacactacgtttgctgctttctgaggagcccagtggcctgtcaaccgaggtggctagtgccgaggagtgcctctccaggacgctgactgtgtgacagcccatccactctcaactccgctggcctcgacctcgtgcagggccagaggagagggcggagcacctgatggccttcctggaacagcatgtgccacaacctgtcactgtgctgggagccagcctgggcggagcagtagccgtggattttgcggcccggtacccgcatgctgtgaatgggctggtgctgctggatgcccaggtggggttcacggcaaccacatggcagggaggaacaggagggccagcaagcagccgctccacatgtttgcctctacagatgcaggcggccgctttccaagttcataggtcaacggctgtcggcaccggaccccctacaacatcccacccccccttccccgctttcttcaggtgatgaaggatggcatcggcatgctgnnnnnnnnnncttccaagttcataggtctacggctgtcggcaccggaccacccacaacatcccccccttccccgctttctacaggtgatgaaggatggcatcggcatgctgagcagcctgccccagatcgcggcgcggctgggcgtgagggcgctgcgctcgcgctggctgcgccggagcgcctgcgacatgtcgtgccacgcccaggatgcggctgcggtggaggacatgaccgagatcgggcggctgcacacgcacgccgcagactgggaggcctgcatgctggccttcatgcgctcagggggctaccacgtgcgcggcaggctggcgcagctggcggcgcccagcctggtcctgtggggcaggcaggaccgggtgctgccgggggcgaagaacgcacggcagctggtggaggcgctgccgggcgcgcggctggtgtgggtggaggactgcgggcacctggcgcatgtggagcacccggacgtggttgcctcccatgtgctggagtttgtaggtgcgagggcccaggatgcgcgtgcacggcatgctggggacgattctgttccaggcaatggcttcaggtccgcggagggggtgcgcagggctgccaatggcttggatcgcctgcagtgagctccggacgcagctttggtagcatagattctcaggaggaaagcgagaatgcgggacagcggggaagagcagatctcaagctgctctcggccaagggctgggcccgaatccagggtcaaacgaatctgctcggagttgtgaggcctcccctccctccggaaagatacgggggaagcgggagcgcctttcagagcctagtttcgcatcggagcagggtccgacttgaattttgacaagcgcaacctcgctggagccgcagtcgggctacttctagggtacgtatcgtgtctagatcggtcgtcttcggatctgcggcaacatcgccgggaaatcacccgggcgaacacaagcctcgacaggtggggcgaggggcgagccagcgagtttcacgatcagcaggggagaagtattgtgtgctcagcacagcaggacgtatcgaatcgaatcgccgctcctcgtccacagggtatatcggagctgcgtcctgaggagccatggtgcaggctggtcacatacacctacagtccccccccgagctttccatcctagcatcctgcagcttccccagcgttctttcagaggccatcgaggcgagcgtggtcgagcccaaccatgccaggagcgccgacgccatcccactgcactcggcctccccacctcgcatcgggctgggggcctacatggggcgcctgctcaagtactgccgctgctccccggcatgcctggcctatgcctacgtctacatgaagcgcctggctgccatgggcggcatggcggtgacgtccaccagcaagcaccgcttgctcctcaccggcaccgtcatcgcggctaagctggtggacgatcgctgcttcagcaacaaccactgtgagtattgctatgatgactttcgttgggatggtgacgtgtgcatgggttgtgctgcacgggaataacgttgccctgcaatgtccttaccaacccctgcagcactgagatccccgatccatcgctccatctttccagacgcgcacgtcggcggggtgagcnnnnnnnnnnggttgggatgatgatgtgtgcatgggttgtgctgcacaggaataacattgccctgcagtgtccttaccaacccctgcagcactgagacccccgatccatcgctccatatttccagacgcgcacgtcggcggggtgagcctgcacgagctgaaccgcatggaattgagcatgctgcgcatgctgagctaccgtgcccaagtcggagccgaggagctggccgagcatctcctggtgggttggtacaccagtaccgggttgccctgaaccggtgaaaccagcgatgctggtgccagtgtgcaccctggcgggcttgggccgacccggtgcaaccctggctgggcagtcttcactcccgcacccctccatctcccgaccacctgcccacactcccccctcgccacagggcatcacctgcgtgccagaggtcgccgccctcccttttgatcggccgggcatgccgccgccctcctccagctgccccgcgccccaatccaccccgtcggccccgctcgacgacggccccacccaggagcagccccgccacgtccgggcgcgccactgcagcatggatatggacaccgagtccggcctgaacggcctggacggttttgtgcccgccgtataggccggcccaccctggagcgcccactctcaaaccaggaactaccactccctctgaaccgtggactcccctcctccctctcttcactttcccattcatacttacgagacttttgattctgccttatctgggcgttccagaggctggccccttattccagatttcctacgtcacccctgccgtgcgcccctcatcctgtnnnnnnnnnnctctccctctcctcacttccctattcaaacttacgagacttttgattctgccccatctgggccttccagaggctggccccttttcccagatttcctatgtcacccctgccgtgcgcccctcatcctgtctaccgtgcccctgtgtctgtccggtcaggagctgccctagaagcactgctgagcaccgagtgcctgtgccgttgctcagtgtaacgcctcgcccttccgtcggtggtgccgagcggggcctgtgcgcgcatacagggtctgggagggccaggcagttcagtgcttacacggggggaacgagggcttgccgcgcgcggcaagcaggcaggcaggtgtctgaggccnnnnnnnnnncacacggggggaacgagggcttgccgcgtgcggcaagccggcaagcaggcaggcaggtgtctgaggccatccctcggccctgctctgctccaggcacagggaggccggcacacgacccggcagggtcccggctccctccgccccctcggcccgcgcctcgttcagtcgccaacctgccccgcatgccccacctccgccgcgaccgtgaggtccagcgtgttggcgcgcatgatgatgacctgaagcacggccagcacctgcggcacctcggccgccagccgcgtcaggccctggcgcgtcagcgccagcacgcgcgccacggggctggagcagaccgcctgcgacccgtggggccgcgccaggaagaagtcggtggaccccgccacgcagccggggcccagctcgaaggagcgccccgcggcctcggcgggcacgaccccggcgtcggggtcctcggcgcggtccgctgccgccgccgcgccaaagcggtgctggtccacctgggtgattggaggtgtgtgaagggggggagcatgagtcggcagtgctcggggcgggcctgcgagggaccgacccaggctggccatctcaaccccatcgccggcgatgggggcaatcagcatgggcaccacctggcgcggctcagnnnnnnnnnnagaagggggaggagcatgagtcggcagtgctcggggcgtgcctgcggggggccgacccaggctggccatctcgaccccatcgccggcagcgggggcagtcagcatgggcaccacctggcgcggctcagatcccggcaccaggaggggcgagcgccgccccgcaacacccacaaccgccgctcaccctgagcgaccccttctccacgatgaacatctgctgcgcgggtgcgtccagcctccacagcacctccccgtactgcagcaccctgctgtccaggtactgcaccagtgtggcagccacgtcgtcggccgcgcccggggccaccaccggcagcttgtccaggtgcgcgcggacgaggtcggccagggtcaggcgcgccaggggcgggcggcacagcccgtaccgcaccgcggtggacacgtactggtcctccgcgtagcgcagcgcggcctgcagtccgtcgaagaccagcgcggcgtcggcgccgccgcgcgccgtctcggcgccggggggcagcgcggtccaggccgcgtgcggcaggcgcatgacctccgccagcgacccggagtcgtgcg

SEQ ID NO: 48403 - DNA, 61 bp, Chlorella protothecoides
gtaaactggtaaaagacatgatgaggcggggttgtttgctctgcgtgttgctcgaataggc

SEQ ID NO: 48404 - DNA, 66 bp, Chlorella protothecoides
ccaggacgtgccgcacctccgcgccgcgcacgccgcggtgctgaagctggtgggcggggatggggc

SEQ ID NO: 48405 - DNA, 61 bp, Chlorella protothecoides
atcgtgctacatgctgcgatgtggcaggggaggaaaaggaaaagtgctgaggctctaaggg

SEQ ID NO: 48406 - DNA, 80 bp, Chlorella protothecoides
gggggggggtttcttgggtgttgaagcagccatggctgtgcggtccagcgaggacacctctgcttggactggagacggtg

SEQ ID NO: 48407 - DNA, 61 bp, Chlorella protothecoides
ttcacagggcgtgtaccgtgcatgtacgctgtgcaacgccgcgtcggggtcagagtcagtc

SEQ ID NO: 48408 - DNA, 63 bp, Chlorella protothecoides
cacgatgatctccgccagcgcggcgcggtagatgacggggcgcacgcgaccgccgtccttgta

SEQ ID NO: 48409 - DNA, 61 bp, Chlorella protothecoides
ctcgctctcaacacagtactcgggaagcatagccgattgaggtgcctgcgccgcatgctgg

SEQ ID NO: 48410 - DNA, 73 bp, Chlorella protothecoides
atactcctcagcatgcactgaagcaaggtgttctttcctgaatccatatcctgacacccagggccccacctcc

SEQ ID NO: 48411 - DNA, 501 bp, Chlorella protothecoides
  modified_base (223)..(397): a, c, t, g, unknown or other
gagatctgcgcacccagactcccctggcattaggatctgatgggggatctgcccccaccctctccccacgatccaagaacaacgaggtgcgcagaggaaagcaatacttcagctcgtgttgccatcattcaatgattgttgctctagaagatagagtccgggccagctcggcctccatgcgacgccgggcgtccccctcgtgacaaccccttgggtccctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacagtggaaccgagacgcttggggctggccatgtcggctgagttccggggatctacagggttgcttttccatacctgggcttacctgggctccaggctctgcc

SEQ ID NO: 48412 - DNA, 61 bp, Chlorella protothecoides
gccgcggcggccaggggactggcagggcccacctgcgcgtgctccgtcagcaggtccatgc

SEQ ID NO: 48413 - DNA, 74 bp, Chlorella protothecoides
ggtcccagcgcatcaggccggtgctcagccgacgagcctcgttaaacttagcgtgcggcacctcgtgtcgtcgt

SEQ ID NO: 48414 - DNA, 61 bp, Chlorella protothecoides
gacggagtaggagcgcccggcgtcggcatttggccgctgctcctccacgcacagctggtgc

SEQ ID NO: 48415 - DNA, 79 bp, Chlorella protothecoides
tggtcagtgttgcactcacagtgagccggtgttgctcagacaccgcgtcggttgcgcaaggtttggagggagtaaaaga

SEQ ID NO: 48416 - DNA, 71 bp, Chlorella protothecoides
ctgcctcccagcctgccagatgtgtgcggcttgcacgggactgcggaccatccataccccattccaaacat

SEQ ID NO: 48417 - DNA, 66 bp, Chlorella protothecoides
ctcagtctagtccatcaggccatccctgtgccattgccagcgcctccctgcacaccacaggccagg

SEQ ID NO: 48418 - DNA, 190 bp, Chlorella protothecoides
cccctaccatctccagctctaatctctcgtgccatgcgttggaagcccatcaactcagctacaatacatgtctacatgacatcgggctccagcccgagcccagactttaccatatgtgttgggataccctatgtgtttagtacaagattggatccccgtgccccgaatgatgagtcaatttggaaatcgc

SEQ ID NO: 48419 - DNA, 62 bp, Chlorella protothecoides
taggcttccatgagggtttctagatggaggtgtgcctgctcccccccatgcatgtcggggag

SEQ ID NO: 48420 - DNA, 65 bp, Chlorella protothecoides
ctcgccgctcccccgccgcccgccgtccgcccgccgcccacgcctcccaccgcggcggccgcccc

SEQ ID NO: 48421 - DNA, 61 bp, Chlorella protothecoides
gaggaatgcatgcatcgtcgtggtggccggtgctcggcaaggtgccatcccatctgaagtt

SEQ ID NO: 48422 - DNA, 61 bp, Chlorella protothecoides
cgacttgcggtcgcccggcaccgcggccgccgggcccagcagcccgcacaccttgatgtcc

SEQ ID NO: 48423 - DNA, 62 bp, Chlorella protothecoides
acagcttcatacccatgcacgtacccaagtccatgcatgtataaccatcgactcgacgacgc

SEQ ID NO: 48424 - DNA, 61 bp, Chlorella protothecoides
cagcccagccatgcgtgatgccacagctgcaaaagcgcctcacagtgcaactcttgcccac

SEQ ID NO: 48425 - DNA, 61 bp, Chlorella protothecoides
gtcttacgacgagaaggtggacgtgtttgggtttggcatcatcctgtatgagctcttcatg

SEQ ID NO: 48426 - DNA, 61 bp, Chlorella protothecoides
cagcgcgaatgtcgcccccggcgacatggtcctcgacagtcgtacgcgtagggtgatgcat

SEQ ID NO: 48427 - DNA, 127 bp, Chlorella protothecoides
gggtgctggtgttattggcaaattttgttgaggcaaattttcacttctatctggtgtacttctcatcatcaattgtcgtggctctccttaagagccctgtcatacttcagcagtcctgcacattata

SEQ ID NO: 48428 - DNA, 125 bp, Chlorella protothecoides
aaggcaatgcagcacatgctcagagaggcaaactggcaaccaatcagtaaattccctctttgcgcgctgttcctcttgccacccccccacctcatccagccagcacacctgtcgagcctcctggg

SEQ ID NO: 48429 - DNA, 61 bp, Chlorella protothecoides
ggaggggtttggatgttgtggatgtggcggtggaggagggtaatctcgggctgtggtgctc

SEQ ID NO: 48430 - DNA, 5860 bp, Chlorella protothecoides
  modified_base (1101)..(1110): a, c, t, g, unknown or other
  modified_base (1753)..(1801): a, c, t, g, unknown or other
acccccgccaagccccacccccagcccgtctggcactccctcaaccatgtagaggaaacccctgaggtaccattgccgcgcagttccttcctataccagaccctccaccgatagagcgttgggatgctgacccacccggccctgcgcgcctttatagataatacctgtctacctcccaattcgtgcctccgctgtaatcaatgagggtcatatagacactagtgtaactcccgaggccattctagcgctacgtgctccagctcattcgggccatcctcttgccacgagtttctcgccgggagtattcagcccagctgagggagcaggactactcacgcccatagcacctctcatgcggatggaggtaatcccagaatcgacaaagctcggtacttcccctgctttcacgctgcgcttcggcagcgattggcaatgcgtcacaattgtggcgcgtggtgggtggaattcgagatctctcgcgctcagacttgccctgctcgagaaggttttagtacctcatgcatccgaaattccgacaggagagtgtgtctctgacattgaaactatacttttaagccagagcagtgcatgtttctttgtcaggacgctagggctcgttttcctgttcccaagcaggcggtagctcggcttcgtcctcagaaactttgaataggactgtagggacccgaataaattctgctgatttcaagagcaaaccgagcacatgagattctacaggaaataattaccccgcgaggatttgggccaccctttgctctgcatccctcacatcgctcatgtttcgaactttgtggtccctgcaacgtgtcgctggtatgccctcggaagttacgagacacaacacgcaaggtttgtgcagcactcaccaccccaagcgactctaccgaacctgacagcacttgaatgattcgacaagcatgcttgtggacagatggcagacccaacgtctccacgtacaaccggcggtccgctggtagtccgcatgcggttcacagcaagagcagggcatggcgcgacggacgtgggaagtgcagggatatgttccgtacccgaatggcataagattggatatgtctgacnnnnnnnnnnaggaagtgcagggatatgttccgtaaccgaatggcataagattggatatgtctgacttttgcatgccgcataatagtcgtcagctccgcctgggcatgtgcactgtctatattccggacccgtaccggctggcagtacacgcattgaatgaaagcgccccgacccaccgccctcctatggacgcttctggttgtttggcacacgacacttgccgcagcggtgagaacctcaagatttgggtgcgtgaatcccacaaacccagccattcgttacatctcgaggtgctaccttctcttcctcgcctcgcctcatccgcgcaggacaagccgaccatcaccctgaactttatcgagtgcgtgaggacatctcgcggtgacccacctgctgatttcatcacatgcaccgccagcgtgacattgtccgagctgcctccggactcctactacatcgactacacttggggtgatcttctgggcgaggtcaagttcaaacccaaacagctcaccaccttcgtgacctggaccggtgctgggtcctccgtcgagggcagtgcctacgcctggttcagggcagcagatgggtcttccgttcgctccaccaggaccccaatcacccccttcgcaagtccacccccgccacaccnnnnnnnnnnnnnnnnnnnnnnnnnnnnnnnnnnnnnnnnnnnnnnnnnccctgggcctccccccccacctacgctgccgcccccaccctcgccccctccccccgacctggctgtgttcgacagtgccttctgccacaaggcgtactcagagaggctctcctgcaccgtcagcatgaccttgcaacagctgccttcagtggtggcgctcaccttcaacatgtcggacggctcaaattatcagcagcagtatgtgagcagctctagcaaaatgacatacactgcgattttcgttgccttttcgcccctgggaacagtaacagccgttgtccagatagggatcccttttcaagttggcccctaccccatccgcgacgactccctccctcccccgccacccaacccctccccgccaccgccgccgccaccccccactcccgtcacgctgagcagtgcgatgtgccaggggctggagtccgacctctgcaggtgccaggtcaaggtgaccacctcagacctgctggcgctgctccacatcatataccgtatcggtggggcggaggagacccacatctatgcgccggccgacctgatcaccatcagcaccaagaccttcacctccaccagcagctgcatggaggggaagattgtggggtatggcgtggacaacgatggagatgagctgtgggcgacaccggtcgacatcaacccgtttccgccacctcccccgctcccaccctctgcgcctgctccggcgccgcagccaactccacgtccgacacctcctgggtcagggcccccaccttcaccgccccctgcaccgtcccctctccccccgcccacccctccaccgcccaccccgctcggtccggccccgccgagacccgctcccgccccgtcgggcacacccccgccaccttcaggtccctcgccaggcagcgcaccaccacctcgttcctctccctctccaccgggtgcgccgccaccatccccagcccccagcccatcaggcgcaccctcgccgagaccccaattgccaccttcgcctgcaccgagtccttccccggcagctccatccccctcaataccatcccccaagccacctcctccgtccccgcctccacttgctccatcaccaccgacccctgttccgcccccaccgcccacttttccacttccatcgcctccttccccatcatcaccaccaccatcagtctcgccccttcccccaccccgcatcagccctcctccgccccccgcaaaaccctcgcctccccctcccaagaaggcgtccccgcctccacctcccaagaaggcgtccccgcctccacccaagaaggcgtcaccaccaccaccacccaagaaggcgtccccgcctccacccaagaaggcgtcaccaccaccaccactcagaaaggcgtccccgcctacacctaagaaggcgtccacgccccctgtaaagaagtcctttccgctgccacccaggaaggtcccccggtctcccccaaggaaggcgtcccagcttccacccaataaagaggccattccgccaccaaggcgctaaaagatcccaggagttcccttttagcagaagtcttcgcatcctcggacaggctggctttccttgcagttgacatctccctgttccaccgcccgagattccctggaaacatgtactgcacggtttacaagaccctatccaatttatcgctactcattgaagctcgttcagtatggtgctgcagaggagagcccagaatctgggctcagcttacatcttgcctgcacaccccttctagctgttgagaagactccttgaatggatccctgaagagttggcatgtaaactcaatcatcacacaagccgcagggtagaagatacaccattttgtgggtgggcatctgttgcaggtgcatagtgcctgccggtgctctaaatatcgttgcagcctctctggtaaaataaagaacatattctgtgactggcaggggtacagtttgtagctcaggaatcgcgaggtcatgcatggctttctcattggagcatgattaacgtccaacaccatacgattatctttcttgcccaagctccgattgacagctgccctctgtgaagactcaatgccagcctgataggattccgctgcctgagagcggcagctgtgatcaatggtgatcaaggtctgcccagctgaggcgagctgagcatggcaagcagcggtacgaccatcctccaccatttccataagatgtatttggctcaagtaatcagaaaaatcaatgagcacccattgtctgtgtagtcgggactcgaatgtgtgggcaaaaggtgaaaagcggtaccaggtatgattcggcggactcggacaagaaggcataggtattcgaaaatctacagccgactcgctgttgagggagcacggcaagatacaagagaaaccccagcaagaatagtgttagaagctggttctgcggaggattgacaatctgtagaaacccggcgcgattttcgctgacgcaggaaaggggcactcgaatctctctggctacttagccatgggccgtgtcatccattcaatgcgacgtgtacagcttgggctcggccagattgatcgagacttttttgggctgacaaccccttgagactgccttaagacagctttgcagccccgccctgtcgggctgctgtccccatggcagccgtgaagcgccagagcgtggccaagccacccttcaccatcggcaccctgcgcaaggccatccctgcccactgcttcgagcgatcagctctgcacagcgcagcctatctgatggtggatgtggccctggtcgcggctctgtatgtggcgtcgacgtacatcgaccccgcccctctgccgacctggttcaagtacaccttcctctggcccacgtactggttcttccaggtaggcacatgccatgttagtgccctctcgaggttgttgcgacgcgctgcgaggggcgcggacccctcacgcccgtcgcctgtgctgaggctgtcaccctccccccccggtcgtatagggcgcggtcggcacgggcatctgggtgatcgcccacgagtgcggccatcaggtgcggagcggggttgaatcgatggcgggttggctccgcccctggtgttacgaatgccatgcatggctcctgtgagcctcagtgcccagtccgagtgttcgtgccccctgtcactgggcggccaaggcggctgggaaaccccatgccggctcccctcgaaagcccactcccgctgcgctatctatctcactgggcatatccgctcatcagccctccatcctctccgctgcccttctcaaccaaagaacaccccccgtccgccatctccccccccccccttgtttctgccccaggccttctccacgtcccagaccatcaatgacggagttgggctggtgttccactccctcctcctggtcccctactactcgtggaagcacagccaccgtcggcaccactccaacacggggtgcgtggacaaggacgaggtgtttgtgcccgcccagcgcgaggagccccatgagggctttgagtgggagcagaccgcccccgcccgccttgcccacatcgcggtggccctgctcctgggctggcccctgtacctggccttcaacgcctcctcccgcccctacccccgcttcgccaaccacttcgacccctggtcgcccatcttctccaagcgcgagcgcgcagaggtggcgctgtccgacgccgcgctggtggcggtggtgtcgggcctggggctgctggcccgctccttcggcaccgcctggctggtcaagacctacgtcgtcccctactttgtggtcaacgcctggctggtcaccatcaccctgctccagcacacccaccccgccctgccccactactacgagaaggactgggactggctgcgcggggccatggccaccgtggatcgctctatgggcccccccttcctggacgtcttcttccaccacatctctgacacccacgtctgccaccacctcttcagccagatcccgcactaccatgcccaggtgggcgtgggtttgtgtgtgtgtgtgatttctgggggttggtgggctggggggg

SEQ ID NO: 48431 - DNA, 61 bp, Chlorella protothecoides
ggctgtcaagtgcacccaagatcacttccgtagcctggtgaaattcagagctggacggtct

SEQ ID NO: 48432 - DNA, 61 bp, Chlorella protothecoides
caacatatctgcaaccagggcatgcacggtaacggtgctcctcccatgcccttgcctttga

SEQ ID NO: 48433 - DNA, 73 bp, Chlorella protothecoides
agacagctcagtcaacagcagaagtccaaattatcaacactccgggaatggcaggctaacccccttcctcctc

SEQ ID NO: 48434 - DNA, 172 bp, Chlorella protothecoides
agagcagggccaggtgaggggacgtccatggaacgattttggaatgggggtcggtttggctggggggctgctacacccgtcggcataggtgctcgacgggtgtgtgcctggactgcaatcaaatcgccttgttatacaaggaatcctacccaccctgactgtgcctcggtca

SEQ ID NO: 48435 - DNA, 61 bp, Chlorella protothecoides
cgcgctgctgcgcagcctgggcgtgcgggaggtgcttgggtcgcgggacaccgactttgtc

SEQ ID NO: 48436 - DNA, 74 bp, Chlorella protothecoides
gaggaccgtcttgcaccccggcctggcctctttcctagacagaagataccatctcttgtggccagccgtacctg

SEQ ID NO: 48437 - DNA, 61 bp, Chlorella protothecoides
ttgcagaaaaactgcgcctgcagcgactggtggaggagtcagactaccagaatgccatgga

SEQ ID NO: 48438 - DNA, 80 bp, Chlorella protothecoides
tggtgactgcagactccgtgcgcgcgcgcaaactctttgggggggggtatcctttcggtttccgatgacattcgctgggg

SEQ ID NO: 48439 - DNA, 109 bp, Chlorella protothecoides
tgcgccgacccgacggcaggtgggagggtcgtggggcgatgggcgtggcaagaacccacaagggaagggtgtcctttgggatgctctactggtagcgtgtgtgcacagc

SEQ ID NO: 48440 - DNA, 61 bp, Chlorella protothecoides
ccgagggcaaagtcggaggcgtcgcaccagctgacaaggtttctggtcaagtctgggcagg

SEQ ID NO: 48441 - DNA, 90 bp, Chlorella protothecoides
gaagattggcacgaggacctgtggacagggtatcgtcagcattttgggtgaaccaggtttgagaagggaatgcaaggcccagcaatgcca

SEQ ID NO: 48442 - DNA, 77 bp, Chlorella protothecoides
tgaggggggaggggaagttggaggagaggctgcgggttggcaagtcggtgagcgtcggacctgccccggctccgcca

SEQ ID NO: 48443 - DNA, 64 bp, Chlorella protothecoides
tggctgccgatatgccggctgcacatgcggtttgcctcattcaaacgtcctgaggagaacatcc

SEQ ID NO: 48444 - DNA, 72 bp, Chlorella protothecoides
cgacaacaggcagcgaggcctcgttcgtccgggaaaccaagggggacaaggcacgtggcagccccgcagcaa

SEQ ID NO: 48445 - DNA, 64 bp, Chlorella protothecoides
cagctgccagaattcctgtgcttcgatgctaggctgaagggggtataaggagcactgaaacagg

SEQ ID NO: 48446 - DNA, 66 bp, Chlorella protothecoides
cattgacaccatcccatctcagccaagcaagccgtcgtaacgattgcctggcaaagctgtctcact

SEQ ID NO: 48447 - DNA, 61 bp, Chlorella protothecoides
aacgagtacattgcagcgcagtcggtggatgccagcaagtgctacgtggagaccggtgact

SEQ ID NO: 48448 - DNA, 61 bp, Chlorella protothecoides
gcctgcaccacctcgtcagtcgtagccggctccccgccgcagcgcgcgggccgccacgcgg

SEQ ID NO: 48449 - DNA, 61 bp, Chlorella protothecoides
ttcttagaacaaacaggcggctgctgagagggaaggatggagcctctcagcctttgctctg

SEQ ID NO: 48450 - DNA, 145 bp, Chlorella protothecoides
tgaatgtcccgggctgatggcaggctgtgatctgccatatggaggagagaaggggacagcacaggcatgctgtggtgctgttgatgattctgggtctggtattctgatcgatgtagtgacatgcagggtctctgtctgccttgct

SEQ ID NO: 48451 - DNA, 61 bp, Chlorella protothecoides
tcctcctccgggcgcgtgatgaggtcggacaccctccacagctgcagggtcccccccccag

SEQ ID NO: 48452 - DNA, 61 bp, Chlorella protothecoides
ctcaaggggcgcgtggcctgcgagatcaacaccgccgatgagctgctggcaacggaactga

SEQ ID NO: 48453 - DNA, 103 bp, Chlorella protothecoides
gggcgcacccgtggcgtgggaggcggaaatcttgcgatggccttggaacatgctatcccgtgcctcccataacctgcaaggagccacaatgagctcctgcgtt

SEQ ID NO: 48454 - DNA, 61 bp, Chlorella protothecoides
caagcacgtcagccactcggtagctgggggtgccgcctggctcattgctttacttgcatcc

SEQ ID NO: 48455 - DNA, 107 bp, Chlorella protothecoides
aaggtcggcgggcgggatgggcatggagaggcgggtgcatgcctgcccgaggttcatggacggggacagagctccgccaggggagggccaagccgaggatctggtgc

SEQ ID NO: 48456 - DNA, 86 bp, Chlorella protothecoides
gcgaaatacgccaggcaaggcggctgatactgttatatgaaggggcgggggagtcttgagaaaggggggggggggggggggggggg

SEQ ID NO: 48457 - DNA, 76 bp, Chlorella protothecoides
ttcccggccgccgcaggccacatgcagctccactttcatcgccctccccagtgcaatgtgagacgtgtgttttgtt

SEQ ID NO: 48458 - DNA, 124 bp, Chlorella protothecoides
taatccccgtggtgactgtggccaaccatcgcactgcagtcaaatcatggtttgggaatgcagtatctccgtctgatggcgaaagtacgcacccccccggtcggccgttgacccccccttggca

SEQ ID NO: 48459 - DNA, 132 bp, Chlorella protothecoides
ccaagctctgagggcagtggggtgggaggaagggagggcctgcaaggctgggagatacgcggagtgatgcggcagggtcggcggcctaggaatactgcagttgtacctaagactgccagcagtggaccctgc

SEQ ID NO: 48460 - DNA, 62 bp, Chlorella protothecoides
ggagcctccccttgtttctggtcggccttctccctccacccctccccccaaaccatgagtaa

SEQ ID NO: 48461 - DNA, 61 bp, Chlorella protothecoides
gactgaggggagtttctgggagcggcgggggggggccaagatccaatggcgtgtggcggcc

SEQ ID NO: 48462 - DNA, 61 bp, Chlorella protothecoides
gcgggccaccgtctgctgaagttgggcctgcgaggagcgtgcagaggggtggcggggcccg

SEQ ID NO: 48463 - DNA, 61 bp, Chlorella protothecoides
gttgtgagcaaccgcaccctttcaacacacccaggccgcgatccgaaagagctatttgaag

SEQ ID NO: 48464 - DNA, 12817 bp, Chlorella protothecoides
  modified_base (2029)..(2064): a, c, t, g, unknown or other
  modified_base (2163)..(2172): a, c, t, g, unknown or other
  modified_base (2820)..(2829): a, c, t, g, unknown or other
  modified_base (2897)..(2906): a, c, t, g, unknown or other
  modified_base (2982)..(2991): a, c, t, g, unknown or other
  modified_base (3487)..(3496): a, c, t, g, unknown or other
  modified_base (3568)..(3577): a, c, t, g, unknown or other
  modified_base (5110)..(5119): a, c, t, g, unknown or other
  modified_base (5769)..(5778): a, c, t, g, unknown or other
  modified_base (9217)..(9226): a, c, t, g, unknown or other
  modified_base (9861)..(9870): a, c, t, g, unknown or other
  modified_base (10254)..(10263): a, c, t, g, unknown or other
  modified_base (10602)..(10611): a, c, t, g, unknown or other
  modified_base (10857)..(10866): a, c, t, g, unknown or other
  modified_base (12478)..(12487): a, c, t, g, unknown or other
ggcggcgccggtggacgcccgcccgcccgccgtgcgcgtcgcggcgttgcccggcgccaagagcggggcaggcacggcgatgggcctgccggcggcgtccagcgccgcggcggcgtcgtgtgccgtcgtgggcaggctcatcacctccttggaccggatcagggactcaaaggcgcggcgctctcgctccaggccggcctgaaagcggtccatctccacgctctcctcgtagcgcaacacgaagacgtgcagcggcggcgccccggccctgagggagatgatgtgacatgtgtttcggggtcagtgaaggtgcggggaggggaagcatcagcgctcgccctagggaagagcagcggcttccaaacaaagacggaggcgatcatgtgcgtttccaaattaatgcagactcagccgccgagcagcggcattgcccctttcagcacctcgtctgcatggcgttgtacagctccagctgccgcgtcagcgcgacgtccgggtcatacatgatgacgctgccgggcgcgcgctcccagaccaggcgctcgtcgtgctcctccaagaccaggaaatccaccctgccccgcgcgcccggcgggaagccgggcaggtcggccagcgccacgcctgagaccgcgccctcccctgacgcgcgcggctggcgctcgctctcagtccctggtgggacggcgtcctcatcctcgtcgccgccagccgcctccaggctcccgggtccggcctccgccacatcaaacgacccccgcgtcactcgcaccgccaggctgcgggccaggttctcgggggcgcgggcgcccctcctctcgagctcccccttgcctcgccgtttcgacggattctggcctgtggcggccgggtcgacgcccgccccgtgcttggccgccgccgccagcgcggcagcctcgccggcgggcatgccccccatcatgcgcgccgagcccatgttcgaccccgggtcggggcggccgccatgctggtcctgggccgggcggccggaggccgccctctgcgccagatactcccgccacatgtgctgcatgtgcgcgtcggcaccccgcgtcagcacctcccgcagctgcgcgagggagggggaggaggaagcgagggactcgacgcatggtggagatgagtaggttgagggcagtgggcatgagcaaggatgcgctgtcagggctgctgtggtcggcaagatgcagccttgtgatgcacatgtccatgtacagtggcagacagggccgaaagcttgcggctcagttcaagtcaggattctcacaccagcactccacaatgccaccaactggaaatacctgtgacgcggtgaaggcgtcctggcaggccaccaagacggtggggcccgctgcgccgcccaggctcgacgtgttgccagtcccggccgcatcttcccttcccacttccccgccttccgccgccccctcctgtgccacctccagcaggagatccaggagcagggcccacttgggttgtggctcaagcaccggggtcacggtgacggtggccggccgagagcccggggcctggccggcatccgaaccgcgcttggcgggagtcaggccccgcgccacgctgtagacgcgcgactttgccacctcgaagattgtgtgcgccgctgcgacgaggagagcgaggaacggaaggaggcatcacggtgagtggcggccggccatggaaggtactgcggacccacatggcctgaagcaagtcttccaggtggggtgagaatgcagcgttgcttgtgtgcgctgggaggcaccacgtgcattgcccaccctgccatgcaatactgtggagcgctgacacggccgtgcaggcagcccctcccccttgcgtcacctgaatggaagagccacacggagttggtcccctccgtcgccctcaaggtctccaggtaggagaagaaggtgacggcgtcgaagcgtaggaggtacgtggccagggtgcggagcgtgcggagatcagccacgatctgcgcgggggggggggggggggggggggnnnnnnnnnnnnnnnnnnnnnnnnnnnnnnnnnnnntggaggctgctggggggtttgaggcagatcaacccacctcactgaccactgcaagaaacagagttcccgatgcagtaacccatactgggcctgctgccnnnnnnnnnngaggctgctgggggggtgaggcagatcaaaccacctcactgaacactgcaagaaacagagttcctgatgcagtaacccatactgggcctgctgccgccccacccacctgcttggtgcggggccccacagtgtgccagatggggttgagctggcgccgaatgatgtcgtcaaaggagcggaacaggccctggcaaggggttggtggaagggatgccgaggttactgggaatgaacctggctccccttgccgcttggaaccccctgtgttgaggggagccttcccacactccttcaggagccttgccagaccagtgcaacgggtccagccgtcgccaaagcagcttggatcatgaggctcctgtcctccgacggaaaccgcaccccaggctcccaggcagtcgcggaagccagcgtgtccccacaagcagggaagaaaggaaactccccctcacctgctccagggtcaggtcggtggcatcgatcttgttggacttgcgaacctccttgacgcaggcatccatcagctgggccagggcatcatacatggccgccatgcccaccgtcagtccctgggacacctctgtcacctgtaatggggattggaatgggtgggagagtctggctgcacaggttggcaagatgcttctnnnnnnnnnnacttgtccccacaagcagggaaggaaggaaactcccgctcacctgctccagggtcaggtcggtggcannnnnnnnnnaggttggtcacagccggaaccctcgtggactcgggcagtgtgcgcgccacacccatcatcccacccctccaagccnnnnnnnnnngggttggttacagccggaaacctcgtggactcgggcagtgtgcgtgccacacccatcatcccacccctccaagcctcccaagtgaccccgcccctcacctctggcggcgccgtctccaggtctgccctgacctgggactggaacctgggccagaggtggacgcggcgcacaaagagggccttgagcaccttctccgcgcggttgaagtcggcggccagggccggcgccgcgtcggtcaacccgcgcacgctgccggcgcggttggtggcgcggaagagccgcgcggcgaaggcctcgccgcaggcgtcgctgacgcggtgggcgttgaggatcagcaggcccgccaggtcccggcccgccagccgcccgcccaggaagtccaccaccaggatgcgggtggtgacaaagaggcatggcgcggcggcgtacagcacaccacgctcggcggcgggcacctgcgccgtgatctcggggaccgtgggcgaggggacggcgnnnnnnnnnnagtgggtgggtcgggagaaagggtgatgggcgcctttcattacccagccctgcgcggctgcctgtgcggggnnnnnnnnnngggcgcggcggcgtacagcgcgccgcgctcggcggcgggcacctgcgccgtaatctcggggaccgtgggcgaggggacggcgccggcggcgacgccagccgtgacttcacactcctggcgcgccacctcgtgccgaatgccctcccgctgccactgggtggcgcccaggacgagcagggcccctgtctgggtggggtcagtggcgcggcgagcgtgctgcagccggataagtgccgcggcgatctgcggtgtgggtgggttgggagaaggggtgattggcgcctttcatgacccagccctgcgcggctgcctgtgcggggtgcgggagaccccggcatcccacgtagggcccctcaatgcaccctcccgcccctggggcatcggacctgcgccagccccagcccggaggccaggacagccattccatcctcctggaccagatcatcgaggagagcgagctggaaggggaggagggggatgtcgcatgggagtggggcctccggtgcggaaaggagcaccgggtcggccatgatgcatggggccccagtccccgatcccgagtgatcaagagggtgagagcatctctggcagtgtaactctatttccaaggctgcgcaacatgcagtaaggtatctcatgtactgattcccgagcagctgggtttcgtgctacgacacttcgcgccctgccttccggcgtacacatgcttggcctgccggacggcgtgtccggccctcccaaatttcagagagctccatgtgcaacccattggcctgaactgcgaggtttgttcatcacatgcacggttgctcctgggtcagctggtgatcagaggcctgtcacgtcgtgttacggagtcgcctcgctccccgcatgtcctcatgaaggcgcctggccctgagaacggcgcggccctgttgaacgaatcgagtgtgctgggtgcggaatgaggcggagagcagggtgcctcctgcgaccggtcgtgaggctgctctccgcaaagccctccctccagaccgagaccctcgccctgcccgccgtgcatgaccggtcctggacctgggagccgcccgcctgggccccgagtcgcacgcctcgggaaggactgacacccttcctcgccctgcccttcggcgtcggcgccctgcccatcactggctccgcctggcagccagaccatgcggccaaggaaagcggggcgaaggctgactgtcgatcctgggagacgggttccgccactccaagtcaggagccaagtggcgaggagcatcgcacgcggcaggggcctgccgggccaggtgaggccacggccgtcaccccaccccagccagcggcgacgtgggtggacagggcccctccctccctccagccctacctccacctcatccgcatcgacaaaccaataggtaggcaagcatgttgatgattcagcggggatgcatgtgtgtgtctctgtgcgtgtattttcccaaaggggggtgtctttcagattccctgccaccgtcacgacctccaagctgccagcttgctgcnnnnnnnnnnatttattttcccaaaggggggtctctttcagattccctgccactgtcacgacctccaagctgccagcttgctgcccggaaacacacagactccctgctcgacaattcccccttccttccagggacctggttgctggcgtggccctgcttctggtccatagcgctggcggcgccccccggcgccgcccccgatctccggatgctggccctgtttgggacgggggccgtcctgctgcgcggtgccggctgcaccatcaacgacctgtgggaccgcgacctggacggccaagtcgcacgcacgcggcgccgaccgctggcggcggggctcctcaccccgcgccaggccgtagctttcctgggcctgcagctgtcggcggggctggccatcctgctgcagctcaacacatacagccaggtgctgggcgcgtcctcgctctccctcgtcgtcgtatacccactcatgaagcgggtgtttggctggccgcaggtggggacattcatgggttgtgctctgcacgagcggctcatggccgcttgcgagtggagggcaggcggagcctgaggcattcatgggcctgatgcgggtgagcccgaccgccacaccatggacgtaccccccccctcatacacgaggacacctcttctccccgnnnnnnnnnnaggcaggctgagcctgagccatttatgtgcctgatgcgggtgagcccgaccgccaaaccacggacgtacccgccacctcatacacgaggacacctcttctccccgccaatgcactgccgcttcctatgacgcatgacctcctggctctggtctgcctctcccaaagctgccgcatcaagcagcctcccgtcttattcacccccgaccttcccaccagacccacccctgcctcccgcccaacagttggttctgggcatggccttcaactggggagccttgctggggtgggcagcaatccacggagcatgcgattggtcagtggtcctgccgctgtacggggctggcatcctgtggaccctggtgtacgacaccatttatgcgcaccaggtgtgcaataggttgcggaagagggtttggaagggagggtgtggaagcgagggtgtggcgcgtcagtgttggtcattgatacacagtattgcgtcagcaaaggccatcaccccagtttggtggtatccctgcagaccaaagcctgattgctcggctcgatgacccacaaggacagcatcaagatctcccctgaatgtgtacctccagtacctgtccaggaagcaggcttgtcagcaatgcagcctgctccctgacagtcaccagatcctcggacccccctcacccctcctcatcaggaccaggaggacgatgccaagattggcatcaggtccaccgccctgaccctgggaagacacagcagggcagcaatgtggagctttgcggccggcacagtgggactgctggggttcacgggcttccaagccgggtgtggactcccctacttccttggggtggcctctgccgggggtcacctggcctggcagctgggcacagtgaatctggacgaccgagcggactgtggcgccaaatttgacagcaacaagtgggtcggggccgcggtatttgccggcacggtggcggacagggtgctggggtagccgtcccgggaccggccgatgcatggaggtcggcttcgcggatgaatgccgtggtctgggcctgacggccccgcgccgaagactcaccttcatgctccctctgtgcacagcgtcacaaccccacactgccgtgctgacggctgaatacggagtcgccgctggttcatgacacgtgctaatgctgtaatccaacaccaactcttctcgggagggtaatgggttcgtaccctcagggaagtacgtacgaagacaccgctgtgtggaaaggattgttccgggtgttatcagcgctaggtctgcgtgaacctgtaattaaatactgtccacgggtcagaaactcgccaaagagcatcttctcactcgcgtctgcacctcccggccttgcacgtagacgcacagcacagattctcgacacaccccaccagcttccttaaccacagcagaccgtcgcgcacaacagctcgaccccattatcatgatgaaattcgtccaaaaccacaggggaggggttgtagaccgccgcgatccccaggggacgcgcgcgcggatcccaaatgcccccggacattgcggctgcccgacgaaagcccccacccatggcttcgcacggggtcaaccctgcgcacaaagcggtcaaagggtgcttcttccccctgcgaccgccgtggccggtcccattttggagaagggcatccgcaatctgtcccgagtgctggagggctcgaccctatccccggcacatggcgccccacacatcgatgaattggccaagtttcccagccaagtgcgcccctatgcggccctggctcgcctcgacaagcccattggtgagcccgggtgggctgcgtgccaagatggattgtttgtcccgggtccgcgtgcccttcacttgcgacatgacgccatggcttcccgcaggtacctggctcctcctctggccctgcttctggtccatcgctttggctgcgccggccgggagtctccccgatgtgggtctcctcatttcttttggcatcggagccaccgtattgcgtggcgcgggctgcactatcaacgatctgtgcgaccgggacctggacggcagcgtcgagcggacccgatcccggccgctggcggcgggtgatgtcagcgtcgcacaagccatcggtgaggcagcggaaaagatggaagggtttgtatttgccccctgccccggtatgcgaccgcgcacatgctcgccattctgcacgattggccgccgagccggtccgaggatttccagacaggcacaccttcctctggccacccttctccccgcctcagccttcctggcgctgcaaaccgccgtcggcgttggatggatggccagcctgaacccctccgccctccagctgggactgtcgtccctgggcctggtggcggcctaccccctcatgaagcgcatcaccgactggccccaggtgagcgaggggagtgtgtccctctggaagcttggagccctgggcagtgctgtccctgactcttaacaccgcatggcaggggtgggtttacccctcgcatgcacgcagctgaagcggtgctggcctctgtcccccctgggcgcttgcatcgccgcacccacccaccacccatcccccctccatgatcagctcttccttggcttcaccttcaattggggagccatgatgggctgggcggcggtgcacggggactgtgactggaatgtggtgggacccctgtatgttgcaggcatcttctggaccctggtgtacgacaccatctatgccaaccaggtgcgtcgttattgctggacccatgggagccctggtttcttgcttggagaaatgtgctctcagtgcctgcactgttgggaccagcttccatgcgagggttgcagtggcatcctgccgtgtcagcacctgccttgccttccatgccgcttgccagcgggttgtgtccactgcctcatgacgcagcatcactcctgcaaccctcctggccagcctccacgcacacaccgaccctccccccaccgcggctgcaggacaaggaggacgaccgcgagatcggggtgcgttcctccgccctggctctgggttcggccaaccgagctgccatgtcggcctttgctgccgcctcggtggccgggctggccgccaccggggtgatggcggggtgcagcggcccctactttggcggggtggccgccgccggcgcgcacctggcctggcagctgggcaccgtcgacctgggcgaccgcgccgactgcggcgacaagttccggagcaacacctgggtcggcgccgcggtgttcgcgggtatcgtcctggaccgcctcgccatcttctgaccatcttctgaatcatcatgggcgcccgcggcagcgtgcggccgtgcggcgcagcgcagaatgacgttcccttggatgcaccagttcacagcgaattccctcgccgcaaacacctgtgtccccnnnnnnnnnntcgggcgcccgcggcggcgtgcggccgtgcggcgcagcgcagaatgccgttcccttggatgcacgagttcacagcaaattccctcgccgcaaacacctgtgtccccgaagacacagcggcccagggcgctgatatgatggacaattccccacttcaccaagctggtctgttcctatgcagactgtgtgtctgaccctaagcagatgcttgacaatccccttgccgcctggctgccccttccccgcagcccaggcgggctcttcgtccccatgttgccccccgccggatcccctgactatctggatttcacaccttcccctccatcaccctcgagcgcccagcccgggcatcttcctgtgcctcgctattagaggtctcctcacctcccctgtttccctgcccttctcccccaagcccgtgccactccaccccaccacaaccagttgcgcatagctccctccccctttgatcacattgccattcttgacagctgccaagtgcctgcagatcatgttcaccagatgtgccgactcacccctgtcagaggggtcacaagggggacagcacagccgcgcccgagcaggccactcatgggtaccagtgggtcatcacatgccaaacatgccgttcatcannnnnnnnnnccagcacagccgtgcccgagcgggccactcatgggtaccagcgagtcatcacatgccaaacatgccgttcatcatgctggcagcatacttcatgggcttgacatctgggtgcggggccgcctcaaactgggtgaaggcgggcaccatgtcttcacccttgaaccggataaaggcaccctggagttgtaaagggtgggagggaacatgtcgaagcagggtgatgataatgaaggacagggagcaacaaggcccaggcaggtgattcttgggcatggtgtgccaagcgggggagtcccaaggcacatggaggcagtgggacaggtaggaacgccccctgtaagtccactccaaataggcgccctgcacggcatgaagggcaccggnnnnnnnnnncattcttgggcatggtgtgccaagcgggggggtcccatggcacatggaggcagtggaacaggtaggaacgcccccctgtaagcccactccacacaggcgccctgcacggcatgaagggcaccggcatgtctggacggcacctggcacctacgtccctcgccacaccttattccccatctggtcgcagtagtttggcgccgagaagatggtgatgcagtacccctgcggcggttgttgggggggggagaaggaggttccccagcactgtccagagtaggctcggcgtgcaaccaccttccttctggccgccgcccccaccctcatggcatgcgggtgtannnnnnnnnngtgggggggggaaaggaggttccccagcactgtccagagtgggctcggtgtgcaaccaccttccttctggcccccgcccccaccctcatggcatgcgggtgtagcacgggcaggccccccgccgctgccctctcacccctacaacctactttggcactcctacactacacacgtttgtctcctcccgctttccagaccccttcccccccacccctctcccccttcaactcacgtcgtgtgccaccnnnnnnnnnntgctttccataccccttcccccccccctcccccttcaactcacgtcgtgtgccacctcatacccctcgtccttgacctcgtggctgcggaccagcagggacaggccgttgtcctgcaggaaggcacgggtgacgttcgggccaaaggcgatgccgacgccgcgcttgttgggctcgcgtcccggcgtgtccttggggtcgctccacaacatctcgcacatgtgccccgcctccggcggctcccggtagcgctggatggctgccagctcgtccagccgcacgccgtcgtcggagaagaggccgccgtgcaggacgaggacggtgtcccgcagcacgtagcccagcggcagccagcagaaggtctcgcggaagacctccaccgctgtggggccgcacttctcgcgcacctcgccgtagaagccgtagatcaggttcatggacttggcctcgtggttgccgcgcgtgaggtgcatggcgccggggcacaggcacttgtgggccagcagggtgagcatgacctccaggctccaggacccgcggtccacgaagtcgccgttgaagaggtaggggttggcctcggagggggcgccgcccagctggaagatgcggagcaggtcgaagaactggccgtgcgtgtcgccgcagacggtgatgtgggagccggcggggacgtccacgtgcaccagcgagggcagagccttgagcaggcgctgcgcctccagcacgatctggggtgcatcagaagggggggggcgcaaaggggggtgagggctgcgccaaggacctgcatgctggccagccaggagaccccccggtctcaaggtcaagcagggggtgggcacagatccccgggagcccccctccatctcccagcacagagcaggcggggaggcagcctggctgcggggcagtgtccttggggattcccctttgcaacttcctaccccacactcacccacagcacgtagcgccggtgaagagtttggccccgcttgaaggcctccagcatgctctcgatgaattccaggtttatgaagtaggcgccgttctcgtcggctgtcgggttgaggaatcaagggggtgatggggaggagaaggagggagtgagctcagggatgcccccgtgtcaggggaacgccatgcatgaacgcgacacagtgaaccttggagggagctccttcaccatgtgggaccttcatgcatgcgggtttcatgacatcattccaacggagacaccttagcatggactggcaaccagagtctccgtgccagcggcaccccagcacagtcaccctgccactcccagccagtctcaaaacccaaagttccacatactggggagggcgggcccgcagtagctgctatcaatggcgacgtcatccaacacaatggtatcggagaccggcacgtcattatcaggctgactcagcgcttcttcaaatcttgcacgtttcaattgcttctcagcctctgcgagctgtgcacacatgggagcaagggagggaggcagtgagccgggaccgccagctgcactgcggaggggctgcaggctcgcaccagcacggttgtctgtcacacacacagctcccagcccaatgtaccttcctacggannnnnnnnnnggggggtgatggggaggagaacgagggagggagctcagggatgctcccgtgtcaggggaacgccatacatgaacgcgacacggtgaacctgggagggagctcctccaccatgtgggaccttcatgcatgcggggttcatgacctcattccaatagagacaccttggcatggattggcaaccagggcctccgtgtcggaggcactcaagcacagtcaccctgccactcccagccagcctcaaaacccagagctccacatactggggagggtgggcccgctgtagctgctatcaatggcgatgtcatccaacacaatggtatcggagaccgg

SEQ ID NO: 48465 - DNA, 61 bp, Chlorella protothecoides
cagcgaggggttcctggccctggcggcgctagccggcgtgcctcaggtgcggatgcaagct

SEQ ID NO: 48466 - DNA, 76 bp, Chlorella protothecoides
cctgcgagtcgccctcgcctgcagcaccagccccctcctcccgggcatccgctggctttgcagccgcagaggcctc

SEQ ID NO: 48467 - DNA, 61 bp, Chlorella protothecoides
ccgcatgtgtcaagtgctcaggtgtcggatcgcagccccaatttgctccaatggcccagca

SEQ ID NO: 48468 - DNA, 80 bp, Chlorella protothecoides
ggcctcgcgcacggcgtgggagggcgaggcgcaaccgtgctgccgccggcaccgtcagggccggggtgagtcccgcactc

SEQ ID NO: 48469 - DNA, 69 bp, Chlorella protothecoides
tgccgcgccggggcgggcagggggaggagcacaccattgtcgtgctttgcatctgtctgagaagcagaa

SEQ ID NO: 48470 - DNA, 72 bp, Chlorella protothecoides
tgcagctgcgccctggtcgcccaagcccattgaggggccccgtcccccgcccctctcaagctcgcacctggt

SEQ ID NO: 48471 - DNA, 128 bp, Chlorella protothecoides
ggagagtcgcagggggatttggtcagcatgaagacccgccaccgcagcggcacagtcgaggaatccaccatatcccccaccaaagtcccacaaacccaccacaccgccgcaccctcacggccagcgtc

SEQ ID NO: 48472 - DNA, 61 bp, Chlorella protothecoides
gtctgcctctctacccatcacagtgacgggtcagcatgctgacgaggaaaagattgaccaa

SEQ ID NO: 48473 - DNA, 83 bp, Chlorella protothecoides
ggtgacctttggctcgccccccgtgctcgctctcgacgcggcgttgcccgcccaagacggcgctgggggggagcatgccatgc

SEQ ID NO: 48474 - DNA, 88 bp, Chlorella protothecoides
ttcccagtaccatcgcccctccccacctccgaccccacaaaaaaacacccttccccatccaacagctgcgatcctttgggctggccct

SEQ ID NO: 48475 - DNA, 61 bp, Chlorella protothecoides
ggctctcatcgtcactgcacgccctgatcgaggaacctgcgaaccgaagagcctgggatgg

SEQ ID NO: 48476 - DNA, 61 bp, Chlorella protothecoides
aggtgggttgcgcctggggagctttgagacacccgggggcctgcctgtcgcggtgtgcaat

SEQ ID NO: 48477 - DNA, 11437 bp, Chlorella protothecoides
  modified_base (379)..(388): a, c, t, g, unknown or other
  modified_base (1592)..(1670): a, c, t, g, unknown or other
  modified_base (1982)..(1991): a, c, t, g, unknown or other
  modified_base (2520)..(2604): a, c, t, g, unknown or other
  modified_base (3297)..(3306): a, c, t, g, unknown or other
  modified_base (3893)..(3902): a, c, t, g, unknown or other
  modified_base (5276)..(5285): a, c, t, g, unknown or other
  modified_base (5670)..(5679): a, c, t, g, unknown or other
  modified_base (5937)..(5946): a, c, t, g, unknown or other
  modified_base (6061)..(6070): a, c, t, g, unknown or other
  modified_base (6186)..(6195): a, c, t, g, unknown or other
  modified_base (7044)..(7053): a, c, t, g, unknown or other
  modified_base (7499)..(7508): a, c, t, g, unknown or other
  modified_base (8212)..(8221): a, c, t, g, unknown or other
  modified_base (8567)..(8576): a, c, t, g, unknown or other
  modified_base (8667)..(8676): a, c, t, g, unknown or other
  modified_base (8732)..(8741): a, c, t, g, unknown or other
  modified_base (9225)..(9234): a, c, t, g, unknown or other
  modified_base (9455)..(9464): a, c, t, g, unknown or other
  modified_base (9537)..(9546): a, c, t, g, unknown or other
  modified_base (9939)..(9948): a, c, t, g, unknown or other
  modified_base (11017)..(11026): a, c, t, g, unknown or other
  modified_base (11129)..(11193): a, c, t, g, unknown or other
gtggccgcgctggcccggcgccgcgccgggctgcgcgacgtcggcctggaggtgttcttcgccgggggcacgggcgggggcggcggcacggggcccgacacctggggcgcgccctccgcgttcctggtgttcggcgaccgggaggaaagggaggggtggctggaggccatgctggcgcagccgggcctgggcgcggggcccgccgttccgccgcggggggtgtcgggggatgggacggcgggggatcctgtgcgcactcccagagcgctcctgctggaggtgaggtgggggtggcgacgggagcccccgagggctcaacaccatggggcctcccctcaggatgtgggagccgggaggcctacacgtatggtccctcagnnnnnnnnnngtccgccgcggggggtgtcgggggatgggaccgggggggatcctgcgcggactcccagagcgctcctgctggaggtgagttggggtggcgacgtgaggccccgagggctcaacaccatggggcctctcctcaggatgtgggggccgggaggcctacacgtatggtccctcagcgctgacccacattgccacgctctgtgtccaccttcacatctccccctccctcctccaaacaaacttaggcgggcagcgagtgggttcggggcgcaacggctgcctggcagcgcggggccctgtccaacttcgactacctcctgttctgcaacctggcggcggggcgctccttcagcgacctggcccagtaccccgtctttccctgggtgctggccgactacgcgtcagaggttctagatttgaacaacccaggcgccttccgcgacctgaccaagccggtcggcgccctgaaccccgcccgcctggccgccgcgcgcgcgcggtacgccgacatgcgcgactgcaccgacgatccgcccttcctgtacggcacccactactcctgccccagctacgtgctgtactggctggtccgcgccgcgccggggcacatgctgcgcctgcagggcgggcgcttcgacgccccggaccgcctctttgcctcggtcgcgggggcctgggcgtctgcgctggccaaccctgccgacgtcaaggagctcatccccgagttttacctgccgggcgccgcggggttcctgcgcaacggcctcgggctggcgctgggcacgcggcaggacggccgtcccgtgggcgacgtggagctgccgccctgggcgcggggttcgccggagcgcttcctgtccctccagcgcgccgcgctggaggcgcccgtgatctccgcaaacctgcaccactggctggacctggtgttcggctggaagcaacgcggcgccgccgcgctgcaggcggggaacgtcttccgccacctcacctacgaaggtgaggggttgggggagtggacacgtgtgcattaacttgtaggtggatgggttgggtgactttgaatgtggggcttgggcgatgcgaggagtgtgcatgggtgggtggagtgctgtgcggtcttgggtttatctgaggtggatgttcagtgtgctactttcaaccattcctgcccgccaagcattccgtgactgcaatcgctgaacctcttnnnnnnnnnnnnnnnnnnnnnnnnnnnnnnnnnnnnnnnnnnnnnnnnnnnnnnnnnnnnnnnnnnnnnnnnnnnnnnngaagcaaaacccgggggaggcggcgctcctgcgccttcagatcgaggagtatggccagacgccgcgccagctctttgacgcgccgcacccgcgccgtttggtggcacctcgcgcgtgggatgccaatggggagactccgggtgctacgcttgccccatcactatcggttggagggcctgcgcccatcccttccgcccccacagccacgagcgacggcatggcggggctgtgcctctccctcatggcatctgtgctggcggcgagggaggaggagggcgcgagggcggagcccttcacggacgacagccagcnnnnnnnnnncccattccgcccccacagccacgagcgacggcgtggcggggctgtgcctctccctcatggcagctgtgctggcagcgagggaggaggagggcgcgggggcggagcccttcacggacgacagccagctggcgctcctggacgccctcgaccttgcgccagggtctgttggagtcgttgagggtggcgacggggcggaggacctgggccttcgcggaggcacagccccctccgacactcaagatcagcacccggcctcgccagtgccaccaccactggcgagagctcccggcgtgtcggcccagtggccgcccgcccccgcgcccgctggcgtcgagccggccccctcccccgatccgcgggcgcggctgggtgccttcaacgccgtctctgcacgcctggggtccctgagagccgccgccctggacgcggcggccgcctcccgacccagctccatgttccgcggcctgtttgaccgcagggcgtctgtggaggctgaggcggcgggtgtggcgggcccgggggggccccnnnnnnnnnnnnnnnnnnnnnnnnnnnnnnnnnnnnnnnnnnnnnnnnnnnnnnnnnnnnnnnnnnnnnnnnnnnnnnnnnnnnncaggggccgcggagtcggcaggccgagttcagtcggcagaggagacgggccccagcacggcagcagggccgacaggccaccccaagtccgtacagccagtgggtcccaaaagggtctcctcaccggaggacgcgccactgcaccagactcccctggtgtggaaaggacggcggcatggggcagtcgcgtccgccgccccgccgtcttcctccggcagcgcatccccgctctcatccctggacagcgactccgaggaggacgggggcccaggcatggtagcagagactgaagcccctgcacctgctgcgctggcgccctggtgggacgacctcgtgaccctggcggtgccgccagggctcgccagcccccatgcctcgccgcaggcctcgccccggccccgggacgccaaggtgctgcatcggctaacatttggcccggcgcacggggtcactgcactggcggtcgcagcgggggacggcgccaggaatggaactccgacagcctttgccgcgacgcagtccggccagatccgggcggtcgagctggagagcgggaagcaggtagttctcttgggtggctgggttgttggctgctgttgtcaacaagcaggagggctcttgcgtcgtctgagcacacacatgtgtgtggcccgcccctcggagcgctgcagccccgcgctgatttggtgggcannnnnnnnnnttgttgtcaacaagcaggatggctcttgcgtcgtccgagcacacacatgtgtgtggcccgccccgctgaacgctgcagccccgcgctgatttggtgggcaggatcccttgttcctggcctgccgccgctccacccacctcaatcaccccccaccctctcaaccctaacatcgtgttccgccttatcccaaggtgcgctgcgcgtcgctatccgcgcagccgctgacgtgcctggccctggcgcgccccgacccgcgcggccacccactggcgctggcgggcggctacgacggcgaggttcgtgcctactgcgcgcgcactggctgctctgccggcggctgggtgccgggggacgatgcggtgagcgcgctgtgcacgctgggatcgggcgtggtggtcgccaccgccagcggcggtctggcggcctgggagacgggcggcgggcggcatccctggcgccctgtcgggcggagcctgggcgacgggggcgccgtgctacccctgctggaactggagggactgcagggcgagggagcctggtctttggctgcactgcccgcgggctctcacccggggccgctgatcctnnnnnnnnnngcgggggcgccgtgctacccctgctggacctggagggcctgcagggcgagggcgcctggtctttggctgcactgctcgcgggctctcacccggggccgctgatcctggccggcacggaggcgggcgcggtgctgggctgggacccacgacgcggcggggccccggcctggcgctccgtcttgggccaggacatcgtggcagggctgagcgtagacgccggcagcgcccctcgcgtcagcgccgctgcggccgacggccggctgcgcctgctggacctccggcggggtggggcggtgatggcgagcgcggcgctgggcagccccctgctctgcgccgcctgcccaggacctggctggacggcggcgggggacgaggagggcgcggcgtggctgtggcgcgcgccggggggcgggcggccggcgcgggcctggcggggcgaggcaggggacgccctgaatgctctggccctggggccgccgggcccggatggaagcccacgggtcgcgctgttcgggactgagggaggtagcctcctgtgcgtcgatctggggttgtaaaggtgatttgatccatggcgctggcccaggatggttttgctggcacacgaccatccacgctcgattctgtccctttcacgtcaggctgacgatacttccggggaacttgcgtgagcccccgagatgcattcgtttgtgcatggatcggtgcacccgtggagctggaacagcacttccagaggcatgaaaatcgtttctgtgctagagaaagcagcgacctttgctcctcgactggcaagcagccggagatcacatacacgcaccgtcatgtcggcagggaagatcgtccactggcagtctaagaactgcccctacgcacaaaggtagggtataagatgcgatttccgtgtttgtgggcatgtgggaccgacgtcgaaaagctggctgtgtacagtgggtctgtgggggcgaagtcatgatgaaccaacaactctgcggtacgtgctcccatgcaggtcctggatcacgctcctggagaaaaacctttcatttgatatcaaagaaggtgagcgaattttgggtcaatgggatcgtgggaggtatacctgctgcaatgaagagtgagatgcgatcgtctcggattcatgctgaatccggtcccactaaaaatgccctcgcccgcagtggacctggagaacaaaagtgatgagtttaaaggtacgaagtgttcagagctcttcgcgttggctgtgtagcacaaacttcccactgcacacctgacttggggtgcggcatgcgcgtgaagttgcggctccggaaggaacttcctcccctcctccagttgatgagtcagccacccccttgacttgctccccgnnnnnnnnnntacctgacttggggtgcggcatgcgcgtgaactggcggctccgcaagggatttcctcccctcctccaattgaggagtcagccacccccttgacttgctccccgcatccctcacatgccagccaagtatgcgtccctgcacccgggccccgatgcccctgccaaggtccccatcctggacgatgccgatggcacagccctgtttgagagtctggtagtggcatactacctgaacgacaagtacccagagccggctctgctgcccagcgaggcggccgcaaaggcaaaggtgggagacgtgcgtgagggggcctggctcctctgcccgtggtcttgtgtctagaggcttggacgcatctggacccccctttgtggcatgccccagtnnnnnnnnnntgaggcagccgcaaaggcaaaggtgggaggcgtgcgtgagggggcctggctcctctgcgtgtggtcttgtgtctagaggcatggacgcgtctggacccccctttgtggcatgccccagtcaccatgtcgtctcttcgcaagctggagcaggcagcgtgttgagaaggatcgcagatgaccgtcagctcacccccccccttccatctccacaccctctccacacacccccctgcagatcagcctgttcatcgagctctnnnnnnnnnntctggagcaggcagcgtgttgagaatgaccgcagatgaccgtcagctctccccccccctccatctccacaccctctccaccccgccctgcagatcagcctgttcatcgagctctnnnnnnnnnnacaggtggccgagcgcctgccagcgctggtccagggcctcaaggtgcgtggccatgattggccgtcgctcagaactatcgtcacataaccgcgcgcacagtggtccccatcatgannnnnnnnnntccccccatccatcttcagcaacgccttcagcctggtgaaggccgagaccagggctcaggtggccgagcgcctaccagcgctggtccagggcctcaaggtgcgcggccatgattggccgtcgctcagaagtatcgtcacgtaaccgcgcgcacagtggtccccatcatgactcactccgcggcaccccattcctcaaaccgaaccgcacagaccgcaaacgccctgctgaccagcctggggtcctccgagggcggcgactactttgcgggggcgcagtacacgctggccgacatcgccacctcccccctgtaccatcgcgccgtgcacctgctgaaaggccaccgagacatcgacatccccgccatcctgcaggagcacaagctggacaggtggcactagggtctggaaggatgggctggaaagggcggagtgcagggtcgatgtgccgtcatggccatcctggacagtcggtgccgtggcgaggcggcgcatgcctgcgcatcttgaggtttggtatgcacacatgaactcgcacaccctcatcgctccatctcccaggctggcggcgtggtcgaaggctgtgctggagcgcccctctttccaggagaccgcccctgatgccgaggtggtgatcaagtccatggcaaagttcgtgaaccccctgtctgattgatggagggagggttccccaccagccggacagctgtgctcatgaaggtggcctgtgcctgtctggctggtggccttgccttgtaatgtatcgtaagggatgcaggaaggcaacggtgtaaacatgggataacctccaagaactagctggcacgcctggcctcctctgaacttttgcnnnnnnnnnncggcctgtgcatgtctggctgggggccttgctttgtaatgtatcgtgagggatgcaggaaggcaacggtgtaaagatgggataacctccaagaactagttggcacgcctggcctcctctgaacttttgctgtgcggagattgagggctgatgcgtgtagcggttggctgggatacaccctagttgtatagaaccgggaggaacacacaccgagtggtggatggtgcgccatcgcgatttacagtgtgcaccccaccacctggggtccaagggcacctagtttcggttatttccgctcttgcgattcgaagtttgggaaattttgctgttgcgctttggctttcggacgatttcgctcttgcgattcgaaattcgggagattccgctcttgcgtgtcgacatcttctgcgccgacggcaccatcggaaacaccgactgcagggcccnnnnnnnnnnatattttcgctcttgcgattcgaagtttgggaaattccgctgttgcgcttcggctttcggatattttcgctcttgcgattcgaacttcgggagattccgctcttgtgtgtcgacactttctgcgccgattgcaccatcggaaacaccgactgcagggcccaatgaaggcgaaagggaggttcgccgggcaaactatacgtgatacagaggcgcagaccacatgattttacacggagggtgcaccatgatgatgcaccaacatcagtgtgccttgatgaggatctcatgcgcgaggtgcacacatgtctagcaccgggaagagggtattcagtgcatggcaccttgcacagcaacgaatggctccacacggatgacgcttcatagattcatcttgctgcgccgcaagtagttggtaggagtggtacttcactcccgaagggtcgtgcttcatgcacattcgtggtgcaagggtataattcgatgcgatctacctgtccagccggttatgtgagccgtttggtcatgctccgcgacgccagctgcagtgctccatggaaggcgagccttctgcagatacgagagcgaggacacacgatcacacacattttcgctgcagatacagattatcagcttacccggagcactgtcgagcgagtgccatactttcaggatgtcggcagctcgtaaaattacccattggatgnnnnnnnnnngggacacacgaatcatacacatttttgctccagatacagattatcagctcacccagagcattgtcgagcgagtgccatactttcaggatctcggcagctcgtaaaattacccattggatgaccccggcatcaagccatgcacagaggtgggtttgctgcagtagatttaccacagaaggtggtataagatcaaaagtaacatcaatgaaacgttaagaattgagacgagggttggcccattgtcgtcatgtgtactgcgtccgtgccattgtggactgtattacatgacctagccaccactcccacatccacagaacccacatcgtacttctcgagaaaaatctgnnnnnnnnnngggtggtataagatcaaaaataacatcaatgaaacgttaagaattgagatgggggttggtccattgtcgtcatgtgtactgcgtccgtgcnnnnnnnnnnaaattcgagaacaaaataggtgaggcgatgggaatcataccatccgatgtgcttcnnnnnnnnnngaattcgggaacaagataggtgagacgatgggaatcataccatccgatgtgcttcaatgacgcatgagtcgcaagccatggggcatgtgcctctttcatcatagagatttccaccttttccgcccgtgctgcagtggacttgaccaacaaaagcgacgagttcaaaggtcggtgaggccttgtggtagatgaccgaatgtgttgattataagccctagaaatgatcagtccatgcagattatactgcaggcttatttgcagtagatatggcctggacggctcagtggtccactattacaagtctcttccctgacccaatgttcctcactcgctgcttgtcacagcaaagtatggctctgtgcatcccgtaccgggtgcatcggccaagatccccatcctggaagatgtggatggcaccacgctcatcgaaagttggaccatcatgcattacttggagtacaagtatcccgagaccccactcctnnnnnnnnnnctcatcatagagatttccaccttcgccgcccgtgctgcagtggacttgactaacaaaagcgacgagttcaaaggtcggtggggccttgtggtagatgatcgaatgtattgattataagccctagtaatgatcagtccatgcaggttacattgtaggcttatttgcagtagatatggcctggaaggctcaatggtccactattacaagtctcttccctgacnnnnnnnnnnacccgagggtgccgccgagcgagcaaaggtgtgagtagcagtctgtgggccccgtacctggctgacaataccnnnnnnnnnngcccaagggtgccgccgaacgagcaaaggtgtgagtagcaggctgtgggccccgtacctggctgacaatacctgcacaagcacactgtaccacttttctacagagctgtataatttcaatcaagcaagccgccaacagaactctctgaaactgtcgtatgcccctcgtctctccccccaacacagatcgagctctttgtgcagctccagggcgccagtctgtttgagagatcgtccgcgatcctgaaggctcgcacccaggccgagcttgcggtggccaaggcgggcttcgtcgatgcgctcaaggttcgtgacgggacggagtgaggcagtgccgatccctctcaagaggctgtgaccatgtcaccttgcatggtgcctgcacatgatcttnnnnnnnnnntgatgcgctcaaggttcgtgacaagacggagtgaggcagtgccgatctcactcaggaggctgtgaccatatcaccttgcatggtgcctgcacatgatcttgtgcttgtggatgtggagcgtcctgcgaggcggtcctgtcaagtgcatggtcagctgtacacctcggcctccaagcgccgaccatgtgcaggtcctggatgccgcattgaggacgctgggctcgcaggatggcggagactactttgcggggggggagtacaccctggcagacattgcagccagcacccgcatctaccggccaatagtcctggtggaggatcactttggcatggacgtccagaggctcatcaatgagcatcgcctggaccggtgggccatgtgactggggaagggttcctgtggatcatgcctgtcggccgctcctctgtgattgcttgtgcagggatgcatgtggatgcagtcaggcctggctctcatgctgatctgtgctgtgtgtctgggaagtgcatgaggcggtgagttggtgtccactcaagtctgctccaatgctccttgacaccactctcatgaacatggatcccccaggctgaaagcgtggctcaaggccatttttgagcgccccactttcaaagcgagcatccccagtcgtgcagccatgtctgagaagatgggcaagcatgtcgtccccctcgatggctgaggtcgagctctgaagaggggagtgccatgcgcagcacctgcccttttggaagctttctggcctgagaccagagcacatggcagctgcaaaacccaatgcaagacgcagaggtggctgatcatccacagcatgtgctagtgcgtccctcttcttcacgctgggcatgcagtcttttgctggaagaccacccaaccccttgggcccgagaaactgcaagcttttcacgaaacagatcacaggattcaactcttgaatgacaaactggtggggcagaatcgtcaagagacgcaggcctgcagctcctcgtaggccagctgcacgaccttgaagcgctcctccgccgccagcctcgcctcctccccccttcnnnnnnnnnncagctggaagaccccccacccccctgggcgcgagaaagtgcaagcttttcacgaaacaaatcacaggattccactcttgaatgacaaactggtggggcagaannnnnnnnnnnnnnnnnnnnnnnnnnnnnnnnnnnnnnnnnnnnnnnnnnnnnnnnnnnnnnnnngcatgcgtgacggcggccccaccttcaatgcccagggtgctcagcgcggaccgtgaggcgtcggaggaggccaggcccgacccaccggtggccgccgcagcagcctgctgtgcggcgcagcgcgcggcggccgccgccgtctcggcggccaggcctggggtgccgggcgcggcgcgctccgcctggcgccaggccaggaaggcctcggtgtggcgccccagccgtgtcagcagccgggcctgca

SEQ ID NO: 48478 - DNA, 61 bp, Chlorella protothecoides
ccacccctcctccccttgccacagccagtcggcccctgcggctggtcgtccatgcccccct

SEQ ID NO: 48479 - DNA, 61 bp, Chlorella protothecoides
cgcatcctcgtcttcgggtggaaagggcggtggcgcggcagcatccggcgtgcggtccccg

SEQ ID NO: 48480 - DNA, 82 bp, Chlorella protothecoides
accaccatccgatccgattccttgggtcgaagatgggatccatgcatggtgggctcgaccacatgctggcagctgtgcaggg

SEQ ID NO: 48481 - DNA, 124 bp, Chlorella protothecoides
gcggccgccaggcccgccggtgcaggcgccacgccggtggtcggaacgctggacaccgtggacgtaccggagactcctgccactaccacggccgaggctgagaggggcggcgctggttcacgag

SEQ ID NO: 48482 - DNA, 67 bp, Chlorella protothecoides
gtgctgagtgcagcatcgtgcatgagcgcggatgcatgctggcatgcaggtgcgtgtggaggctcgg

SEQ ID NO: 48483 - DNA, 61 bp, Chlorella protothecoides
catgtgcagacccgggcttggggaggtccttgggactgtagctggtccaacatgctcgcga

SEQ ID NO: 48484 - DNA, 61 bp, Chlorella protothecoides
tgggagatgtaagatggaatacgcttgctggccagctgtggggtgatgtagcagcaatcgg

SEQ ID NO: 48485 - DNA, 61 bp, Chlorella protothecoides
tgcctgagtgattgggtcgggtgggggggaagcaggcaggtaagtgggttcggcaagagtg

SEQ ID NO: 48486 - DNA, 61 bp, Chlorella protothecoides
ctgcttcttttggagtgatgcattggcgtctccacgccacacagtctcgcctcaatcgcct

SEQ ID NO: 48487 - DNA, 67 bp, Chlorella protothecoides
atgtggtgtataccagcagcgaggtgcaccaccctacgcaactacccgctcacccgccaaccaccca

SEQ ID NO: 48488 - DNA, 61 bp, Chlorella protothecoides
gtcgcaggcctccttgagcaccacggcgtcggcggtgaacaccacggcgtcgttgaccagg

SEQ ID NO: 48489 - DNA, 66 bp, Chlorella protothecoides
cgacagcacctgtgcagtggtggtcgtcgttgttgaaggattggatgtggagttggatggagggaa

SEQ ID NO: 48490 - DNA, 61 bp, Chlorella protothecoides
accatcgagcttccccggggcggtccccccactgtgcgctcccatgatttacacctctctg

SEQ ID NO: 48491 - DNA, 91 bp, Chlorella protothecoides
tcaccggttctgtgcagaattcagtcttgcttcacccccatgatccgcttcctgcccttgtcgtgagcctcactctcgccccctcaccctg

SEQ ID NO: 48492 - DNA, 78 bp, Chlorella protothecoides
ggatgccctcagcacaaaggcacctgggcaaggcgagaagcctttaccaacaccccgcttttcacccacctctgtcca

SEQ ID NO: 48493 - DNA, 69 bp, Chlorella protothecoides
caggactggacattgtgtacaagtaccctcgtccatccccacctcaggattacagcggcaccgcagtca

SEQ ID NO: 48494 - DNA, 78 bp, Chlorella protothecoides
agggtcacgggagccaccgcttggctcagaatggcgctggcagccacgccgtctgtcttgatgacgccgttgaagtcc

SEQ ID NO: 48495 - DNA, 73 bp, Chlorella protothecoides
cgccaccacctgcacgccgctcgcgcccaccgttccccccctcgcactcccacgcagggtacaccagctacga

SEQ ID NO: 48496 - DNA, 62 bp, Chlorella protothecoides
ggtggggtacggcggcgcggacctcaaggcgttgtgcacggaggccagcctggccgcgctgc

SEQ ID NO: 48497 - DNA, 61 bp, Chlorella protothecoides
gggccgcggcgggcccggccccaggcggggggggggcggggacccggcttcggaccgcgat

SEQ ID NO: 48498 - DNA, 67 bp, Chlorella protothecoides
tggacgtcgaggaggtgaaaggaaggggggctggaagggggggggctcggtaagtggcatggcttct

SEQ ID NO: 48499 - DNA, 61 bp, Chlorella protothecoides
atttttgtgtgactagatggctatgtcgtcttggctggatgtaagatcttgacatcaagat

SEQ ID NO: 48500 - DNA, 61 bp, Chlorella protothecoides
tattcccgcggacgggatatcgctggcgcaattggttgcctctaatggcgaaccggggggt

SEQ ID NO: 48501 - DNA, 79 bp, Chlorella protothecoides
cgctggagggcctgagggcggtgcggggggtgttacacgccgtgcacgtcgccaggcgggaggccgccccattcccggc

SEQ ID NO: 48502 - DNA, 64 bp, Chlorella protothecoides
gcaccctgctcctcctttgcctgcacactgccatgcgagacacccgagtgtcttgtcagacctg

SEQ ID NO: 48503 - DNA, 64 bp, Chlorella protothecoides
gcggaacccgaggcgcgcgctcgcacgcactgcatccgggagctgatctcaaactgttgaactc

SEQ ID NO: 48504 - DNA, 61 bp, Chlorella protothecoides
agaagcccatgacgcctgggaccagcgaggcggagctcggcgccggggacgatgcggcgaa

SEQ ID NO: 48505 - DNA, 63 bp, Chlorella protothecoides
caacttgcagcacacggccgcctgacgaccctggttgctgcaggaggtgcaccacagcgtggg

SEQ ID NO: 48506 - DNA, 83 bp, Chlorella protothecoides
gcaggaccgccgcccccaccgcctgctcaggatggagcgggcaagggggggggcggtccaatgagcccaggatccgtgggggc

SEQ ID NO: 48507 - DNA, 61 bp, Chlorella protothecoides
ggttaggaagggggaacattaatggcagggtactggcctgcagtgggggtgatgggggggg

SEQ ID NO: 48508 - DNA, 70 bp, Chlorella protothecoides
ggagcgagacttgatgacggacagccactggtcggcgaaaaggaaggggccggagggcatgccgacgatg

SEQ ID NO: 48509 - DNA, 68 bp, Chlorella protothecoides
gaggcgtgagcagggacggtgcacctgaccgacagaggccatgctcggcaggacatggagcggggtgg

SEQ ID NO: 48510 - DNA, 61 bp, Chlorella protothecoides
gcacgacctcatcatagccaggttgccggacaagaaattaggcgcatggatgagataccaa

SEQ ID NO: 48511 - DNA, 61 bp, Chlorella protothecoides
agccggcgatgcgcggctagggccgccgggtacgaccacgtctgccctgtcacccctccct

SEQ ID NO: 48512 - DNA, 107 bp, Chlorella protothecoides
caccgccgccgagtcgctggcctggaaggcggtgcgctggtaggtggtccgcaaaaagggctcctgggcctcgcgcgccaggaacgcctggacgcgggccaggaggg

SEQ ID NO: 48513 - DNA, 93 bp, Chlorella protothecoides
cacgcccgccggcatcacagcacctggcactgacggcattcccaccgattggacccttatccacccccaaaaccaaccagggtctacctgacg

SEQ ID NO: 48514 - DNA, 61 bp, Chlorella protothecoides
tcctgtgcgggtgggacgagaagggggcaggtgggagtgaggatggactgggggcgggccg

SEQ ID NO: 48515 - DNA, 153 bp, Chlorella protothecoides
caggcctgaatacaactaaatttaatacgtttgaaggggagggatagcaggcccgatgtcttcttgagtttgatcgtggaagtgacgcgcacgccgccccggtcgatctgctcccccgccgctgcgccgcacgggctcgtatgcccttgctca

SEQ ID NO: 48516 - DNA, 77 bp, Chlorella protothecoides
aggagtgggaatcctgtgtccctgcggcgctgccccaaaaggctgccgcccttcacagcgttcaaaccacggcgacc

SEQ ID NO: 48517 - DNA, 69 bp, Chlorella protothecoides
tgtgggtggccatgaatacttgaccgagcagagtgcagaggcccctcaccgccgttacctgcgccgcgc

SEQ ID NO: 48518 - DNA, 62 bp, Chlorella protothecoides
caggatcaggtacgccttgccctttttcacgggctggtccaggaggtcgccgcacacctcgc

SEQ ID NO: 48519 - DNA, 77 bp, Chlorella protothecoides
tgtgtgtgtgtgtgtgtgtgtgtgtgtgacggtgcccatgtggaagagtgacgagtgtacgcaggtgtgccctggac

SEQ ID NO: 48520 - DNA, 63 bp, Chlorella protothecoides
cccatctccctctccctctccttcccccaacgtcagccccagcccctcacccaaggccagccc

SEQ ID NO: 48521 - DNA, 61 bp, Chlorella protothecoides
gcggtagaaagggcagtcgtcctcggggaaatagagccagcacttgaggccgtgggggcac

SEQ ID NO: 48522 - DNA, 68 bp, Chlorella protothecoides
gtacggggtgcagggcggcaagcccagccagacacccgctgctgtgctcagagcagcatggacgcggg

SEQ ID NO: 48523 - DNA, 18399 bp, Chlorella protothecoides
  modified_base (399)..(408): a, c, t, g, unknown or other
  modified_base (1362)..(1371): a, c, t, g, unknown or other
  modified_base (1686)..(1695): a, c, t, g, unknown or other
  modified_base (2120)..(2129): a, c, t, g, unknown or other
  modified_base (2457)..(2466): a, c, t, g, unknown or other
  modified_base (2869)..(2878): a, c, t, g, unknown or other
  modified_base (3509)..(3518): a, c, t, g, unknown or other
  modified_base (4669)..(4678): a, c, t, g, unknown or other
  modified_base (5439)..(5448): a, c, t, g, unknown or other
  modified_base (6267)..(6276): a, c, t, g, unknown or other
  modified_base (7086)..(7095): a, c, t, g, unknown or other
  modified_base (8373)..(8382): a, c, t, g, unknown or other
  modified_base (9104)..(9113): a, c, t, g, unknown or other
  modified_base (10239)..(10248): a, c, t, g, unknown or other
  modified_base (10962)..(10971): a, c, t, g, unknown or other
  modified_base (11433)..(11442): a, c, t, g, unknown or other
  modified_base (11795)..(11804): a, c, t, g, unknown or other
  modified_base (12462)..(12471): a, c, t, g, unknown or other
  modified_base (12975)..(12984): a, c, t, g, unknown or other
  modified_base (13122)..(13308): a, c, t, g, unknown or other
  modified_base (13387)..(13600): a, c, t, g, unknown or other
  modified_base (13745)..(13754): a, c, t, g, unknown or other
  modified_base (14083)..(14092): a, c, t, g, unknown or other
  modified_base (14948)..(14957): a, c, t, g, unknown or other
  modified_base (15541)..(15550): a, c, t, g, unknown or other
  modified_base (16884)..(16893): a, c, t, g, unknown or other
gcgcccgcccctgcgcccgccgccgggccggggccgtcagcggggccggggcgcgccgcgctggccgcgttgtgcaccacgcgggccaggtagcccagggcccgcagctcctcgcagaactccgtcaggtccacgccgccggtgcagagggccaggctggtccgcaccgcgatgacgtcctccagcagctggagggaagggggcaatgggtgggggactcaggcatgggaagcaccgggggagggcgggcgaccagcaggccgagagaaaggcatggggtagacgcccagggtcacatcatccggcacgctacgctgctcagggcatggcagctgcaggccatgactgtttcgcagctggagtgaatcaggcgcattctgcagcgaggcaggcacgttnnnnnnnnnntcatgattgtttcgcagctggagcgaattaggcgcattctgcagcgaggcaggcacgttctacaactcgagcagcccggtcgctgcccctccgaccttcctcccaaagtcagcactcaccgcggcctcaaagtgggtgctgggcctgatgagctggcgcaccgcatgcaccacgagggcgctggcggtggtgggcagggcctcgatctcggccttgctcagctccagggggatgccttgctgcagcagcatgctggtgtgcgtccaggcatggtcgtagcccccgccccggtaggacaggtcgatgtcaaacacagccccggccgagtggcaggacgtgtctgtctcggactgctgtgggggagcaggagggggtggggtggggtgtaatgtgtgtgtcgagccgggcatgcaagggcaggcctcgggcacacaacgcgataccgccgtggggcgccggcatggctgcaattcagctgccgaagccacaagcgctcgcgcctcctaccaggtgcctcccgtggtggctgctgccgttccgagaaccctcgcggtttggcctgctggctttccgaaggctgaagaaactcaacaggcgactcatggggcgcaccggaggcccggacatgccttacgcctgttttgagtatgtggccccctaggctcgagacggcacagcctcgggtggccagtcgggactcatgactgcaagttatacagtcacgttgggggaaggagtaatgtggggtgaatagctgcaaacaaatcccggtcgcttcgtgatcagctcagcggcgacccatttgctggagtacgaaacggttgtaggaaagcgcgaccatacgaagatccaaaaggaacatgagctacccgccctccaagcgcaaatgtgccgaccgagaagagttcacttgccatgcatggtgtagataaaggcctattgtgtaagtgaggnnnnnnnnnnttggagtacgaaacggttgtaggaaagagcgaccatacgaagatccacaaggaacatgagctacccgcccacctagcgcaaatgtgccgaccaagaagagttcacttgccatgcatgatgtagataaaggcctattgtgtaagtgaggccggcgataaggctaaagcggccatgtgctgccagtctgaggtggacaatctctggaaagaaagtccatgatattttcccaattccacgtttgtaaaaatggggctaatggcttccagtcgtgtccatgtttatttacatatcttgggaggacatttgaactgctgnnnnnnnnnncagaaagaaagtccatgatattttcccacttccacgtttgtaagaatgtggctaatggcttccagtcgtatccatgtttatcaacatatcttgggaggacatttgaactgctgtcaaactggatgtgagtcaggcagaaatgggctcgatcacaaagatacccccacaacatcattcacgagaaaccatgccccatgctcagagggaaaatcgctgagaatttgagaggcgtgcatttgttaaggagcatcgtcgtgtaggggcacgtgctccaaaatcgccccaaatcgttctgcgaccgagacatccgctccccgcgatacgattgtcctcacaaacgggtttgtttcacccacggagcatttcgttacacaaacaattactcctcgaaatggcttgcacaatgacgtgtgtccatggcgggnnnnnnnnnnatttcacccacggagcattccattacacaaacagttactcctcgaaatggcttgcataatgacgtgtgtccatggcgggtccatgcacggctcgcaatcgtcacgtcgcccagcctcccttacccgattggctcaccatgctcgcccctcatgccgtccaggttggtgtgggtccccatcgtatgggcaagctggtgctcagtacttgggaaaggactttctaggaagctttagcattccggcagcgactttctgaatggcctgctggcacatgactccagtgtcagcaactcacatgctgacgcacagggcgcgcactgacccggcnnnnnnnnnnaaaaaggacttttaaggaagctttggcattccggcagcgactttctgagtggcctgctggcacatgactccagagtcagcaactcacacgctgacgcacagggcgcgcactgacccggctccaggccggtaaagagccaggaggaggttggttggacctgagtaactttgtatcttcatcgggaaagagcggccaggatggctattccgacctgtctgaggccataggtgagcagcaatgatggaaggtttccaggagacagtgatggtagctcccgagggtggtgccattggagcaagcgttgcgattcctcatgcacggaatttacatcactcatttgcctcccaaagcttgcagcagagggtagagatctgtcccctcaatgtctctcacccacacaggnnnnnnnnnngttggagcaagcgttgcgattactcatgtacggaatccacatcacccatttgcctcccgaagcttgcagcagagggtagagatgtgtcccctcaatgtctctcacccacacaggcagggatgtctacatcgatgtctccggctggcacctgtacctgcgggacgtcaaggtaccagactcgggcggcaccaccctggcttccggactggcagcaatgctggcccaggagggggatggtgctgacgtggcaggcggcctcggccaagtgcccgtgcccctgggaggaggacaggtaggcgacttgaagtctggcataggaatttaggggagggcctggcaccatgacattgtgggagcagtcggtgctgacaattggacagacaagggggcgctccacccagcgatgagggatggaagtcttggtggatgcttccagattcaagtacatggctttgcaaaaagtgcacagtgattgtttggtgggggctacttggctcagcctgatcctgggcagtgcgcaccgacagatgttaagccccggccttctcatccctctttctggacagagaccaatattattccccctgacctcagattcttcttgcccacgcaggtcaccctgtcccttgcnnnnnnnnnncacatggctttgcaaaaagtgcacagtgattattcggtgggggacacttgactcagcctgatcctgggcagtgcgcactgacagatgctaacccccggccttcgcatccctctttctggacatagaccaatattattcccccctgacctcagattctacttgcccacgcaggtcaccctgtcccttgcggacgtgattcccaagtctggtgtgcggaacttggagaatctatttaaaggctggctgcatgacctgtagatccttttctttcccatcctatgctgacctccagcgaatgtattcgatagatatggaggaggtgccagttccaaagcaacccctcccggattgtgcaacaaccttacgtcataccctgcacatccttgtgccatgacgggccgtgtggtggggagtgctagtgataaccgcacttacttgcccacatgccaacagatttcagagatggtcaaaccagtgtctttccagtaaagtccgcgcgcactttggtgatcagcgacgatacccagtgatggaggtcggacatcgcgacgccaagggggtccccccctccggccccagcggccacatcccgtatgtcgactctatgcccgccataaacggcaaggagagtaattctgaccaggccaaggcgggagcgggcatgctggtcacctttgatgtgagtttgaggcccgcaagatcgtagtgggtgggaaaaccctggccgcccgatgcctgtccggccctgaccccccgccagcctgctcatgccccacgcctaagccccgcacagaacgttacgtacaccgtggtcaatagtgccaacaagaaggagaagatcagcctgctgcagggcgtctcaggctacttccagcccggccagctgaatgcgctcatgggtgaggtggtgctttgggctgcatgcagcggtgccgggcaggcacacagcctcgagtgtgtcccttcggcaaagtatgccctggatgtgcggtctgtggtgggcgtcccatgcctggcctatcatcgccccgcccaaggacattgccgcccccgcggtacaacctgccggcccaccgaccacaccccctctcgtcacgcaggcccctctggttctggcaagacgacgctgctggacgttctggcagggcgcnnnnnnnnnnatcccaggcctggcctatcatcgcccagcccgtggacattgccgcccccgcggtacaagctgccgacccaccgaccacaccccctcttgtcacgcaggcccctctggttccggcaaaacgacgctgctggacgttctggcagggcgcaagacgacggggaagcaggagggcgccgtgctgtacggcggcgtccagcccagcggcccctttctgcgccgctacacggggtatgtggagcagtttgacacgctgctgggcaacctgacggtgcgcgagaatctgcagtacaccgcggagctgaaggcgcgggtcagcctgcccctggccgacaaggtggcgcgcgtggagcgcagcctgcgccagctgggcctggagacctgtcagaacgtgctggtgggcacgcccgccaagcgcggggtgtcgggtgggcagctgaagcgcaccaacatcgggctggcccttgtcacctccccgctcgtcctcttcctggacgagcccaccacggggctggactcctacacctcccaggaggtcatggacacggtcgccgagctggctcgtacggggatcacagtgtgcgccaccatccactcccccacgccccacgtcttccgcctcttcgaccgcctcttcgtcatcctgcagggcaggaccgcctactttggccccaacagtgagttcagggtgtggtcagaagggggcaaagaggtgggttaggggaagactctctcacccacctacccacccatcagttccctcannnnnnnnnntagtgagttcagtgtgtggtcagaagggggcaaaggggtgggttgggggaagactccctcacccacctacccacccatcagtttcctcacccacccactcacccacccacccactcacccactcacccacccacctgctctctcacagacagcgatgtggtgcccttcttccagcgtgccgcccagggcctggacgggctgtcagagcggtccagcctgtcagacgtggagtacatgaccgacattgtggtgcagtcggaccggcagggcaggtccgacgccatcaccgattactacgcggcctccgacctggccgcccaaaaccgggaggatctgggccgcctggccggcgtgctgaacgacctcaccccctcccagcgcgagtacctggcggtgaagcgtgcgactgtcacgccctcctggtttggcctcaagacgctgatcaagtaccgcctgcgcgccgacctcaaagaccccctcttcctcctgccgcgtgtcgtggacaagctgctcattggcttcatcctcttcaccctctactggtggggtgggctagaaggagtgggactttcatttgaaggggacagtaggggacactcacaatggtcctcaaccggagcacaagacccaggtctcaactcctttgcgtcgagccgccatccgcggcgcgcctgtggtcaagcatggtcctcgcctttgaagagaaagtcctccaacccccactctctcaccgtgaccctatccctctccctctggtaatatcacccccccaccccaccccaccccctaacacacacacaatatcaggcatgtgggcannnnnnnnnncctcacattggtcttcaaccggagcataagacccaggtctcaactcctttgcgtcgagtcgccatccgcggcgtgcctgtggtcaagcatggtcctcgcctttaaagagaatgtccttcaacccccactctctcactgtgaccctgtccctctccctctagtagcaacaaccccccaccccaccccaccccaccccccaacacacacacaatatcaggcatgtgggcaaggacctctcggagcagaacatcacaaacatcgtggccgtactgttcatgtggacggtggtggtggcctactccgcctccgcctacatccccgccatcctcatggagcgcccgctcttcatccgagagcgctccgacggcctctttcgcgtggtcacctacctcggcttcaagctgctggaggagttttcagtgcagttcatcctctgccttcccatctcggccatggtcttctacccgctggagctgtccggcagctgggccctgttctggctggtctactacttcaccaccctcgtcggcatctccctcggctacttcattgccgcgctgtcgccaaacatggacgttgctaacgccgccctccccctctttatcaccatcttcctcttcttcaccgggctgctcatccgatgggtggacacaccctggtactggaggtgggtcggctatgtcaacttcctgcgctactcctggggggccctcatgatcaaccagttccagggcgccaatgccatctacctggggtcggaggtgagaggggagagggaataggggcattccaacagggttgtttagtgcnnnnnnnnnnagaggtgagaggggaggaaggagtaggggcattccaacagggttgtttagtgcagtgtcatgtgaaggcagggtgggcgcatgccgctgcgcctgcaagcaacactcttcacgctggtggtcctgggtggtggagcaagtgcacgcgacggctcctgtgtgggcagcacccatgccatgcctgctcaagacacctggtgaacgcctctgcccccccacgcgcccctgtaccaggtcctggagtactttgcgctgagcgggtacgctgcctggcagttcttcggctatctgaccatctttgtggtggtgttcagcttctgggcctggctcgcattggccttcatcaagcacgtcgtgcgatgaagacggccccatgggaccacaggcgaccttgatatatcttgtttctcctttgctcatcactttgtaaatatccgatcgatggcgctccatctgacatgtcgcacgtgggggagaccaggctggtcgagtcccatcccgtcgtgcatgtgcgatgatcatggtgattgtacgcgacattacgttcaacagtcgcggcgctagggtccggtggtgtcggtccgttcattgaccttgggtattttgaacatttgcaatggcttccatcgctctaggaagcattaggtctccatgcggggcagtggtacggcccccggcatctgcatggaaggcaacatggagtcctcggcgcatgcccagaacagcaaggattcctgccctgcgaactgatcgtgcatctggaaaagttgctgttcgggagcaagggggtgtctccttgcgaggcacggtccgaaagcagaacgaggatcgctacattgtgcaggtgcatggtaggaatgaccgtcagatggggattggtcggggagtgatgtaccggaaagagtagactcagccactcacctccatgctcctctgcatgcccagattgccccagagagtgccaagggtggcggcctgctggcatatgtgggggtgtttgacgggcatggcggttctgcaaccgcccaatggttgacctcagaattggatggctaccttcaagaggcatggcagcaggagacgaatccgggtgagtagatggcgaagattttgtgtgcagattggttgatagtgtgtcgagctgatgcgaatggatgctcctgcagaccctcgaaaggcctgctgaccaagtccagccttgcacacgatacccatggttccatcttgagccattgccccaatttgcccctcctgatgttcagaagctgctgtcagggannnnnnnnnncgctgaccaagtccagccttgcacaagatacccatgtttccatcttgagccattgcccccatttgccactcctgatgttcagaagctgctgtcagggaggccttcatcgctgctgacaaggcggtgctggcgcccaagcccggcttcttggggatggtcggggaacgtggcaaaggcgggtccaagtgtgggtccactgccgcagttgccctcctctacgaggtatgcatattgttgaacggggcatcacacgagggtgggttttgtgtatatgagaatgcctgttcctgccattcaaagacctgaggcatgtcggaattgattggcgctgccatgtaccgcgccttgcctccccgcaactcgtcaggatgctcatgcaaccaagcccctcacaacacctgctgcagggggacgggaagacgtgcctggtcaccggcaatgtgggcgatgccagggtggtcctcgtgcagggtggcacctcctaccagctcaccaccgaccatgtccccgacagcgaggatgagaggctgcgcatcgaggcccagaaccctaaccccaagatgccgctggtgcggtacgtaggcggtacatggcgcgtcggaggcatcctggcgctcagcagggcgtttggggatgcgtacctcaaagtgagagctggacaggcgtgatggaatgggcaatgggggagggctgaccatctttgcattgcgcgggctcgttgnnnnnnnnnnggtgacggaaggggcaaggggggaagggtgaccatctttgcattgcgcgggctcgttgagaaatgcggaaagagggccttgtgtctgtcgcagcccagggctcaattgttttccctcaagcagtcacgaggggacacatccagcaactcctctctaccacaccgtgtaacctcctccacatccctctcctggcatccagggtagcggacaatttgagggcgtccgtgcgggaggcgatggctactcctctggctttggagtcgttgctgaggtacaaatcatgatgtagttgggaatagtgggacaggacttccctccggatgtcctctcctgagccactgtacttggccatgaaccaatagacacaatcgcacccaaggttagggtgctaaattcccttcctctactcatcttacctgcgcagccatacacagagaccagggagctcacggcctctgacacctggctggtggttgcatcggatggactgtttgccaacgaggagcgaggtggtgggggaggcctgaccaaccaggaggtgagcagaaattgtttatcaggagctgcttcaacaacttgcccagtcgacatggcactggagcgtgtggtactgccacgagtgtcgtcgctttcctgagagggaccatgcgtgcgcttgcagcgctatcccttccagtttccactctaattttcacccgtagatcgcggacgaactgaagcggaagtcttccctgagctgcgaggctctggccaagcacctggcagccgttgccgtggagaaggggtccactgacgatgtgacggtcgtggtgctccgattgggacaggcgtagcggcttgcagctcagccaagggcattggggggctctgcgtcaggtttgctccctgatatgtgtggacagctgcaccacgcaattcacccctgcagctgcctcaggcctccttcttgcctcgctagtatcttgctctgctgcactccagcattcaggcaccccttttgattcgcgagataatatctcgagtctgggatctttgtaacattgccaccatgcacatgccagggagggttcccaggccccaagccaggatattgtcgggctcaatcgcgcatgctgtcctcgtcctnnnnnnnnnnggtatcttgctctgctgcagtccagcattcaggcaccccttttgatcagcgagatagtatctcgagtctgggatctttgtaacattgccaccatgcacatgccagggagggttctcagggcccaagccaggatagtgttgggctcaatcgcgcatgctgtcctcgtcctcaatcttcggagccaggtagaatgcaagtcggcccacctccgggatgtggtactccaccaggatcgggagctccttgctgagcttcaggacggcgtgtgtgctcaagggggtcgccttggcgaagctgcggggagcagaaggggtgccgagcggcgacatgaggagctggcaatgagctcagtaaaagacagaaaggtggcataataaaggaagcaatcccatactccaagctgtgcaggacacataactccagccaacctgttgaggtatcgcagggcaaacgtcagggacacggcctcgttgatgtcaatctccgtactctcgtcaggctgtgagacagtgaaatgggatgttgtggatgaaaggagcaggtgactgtattccacacaagtgtcactgcttaaatacttggagctcacaatgctgcatacgacgatgctacaagagatatgcatacaggcagactatatccagagcatgtgctcctctgctcctcctcccctccacaagcataccttgtcagcagccttgttctgtcggcacnnnnnnnnnnaactgtattccacaaaagtgtcactgcttaaatacttggagctcaaactgctgcatgcgacgatgctataagagatatgcatacaggcagactatgcagagcatgtgctcctctgctccccctcccctccacaagcacaccttgtcagcagccttgttctgtcggcacatgatgttggcattgccaatgtcacccgtggtgccaaacttgacagcgtccttggtgacgctgatctccaccgtgtctccgatggtggacaggtccttgacgatgcgctggaactcggcggcgggcagcttcacggtggcgtcatattcgttgtctgttggagaggattggggttgagcctggcagccttggaactgacatttctgtgaagtataatgtcagcgactctgcaataccacacgttgctgtgggcccacctaccacctcaactcaccagggatgccaagatgctcnnnnnnnnnncttctgcgaagtataatgtcagcgactctgcaatgccacacgctgctgtgggcgcacacaccgcctcaactcaccagggatgccaagatgctcgctgtcaatgtccatgagtttcaagtcaaactcggagaggcgttcctgctctgttaatatcataagaaagggggaagggtgcctgtggggacactgacagatgaccttgccagcaattgcatagaccgagggtggtccaggtaagatttagggcccgcactgctaggttaagtctcaataagcaggacctaggtcatgcatttctcagctgaggcaaaacccaggtctttatgtgcaacagacgttggccatgcaacacnnnnnnnnnntgcactgcaaggttgaagtctcaataagcaggacgtatgtcatgcatttctcagctgaggcaaagtccaggtctatatgtgcaacagacgttggccatgcaacacacctggggactcaaacatgaaggtgatggtgtcgccattgtcctcggacttcattgtgatggcgtcgtcgccgttggcacacttcaggatcttggagaggctagccagcttcatccctgtcgtcatgtcgggggtgcggattaagaacctcagggcttgagcgcactcagcatatgggcaccataacagtctgtgctggcaaacatcgccctgcatcccctcgaggtcatgcaacgccatctgatcacacactgaagctcacccatgctgacgttgcgatcacaccggtagtgctcgaagccatctgccctcagggacagagcgactagggacacatggctggagtccatggcctgcaagctaaagccgctggagttgcagtcgaagtttgcatcttcgatcaagtccttgatggcctccaccacctggcgtgaggaggggcggaggagacatacgaggagtgggcacgtcgaaatttgaaactcccgtgggccattactcgaaatcccggtagcgctatcaccgatagccgacgtgattgcgctattaacgnnnnnnnnnncggacatcagtcgagatcccggtagcgctatcgccgatagccgacgtgattgcgctattaacgtagaactctgtgggttgaattgcgatcggatagccatggcagtgccgtgtaatcccgagccagagtggcgtaccttcttgagcagggctccctgtgcaagacgcgcctcaaacattctgcctagtgtgcgaaaacggcgggcttcagaagatcgggatgggaagtgctatctcagatcaggaatatcgaatagacggtagcgggatcgagtggagtgcaggtgaagagtgtggcagctcgcgaacgcccgcaagtttgaatcgcttcccttcgttccagtcggccatcccctctttccagcacagggggaaagttgatcacagcgatggatcttctagccgtataccttcagcgacatatcgacgatgccttgatacttggttctcctgagtgcatgagtgcattggcctaagcgacgacttcttgctttgagccctgcgnnnnnnnnnnaggggaaaagttgatcacagcgatggatcttccggccgtataccttcagcgacatatcgacgatgccttgatacttgtttctcttgagtgcacgagtgcattggccgaagcgacgacttcttgctttgagccctgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgtgtgcggcgggttggaatccattctgcttggcacgactgaagcctctaggaactcactcactcatgcgatttaccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtaatcatgcccaacctggttccgccagtcacgacgacccccatggtgggcagcgactgcatgctttccatgtatggtgctctgtttgggaaaggctgttacttttgtcatgaaaggaacagcatggccaagacgtgagcatcannnnnnnnnnggcagccaattggctgtggcgcagcgcagccgtcacaccaaatagaaataggtgcagggtgtccgaggacacacgcacgtcggcttttcaatgtcaagctgtcgctggttcactacggtgaatccggtgaagcaaatctccagcgctcaacgagcaggtgtgtgcggagggttggaatccatgctgcttggcacgactgagccaataggaactcactcactcatgcgatttaccgtttggagtggtatcttactgcaatctttcccccaatgtgctagggtcgacagcgagggtttcatttgttactgcgtcttccaccccgtccgtgnnnnnnnnnncggagtggaatcttactgcaatctttccccaatgcagtagggtcgacagcgaggggttcgtttgttactgcgtcttccaccccgtccgtgaccagcctgacgatcatcaggcctgacgactggcacctgcatgtgcgagacggccccggcctggcctccgtcgtcccgcacaccgctgagcactttgggcgagcgattatcatgcccaacctggttccgccagtcactacgacccccatggtgggcagcgtctgcatgctttccatgtgtggtgctctctttgggaaaggctgttacttttgtcatgagaggaacagcatggccaagacgtgagcatcaaacagccactggaccagtactctgtgtctgaggccacacaccatgcatccatacaccgcaggcgctggcgtatcgggagcgcatccgtgcagcagtcccgtctgcttccagcttccaacccctcatgacactctacctgaccgacaacaccagtgtggaggaggtggagcgcgcggccgaggcgggcgtggtggccttcaagctctaccccgccggcgccacaaccaacagcgcctccggggtgacagacccagacctgtgcctgccggcgcttcgcgccatggccaaggtgcgcctggggggcttggtgatgggtacccggcacgggtgcacatcagaccgggatcacgcaccaaggcgccgatgtgcggccctctacattagcgcttggcccctccctggcctcgtgtcttccattcaggggccagaatgaacctcaatggcacacgcctgggtccgccaccccgccccagcctcgttctgagcctggcgcactgtggttgggggggtctgggcnnnnnnnnnncggcacacacctgggtccgccaccccgccccggcctcgttctgagtctggcgcactgtggttgggggggtctgggcaggctgcgctcagcatccggcaccactcattacccccctgggaccctattcttgccacaatatgtgcaatggtgtttccatactcaatcctacattgcatgacctcgcactcttctgaggcagcagctcgcccattgcagcatcccacggtcgcatggatcaatctggtgtggaaccacctgcccactctgtcctgggtagcaggagttcctttgacaagagcatcactcaccaccccttccttgtggaatccaggcgaagatcgtgctggcagtgcatggcgaggtcacagaccccgccgtcgacttcttcgacagggaagcggtcttcatagagcgcgtcctgcgacccctcctcgataaggtggggccgtggggcctgttgatcttacgggcacgttgagctgagttcggtttccaggagtccactaggctatgcatgcgggcgtcggcatccctggcgtattggggggatataaacttggcgtcctgccattctgtgtcacccnnnnnnnnnntcacctgcccactctgtcctgggcagcaggagttcctttgacaagagcaccactgaccaccccttccctgtggaatccaggcgaagatcgtgctggcagtgcatggcgaggtcacagaccccgccgtcgacttcttcgacagggaagcggtcttcatagagcgcgtcctgcggcccctcctcgataaggtggggctgggggcctgttgatcttacgggctcgttgatctgagttcgttttccaggagtccactactcattgcatgccggcgtcggcatccctggccaattggggggacatgaacttggcgtcctgccattctgtgtcacccacccccccagcagcaacagggtgtggaatccgcctcctcacccaacctggcccccacccaccccccactcctgcactccctggtcaggtcccagacctcaaagtggtgatggagcacatcacgacccgccaggctgccgactttgtggccgagcacgccggcaccgggcgcctggccgccagcctgaccccccagcacatgctgctgaaccgcaacgccctgttccagggtgggctgcggccccacgccttctgcctgcccatcctgaagcgggaggaacaccgccaggccgtgctggcggcggcctgcagcgggagcccggccttcttcctgggcaccgactccgcgccccacccaaagcacgccaaggagtcggcgtgcgggtgtgcgggaatatacagcgcccccgtggcactcggcctgtacgccgccgcgttcgagggcgcggggcggctggaccggctggaagggtttgcctcgctccatggacccgacttttatggactgccgaggaacgctggtgaggcacggggctggcagagtccgatgtggggcgtgcaagtggatgggccaagcttctgcgagtcactcgcgtggaccccctcagatcatgccatgatgacgtggtactcaacccgggtctccaacccgctgcagacaccgtgaccctggttcgggaaccctggcaggttcctgcctcctaccagtttggagagggggaggtggtgcccatgtgggccaatcaggtctgtgactggagggtggcgagccccgcctgactggcgtcgccacgttggcggccgctcaacattggtgcactgtgaggacccatgggcattgcggcttctgaaatccaaacccagaaatatatatacttctgtttcggttgtacaaccacctgtgtacttgttcaagccccggacatgccaagcttgtaatatttgacgagtgagacggtggtggccttagtacatcctcaggcctgcgcgcgcgcggatggccnnnnnnnnnncgacggtggtggtctcagtaaatcctcaggcctgcgcgcgcgcggatggccgtccgtgtgggcgtgggcagcgaccagtgccgtggcatgttcacccggtctgcaatatgaggatgcaacgatccacggagctttacagcagtacatcacccaaaggcatgccccgtggaacgtcgtgagcttcggaggtcccggccgtgctcaaggatgaacgggacgagtctcttctcccagtcctactccgatgcccaggcccccttcgatgctggtgacatcacggccacccagctcgggagtcaggtggatttctcctttctggacttcaacacccaggaggctggagcggggtacccagaccctgttcctttcagccaggtgcgttcccctggcgcgcccctccgcggccaagggggaggccgggtgcaggcttgaccacatgccatgacgctggccctgagccccagatctccgcatcgaccactgattccacaccgccgacctgggcgcaggtgccggatgcgagcgtgggcatcgtgtcggccccttcctcgcagggggggggcctgggcctggacgggcccctctccgagacgggcctcagccagctcagcctgcaggacgcctttgatgggttcacggacggcgccccagaggccgtcatgaaggcgcccgagtgggcctgcgcgtgagagtggagaggctgagttggacagtctttggggggagggaatcccccctgctgggcggcgggggcctcgcagacccttggatgtgggccatcagtcacagggagggatcgtgctgactcagccatgcacacccctgcgccatcgccgaccacgcccactggtgccccggccccgccccaccttctcccctcccacccccacggtcccatgcaggtactgtggcatccacaaccccgagtccgtggtcaagtgcctgaccacgggcaagtggttctgcaacggccgcgtcacggggacggcctcgtgcatcgtcacccacctggtacgcgccaagtgcaaggaggtgtcgctgcacaaagactcccccctgggcgagacggtgctggagtgctatgcctcggggtcgcgcaacgtcttcgccctcggcttcgtgcccctggccggcgagcacacggtggtgctgctggcgcgggacacgccgccctcgtccccggctatcaaggacttggacctggacctgtcggcctggtcgccgctgatcgaggaccgcgcgtttgtcggctggctggtgcggccgccggaggcgggggagatcgctcgcgcacgccacgtctccggcgccgccgtggccgcgctggaggaggcctggcgccgcgacccgaccaagggcctggacgacctggcgccgccccgtgccgaggacgagccctgccccgttgcgctgcggtacgacgacgcctaccagtaccagaacattttcggcccgctcatcaagctggaagcgggtggggatggcggggatgggggatggcgggga

SEQ ID NO: 48524 - DNA, 61 bp, Chlorella protothecoides
gccaggcacagggacatcggagttgcctgccacccctgctccgatggccgcgtgccacgac

SEQ ID NO: 48525 - DNA, 417 bp, Chlorella protothecoides
  modified_base (117)..(336): a, c, t, g, unknown or other
gaggccgcagcgcccgcccacccagctcctttgcaggggcatgcattcccatgggacgcgctcttacccaagcctgttctccgcctgcgcctcacaggtagcgctggcggaggctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcccttactccctcacagtcccaacctgggacccaacccaaaacacccccattcagcgctttgtcgacaccccaccgcagg

SEQ ID NO: 48526 - DNA, 72 bp, Chlorella protothecoides
tcggaggctttgtccccccgcccaaccctcccactcacccctcccaccacccttgtcccgggcagcttgcca

SEQ ID NO: 48527 - DNA, 76 bp, Chlorella protothecoides
aatgcgggcctcacgacacgacgactgcgacgcaggcgtcggcaccccaggcccagggccgctcagcgacgccgac

SEQ ID NO: 48528 - DNA, 61 bp, Chlorella protothecoides
ccagcagtgggagttgtcatggtcgtggatatgggagccctggcctggctgccagcacacc

SEQ ID NO: 48529 - DNA, 245 bp, Chlorella protothecoides
tctgggtgccggggaatggagagatggggcacaccgcagcagtggggggttgcctcctgcgctgcaggtctacgagagctgctgtcgcgggcaagtcacccgttatgcatggtagggccacaggaactgtgccctgccccggcacgccacactccgctcccaacaaccgtaccttaggcacccccttgccccaagtggagagcaagggactgcttggcctgtccagggagggccggcgtcaccca

SEQ ID NO: 48530 - DNA, 76 bp, Chlorella protothecoides
ggcgtcgcccaccttcgtcgctccggggacggtgggctgggcgacgccgcgccctgcctcgggccccgggcaggcg

SEQ ID NO: 48531 - DNA, 61 bp, Chlorella protothecoides
tgatactttctctgcagccatgaggaccgacccctctcgtcaacggcttgcaggagaatga

SEQ ID NO: 48532 - DNA, 103 bp, Chlorella protothecoides
ctgagcgccagggcaggggtgcgcagggaaaacacctggccacagcacgaagcaccacctgacccagcttagagacgctatcaggtgaaggcacgcaggaaac

SEQ ID NO: 48533 - DNA, 61 bp, Chlorella protothecoides
tcagccccggtcctcctgcagcaaggtgggcgtcgtcctgtgtcgagtgaaaactgttccc

SEQ ID NO: 48534 - DNA, 61 bp, Chlorella protothecoides
accaggccgtggattgcatcgcggcggcccaccagccgctccctaggcggcgtactcagct

SEQ ID NO: 48535 - DNA, 61 bp, Chlorella protothecoides
tgaagggaccaggagatcagccgcaggaggtgctgtgcaagggaaggcacgcacagcaggg

SEQ ID NO: 48536 - DNA, 88 bp, Chlorella protothecoides
ttgctcgaggctgccccgctccagggatgtcatgggcaggtcaccagccctcctgctcgaaactcacaggaggagcgctggctgcaag

SEQ ID NO: 48537 - DNA, 61 bp, Chlorella protothecoides
attggacaagccccgatgccctcaatgatgacttcagtttgacagactggaccggcagcga

SEQ ID NO: 48538 - DNA, 61 bp, Chlorella protothecoides
cagcacgcggtcgcccttggcgatcagcgacgtgatgcgccctgaagtccattgggaggag

SEQ ID NO: 48539 - DNA, 70 bp, Chlorella protothecoides
atcaactacgagcgagacgagaggtgaggggccgcggtgattggatggtgggagggcgggggatggggtg

SEQ ID NO: 48540 - DNA, 61 bp, Chlorella protothecoides
ccccgtcggcgcggcgctggcgttcacggaacccaccgacggcaggcgggaggagggcgcc

SEQ ID NO: 48541 - DNA, 61 bp, Chlorella protothecoides
tagctttaggctggtgggtcatttccgcagaaacctgtcttggtagcctggatggtcaagc

SEQ ID NO: 48542 - DNA, 61 bp, Chlorella protothecoides
ttctcaatgccgcccttgttgtatttctcatgacactgaagcagcgccagcagcgtcgtca

SEQ ID NO: 48543 - DNA, 61 bp, Chlorella protothecoides
agattcagagcgtttgcgcactgtactcaccagtgtacggctcaagcatggcctcgactac

SEQ ID NO: 48544 - DNA, 61 bp, Chlorella protothecoides
gaccagcggcaagcgcgaccgcggcggggcacccttgggcgccccaaaggcaggggaattg

SEQ ID NO: 48545 - DNA, 80 bp, Chlorella protothecoides
acgtgctgaggggtcggagccatgcagtgcaggggccatacgaggggcgagcgaggatggcagccgcgatcacttggaca

SEQ ID NO: 48546 - DNA, 103 bp, Chlorella protothecoides
agaccccacagacccacccccaggccgagcgtcagaaccaggccgagacccagaccctgtccgcaacccaagttctggcggagccccgctcccaggacgagcc

SEQ ID NO: 48547 - DNA, 61 bp, Chlorella protothecoides
tcaggccgtttcgaacctttgcatggcggcacctgcctcgagtccatgtgccgccctgtcg

SEQ ID NO: 48548 - DNA, 67 bp, Chlorella protothecoides
ggcttgcgccggttgcacagctacgtccgcaaggattaggctggcgcagttggttgcctctgacggc

SEQ ID NO: 48549 - DNA, 61 bp, Chlorella protothecoides
ggccgctgtgactgggaacaagggcctgaacggggcagaggatttggccaaggaggccaag

SEQ ID NO: 48550 - DNA, 74 bp, Chlorella protothecoides
tcactcgaggcggacgaggagcgggccgcttggcactcaggctcctgtgttgttctgcgccgaggcctccactc

SEQ ID NO: 48551 - DNA, 109 bp, Chlorella protothecoides
agttgaagaggtccgccgctgccaccagggtctgctcgatcccctggggaaccttcatggcggcgagctcctgggtgttgggaaatctgcagtgaccatgatcgtccct

SEQ ID NO: 48552 - DNA, 61 bp, Chlorella protothecoides
ttgttggccatgcgctcctgggcaatgagcaccttctccgagccgttgatgatgaagtagc

SEQ ID NO: 48553 - DNA, 94 bp, Chlorella protothecoides
gtgtgcatgtgcgggaagggagggcgaggcacaggtccagccccatgcacacacgcctggctgttatggggacaccctccaccacccacccacc

SEQ ID NO: 48554 - DNA, 61 bp, Chlorella protothecoides
ggacgcatgccggtccaggacctcggccatccggaagaggagaggggaggggcgcttgctg

SEQ ID NO: 48555 - DNA, 120 bp, Chlorella protothecoides
ccagacctgccaatggaatgaggcttgcatctccatctgaagctactcaagagctgagcgatgggagcccatgggccagggcatcgaccatacccttgaccgtgatttccaccttcccca

SEQ ID NO: 48556 - DNA, 61 bp, Chlorella protothecoides
ggcagggtatcaataccctgcagtggcaggtgtgtagagggcactgcgctcccatcggtgc

SEQ ID NO: 48557 - DNA, 61 bp, Chlorella protothecoides
gtgggggtgtggggggggggtgcagacatgtctcataggtctttgccaaatttggagggcc

SEQ ID NO: 48558 - DNA, 97 bp, Chlorella protothecoides
cctgtgggcgaagtgaggtgacaggaggggcgcactcatgcagactcaccagcctgatggggggcactgccagctcctggcagaggtctcatgcact

SEQ ID NO: 48559 - DNA, 68 bp, Chlorella protothecoides
tgctcctggctgggcgcctggggtcccgtctggagcatccttgctggaagccactggcctgtctgggg

SEQ ID NO: 48560 - DNA, 61 bp, Chlorella protothecoides
ggctcggctgcacgaagaggcacatgtggggtctgtgctgaccgagagggcagctcttgcc

SEQ ID NO: 48561 - DNA, 61 bp, Chlorella protothecoides
tgtcgtcgccgccgccgtcgccgcgccacaaccccagctcaggggccgtcagctccttggc

SEQ ID NO: 48562 - DNA, 61 bp, Chlorella protothecoides
gccacagcctgctggtcaccttccgcgtgtttgccacgcaggggccggccctggaccgcgt

SEQ ID NO: 48563 - DNA, 80 bp, Chlorella protothecoides
accactcactccagcacttgggctgctcgacaaatgatagggaagccatgtgctgtgtctctgggtgacacctcatttgc

SEQ ID NO: 48564 - DNA, 61 bp, Chlorella protothecoides
agcaggtgaggggaggtttgtggcagggggggcactggccgagcgacccttgctcctgcac

SEQ ID NO: 48565 - DNA, 65 bp, Chlorella protothecoides
agcgtagccacatggcgcccagactcgaatccaggcacccccccccaatgcagtcctcacccctc

SEQ ID NO: 48566 - DNA, 94 bp, Chlorella protothecoides
aagctggggcgccacattcaaacgtatgctgaacatctacccgcctgtggaccccctcatccctcccttctatgaccttgctgctggtctggcg

SEQ ID NO: 48567 - DNA, 80 bp, Chlorella protothecoides
agtgctctcggacctccggcctctggtccaaaccatcggcccccattcagtcacgtttcagactggtgtgcattgccttt

SEQ ID NO: 48568 - DNA, 78 bp, Chlorella protothecoides
atggatgcatcccaggagccgggggaacaggctcgtgcgtgcgcatgcatccagaacagacaggcacacttgtggtag

SEQ ID NO: 48569 - DNA, 133 bp, Chlorella protothecoides
tgtaggccattaccccggtggactttgagggggtcaaggcggtctccttcgggtttgcaggacagggcagtgccatcatgaggggagccatggtctcaggtgtgtgtggggggaatcggggacgtggcagggg

SEQ ID NO: 48570 - DNA, 61 bp, Chlorella protothecoides
gcaagcgctctgtgtgaccctgcactgggcagcgctggtgtttggcgtgatcctgccgcag

SEQ ID NO: 48571 - DNA, 18896 bp, Chlorella protothecoides
  modified_base (1664)..(1673): a, c, t, g, unknown or other
  modified_base (2279)..(2288): a, c, t, g, unknown or other
  modified_base (2494)..(2503): a, c, t, g, unknown or other
  modified_base (2662)..(2671): a, c, t, g, unknown or other
  modified_base (3202)..(3211): a, c, t, g, unknown or other
  modified_base (3555)..(3564): a, c, t, g, unknown or other
  modified_base (4064)..(4073): a, c, t, g, unknown or other
  modified_base (5388)..(5397): a, c, t, g, unknown or other
  modified_base (6755)..(6764): a, c, t, g, unknown or other
  modified_base (6889)..(7072): a, c, t, g, unknown or other
  modified_base (7243)..(7252): a, c, t, g, unknown or other
  modified_base (7384)..(7393): a, c, t, g, unknown or other
  modified_base (8907)..(8916): a, c, t, g, unknown or other
  modified_base (10067)..(10076): a, c, t, g, unknown or other
  modified_base (11038)..(11047): a, c, t, g, unknown or other
  modified_base (11478)..(11487): a, c, t, g, unknown or other
  modified_base (11811)..(11820): a, c, t, g, unknown or other
  modified_base (12116)..(12125): a, c, t, g, unknown or other
  modified_base (12237)..(12246): a, c, t, g, unknown or other
  modified_base (12784)..(12793): a, c, t, g, unknown or other
  modified_base (14176)..(14185): a, c, t, g, unknown or other
  modified_base (14777)..(14786): a, c, t, g, unknown or other
  modified_base (16392)..(16401): a, c, t, g, unknown or other
  modified_base (16573)..(16582): a, c, t, g, unknown or other
  modified_base (16814)..(16823): a, c, t, g, unknown or other
  modified_base (16992)..(17004): a, c, t, g, unknown or other
  modified_base (17183)..(17192): a, c, t, g, unknown or other
  modified_base (17269)..(17278): a, c, t, g, unknown or other
  modified_base (17751)..(17760): a, c, t, g, unknown or other
  modified_base (18092)..(18101): a, c, t, g, unknown or other
  modified_base (18171)..(18238): a, c, t, g, unknown or other
  modified_base (18302)..(18311): a, c, t, g, unknown or other
cacgagccccacacctgccaggctctgctggtgcatagcagccttggcgaactcggcgctgctgcgccagcggaagcgcacgaaggccagggtcttggccgccgccacgtgaacgtcctccactgggccccacgccccaaacccggcacgcaccgcagcgtgcacggcactgggttccacgccggcgccgccgtagttgacgtacagcgtccggcactcgcgctcgtaggagccggtgccacgcttgcggccgtcgcgcgacgccgggttgcggtcgcggccgaagatgtccacggcgtggtcgcgcgcgtgccgcgcctccatgccctcatccgggaggcggtgcaggtagttgcactcggcgccgtggtggcacaggcccctgctgtcgagattgttgtgggatccaagggtgagcgccgagacgggcaacaggtatggagcagggattgtaccccttccccacacgtaatcgtcgaatgtgcccactccacaacccccccccccctcactcagggccccacccacctggcaaagtagaggcagcagtaggaggcgccagacccctcccccctggtccagccctggtcggtctcggggtggcacttgtacttggatgccaccctgggccccttctcccgcgcgccatggccagcaagccggcgccccgtccaaatgttcacggtgcccgcggggtgcttctcctcacgaccggtcactgcctcatggacctgcgggaggaggccatgtgcattacaagtcatggatgtggacgggaacagcagcctggcctgatatccatgcaatgctggaggcgcacctgtgctcgggccagcctcctcggggctgtggctgtgagctccatggccgaggacttgtctcaaggctcacatggtcatttggaatcgacagtgaattgggagaatctcaaacggccatcactgtgactagcatggtcgccttggcgccctcaccatcgtcaccatctgtgtgtcgcgcactttcgacaaacgacacctggaacccttgtccggcacgcagatcacgagcatggctccatgccttcactgcgactgaagccaccgatgactgtttctgactgaaatagcgaggtcacaacaggcaattgctctggcttttccacaaccatccacgctgcgtgggttgggcagcgcgtgagctcgttccaccacctcctgccctgtttgcacccctcccgccccatgtcggtctgaaagtatggccgatcgatccgatgacggcttttcccgcatgcccagcctgcaccaatcgttccgggaggcgggggattggttcaaggagctcggtcgtaccttggcattcagtggcgagcccttccaaagcacgtccctctcgcgaccctccttcgaccgcccaatacctcgcaccggaaatttgaccgacaagcaacaggtttgtggggtcgaagctggaggttgatgtgctaatggtgcgggtgacactcctcgcttcacggatggttgtgctggggggttgcacaggcaggttctgtgcccctcacatcagccctgcagcagccagcacacctggcattatgtgcccaaccgtacaacatgccgatcactgtcgttacaaacgccttaaaacccctgcccctgccccagattgtcgctggggtgctnnnnnnnnnnacccaaccgtaccacatgccgatcactgccgttatcaacgcctcaaaacccccgcccctgccccagattgtcgctggggtgctgctgaaatatgtcaacttgggggctggatggcggcatcgtctgtttgtcctggaggatggtgtgcttcggtactacaaggtgaggctgggcaggggcaggatatacgatgggcacatggctctcaagcagatgattgcacgagatcttcttctgtggatagagtggtagtgtccctgctgatgcacaaaagcccatccccccctcagatctttggccctgctgccatcaagatccacatgcttctggactccctgcgagccaagggagagatcttcctggtcggtgctgaagtgagcatgctagagaaccgcgatcggaggtgaggcatgggaagggggtggtggatggtcgtgtccatgcgctgtggagggaactgggtcgctgcgctggagccctgcaagtaggttgggatgcagctgccctctggactgtgttttgcccttcagaatattctggagagggacaggttgacagtgacccagccctcatgtaatctcacctccattgcatgcttccccatgnnnnnnnnnncaggttgggatgcagctgccctcttgactgtgctgtgcccttgagaagattctggagagggacaggtcgacagtgacccagccctcatgcaatctcacctccattgcatgcttccccatgaagcaggagcagcgccggagggaagcaggggtcgggcagtggccgcctgccccctgcacagggcgagatccatctccaggtggctnnnnnnnnnnggagggggaggaggagcgagcaagtgcgagtgcactgtctatgagcggcattctcctggacccgggttcactcggaagagatcgggccggcgtggcatggcttcaagacccacacgctccgagtcagggctcgtggggccatgctctgcgtcacgtgcnnnnnnnnnnagagggggaggaggagcgagcaagtgtgagtgccctgtctatgaccggcattctcctggaccggggttcacttggaagagatcgggccggcgtggcgtggcttcaagacccaaagcctccgagtcagtgctcgtggggccatgctctgcgtcacgtgctcgctctcacactccctctggcagggaggatcgctgggtttggagcgaagcgctgcgggctgccaagggagcctggcaagggctcactccctcggaggcgggcgctttggcacgagacaatgaggacaggtgcgttccagctcctgtgcatggttgggtggggtatgtctgctggggagatgggtggggcccaagctctgatccccagcctggcggtgcgcaggggaagcagggccctgtggttggtagggcatgggcgcctgggttggggccttggctgcagaagggcctccacccatggcacggagcacagcgttggggcttcatccctctccaacaattgctgctgtgtgccctgcaggatcctctctgnnnnnnnnnncaagggcctccacccatggcacggagcacacaactggggcttcatccctcgccaacaatagctgctgtgtgccctgcaggatcctctctggcgacgacgtcttcctgcagtacctttccaccgtcgaagataatcttgtgtccaggaatgtggactctgccgccagggcctacgtcgccgatttgctggtccaggtgggggtcattctaggaagatgggttggagggtgggatcgttcgtggcacccggccccagccctggtttgacacacactgagcttcacaccatcaccgtatggcatcgtgaaggccacgggggtcatcatgtctttcaaggggtttgtnnnnnnnnnngcacactgagttccacaccatcgccgcatggcatcgtgaaggccaggggggtcatcatgtctttcaaggggtttgtatctggtggcgactgggccagggctgtaatacaggggcccggcatccagcgcttgtactcaaagcgcacggcggggcgcgctgctgccgctgcatcaggcagtgcagagacccagcgtcacctcgaatccacccactccccgcacaggagcaccagaagctgcaccaggtcttggttgcagaggcaaacaagcgcagctctctgctgaagaggatctaccagctggaggtgaatgagcgggggaatgggggagtcgacttcctgtggccctgcagcggatgaggcggtatgagcctggcagccggagggtttggacccgggctgcaggcctgcttggtagcccctcttgcgctgagcacactcgaagtacagggccgccgcaccgcgtcaggtagccgccaggctcagcccacactccgtgccnnnnnnnnnncgccggggatgaggtggtatgagcctggcagtcggagggtttggctcagggctgcgggcctgcttggtagcccctcttgcgctgagcacacgcgaagtacagggccgccgcatcacatcagcaagccgccaggctcagcccacactccgtgccacgcagaacgagaagcgggagctggaaacggccatcgtggtggaggggcggcaaacctcagacaaacggatatcacccagcgaatctgcttctggtgcggcgatgggatggtgttcaccggcctcccttgtctgggctagaggagggcaggtcgtctggggtttaaggagtgcagtgtggcagcgctgcagattcagccgtcttaatccctggccgcggcctgaggcgtgtcggaggctgggggtcaggccttcatgcaccatgcttggcagatccggcagccgtgtgctcgacaaggcgctcatacgccaatgtccctctcccttcatcctgtgccagtcgtgtcggatggagaggagagggaggaggaacgcgtcagccacatcttctgtgctgacggcggggacggcaacgagacggatgatgtgagtggctcggcggtcaggctgcctgctggggtgtggggctgtcttgtgtgtcgatgtgtggaggaggagacccacagatgctccttgtggtgggtcgcgcgggtggaatttctggggtcatcgggatgggaagcaggacctcccgcgccgcagtggggcagaggaccctggcgcagggctcagggcacgcatgggtggcctgcccctcgctcggtggccctgcacatgcacgatctctgcctctgcacagtcggcgacgcccagccccccgcctcccgcccccgtccatgtctcgcaggagttcttcgacgtggacgatgcccagggcactgcagggcggcactcgcgcggcaacagcctggcgagcatgctgacgcccaccggctccctcctggacggcctcgatctggaggcagaggcctccgccaaggagccggggtcgacagaggccggcgccctggccccggccccggcccagcctgcctccgccgcggcggcgcccgctcggtgggagcagggcacccccggcgacccggcctggctcctggccgagaagggtgagagcacacgtgagggctgtggcgtgcagggcatgcccaggccgcccttccccctgtacagtgctcccagcgaggagggtctgcagccatttttaccttgtcttgatcagcgtctgctgcgccgccatacctgctgggccctcccccctcctcccatgggcgctgctcgcccgnnnnnnnnnntcagcgaggagggtctgcagccttttttatcttgtcttgatcagcgtctgctgcgccgtcatacctgctgggcccctccccctcctcccatgggcgctgctcgcccgagctcacccccccacccccaccccttgcctgcagccaagggcatcccgcgccgccgcgcctcgctacctccccccgcgcagcaggagaagaccgtgagcctctggtccctgatcaagggcatggtgggcaaggacctgtcccgcgtctgcctgcccgtgtacttcaacgagccgctgtcggcgctgcagaagagcgccgaggacctggagtactcggagctgctggacgccgcggcagccctgccccgcgcctccgcggaccgcctgctctacgtcgcggcctttgcggtgtcaggctactccggcacggtggggcgcgccgccaagcccttcaacccgctgctgggcgagacgtacgagctggtgctgccggagaagggactgcgcctggtggcggagaaggtggtgcaccaccccaccgtcctcgtcatgcgcgccgaggggcgggcctggtgcatggacgcggacgcggaggtgcggtccaagttctggggccggtccatcgagctgcggcccgagggcgtgctgcgcgtgcgcttcgccgacggcgacacctacgtctggagcaaggtcaccaccagcatcaacaacctggtgctgggcaagatctacgtcgaccacggcggcatcatgcgggttcgcggcctcgactcgggcctcaccgcgcgcgtgcgcttcaaggagaccggcatcttcgaccgcgacccgcgccaggtgggtgggtatggggtggatggtgtggggggggggcccggggattgggaacgtgaaggggggggccaacaaagggaaggaaggggcgtgaatcagaggatgggcatgagcgccgggggggggaagcgctgtccggctctatcttgaaagagactggccagcccgcccgctccgcttgacgaggggcccctaggccactcctcgggatgtgggccgctgtgtggcctgggcaccgcatctcggccccaacccgcatttgcgagacgcgctgcagcgccgctgcgtgcaccccgagctgctgcaccccgtgcccgccatgccaccttttcctcctgcgattcacaggtccggggggtgctggagaggggggacgagcgcctggaccgccccatcctgcacggccactgggactcatccctgcacgccgatctggaggacggttcacaggtgggggctgggagggttggggggggtcccgcatgggaatggtgtggaggagagggggagggggaactctgaatggctgcggggtctgtnnnnnnnnnntgcccgctccgcttgacgaggggcccccaggccactccttgggatgtgggccgccgtgtggcctgggcaccgcatctcggaccccacccgcctctgcgagacgcgctgcagcgccgctgcgtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggaaggggggaggtctgcatgggaatggtgctgaaagagaggggggggggaactctgaatggctgcggggtctgtagggtgcagggaggaggacgcgcctgtgcacagactgagcgtgcggagggctgagcgcggatttcgatgtcgtgctctggcagactggcgtacnnnnnnnnnnagctgtctctggaggggtgagtgcatgagtaggtggctgtgcgggggaagggcgtcttgatactcggttgcgctcaccctggaactgggcatcgtcggcggggtgggaaagagtctgaaaacttgtgcgccnnnnnnnnnntgcgccggtgcacagacggagcgtgcggagggctgagcgcggatgtcgatgtcgtgctctggcagactggcgtacgccctgacaatggtcaggactttagcgttcccatgtgctccacagacctgccctcccaccgatgcgcaggtcctgctgtggcgcaagaacccgcctgccaaggagccgacgcggtacaacctcactgccttctccatcctgctgaacgaggtggtgccggggacagaggggctggcggctcccaccgactgccgtcgcaggcccgaccaacactgcctggagctgggcgagtatgacgaggtgagactgcggcgaggggtggagagggggaatggatgtctctggaggggtgagtgcatgggtaggtggctgcggggggggagggcgtcccgatactcggttgcgctcacccgggaactgggcgtcatcggcgcggtgggaaagagtctgaaaacttgtgcgccctcctcgcccctgctgggcatgcgctcatccgctcttggagcgcgcgcatagtcacacgccggtgctcactcgcccgcaggcaaacgcggagaagcagcggctggagcacaagcagcgggcggcgcgcaaggcggccgagcgcggggaccccatccggccgcgctggttcgagcacgtcccgtctgccaagccgggggaggagccggcgtacaggtatggaacggatatgacaggggttggtcatccgctcgaacggtgctttgcagccgcaaggcggtcaggcacccatgcctgtgctcggtcaggctacctgcttgcacagccacggaccaacaccgactcactcgccccgccctgtcagatacaagggcggctactgggaggcacgggaggccggcacgtttgagggctgccgtgacatctttggccctgattgataagggggggtgcccggcttgcctcgcccaccctgaccccgcgcatcaaaccaggacccacttggcagcataccccatccgactccccatccctgcctgtgttgccccgcctgcatggcatgtacagctcgagttggagggcatctggctcgagcacagggaggggcacaacagagcgaggaggaaggggattctggtttggtggtgtgaagccccctgtctccccgggtcggtgggaaggaatatgacaccggcacggtttcacctggcgtaatccacgcatgacaggggacgattcagcagcataattatctggcctggacggatccgccagctccgattcgaaatgccttgctggaaagaaacgccggtgtcgggtgatgtgcgttgatccgcgtccctgtccgtttgcgatgttgctgatatggacgagtgggagctcaatcaacccaagtcattcattgctcacgtggtcacgaacccgagtcgctgcggcactggcgtgtgcctgatggccatgcccatccctccctgcctctctggagcccatcggggtgccatcatggatgtcggcgccgtgagcggcatgcaggaaannnnnnnnnncagctcagtcaacccaagtccttcattgctcacgtggtcacgaccccgagtctctgcggcactggcgtgtgcctgatggctatgcccatccctccctccctctctggagcccgtcggggtgccatcatgcatgtcggcgccgtgagcggcatgcaggaaacatgagcgtgagtcatcctgctgcgaccggccccgggagcagcccctactacggctcgccatcacccatgacatcaggattcagcgtgctctgggcgcagtggaggcgccatgcagtcctcggaagtcgtttgcaaacactctgcgccgtgtttctgttctggctaggaactgtacgggcgggcaaggtgagcttccggggggttgtccggagtgatgatgcctcggagataacgttgttcgccgtccgaggggaaacctagggcgctgaaagattcaaaattgggcatttgttccggtttggtagcttgtggctgaattcttcatggacgacatgctgtgaacatgctgtgaaaacgcctgatcaccccccaccatcgccgtccgccaggtcgaagtggcttccgtgcgggccatgagagaggcacttaacgacacctcgattacccatgtcgtactcctcgatcggcccgggggttacgtcctgaccgaggaagatttcccgaaggatagcatctggattgatgggcgggacgtgctgctggaggggaaaggacccaatcccgtctacctcgatgtgagcaacagagctttcctgcaatgtggccacaaccccctatccgacgctgttcaggcagagcagcagtgacacctgtctttactttgcggcatgtgcatccgtactgcttgttcagcatcagatgaacatcagtagcccaggctcgtgagactggattcccacccgtctgtggctcctcatcctacgccacacacagcaaccacctcatgagaatcacccaaaccatgtgcaggcaaactatctgcatgacagggtccacgtgctcaacaacggattccttcaccagcgcaacttttgggcggatgactgcatagctccgtgagttgtgcagaaatggtggctctattgggtgatggagtcagggagcagccgtctgggagaaaccgtcaggaggggaggggcatcatggttnnnnnnnnnncgggtgatggactcagggagcagccgtcagagagcaaccgtcaggaggggaggggcatcatggttcaccaagccttcctggataacgaagcttttcatgctccaagtggcgcttcagggtttgcatcgcctgatcccctttggcatgtggccactcgtgccgcctcaatccactccccgagccggcccccaccagggtggacttgtccatctgctttgcaaagacctaccagggcggcaaggccatgatggaggacatggaggtgcgagatgggaaggggtggggaaactgcgacccgtgctgggcgagcgagcctgcccgcgcgccgcgcctgggagcctcatggtggtgctggcctggtagcatgcaggatcattcacccggccgcttgccccccctccccttcccagcgccccagtcaaccctcccctccctccgtgccacagatcagcgacgcgttttgcgtcgagcaggagcagtcctcaggcctgcgctccctttccagcaccatccactacatgaacctgatgggcctggccaaatcgtccctggacgcccccccccaggtgcagatcgacgcgaggaggacccaggtggtggactctggctggatcaacttccccatgggctccgtgtggcgcatgctgaattgcacgctgtcctgcaccggaaatgtcacccacgagctcaccgactcggcgctgctggggctgtccaaggtgccgcgctttcctgtttgggggaaaagaggtgaagagcttaccatctcctggtgaagaggaacaagcatgcatgcatgcacgctctgcgctgctttggaaggacgcgcacgcatgtgccgcgcatgtctgcccccttgccatgcacatgcacgcctggattcctgcagagcctgcctccgcagtaccgacgcattgccctccatcacaatccccacaggaaagggcgtggggccggtggtnnnnnnnnnngcgctccccgctgctttggaagggcgcgcacgcatgtgccgcgcatgtctggccccttgccatgcacatgcacgcctggattcctccagagcctgcctccgcagtcccaacgcattgccctccatcacaaaccccacaggaaagggcgtggggccggtggtcgttcctctttgcggccagaggtggacccctgggttttggcctggcagtcttgggagcgattgtgttcgtgcgcagacgtgagagtccggggtggctgtgggatcgggcgggctttggcgtcccttggtcctgccgcgcaagcggacagctgcactgtgcgggggactgcgtcctgccagggtaatactttcttccactccctaacaccccccctcaccccttacactccacctccgctcatgcaggcaacgcccgggagggcgccctgnnnnnnnnnnatccctaacaccccccctccccccttacactccacctccacccatgcaggcaacgcccgggagggcgccctggctcgcctgccggagcagaccgtggccaaggcgcagggctactgcctgctgcgcctgctgggcgtggggcactacggccgcgtgtacctaggtgggcggaggcacatggcgtgggcggggccctctgaaggaagggaggaggtccgttgccttgacttgaaggggcgccggccgggtgccgcatggcccctgcctccttcacgacggttgtcggccagcgcccactccttccccccctcccccccccccccnnnnnnnnnnagtgccgcatggcccttgcctccttcacgacggttgtcggccggcgcccactccttccccccacccacccaccccagctcgccaagaaagcacacgccagcactttgccatcaaggtcatcacggtgtacacgccgcgccagctggaggcggcctacgctgagtgccggaccatgctgggcatccggcacccacactgtgcccaggtgcactcctacttctccgcacgcatggagcactcgttgcgctccgtggatggaaagtacgtcgtgcaagaatagggagggggggaggggnnnnnnnnnnttcaagtgtgtggtgcagaggctctgggaagcggccgtcccctggcgcgacgcgcgggccaccaggcacggcccaatatatgtcagccccagccagcccccccccccccccnnnnnnnnnngggaggggggcccgaggctacaagcgcgcagggccttcaagtgtgtggtgcagaggctttgggaagcggccgtcccctggcgcgacgtgcgggccaccaggcaccgcccaatatatgtcagccccaggccccccccctccccgcttccccattcccccccttgtgcagctctgggagcgacgcttacctggagcaggcgttccagctgcggggtccggacgccgcagcatcgccggcctcctccgcagcgactggcaccgggtccctggtcagcaccctctggcgtgccacaaggctccgcggcagcgggagtgagtccgtggcgggggacttgggccctacagggtctcaaagagcctgtttggggccatggcctggaccctgcagtgcttcgtgcaccctgcagacctctccacagagcggccactcgcaagttggatttgcacccatccccacccccgcagccagcctcacactcccgaccactcaaatcggctcgataccccactcccacccgcaggctcctccagtgacgcannnnnnnnnntggccacttgcaagttggatttgcacccatccccatccccgcagccggcctcacgctcccaaccactcaaatcagctcgatacccctctcccacccgcaggctcctccagtgacgcaggcaccgccccctcctccctggccatgcaagtgcacatggtggtcgagttctgcgaccacggcacactggaggctgcggtgcagagcggcatcttcctggaccccgccctcggccgcccgcggatggtgcgggatttgttttggggtggggcccggagggaggggcgagggtcatgtcgtgttgggatgatgagcatacctggggcggtgccgagggtgtgcaactcggccctgcttaccagcctcctcagcagagtcagttcccccccattctcctccccgcccgcctcgacggcaggactgggtgctgcagacggtgctggaggtggcttcagggctggagtacctgcacgcccccgggcgccgagtcgtgcaccgcgacctctccgccggcaacgtgctcctggcgtcggcgcggcgcgggggcggcgacgccgcgccgggtcccgccggcatgcgcccggcgagcacgcgccccttccgcgccgtcatctccgactttgggctgagcatgatgctgagtgccgcggccacccaccgcacctcccacatgaagggcaccgtagcatacatgagccccgaggtgttcaggaccagcgacgtcacaccggccctggacatctactcccttggcatcataagtgaggggccggtggagaaggggggggagggggataggggtttctgctcctgatgttccaagagggactgggttgtcagaggaacgagcaaccatcggggccagggctgtgcagatggctcgccccctccaggcctgcatgcatgtgcacctcttggtgccgacgggaagtgcgccgtcccagcgacacctcaccccaccccgggcctcccccacgcagtgtactatgtatacatgggctcgctgccctacccagacaggaacccaggacaggtggggctggtggcagggccctggtcggcgtggcagggcggctgcacacgatgggatgacgaggcggagtcgccgccaggccctggtgagactgcccattcccccgactgcctgaactgctgaccatacgcgcccccctcccggccccaggtgattgtggagaagatgcgtgaggttgagtgcggcgcggaggagcgcttcgacatcccgcgtgactgccccgccttctaccgccaactgatcctggactgcacccacccgcagcgccgcgaaaggtgcggcacagggaggccggggcgcccggacatgcttgccgatggcgtccaggcccccgacgcggtgccaggctgccnnnnnnnnnngcagggaggccgggcccggacatgcttgcagatggcatccaggcccccgacgcggtgccaggctgcccagggcaccccggcagggtctttgccctgcacaaaggccgctgcagcgctgcccacccagccactcagcggtccacactgccctgattccatccgcaggccgaatgctggcgagctggtacggcgcctgagcatcctccttgcctgagggccctctggctcgacagcctgaggccccctgatcagccctgacatgatatgagaggttgaagattgaatctgcatgcagagtcttgctttcgttcagcgagctgtcgctccccatttaatgaggtcacccactcccacacgtttcgaaaaccccgacacgggaggggaatcggggtacggtgcagcatggagcctgcctctccccgcgtctggagcctggcgaacgcaacaccaagcatgcggtgcgaggtcagaaacatgaagagaaatgtgtggttcatgcgatcactcccccctccatgctgtcgataatggagcaggggccccggtgacaccacccacccgttgtagctagccgggcgcaccggccaccttnnnnnnnnnnctaatggagcaggggcctcggtgacaccgcccacccattgtagctagccgggcgcaccggccaccttgcaccggcgctggatgaggagccatgtctgacgatgggatagggaaggatgatgggacatcctcctggtgagaggcgcgatggtgggcgtgcacagggtctcggcacccttggctgccactgcactcgtcccgacaacggccccccccaccccccccgggccccaggatcctgcgccggaagccggcctcacacggcccccctcaacccctttctgccgccgatgcacgccgggccgcacgactcgaggcggagggcgacaatcggcctcgcgtcgtggcctactccgactctgactcggacgtggagagccacatacggcgcgtcaaggaccacctcctgggcggggaggaggcccctcccgaggaggatcctgcagacggaatgctagctggctcctccacggccatggagcgtggcacgtccacggcggcagccccctcctcagccgcctcggccctggcggcctcggcagccggcggtggggggggcggcatgccccccgccaccaggcacctgctcccctcggataccctgcacccggggctgctggccctggtcacggggctggcggtgctgcaccgcctgaaccccggcctgggcgaaattgtggaggcgacggccgtcgcagtccccctgagcatccgcctcctcggtcccaaggcagggcggagggatggctgtgtcggggcaggggaggggattacgtgcacgagcctgtggcggggcatcgcagcgcccttggcggcgcacccacctgcctgggccctgattcccaggcctgtccgcccatgttcatgcgccgggtcgatgccgaggaccgcccacacccacgaacgcccatgcatgcaccgcaggaccccgccgcggcccccctggggctccccctgcgccacatgaggcatgcgctgcacgctgtgggcgtggtgtggacgctgcgctttgcacgccgggccctgcgcgccacgcgagaggcccgcctgcaccggcggctcagggccagtgccagcggtgagcgcagagtcagtgggttgccgtgtgtccagtttgagggcggggggggagacgagcatggaggggctcggaagagggggttgtggcctggcccggaagccaccggaccctgcgggccatctacgacgcccagcaggccacccacgactggtgacattccccagcacgttgccgcccggctccaatcccccacccgccccctcttcctcccaccgcagtccaagcgctggagaggcccgccaccccgcggcgaggcgtgtcgcccgagagccccggcgatgacgcgccccacgacgaggagtgggtggtgtcgctgcggcacgaggcacgggagatgcggcgcatgctggccgagaacgatgtggacctggcggggacgcggttcgaggccagcgacgcagagctgctgcgctacgcggccgcctgcggcctgcgcgaggtgagggccgggagaggggacatggattctttgcatgggggccacggaggggcacgggagctgtgcagcccctgctgtccctgctcnnnnnnnnnntgcctgcggcctgcgcgaggtgagggcctggagaggggaggtggattccttgcatggatgggggccacgaaggggcacaggagctgtgcagcccctgctgtccctgctccctagcatgtgagccaccgtgttggggaggacgtattcagcggagcccacggtctcctgtcannnnnnnnnnatggcagctgcatgaccctgcacagtccagactgccgcctgatggatctgtgccggggtcacacgggtcgtgctcgagctgcctggggccctctggcctcccctcaacccaagaatgtgaatgcctcaggccgccgtcgcgacacggccctgtgcaaagcctccactgccaacctcgccctcctcccccctccccctttcaatacgcaggcgcagcccgcggccctgcgcgnnnnnnnnnncagcatgtgagctgccttgttgggaaggatgtattcagcggagcccacggtctcctgtcattccgggtggcagctgcatgaccctgcacagtcaagactgccgcctgatggatctgtgacggggtcacacgggtcgtactcgagctgcctggggccctctggcctcccnnnnnnnnnnnnncgtggaaagcctccaccgccaacctcgccctcttccccccccccccctttcgatacgcaggcgcagcccgcggccctgcgcgcccgggcggtggacgcggcggtgggtcgggtggtgaagaccctggactggcaggcgcgccagcgcttcacccccctgccccgcctgcgacgctggannnnnnnnnntgtcgtgctgagccgcgtggcggacggcgcaggcggggtgctggctcgcgccgaccgggtgtcggtggtcgtggacnnnnnnnnnnggctggtggactggcagggcgccgacggcggcgagcggcccatcctcctcgtccgggcggggcgcgcgctgcagctgctgcgcccgcgccgccacgccgagttctgcgacgtcgtgctgagccgcgtggcggacggtgccggcggcgtgctggcccgcgccgaccgggtgtcggtggtcgtggactgccgcggcgcgagcgggctgcgggccgcctggtgcctccccttggtcaagaacctggccacccagctgcaccagcactttccggtgagccggtgttgtattttttgggggaaggggaagggtatcacgagggggaatgggttgggaagggagggtggtgaggtaaggatgcaaagtccaagtgtgtgcaaacaggatcggaggctgcgatgcccaggaggggccagaccacggaccccttggccctgcaccgcgattcaagaatgagcggcatcgacttcagggatnnnnnnnnnnggtggtgaggtgagaatacgaagtccaagtctgtgcatacaggatcggaggaggctgcgatgcccaggaggggccaggccacggacccctcggccctgcaccggcgactcaagaatgagcggcatcgacttcagggattgcccttcaaaacctccaccacttcgtacccccgctgctctacactttcgccactcccaatatcccaggaacgactgcaccgcctgttcctgctggaggtgccactgctggcacggtggggtctgcgcgggttaattgcgggcctgcctcccgccacgcgggcaagggtgcgccaggtcagcatagacaacccnnnnnnnnnnatacccccccctgctctacactttcgccactcccaataccccaggaacgactgcaccgcctgttcctgcnnnnnnnnnnnnnnnnnnnnnnnnnnnnnnnnnnnnnnnnnnnnnnnnnnnnnnnnnnnnnnnnnnnntggggcgttcgtgcagggaggggaaaggggttattaccgtgtagatccatgggctgggtcaggnnnnnnnnnngggggtgtttgtgcggggaggggagaggggttgttaccgtgtagatccatgggctgggtcagggtccgcaacgcagtgttgtatcgacgccgagtgcagcgtcgcccccaggtgggaggggcctcttgttccgtacctttcctgtacacacaaggtcctaccccatctccaacccccctcccaggcggtcggacgtgcgggagctgggcatgcgacgcagcagcagcgacctgaacctccccccgcccaccacgcccagcgccggcggcacgcccctggcctcccccacctccctcgcccttgacttccagcgcactgacagcgagcgggagcgggagcgcgcgcgcggtgagggcggggagacctccgacgagtacctcacgcccgacacctccatggtcgaggtgtttgcctcgccgccagacgggccgggcagcgcactgctggcaaacgggccgcggccggagcccagcgccctggctgtcgcacgcgcggccgcggcctgcaccccgcctcaggtctggcgcgggctgggcggcatgctgcaggcgctggcgggccccggcaggggctgggcgccgggcg

SEQ ID NO: 48572 - DNA, 74 bp, Chlorella protothecoides
gccgccccattcgtccggcatgggctgggcaaaggtcggcagcggcgctcaggcccaggcgccaagcgcctggc

SEQ ID NO: 48573 - DNA, 170 bp, Chlorella protothecoides
gtcgggaactcaggaagggaaaagatcgacttgtcggactgcactcaaaaccctcctgctcgggccgggacaattcgacgccaccatgggagggcctcctgtgcagaagtgcccaccccctcatgttctcagccgcaaaaccccacacccgacatccacgaccctgctgc

SEQ ID NO: 48574 - DNA, 61 bp, Chlorella protothecoides
gcagtgcaatgtgctgaaggcactcttccgttcgagcccacgtgggcttcgcggcgcgcgc

SEQ ID NO: 48575 - DNA, 79 bp, Chlorella protothecoides
ggtggacccagggtttggaatatcctggcaacagggcaaaaagtgcaaaacggggccgccactccttgcatgacaagag

SEQ ID NO: 48576 - DNA, 74 bp, Chlorella protothecoides
gaatatggccagcatggctcactggccaaattcctgtaaacggcatccctccaagctgccacatcctgcaccgt

SEQ ID NO: 48577 - DNA, 951 bp, Chlorella protothecoides
  modified_base (114)..(308): a, c, t, g, unknown or other
  modified_base (376)..(597): a, c, t, g, unknown or other
  modified_base (664)..(878): a, c, t, g, unknown or other
ggtgccctcgcgctctcgagccaccgcccatacactggttcctcgctcctgttggagagtgaagcgcgcacgagtctgcgcacgacgccctcgcccgttgccctgatcttgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccctgcgtaattgtgacacttgccaggccagcaacgacaattctgtacatttgaggtgcacgccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgccatgaatcgtgcgtagaggggcaggtgtgcatcacagctgcattgctgggatgagtacaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggggtcctggccccctcccgatgagggtccgctgatggcggtgcgggtcggggcacacgcgctcagggcctg

SEQ ID NO: 48578 - DNA, 71 bp, Chlorella protothecoides
atcctctgcatgccatccctgacccgcatcccacgccagggcgaggatgggagggacctgccgcaggcatc

SEQ ID NO: 48579 - DNA, 88 bp, Chlorella protothecoides
tttatcagataagccgctgaggtgatcgtgaagaaatgtgtctggagagtgggcccccatacctggaagcgagcataccgtcacaagt

SEQ ID NO: 48580 - DNA, 73 bp, Chlorella protothecoides
cgagctgttccgcttcttcaagaggcacgctgtgggggggttgatccttggctcgaggcggaggttggggtgg

SEQ ID NO: 48581 - DNA, 61 bp, Chlorella protothecoides
gttggtgaatacctccgatcacagtcttggattcctcaccaggacccagctgcagggccta

SEQ ID NO: 48582 - DNA, 61 bp, Chlorella protothecoides
ccgacccttttccgcctgtcgcagtggccaaggacggctttcccgggctgagcccatagta

SEQ ID NO: 48583 - DNA, 65 bp, Chlorella protothecoides
gcttccctcagacttacccatccctcaaccctcctagcgcgctgcgggagtgcgaggacctgagg

SEQ ID NO: 48584 - DNA, 61 bp, Chlorella protothecoides
gcctgaaccctctccggtgcaagagcgatgggtgccctccatttgctgctcctctgttgtc

SEQ ID NO: 48585 - DNA, 76 bp, Chlorella protothecoides
aacctgaccaaatacattggataccccaccagacccccccccaaacacacaaacacacacctggccgcccatcttg

SEQ ID NO: 48586 - DNA, 61 bp, Chlorella protothecoides
gtgcaggagcaagggtcgctcggccagtgcaccccctgcgacaaacctcccctcacctgct

SEQ ID NO: 48587 - DNA, 69 bp, Chlorella protothecoides
ttgacctgcgatttctcatgcgactcctacccccccccaaaaaaccttctcgcctgcagttcaagccca

SEQ ID NO: 48588 - DNA, 61 bp, Chlorella protothecoides
cgcctccctcctgctgcaggcatggcaggggttgaatatgctcgggtttgataggggaatt

SEQ ID NO: 48589 - DNA, 61 bp, Chlorella protothecoides
gcatactcgaatcgcatgccatggtgctgcacacgcctcttggccaggtactcccagggct

SEQ ID NO: 48590 - DNA, 75 bp, Chlorella protothecoides
catctcgtaagtcaacacccccgcctccgagcaggaagcctccaaccccctctcacaagccgtcacctccgccgc

SEQ ID NO: 48591 - DNA, 65 bp, Chlorella protothecoides
ccaagagtctgcaggtttgcgactgttggagccccgctcccccgccaagcctctgccacggtcaa

SEQ ID NO: 48592 - DNA, 91 bp, Chlorella protothecoides
gtgcatggcctcccccgcggcggcgtggtggggctcccagtgctctgcagttatgcgatctggggaccagccggaagccttgagcagctgg

SEQ ID NO: 48593 - DNA, 61 bp, Chlorella protothecoides
gatgttgggggagctggaactggctcggagggtctcacacagcactgagtgccctggaccc

SEQ ID NO: 48594 - DNA, 61 bp, Chlorella protothecoides
cgctggagactgcccatgggccgagcgccagggtgctccacactacaacactcccctctct

SEQ ID NO: 48595 - DNA, 79 bp, Chlorella protothecoides
cctccgatcctgctctggatcagatgtgctatgagctgctgctgttagatctggctcgccgtcgactctgctgctactg

SEQ ID NO: 48596 - DNA, 61 bp, Chlorella protothecoides
cagcccacagggtgggatgatgccgatctcgaacagctgaacgccctctgggcaggtccct

SEQ ID NO: 48597 - DNA, 72 bp, Chlorella protothecoides
ccttcccctccctcagccccctaacccctctcccccccctccttacccaggtcgtcccgcgcgtgtctgtgt

SEQ ID NO: 48598 - DNA, 61 bp, Chlorella protothecoides
ggcaggtccgtcgggaccagcttcccgaggtgggaagccctcgcgatcacggcgtccgcaa

SEQ ID NO: 48599 - DNA, 78 bp, Chlorella protothecoides
ccaagggtcgtcgcccactcagcgccacgctgatgttccaggggggagcttggatcaggccatgctctgcgcctgcct

SEQ ID NO: 48600 - DNA, 61 bp, Chlorella protothecoides
ggcggcgacgtggacgcccgggacttgcgcggccagaccgcgctccagtttgccgcggggt

SEQ ID NO: 48601 - DNA, 61 bp, Chlorella protothecoides
caaggtgaacaagatcatgtcggtgaagaatcttccctacgactactactccctcccctac

SEQ ID NO: 48602 - DNA, 61 bp, Chlorella protothecoides
gtactgtggatactttgcatgctgcgaaggtgcagacgatgcagtgcctcagtgtacctgg

SEQ ID NO: 48603 - DNA, 63 bp, Chlorella protothecoides
gagtgttttgctggggctggggttgaccagcgtccctgctgcatcaggcacgtgcggccatgg

SEQ ID NO: 48604 - DNA, 7818 bp, Chlorella protothecoides
  modified_base (994)..(1003): a, c, t, g, unknown or other
  modified_base (1362)..(1371): a, c, t, g, unknown or other
  modified_base (2204)..(2213): a, c, t, g, unknown or other
  modified_base (2298)..(2505): a, c, t, g, unknown or other
  modified_base (3179)..(3188): a, c, t, g, unknown or other
  modified_base (3682)..(3691): a, c, t, g, unknown or other
  modified_base (4117)..(4126): a, c, t, g, unknown or other
  modified_base (4345)..(4354): a, c, t, g, unknown or other
  modified_base (6430)..(6439): a, c, t, g, unknown or other
  modified_base (6688)..(6736): a, c, t, g, unknown or other
  modified_base (7078)..(7087): a, c, t, g, unknown or other
  modified_base (7299)..(7308): a, c, t, g, unknown or other
  modified_base (7391)..(7400): a, c, t, g, unknown or other
tcacttcgtgagcgaagcatgcaccgatcatgcaaactctgcgcccatcaattcgggcaaggggcaagaaatcgtgtgcttaagcgtcagattaagtgtgcagagcctggttgtgctgtatgcctttcgtgcagattggcgcgacattctgacacgtggaggagggtcgcaaagacagcttacaggcccctgagggaatgctcaaaacaacttgcgctccggcagacagcacagcttcatgccgtccgccaaatgacagccgttcaatcatcgctggttgagcaggctctttacttggggatggttcaagggattgtacatcctcttggtctcctcaactagctgccgagcttcggacagggcagccagtgacacctgtgggaaggtggatcatccgatgaaggctgcagtaccttgcaggtacccaaacccctcattgccccacccagagagcttctggcatcttcctcgcacctcagcactctccctcgctttgactcgggctgcttccgcttggtccactctatcatgcgcatctttcactccttggcttgcctcgctggcctccgattcacagactgacagacccgtacgagccctgtccagtgcagtttgggcctctatcacctttgcttcccacttggcgcgtccctgcagtgatgaggccaaaacacgtgtgcgagttgaagacattctcagaccggcattgtcggtgctgagatgcctgtaagcgaagcttttgcgggcacattagatcctcaacatgaaacccttgcctgttgcaactccttcactttggtctgcagctcctccatcaatgccatgtccttctttatttgcgcctcagcccgcgacagttctgattggtacgtcttgtactgactctcaatagctcctgcgtccacgctggcttcatacatatcgtagcctacctgtggttgcgatggaggctttgaaacaatcaatggagcattgtggctattctatagagggnnnnnnnnnnacccaattttctcaatagcgatgccatgcctgcggcctggatgcgcgctcagcgggtgagcagggtttaccaccttcctactcctgcgcacagcgtgtatcggtgagagcaagagtctatagcataaggttttggataacacgatcgcagtgattgcttcgacaatctggtatactctgcagtgtgtgccgggcatcacgagtgattcacgctctcgtgagtagtcctgaggaaagggagggacccatcttccccggtgttcagcataagatccagagccacctgtatgacatgttcctgacatcccagaaacactcttaggacacaatcggtacgatgtgcgccatgcaggcgatgannnnnnnnnngcccagtttcctcaatagcgatgccatgcctgcggcccggatgtgcgctcagcgggtgagcagggtttaccaccttcctactcctgcgcacagcgtgtatcggtgagagcaagagtctatggcataagattttggataacacgatagcaatgattgctttggcaatctggtatactctgcagtgtgtgctgggcatcacgagtgattcacgctctcgtgtgtagtcttgaggaaagggagggacccatcttccccggcgttcagcataagatccagtgccacctgtatgacatgttttcaatatcccagacacactcttaggacacagtcggtacgatgtgcgccatgcaggcgatgagcgtgccacggaccgggtgtttcgccacggcccggcccgcccccaggcggtgtgcgaaaccggcagcagcgaacaggtgcgcatgtgcgcctggcatcgcgctaatcccaaaataccaggcatcatcatggagattttcatcaacttatgttcgcccccctggcatgccgggccatggctcgatttccccacgacaccgatctatcctgtgccctcctcacaccctgtagcggcagcagggagcgcctgtggacgccaccggccgactcccgcatcacctcgcaccgctccatacccatcgtggccagtcagggccccgagccgcccaacccgctggtggtggagaggttccagcaagtcatctcccagctcttccagcaggttggtgttcaggggcctctgggggcatccgccgctctacctcctgccttggccggatgatgcgtagcccttccctgccacgctcgcatcgtgnnnnnnnnnngcatggagattttcatcaacttatgtttgccccccctggcatgccgggccatgactcgatttccccacgacaccgatctatcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggcatccgccactctctacctcctgccttggccggatgatgtgtagcccttccctgccacgctcgcatcgtgcctccttcatgcatgatgtttttaccgcatcccacccaaccccccccaatctcagcgtattgtgaggctgggcggcgcggtggacgatgacatggccaacctggtggtggcccagctcctgtatctggacagcgtggaccccaaccacgatgtcaccctttacgtaaactctcccggcggctccgtcaccgcgggcatggcggtgttcgacaccatgcgacatgtccgccccgacgtctccacggtctgcgtgggcctggccgcctccatgggcgccttcctgttggccgccggccagacggggaagcgctactccctcccaaactcccgcatcatgattcatcagcccctgggaggggcccaggggcaggcagccgacattgagatccaggtgagtggttgcgggtgtgtggatgggggcggggaagaccagcgggtggcaggtgactgtgctgagggagacggagggcggggtgctgcctcgtgccgcgcagggcacgcttcgtggtggtggacgcaagaacctgtatgatgttggattgtgtttacccattcgttcacatcctcaacccccttccccctcaggccaatgagatcctnnnnnnnnnncgcaagaacctgtatgttgttggattgtgttacccattcgttcccatcctcaccccccttccccctcaggccaatgagatcctgcaccacaagctgacgctcaatgggtacctggcggaattcacggggcagagcatggagaccatcaccgccgacacggatcgcgatttcttcatgggcgcgcaggaggccgtggagtatggtctggtggatgccgttgttaatcggcaggtcctggccctcggctgacctgagggtgtgaggccgccctccagggtgctcgatgacatgagcgagtggagtgcggaggctgcggccctgcgcctggaccagaatttctctgtgcggagggcatggcatgcccactgtcctgcaggcaggactggcactgtatcagtaacaatctttgccagcacaagaagcacgtcatgtgggatatgtgacgagtatgctcctgggatgcccagggagggaggcgtcctgcatcaggtacnnnnnnnnnnttcatgtgggctatgtgacgagcatgctcatgggatgtccagggagggaggcgtcctgcatcaggtacaaggcaaggccggaggcacaagcagcagatctgctcaggtgcaaggcattatgacaggcaagctatccatgaagagcgcgtcagagaccgatgttcagtccgccgccgacagagatgccgatgagctgcaagagcccgcggcctgagatcccctccaccagcagcagtgcaaaaaacccgatctgtcgcggtaaatggagggttgggcccatggtgaataagtttcctttgcgattaaacatctggaccgagcagcaaagcataggaaccaagggaagtccaaacctcacagacacatccgaaggaacatatcatcaactcactccgcatgacactcagcaacgtaccatggctgctnnnnnnnnnnagaatatatcatcacctcactccacatgacactcagcaacgtaccatggctgctcggctgttcaggcgctcagcgtagtccacccacccgaacttggggggaggcaaggtcgggagcaccttgggctgtgcaacaccctgacattgtggtggtggggcggttgcattgatgagacgggcattgcccgtcaagcacctcatgatgcaggtcagaccagannnnnnnnnnggtggggcggttgcattgatgaaacgggcattgcctatgcaagcacctcatgatgcaggtcagaccagatggaaagttgcatgcaatgtactcggcagtcgtattttctcaaaccggccaaagcccacctttgggagctggggctggtactccccaccctcggcaaatactctcactccggcacgtccctgcctctgtgtcctgcatgaagcatgggatggatcagtgtcaacaggtcgcggcgtaatcaagaccacatgcatcaaaagtcttcttcgcacctcgatactgctgcagctctgctcccgagttttggctggagagggcactgcagggagggtgccacggtcctggatcctaatgcttgcatcctggcttgcgtcccttgtcacagcacgtcaagttcgaaattctgcacagaacaggggtatcaagtgttcgttaccgtcctccgacacacatgcgcggcgcctgttcgcccactcaaccatgaggggccaggagctggacagcgtatcatggagccccaaggaagaaagcgcgggaaacctccacgcaattctctatcaatttttcgggagcagagcgccaggtgtcggtaacgcctctcgcccgtcggaaggcatcgataccgctgcctgtaaaacatctggcaagaaccagggagtggtgtgccgtgtctcatgccgcgctgaatttacctggtgcagctcagccccggctgtgctgtcggtttgacgccccgccggatgcagcgccagagatcgcgctgagccgatggggctcctgagctggtggaaggcaagcaatcagaagccatctgccgtgcgagatacgaggtgcgcgcagggcgcggggttgagagggggtggagtagaggagggggcatggggattttgaagtggggacacacctcaccccagcgatcacccacgctcctccgccccatctacaagcccaccctgtgcactttaacctgctccaggaccgagaaaacctctgcagcgcgccccaaccccaagcagaagcaggctgcgcgcttgttgaagcctgctcgaggcatcctcaagcggcagcagtcccctgcggcacggaccaagcgtggccgaccgtcggtgccggccacccgcccgacaggcaacgggtcgctgaagcagggagtcaagcctcggaatggcgcgcctcctgcagggcagcgtgacggcggccgcgggcggtggagggcgggggcgccctccaccgccgcgcccccctcgccttcgctgacccacacctcgggcacgagcgaccacaccgacactgcctctggatccagcgcgccccgcaggggcctgggccgagcgcactcaggcacgccaggcctgaaacgcagccggagcctgtggaagacgcggccgctgatcattggtgaggggtcgaggaggtggcgctttggggcaggtgggagggagatggctggaacggcctagaatctgcctcagccgaattgccggcacgcacgcacctgggccaagggactgcaatcctgcatgctccccggaagcggaccacagaataaaaactatcctcaaaccccttccttggccccccccaccacacacacaaacacagacgagaagctgcctgtgtttgtcgagggcgtcgactcgctggcgctgctggcgtatgacaacggcgacttctaccgctggcagaaggaggtcgaggcgggggtggccagtgcggccgatgcggcgccctacccgctcatcgtccaggactctgacttccgcacgctgctggagatccggcccggcgggggcaatggctgcgaggaggcggggtccggcgccggcgcagcgggcgcagcggcgccagggtgtggcagacccggcccccgcccggggtccggcattgccgtgcctcgcgccaccctcctgccccccgccctgcagcccgacgtcatgctgctggcgggggaggggccccccatcgtggagcaccgcatgggtggcgaggatgcgaccccgggcccggcctccgaggcgaaggggggacggggcgacggaggctcgggctccgcctcgcccccgccgnnnnnnnnnntgtggagcaccgcatgggtggcgaagacgcgaccccgggcccggcctccgaggggaaggggggacggggcgatggaggctcgggctccgcctcgcccccgccggccgccgcagcggctgcggcgctccctccccagctgcagcgggacccgccctacacacgctacgtccaggtgggtgaatttgtgatgtgttgaggccagagctgtggacgaggtgctcgtcgagcggccggggcgcggggttggcnnnnnnnnnnnnnnnnnnnnnnnnnnnnnnnnnnnnnnnnnnnnnnnnntctgaccctcccccattccaaccatccctgcgcagcccacgcctgatgagctggagctggcgatagaatatgacctggatgaggaggatgaggagtggctggaagctcacaatgccgaggtggggaggaatgagggggggtccggcaggcactctacgcggtacaacgtggtgcttatttggagtccaagttgctgctgaaaactgacgaggcatggcctatgaagggagcacgagcgtatcaggtgatggtgctcgggtgcatcagcctgctcttccacccatgcgcccctcccccccctcatcgattcacccctgcaggcccggcgcgcacggagccggnnnnnnnnnntctgttgccccgctgcaatcacggccgcctccacccatgcgcccctccccccctcatcgattcccccctgcaggcccggcgcgcacggagccgggtggcgcggcgcaccctggctggggagtggatggaacacctcattgaccgcatggagaaggagtacaccgccgagctccaggtgcggggaggagtcacgccggttgagtcatgccggnnnnnnnnnngggtggcgagggcccgccccagctcggcatgcggccgtctgcagaggctcgaacctgctcgctcctcaacccccccttgtcgnnnnnnnnnnaggcggcgagggcgcgccccagctcgacatgcggccgtctgcagaggctcgtacctgctcgctcctcaacccccccttgtcgcaccccccttgcagcgtcacccagagctgtggacgctgacgcccgacccagaccgccccgatgcgccgcccagcgtgggcctgccgcccatcgcccgcatcttccccgtggagcgctgcctggccgtccccggcatcaaccactacgagccggtcatccggcgcgtatacgagtactggcagcgcaagcacgaggcgcgcggcgcgcccctcatccagcgcctctggtacgagccgccatggcaccgccgccgcgcggccgaggcggtgggcggcgacgcggcggagggcgaggagggcgaggccggcggcgaggcggcggcgcacccctttgccg

SEQ ID NO: 48605 - DNA, 125 bp, Chlorella protothecoides
accctgccaacatcaataccagtacagcacgtgggcatttacaccaattcatgtatacatccttcgaagctcagagcattgttggggcgcaggggttgcagtccagtcgcgaagcaggcgtgatt

SEQ ID NO: 48606 - DNA, 61 bp, Chlorella protothecoides
taattcacgaaaaccagagatcccacgtgcccggaggccccctcgacccaccaggcacatc

SEQ ID NO: 48607 - DNA, 40116 bp, Chlorella protothecoides
  modified_base (93)..(102): a, c, t, g, unknown or other
  modified_base (580)..(589): a, c, t, g, unknown or other
  modified_base (1273)..(1282): a, c, t, g, unknown or other
  modified_base (1348)..(1357): a, c, t, g, unknown or other
  modified_base (1593)..(1606): a, c, t, g, unknown or other
  modified_base (2403)..(2412): a, c, t, g, unknown or other
  modified_base (2634)..(2643): a, c, t, g, unknown or other
  modified_base (2978)..(2987): a, c, t, g, unknown or other
  modified_base (3317)..(3326): a, c, t, g, unknown or other
  modified_base (3896)..(3905): a, c, t, g, unknown or other
  modified_base (4907)..(4916): a, c, t, g, unknown or other
  modified_base (6436)..(6445): a, c, t, g, unknown or other
  modified_base (7447)..(7456): a, c, t, g, unknown or other
  modified_base (7540)..(7726): a, c, t, g, unknown or other
  modified_base (7865)..(7874): a, c, t, g, unknown or other
  modified_base (10100)..(10109): a, c, t, g, unknown or other
  modified_base (10588)..(10597): a, c, t, g, unknown or other
  modified_base (11323)..(11383): a, c, t, g, unknown or other
  modified_base (12210)..(12219): a, c, t, g, unknown or other
  modified_base (12671)..(12680): a, c, t, g, unknown or other
  modified_base (13863)..(13872): a, c, t, g, unknown or other
  modified_base (14304)..(14313): a, c, t, g, unknown or other
  modified_base (14831)..(14840): a, c, t, g, unknown or other
  modified_base (15117)..(15126): a, c, t, g, unknown or other
  modified_base (15846)..(15855): a, c, t, g, unknown or other
  modified_base (16277)..(16286): a, c, t, g, unknown or other
  modified_base (16749)..(16758): a, c, t, g, unknown or other
  modified_base (17017)..(17026): a, c, t, g, unknown or other
  modified_base (17297)..(17306): a, c, t, g, unknown or other
  modified_base (17872)..(17881): a, c, t, g, unknown or other
  modified_base (19425)..(19434): a, c, t, g, unknown or other
  modified_base (20048)..(20057): a, c, t, g, unknown or other
  modified_base (21491)..(21500): a, c, t, g, unknown or other
  modified_base (22013)..(22022): a, c, t, g, unknown or other
  modified_base (22253)..(22262): a, c, t, g, unknown or other
  modified_base (22687)..(22696): a, c, t, g, unknown or other
  modified_base (22943)..(22952): a, c, t, g, unknown or other
  modified_base (23544)..(23553): a, c, t, g, unknown or other
  modified_base (24409)..(24584): a, c, t, g, unknown or other
  modified_base (24946)..(24955): a, c, t, g, unknown or other
  modified_base (25660)..(25669): a, c, t, g, unknown or other
  modified_base (26291)..(26300): a, c, t, g, unknown or other
  modified_base (26429)..(26438): a, c, t, g, unknown or other
  modified_base (27259)..(27268): a, c, t, g, unknown or other
  modified_base (27720)..(27729): a, c, t, g, unknown or other
  modified_base (27894)..(27903): a, c, t, g, unknown or other
  modified_base (28855)..(28864): a, c, t, g, unknown or other
  modified_base (29804)..(29813): a, c, t, g, unknown or other
  modified_base (30094)..(30103): a, c, t, g, unknown or other
  modified_base (30549)..(30558): a, c, t, g, unknown or other
  modified_base (31705)..(31714): a, c, t, g, unknown or other
  modified_base (32222)..(32231): a, c, t, g, unknown or other
  modified_base (32945)..(32954): a, c, t, g, unknown or other
  modified_base (33464)..(33473): a, c, t, g, unknown or other
  modified_base (33774)..(33803): a, c, t, g, unknown or other
  modified_base (34097)..(34106): a, c, t, g, unknown or other
  modified_base (34344)..(34353): a, c, t, g, unknown or other
  modified_base (34608)..(34617): a, c, t, g, unknown or other
  modified_base (34862)..(34871): a, c, t, g, unknown or other
  modified_base (35274)..(35283): a, c, t, g, unknown or other
  modified_base (36193)..(36202): a, c, t, g, unknown or other
  modified_base (36898)..(36907): a, c, t, g, unknown or other
  modified_base (37061)..(37070): a, c, t, g, unknown or other
  modified_base (37246)..(37255): a, c, t, g, unknown or other
  modified_base (37598)..(37607): a, c, t, g, unknown or other
  modified_base (37714)..(37723): a, c, t, g, unknown or other
  modified_base (37799)..(37808): a, c, t, g, unknown or other
  modified_base (38579)..(38588): a, c, t, g, unknown or other
  modified_base (39359)..(39450): a, c, t, g, unknown or other
  modified_base (39673)..(39682): a, c, t, g, unknown or other
  modified_base (39786)..(39795): a, c, t, g, unknown or other
tccacctgggtccaggtcctcacggtgcgtcgatggttggtgaagaggaacggaaaggggatttggggggctgagatgggtgggtgggcagcnnnnnnnnnncgcgccgtccagcgaggagcccacgctgacccccgcccccgtgcgctacatccccgccgacgtgccgacgctgccgcggagacccgccgcggcgggccccctctccgccgccgccatcgccgccgccgaccccgcctactccgcggacaactgctcctcggtcctggccaccctcaagaccatccccgaggtgtccacctgggtccaggtcctcacggtgcgttggtggttggtgaagaggaatggaaaggggggttggggggctgagatgggtgggtgggcagcgtgatggagcgccacgcgacgcacccctgcacggaaggccggcccaacaggcgcgcccacgccactccttggcccctacccacccccaccctaaaaacccctctcacgcagaacgtgggcctggcggtgctgctggacgcgcccgacgcgcaggcgacgctcctggtgcccaccaactcggcgctggacgcgnnnnnnnnnncaccccccaccccctttgaaaaaccctatcacgcagaacgtgggcctggcggtgctgttggacgcccccgacgcgcaggcgacgctgctggtgcccaccaactcggcgctggacgcggccatcgcgggcggcagcgtgcgcgacgccgacacgctggccgcgctgctcaactcggcgccggacctggccaacccgctggccgcctaccacgtggtgaaggggctgtggccctcctggaccctggcccccggcacgcgcctgcccacctccgccacgctggacaaggtcaacctgctccagctcaacgtgaccgccgggcccgtgatccgcggcgtgggctcttccgccaacgtgctgcaggccgacctgctggcctgcgggccctccatcatccacatcattgaccaggtgctgctgcccttcaacttcgaccaggcctccctggacgccatcaccgccacccaggtcccggtgccgccggcagccccctccccggccgtgaccccggcggggcgcaggctgatgcgtgtgtgagggtgccgaggtgggggaaagaacgccgccccggaccctgcatgcgctctgtttcatgaccggtgcgcacgcggcagcgatcgcctgcatgtccctgctgcagcgtggacgcaggctgtgcatcgtctgacgccccggaccttgggtaannnnnnnnnncaagggaggatgcctatgacagggatggggtcagtacagcccagaccatgttcatggccatggccnnnnnnnnnnagccgaggtggggggaaagaacgccgccccagaccctgcttgcgctctgtttcatgaccgctgcgcacgcggcagcgactgcctgcatgttcctactgcagcgtggacgcaggctgcgcatcgtctgacgccccggaccttgggtaagaactacagccaggaaaagggtgctgcacggcagcgggtgtggcagccgggggtgatgcacatgcgttgcgacacgtccggcgcaaggnnnnnnnnnnnnnncagctcatgtgtgcgcagccttcagccccctcgcctcagtcgtccttcttctccaggggctgcttgccggcggcgccgccctccccctccccggcctccgcctcggcctcgagggcatccgtctgccgccgacgctgctccccctcctccagctccttccgctcatcctcgaactgcacctccagctgcttggcaaggtcccgggagggctccaccactcccaggtccccgctctcagtggagacgatcttgggcagggggatggctgtcaggccggctccgcccttcgtggcagcatccttgccgggtctgagagaggggcagtacaatgtccagagtgaggagtcctaccaggctctcggattctcgcacacgcttggaggggttatagtaaagtcgccggcgactgcatcgccctccgttctatgcacggctgcccctcctccacccgacccccaggccacagtccagatgatcaccgtgactgacgggctgcgcccgacgtgccggcgccaccgcgccccgtggaagggtagggggctgtgccgtgaagttcgtcctccagagccacacggcgctgcgtctcccggtagaaggcggccaggccggcccaggcagcaaaggcaaaggccgcgatcctttgagtgggtgggcagagacgggcttgtggagggtgtgctcactcagggaatgtaccttgtgtgctcaggctgtactggggcggatgctacacgtgtggtggcaggtgcacatctcagcccatggccacacaaggcattgccagcagcgagaatcannnnnnnnnnggagacgggcttgtgaagggtgtgcttactcagggaatgtaccttgtatgctcgggctgtactggggcggaagctacacttgttgtggctggtgcacatctcagcccatggccacacacaaggcattgccagcagcgagaatcacagcaaggaaactcgtcaggctgaccagaccccaatccttcggccgtccagcactcggccggcagccccgcacaccannnnnnnnnnggcaaggaaactcgtcaggccgaccagaccccactccttcggccgcccagcactcggccggcagccccgcacaccagaggttgcgctctgtgcgccatttcttggacagcagggcgatctcctggttgggggatccgtagatgcccagttgctgctggtcacgcagggcacgcagctgcctgaaggcacctgtggaccgatgttaaagcacacgcgattgaatattggagatcattctcacatcacgcaatcgacagctctcctggaatcaagagaatagtacccctgctggaattccagcccacgtctatacctaccaaagaaggcgatcccgnnnnnnnnnncaaagcacacgcgattgaacattggagatcattctcacatcacgcaatcaacagctctgatggagtcaagagaatagtacccctgctggatttccagcccccgtctatacctaccaaagaaggcgatcccggtgaggaagaaggccacatgcaggagcctaaatattcctatcaaggggagatcaaacacccgggtacagaagaggaggatcccacgcctgatactcctagagggtaataggaaatcgatggtcagtgcatgagtccaggctgaaaaacctcgtgcaggaaacccggggaagcgaaggcaccccgtcaatttgacacagnnnnnnnnnngaatcgacggtcagtgcatgagtccaggctgcaaaacctcgtgcaggaaacccgggcaagcgaaggcaccccgtcaatttgacacagggctcctgtagaggagcaaggttgcccactggtaccctgacctacaccgccagctcactttggtccaggtagggctaggagcgcgaagagaatcagcggcaggggcagcaggtagtgtgccaccatccaccatgccgaaaccatgatggcgaggaggggtgtgcgtgaggctggagaatatgtgtgatctggacggtggtattctcaaaagcgtatgcgggatcgcaatcagtctcaatggatgtctttactcaggccggatacgtgtttttgaggagggagtttccggcccacttccgatcctgctttctccgatggtgtgcatcccccccttcccacatttcgaacccggccaagctgcaatttcgagcgagatacggaggctctcctcgtattctatcgaatgggcactgcatatttgatcttgaatacttattgcctactcttcctgggtatctctggagcagagggaagctgtagagnnnnnnnnnnattgatcttgaatacctatcgcctactcttcctgagtatctctggagcagagggaagctgtagagctacggctcctcttcccttttggggctggttagtccgggagtatggcgccgaacgcctcgcaggtgcgattagtcaaccttctgcagctgtagcagcgtattttggctcgtcattacccatctagtacatttcctttacccctgcaggagcgccaggctgcccaaaccctgcgaggagcatacaggaacctcatcagcaaggcccgaagtaggtagggcgctgcatgttctgtgggacatcctggagggtgccgtgcttcctgcacggcattgactgaatcattccaacccatgccatattcccgcgcagatgagaagcacaacctggtcagcacggaccagaacaagcttgcggagctggtcaaggaggccaatgccctccaccacacgggtgagcgcgccgaatggggtggtgctggagatgaggtgtgcaccctgggtgccctgcgtgctgcctgcgcgcggcgacccccgtccaaccgaccgtcaccgcaccgcgcagtggagaagcccagggagagcgccgtggactcggagctcttcgccatcgtcaccgaaagcggcgtggagtttgtgcggaagctcacgtcgggcgcgagggtgaggggaacggcgcgctggggcatggtgtgcgggtttgggggtgcgtcccgacttcacactgcgtgtgtcgctgtgtctgatcagctgcagtctgcccggctcaggtcacccaggcacctcgcccctcctgcccacccacagcaagctcgcaccccagacgacctgctgcgccgcctcaggtcgcgctacgtgacccgcctggaccagcaggcggcggcagagatgcagccctctgccttcaagtggtgagctgtgcggctgaggtggcgccgtgccgtgcgcttcctccgcatcacagtgacaatggacttgctgtccagggacccacccaccnnnnnnnnnntgtgccgtacgctttctccgcatcacagtgacgatggacttgctgtccagggacccacccacctagccagccttccctccccctgagcaggttcatgtttggtcaggacgtggcggggatgtttgcgccctgccccacaatcaagcacatgctggggcccctggaggcgcagcccagggtgaaacggaccttggcgcatcgccgcgtacagataggtatgctttgcgaggccgagggtgaagggatgaggggtgcccggggggaaaggggaccaacaagtgatcgcgtggcggcattcagcctggtgcgctctagcccggcggccgcgccgctcccagccacgctgtggatcgcccagcgccacccccttgaacctccctgcaggcgaggttgtgcgacccgaggagattggtgacggggccgacagtgaggctcgagagacagaccagcagatgaccgacatgtggaccctgctcaagtcatcaagtggcaggtgagggtgttgggattggatgggggttgtgaggaagagatgtgaggggtcgaatggtcccatgcattaaggtcgggcagcaggaattccttgccatactatatcaaggtcaagccaaccctgtgccaaattacctcatcacagggtacccctgatcgagctggtgctcaaccacgactcctttgccgagacagtggaaaacttcttcacgctttccttcctggtaagcgggtgcagttggaggtggggggttgcctgggcatgagaggccatactccggatggcaggcccctgtgcagaactccacacattatcgaaggcatgcatagaagagtcagtttggcaatccctgctatccttgcaggtgcgcgaccgcagggtgtccctcgaaaaggacgagcggcagggcatcatggtcatcccctgcctgggaaggggcagcaggtgcggtgaggagagggcggacagtagcaatcgcacgatttctcacccggacgcttgtgcagtctgtgaccttcgcagcaccgacaccctcgaatgctggctcccccaactacaggcccggcgatgcctcggagagggtgcagttcgtcatggactactccatggcgcagtgggagcaatggaagcaggtgcggtcctcctttctctggatggaaatggggcgagggtaatcgtcaggttacacacagctgcgcgcctgtccctgccactgcgcgtggtctcattcgctgcgatatgctctctgcagcatccaagacaatgggctgacaaatgggtgggctgacgcgtaccacccgtccccacaattcactcccaatggtctcaccctggcaggttgtgccagcctccgcgtgtctgtcccggacgagggcctaccagcggcagtgctccggcgcggagcggccgcagggggggactggcctggccagcgcaccccccgaggataccccccggggtcaagggggtgcgctccccgtggccgccgaggccagactccgccccagccccctcactccagtcggcnnnnnnnnnncggcctggccagcgcacccccagaggataccccccggggtcaaaggggtgcgctccccgtggccgccgacgccaggctccgccccagccccctcactccagtcggcgagcgggcgggtggaggggagggttcggagacacactcagggtcgacgagcagtgccaggtccacgcgtcccgcgagatctcagtccagatctgcggtgaagagtgggccgggggcgccaacccctggcaggtcggtgcgcagtcggctgcaggcatagcctgcgctgggtacagaccctgtcgagtttccagactgcagcctggaggcctgaggatgaagacccagagcgatcccagcatcaacctgataatcatgccccctcgtgacgccagagtatgagctgggctgtataacaaccttgtatgcaagcagtgcgacaggagggtgtgactgggagactagtgcaaaggagatgatcactaattttgatgcggattcggaggaggccaggcatcatgccaccttggcaaaggacttggtgctggccttggctggggcggggagagccgggaacagcatgtagcagttgagggctgaggcgatgatccccagcatgcccaccgtgcgtggcttccagggtcgcagctccagcaggcccaccgccagcaaggcctgcaaagagaacatgggggggcgcagggaaaatgaccatcctgtgctcggacctggaatcgtgcgaaggatgactgtatgtgccggagcagtcgcacgtcccattgtaagaggcgcctggaaacaggcgtgtgccctcacctggaccagggagtgcacgaggaggagcaggtggcgtgtgatctcggcaccgttcttctccagtcgcgcctggtagacctcctccacctcgcctacgcgccgcgcggtcaggcctgcaggagcaggagcagagcattgaaggtcttcagtgcatcccgtcagtcaaatagtcaacactaacaccttggacaatacggtccnnnnnnnnnncgactagtgaaaaggagataaatcactaattttgatgcggattcgggggaggtcaggcatcatgccaccttggcaaaggacttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattggggggcgtagggaaatgaccatcctgtgctcggacctgaaatcgtgcgaaggatgactgtatgtgccagagcagtcgcacgtcccatcacaagaggcgcctgaaaacaggcgtgtgccctcacctggaccaggnnnnnnnnnnaacttgagctgaggcgcagggagaggagagcgagggatggcgtggagtctggacgctggggtgatctgcgggcaaggcaccctgcacaccatgcagggaaaccctcactgcagggtttgagggggcgcttgacctagtcaccttggccagaagctccagcaccaaggggcggttggagttcagtgtggggttctggatgatggggttcaggctctccaggggctgcagtgggggaaaatggtgtgagactgcttagatgagggaatcaggacgcattcagccaagtagtccaactggagcggagagtgtaggcttccgcagggcagccgacctcacccgcatgatgcggaaaactttgcgcgcagcagccacggacgcctggatcttcttgacatcgcctggctggccagcggagatgaacatggccacatactgcacggtggccagcagcttgtccctgccatccgacttgtccaggaactgctgcactccctgctcgaacaggggtcaaggtgggatgtggtacgagcaaataacaaaccattcaaattaccatgcgggtcgcagtgcaccacgtgccttgagttgcgctttgtagctcatcggaggagggttcctacgaaacacagttacgacacccaggtctggtgcacaggcgaggtgtgagagtgcctgtgccgagtgagttccgattcctgtggctttgggatccgaggaagaagtatgctcaggcacggtgcaccgctcaagcatattgcctcaacctgctgactcgaccacacccggtcgtcacgggaccccgcccgcacgcagagcagatgatcgcgcgcagcgagatcgacctgcaccggcggagacccagtgaccagaagccgttcgagtgccgcgatgtaaagtgattcgagtgctggaagcaccgaaatatatatagcaagcactcagtctcggcgcggctgaggcaaatcccccatagcgatgggtcgaccactgccccagggcacccctccagctcccggcgccccaggcccccagcatgcttcctccagcgacgaggagggggagtctgacgaggggtggcaggtgtattccggctcagagacggaggatgagaccgacaacgaaggggctgagggggctaccgagcggcagcagctgtctgacgccatcaaccgtggggacgccgccgccctcctggccctgctggaggacgaggcggtggccgcctgcctgaacgacccggtgcgctgctctgtgcatgcagaagaatggtgcctcggtgcctcgacgatgccatcgacctcccaaagcccccccccccctaatttctacacagaaccgggaaggggacacccccctccacctggcctccctgtacggacaggcagagtgcgtgcgggtgctgctggaggccggggccgacgccggggtgcgggacccggatgcctccaccccgctgcatgacgccgctgcgggcgggtacaccgaggtcgtccgcctgctgctggcctcggacccctgtctggccgcgagccgggacgatgacggcgacacgccgctgcacaacgcggcgcggggctcccacgccgcctgcgccgagctgctgctgggcgcgggggccgacccccgtgccaccaaccatgtgggtttcggagggctgggtggccggggtgggtgggggggcatgcatcaccccatcccaatgtgcaaacccgacttgatgcccctccatcgacacaaccccctccctcgcaggcgctggagacccccgtgcagatgacggaggagggcaccctgtgtcgcgaggtcctcgtggccgcagaggagggcctgcaggccggcactgccccgaccaccgcgtgatcgagagggtattgacccgcgggcgcgtcccaggcccaggcgaccctcctgctgcagacgccgggccttcagcatccggctggttatgtttgcaggggctctcaccgctcggcgggggccagcctccccgccccgccgcccgcagcgcacgtgactgtgacgagatgaatgaagggcccgggccaggggccaccgagtacagcagaaagtttcaaagcagcagtgatggtcctgggtagcaagggtcgcgtgcgtgcagggtgtggcttgggcctcgctcggcttcgccggcggcgtggttccccccccttcccccgccccctgctcagtggggccgacggccggtggtgtcgccgtacaggaggnnnnnnnnnngttccccggcggcgtggatccccgctcctccccccgccccctgctcagtgggggcgacggccggtggtgtcgccgtacaggaggagggccaggcacaccgcgacggccagccccaggaagtgcgcagtctggtaggcgatggccatgtaggccgcggccgtgcccttgagctcgggggggacgaggcgcggggccaggaggttgacgctggtgttggaccagccgcccagcagccagaggacgcacacgaggagcagcgcgccgatgtcgctgcgccaggcagggggggccttgaggtatgcgaagaagatgggaaccactgtggtgaaatgttgcgtgtatttgggggaaagggggggggggggttcagaagagggtttcgtcgcctttgaccgtgtaccaaaacttatgaccacggctacttggaaggccatgcgccgagcaggcgagaaccctgcacggtgggcagcctgggattnnnnnnnnnntatgttgcgtgtgtttgggggggagggggcgggggggggcgtcagaaaagggtttcgtcgactttggccgtgtaccaaaacttatgagcacggctacttggaaggccatgcaccgagcaggcaagaaccctgcacggtgggcagcctgggattcaccaccacaccctggcaccagggtatccctacacgcacgcacgcacatgcacagccccccacagccatgccaccggcgccgcacgcacaggcgagcttgaagagcgcaacccctagcagggcgcgaggtgaggagggcgtggcgaagcgggagcgcggggccaggcgccccgcgatgtcggcaaagacgcgggcaaagaagaggatcttcagggggggggagagggggcttgcttgcacgcatccaggaatactgaatgcctggcccgtgggcaggaatcaaagtgcacgagggtgcccagtctgagcatgcggcagcccctctcccatttctgagctcctcccgcgcacaaaccccgttcccccatccccccctcctcactcaaccctgcgccacctcaccctggggaaggactcccccagcaggcccgaggagggcacataggtgaagaaggggaagacggtgagcgagatggtgctggagacaaagtgcgcggtcagcggcaggcggatggcgtgcaggacctcgcggccggcgcccacctgccgcgcaggagacccaggggccgccgnnnnnnnnnnnnnnnnnnnnnnnnnnnnnnnnnnnnnnnnnnnnnnnnnnnnnnnnnnnnngcggcgtgggcggcgcggcggggttccatgcccccgggcccgcgccgccgtgcgccgcgcagtctgccttccacgcgtcgtccggcgcggccctctccagggcgccgtggaaggagccgtcgtccgccaccacctccccgtccgtggacatgtacgtgcggtacggctccaggctggagtaggagaccagcgggtgcatcagcgcactccccgacccgctgcggggcccgcactccagcgggcccccagggctcagcaggggcatgcggggtccctccggcgcggcacctgcactcgtgaaccccgccgccggctccccgcccgcgccggcatccagcgccgcccagtgccgcgcgacgagcgaggcggcagccgccgcgccggcggccacgatcagggccaccgcgccgtagagcaggaccatgtcggcgtgggaggcgtggggcccgatgccagcgcagagctccagggccagcaccaggggaccggcggcggggcagcccatgcccagcgcgatgacgttcttgttggcaaagcgggacaccagctggtaggaggcggagaaggccaggccggagaagaggcccagggccaccacggtgatgatgaggacgctgttggggcgagtggtggaaagagaggagaaacaaggtttggagggagggggggggatgttggggtgtggggggtgcaccatagaatgcatgtgtgtggaccgtggaacaggctctgtaggaagagaacatggagtgggcagttgggaccaatgcatggcagtggtagaccaccacccacactcaggccgccaacctcgcccacctgaggtnnnnnnnnnncaggacgctgttggggcgagtggaggagagagaggggaaacaaggtttgaagggaggggggggatgttggggtgtggtgggtgcatcatagaatgcatgtgtgtggaccgtggaacaggctgtgtaggaagagaacatggagtgggcagatgggaccaatgcatggcattggtggaccaccacccacgctcaggccgccaacctcgcccacctgaggtctgtgggctggaaggggaaccaggcggcgagcaggccatagcccaccaggcccagcagcagccgcagcaatatgttccgtgccacgcctggcgtgttgcaggggtggggagtgtggaactacgaaaggggaaaagaggcgcacggggagaccgccggccccctcacccacggcacacgaggcccgggccggcagcggcccgcatgggcgacgctgggggcaccaagcacagagnnnnnnnnnncagaggcgaacagggagactgacggcccccacccgcggcacacgaggcccgggccggcagcggcgcgcgtgggcgacgctgggggcaccaagcacagagatgcaacgacctacccagttttcggtccaggtgccgatcaagcaaggaggaaaggaggaggagggggactgcacaggggtggggtgggcgggtggcagtgtggcacttgggggggcggtaggacacctacatgtggagatgaacgacagcatcgaactcacctgtggggaggtagtatgcaatgttgagctgcagcaagatttgaggtccatacaagtccttgaagtagtccagctgggaggagacggccaaccaggcggacgtgtaagcggtgctcacaaggaagaatcgcgcaacagtccatttgccccccttgatcttgttgggcatgttcaacattggaatggccatgacttcaggggtgggggctgaggacgtctcgccccaggtcccaggcctccagagtcaaagcttgcgacctggagcggccggtggcagcagccccgaccggcagggcagggcaatgagatattatagcattgataaagacatgcttgcagatgaattgtccggtaagagggtggcaaatgctagtcatggcgccgtaaagcactgattggtcatggcgcctggaaaaactgagcttacgggattcgaaggaacaaggaatcttcccctgcgcaattatccgccatcttgcttaacggcgagcatccatcgagtgacaggacaatcctttatacatggagtggtgggtgtgcattacctgccttctttcaatctgtatgcccagggctagatgcactgcttcatgtgtgggcttgttggcaggcgcccacccccaccttacacaggtttcatgataggacgatccggaatactaagatttggttagtgcagggagaattgtgaccttcgctgtcacgaaattcactccaagccaattctgtattctccagtactttcatttggatgagtggcggctgctggaaggcatcctccacgattttttgtgcatgtcaccccttcagccacagtacgcatttgtgaaattgtgagagctaattccatccccgtgacaccaatctctcatatacctttggtcaaccccactccacttgcagctgtggcagctgtctgaccnnnnnnnnnntcacaggttttatgattggacgatccggaatactaagattctggtagtacagggataattgtgaccttcgctgtcacgaaattaactccaagccaattctatattctccagtacttttatttggatgagtggcggctgctggaaggcatcctccacgatttcttgtacatgtaaccccgtcagccacagtacgaatttgtgaaattgtgagaactaatcccatccccgtgacaccaatcttcatatgcctttggtcgaccccaatccacttgcagctgtggcagctgtctgaccaattaagtgctggagtacgtcaaacgggttctccaggcgatgtgttacaagtcattcaaccagtcctccaaggacttttcaggagcactgatcttgacagctacagaaccctggacatctgctcctgatcccccaccnnnnnnnnnncggctggaatacgtccaacgggttctccaggcaatgtattacaagtcatccaaccagtcctccaaggacttttctggagcactgttcttgacagctacagtaccctggacatctgctcctgatcccccaccatgagctgccacctccttgtggctgggaaaggcctgagccggtgcatgttggtgcaccgtgcgagcgcctgcagtttcgtccgctttcatgccagcagaggttgggtgccgcaactcccatgggaccctggcctctacttgagcaaatgtggaaggggcgcgcacatcggtgtcaggggcgtgtgcttctgcatcatggtagggctttggcacgtccgacccactgcaaggctgagcttcgccgctcatcggatgagcagtgtttctctgtggagagcattctgcaggggtgcctctgccttttaagggtacttctgctgctgaatcatcgggctgtgaagggccggctagggatttaccatcaagctgaagagaagcgtctgcagnnnnnnnnnntcttgtaagggtacttctgctgctgggtcatcgggctgggaagggccggctaggaatataccatcaagctgaagagaagcgtctgcaggcaggccgaagagcacctccgccagatgctttacatccaacaccatatcctgccatgggtatatgcactgactcttttgtgcatttgtggaatcttgaggcataatgatcaagacatcatcagaaaggtgttttccagaggaggttcggagtagcaaaaggcccaagacacaatcaattgccttgcccnnnnnnnnnngatggtcaagacatcatcggaaaggtgttttcctgaggaggtccggagtagcacgaggcccaagacacaatcaattgccttgcccaccgcatccatggcctctctacccagaagacaaagtcaatttacctcaatgggctcagtactagctggtggtaggcagtactcctccatgaggctgctcggcgtcacaggcataaggcctggttcattgtgcctgtagtgtgcgatcagatcctcccaggcagctcccttggaaagacgaccgctggcggacactgcatgctcagcttcgtcgtatctgtggtcacgtgtgaggagatatagagctagggcgccggaaaagcacctgaaccctcgactgttgccccacctgcacacctgtcggcattggaagccagctgggtgggaccgccaccctgtcgatcagcgccttcagggattttccctccccgtgtgcgattcctggcactcagtgtcttggagtgttgccacctccttcgcgctgcttctttggcagacgcgtccatggctgcccagttgtgctcgtgttgtagagtccaccgcgtcagtccgatatcccctggctagttgctgcaggcacggaactatgcagcctttgtgtgttgaaaaggcacacatgcttctctgtcgatccataatcgcgatacaagaaacgccctggaggaatgaatcatgcatccttttccgcgccctgcnnnnnnnnnnattgtacttttgttgtagagtccaccgcgtcagtccgatgttccctggctagttgctgcaggcacggaacgatgcagcctttgtgtgttaaacaggcacacatgcttctctgtcggtccataatcgcgatacaaggaacgccctggagggatgaatcatgcatccttttccgcgccctgccacacgtagatcgcaacgtcatgtgcagcatgttcgcatccccagcattacaggcgcttgcaggggcaatctgttcctcatagcaagacatatagttgggggtagacccacacgtcgcgattcctgaaccatggcgcccgtcgttgtgtgcggcgctggggtcattggtgcctcagtgtcgtatttcctggcacagaagggcctaacccctaccgtcgtcgacgctgtggggcctgcatgtnnnnnnnnnnccctcaaccatggcgcccgtcgttgtgtgcggcgcgggggtcattggtgcctcagtgtcgtacttcctggtacagaagggcctaacccccaccgtcgtcgacgctgtggggcctgcatgttcagcttccggcaaagctggtgggtacagggtcatgcgaggtgtttgaacatcgcttcgcctcccatgccaatgcacagatcatgcagccccatgacgctgtgctgctcggccctgctgcttgcaggagggttcctggcgcgcgactggtgcgacgggtcccccactggacccctggcacaggccagctttgccctgcacgccgacctggccgacaaactgaatggcaaggagcggtatgggtacaggcgcatgtcaacctacaggtgtggctgcatgcagggagggtcgggtttccatcgggacctggttattgataggtaggaaataggtttagtacacannnnnnnnnncggctgcatgcagggagggttgggtttccatcgggacctggctgttgataggtaggaaataggtttagtacacaagagaagactgctatctacccaatggaatggggcagtgggaactacaggagacagggcgccagcctcaaaatgtccgacagacctgaccactctcatcctgatcttgtcaggaccttgatgctaccattgagaaacaatccttcccttttcatttctccattccagtgttagcctccgtgccggnnnnnnnnnnggatgctaccattgagaagcaatccttcccttctcatctctccattccagtgttagcctccgtgccggcggcgggaagaagggaggtgcaaagggccggaagtcggcgtccctgggctggctggatgctgaccatctggtccaggacagtctcatcgccactccagaagattgcgcccaggtagttgtgtgtcatcgcgtgcttaggggatgcagcgtttcgtctgccctgaatctacatcaggatgaccagcatggttccctggctgtcnnnnnnnnnngtgtgtgtcttcgcgtgcttaggggatgcagcgttttgtctgccctgaatctacaccaggatgaccagcatggttccctggctgtctctagctgtggctggacaccctggagcccccttctacagatcgttggacaatttcggccccactcctcccccttcccaggtgaatccggagcagttcacacgcacgctgctggaggagtctggggccgaggtgcgcatcgccacgctggcgggcctcgtggtggaaaatggggcggtggccggcgtgcggctggagcctcgcgacggcggcccagccaccacaatgccggctgacacggtcatcatcgccacgggcgcttggacaggggccctgcgggccgccatccccggccttcctgctatcaccggccagaaggtgggtgccggttgttaggtgtgtgtgtttctttttcggggggagggcggggtgtgtcgtgcagcggctacgcgcagtcctgccctccccaagcgtgggcgaatgccgaggactccagaaagcaaactgcccaggcccacaccagtgtctagaaccgctgcagnnnnnnnnnnttgccttccccaagcgtgggcgaatgccgaggactacaagaagcaaattgcccgggcccacaccagtgtctagaaccgctgcagcggcggcccatgcccgcccctcgctgggcgtccacccccattattcatgcttggtactcacacaccagacctcccactcctcacgccacctgccgcaggcccacagcatcatactagcggacgccgcgccgggcggcctgcccgccgaggcgctgttcctagcgtaccggggcacggatggcaagtcccaggagccggagatctacccgcggcccaacggcgaggtatatgtgtgcggcgccagcacgcccacgcccctgccgagcttcgcagaccaggtgctgccggacgccggcgcgcccgctcggctgcgcgaggcggcggccgccgcgtcgcaccacctggcgcaggccgaggtgctgcgggagcaggcgtgctacctgccctgctcgccggtgggcacccccgccatcgggccggtgcagggggtgcggggcctgtatgtcgccgcggggcactcctgctggggcatcctgaacgcccctgccacgggcctggccctggcggagctcatcgtggatggcgaggcgagctgcgtctccctgcgggctttcgagcccgcccgcgtcgggtagtcgagcgggggcctcctgcggcggttgcgccgcatgttgcgcaggggtggcgaggcatgccgccggcagatcgatgcacccagggggtgcccattgatgatgcaccatcatgtttatgtaacaatgtacaccagtggagcctgtggaggtgaacaacatgcttctggcctcagggaccccttcctgcctgtctttccacatggctcctaccagccgcaaacgctccaatggtggtgggaagctggtcggggagccggcgacagggccatactccttgaccaggtcgatcctggtcagaactcaccaaaataatggcccctgagcatcgcctcgaggagccagcgtccgtgcaattggcggtacggaacttgaggcgcagcgtaggcgacaacctcatccactccaacctgagcttctccctgcgcagcggggagatcctgttcgttcgaggacccagcggagtcggaaagtccgtgctcctgcgctgcctggcgtgcctggaccccatcgactccggcagcctcagcctgagtggacagcctccagagaagtggggcctgcctcgttggcgctccctcgtcacgtacgtgcaccaggcgcgcatcgcacaccccggcacaccctcccagtactacttccggctgcagcagctggcagcccagcggagcagggagaggggagacctgccgtccatcgtctccagccttggtctcgagccagaggtcctcaaccaggcgtggcaggagctttctgtgagtgccgaggggcggctgtgtgtggtgtaccttgtaattggtgccattcctggtgcctggggcaagcactggtggcggactgttcttctgaaatgggaccttgtcattcgaacgctgggcgctgtgcatnnnnnnnnnnttgccattcctggtgcctggggcaggcactggtggcggactatccttctgaagtggggtcttgtcattcgaacgctgggcgctgtgcatggaggggcgccgggcaccttgcctcctacggcccactccggcagcctccttggacccctcgactggatgacacatcatgcctgtaccaactcctcacacaacaacagggagggcaggcgcagcgcgtgtccctagccattgccctggccctgaagcccgccatcctgctcctggacgagccgacgagctccctggacgccgcctccgcggagaaggtagaaagtgcgctcaagacctgcggcgctggcatcgtctgggtcagtcacgacccgcagcagcccgaccgcgtcggtggtcgcgtcctgaacctgccagccggcaccgagggccaggcggggccgggagtgccgaagcccgagcctaacacgcaagtcaaagctttcgcagaggagtagggcacgcaactgccccagacgctcttcgctgttcaatcgccgaatcgagccagcgggttccaagacttcacgatctctacatacttatagcagccagtcgccgccgacagcggccatcattctgcagcannnnnnnnnngggcgagactccacgatctctacatacttgtagcagccagttgccgccgacagcggccatcattctgcagcagctccgattcagatcgcaatggccctgccctttgcacagtcgctgaatgcaacggccaccggctgcatgctggccctgtccatggacccgacctcccacctcctcttcgattaccatgacggctctgtgccggttgggaagagggaaggcggcccggtcttcatcactcccttccgcctgggcctggctgcggcggtcatcctggtcaacggcctggtctccgtttggctgcgcctggccatgcacaagaagctggccatcgccaccgtcaggttcgactggaaggagggctggtgctctgtcgatccgggaagggagagcggttgtttgcatggtggaggagctgattgacttcgctcgaggttcaacctgtttgcacggtggatggcttacttcgtgcactcatgcagccacctgttccccctttttcccccccttctccacacacacacataccttcctaccttcccacattccgtgccccatgcagggtggtcctgcagctgtccatcctgggctacatcctggtgcccatcttcacggccaacagcgcgtgggtgacggccgcctacctggccttcatgctgctggtggcggggctggaggcgctgtctcgccccgccctgacctatgacggcatgctgtggcaggtgctggcctcgctgggcctgccctgctccgccatgctggcctacggcctgggcgctgtcatccgtccccggccgtggtacgacgcgcagtacgccatccccgtggcgggcatgctgctgggcaacgcctgctctggcgttgccatcggcctcacctccctcctcgacgacctgtcctcggggcgggaccgggtggaggcgctgctggcggcgggggccacgcgctgggaggccgcggaggacggcgtgcggcgcgcggtgcgcatggcgctgacgcccacgctgaaccagatgaacgtggctggcatcgtgtccatcccgggcatgatgacggggcagatcctgggcggcgccgaccccaccaccgccgcgcggtaccagatcgcgctgctcctcttcatcgccgccgccagcggggcgggggctgtggccgccgtgttcctggccgcgggcacgctgctggacggcgcacaccgcctgcgcggtgaccgcctgtcgccgcgcggcaccacgggcaagggcgtgctggtctggctggcctggcaggcgcgccgggcagggggcggcgcggcgcgcgcctggaaggccggcgtcgggcgggttcgtgggggccctgagcccggcgccgaccccaccgtggtcgtgcatagggggggcgaggtccgcgacggcctcgatgaaagcctcctgcgcgggcgctagctgtcgtgcnnnnnnnnnntgggtggcgaggtccgcgacggcctcgacgagagcctcctgcgcgggcgctagctgtcgtgcgcagggaggggcggcgcggacggccgcattctctgtacctgggaacgcagagcacacagatcctgtggtggtggcgcctcagccagcaggacgcgcaaggttctgtgctgggccgccgtggcggaagcaatatctgatcttggtgatgttgagtcccacaccatagcgcggcaatggattggtcttctgaagggctgcggctggatgcccttgcacgctccccctaccagagctcagcagccacacttctcaaatgtcttgtaagtggatgtcatagtattgcccaacatgaggagtgacaatcttggcccgatcaacagtactggtcagggctgcacaaatacccctcgtccgggatctgcctcgtttccacagagcattgtgccattgatatgaatacgcgtctgaggctttgaaaagcgtgcaaaatgtgccacgacccctgcgatcnnnnnnnnnncccacagagcattgtgccattgaaataaatacgcgtctgaggctttgaaaaacgtgcaaaatgtgccacgacccctgcgatcagaggagcctggctgtctcagacaccatccacgctctgtaagttggagataccatccgtattgccagaggaccaggattccgccttggagatcacaattcaagactaattcattcattcatgaatgcacccagtttgttcgcgtatagnnnnnnnnnngatccacgctctgtaagttggagatatcatccgtattcccagaggaccaggattccgccttggagattataattcaaggctaattcatccatgaatgcacccagtttgttcgcgtatagcagttgaagcacagttttggacttgcgagagaacttcgttgggacctggatctcgggagcgccttcatgcggggcccaggctccgaggggaggcctgcttctcagcgaccaatagcacgcatagacgacaacacaatatagttccaataccaacaagcgttgaaaagcctgccttgatcggctttcggtgtcccaccggatgcccctccgaaccatgacgtgtcgggaccccgcgagaaaattattctcatgcagtttcggaggtccgagcatctgaatccaggtgtggtccaggcaccaagcaannnnnnnnnnaaaacatttattctcatgcaatttcggaggtccgagcatcggaatccaggtgtggtccaggcaccaagcaactcgcgctgggtccaagcaatagaacactcaagctctgtcaggggttcaagcgggtttagacgagctcatgaaccgcaggccgcacacaggagccgagtccggtggtgcctaggataacgcgacaacatgtcgattgccaccccacagccagcgtacagccccttctcacgcgcgnnnnnnnnnntgcagtccgcacacaggagccgagtccggtgggtgcctaggataacgcgacgacatgtcgattgccacccagcagccagcgtacagccccttctcacgcgcgtttaattcctggtttgcttgcatttaatccgaggatgtacggcatggcttacatccgcctcgccatagtacttgcagcggtgtgcagcgtgacagccgtggccggtgaggaggcgggtgaaggggccggggaggcccgcacccttgtgaagggaggcaggcatgcgccctgcaccgggcctgcgtccatgtcggcgaatcataccggcccaattgcatgtcgtgaaggcgcggcctcttacgtggcgtttccggagacggcccaacgaatcctgcctccccccctgcaggctcctgccccaccggcttctccggcccccagtgcggcgtgtgcgagtcggatgccgcctgcgccgctggcaccaacgactccggcgctacgtgctcccacgacgtcgcctacacctccaacagcgtcaccaagtcctacacctgcgagatgggcaccggcttcctggcatccatcgtggcgcccaacaccacctacgtcnnnnnnnnnntaccgccgccaccaacgactccggcgctacgtgctcgcacgacgtcgcctacgcttccaacagcgtcaccaagtcctatgcctgcgagatgggcaccggcttcctggcctccatcgtggcgcccaacaccacctacgtcacgtgccacaccggcgcccaggcggggcaggtcctggcgcccagcgccgaggctccggcgcccgaggccgggcaggctccggcgcccgaggccggcggcgccatcgggacaggcaactgtgacatcggcttcgtgctgaacaccacatccgtccctgtgctctgctcggccacctcctgccagatgagcgcgggcgcgctggacgtgtactgcggcgacgtgacctgcgcctgctccggcgcctgccccgccgggctgatccagggtctggtgagctcggtggcgggcaccgcgaccatgacctgccagcccgggggcgcctgcgccatcgccatggaaggcctgcccatcgcctccatcgacgtgcagtgctcagtgggggagtgcctggtgcccgtggtgcggccgctgggcaacgacacgctgccggagggcgacgtggcgcacctgagcatcaaccccttcatcgccgccatcccgctgctggcgctggtcacgctgctggcgggcgtgggcggctacgcctgggcgcaccgccgcctctgggcaccggcgtccggcgcgctggacgccgccgcgctggccgcgctggccgacggcccggccgcgctgccgctgcgccgggtggccacgctcaccttcctgggcctgggcgtgagcgtgcccatgaacccgcgcctggcggccaagaagcgcgcggccatgcaggtcaaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcctgggcgtgaacaccagcgaggacgcggaggtgcccgcgccgcgcggccgcgcctgggcgcccgcgccgcccgcgcagagccccgcggtcgaggccgcggctgcggagttcgtggcgtccctgcacgacgtgcccggccagcgcgggcagtgggcggtgctgggcggcatcaccggcaccgtgcacggcggcgaggtcgtgggtgagcgaggggttttcttttttgttttggtgggtgagtgtgtgtggagggatgggggatatagtaggggggatagggttccaggcaaggggtggcttgctgtgactctctcatcgtgcgcaacaagctccccagggccaggcggctgtgacctgagnnnnnnnnnnatttttgttttgttttggtgggtgtgcgtgtgtggagggatgggtgatatagtaggggggaaagggttctaggcaaggggtggctttctgtgactctctcatcgtgcgcaacaaactccccagggccaggcggctgtgacctgagtccattcctcacccccaccaccccaccaccctccatcccaggcgtgctgggtccgtctgggtgcggcaagacctcgctcctggggtcgctggcgggggcggccatggacctgggcgcctccgcccagaccacgggcgaggtgctggtggacggcgcgcggcggcagaaggccgacgtggcctacgtaccgcagtccgacgtgctcatcccgtcgctgacggtgcaggagtgcctgcgctactccgcgctcctgcgcctgcccctgagcacctcgcccatggagacccagctgcgcatcgagcacgtgctggacgagctggcgctgcgccacgtggccgactcgcaggtcggcggcgccggccgcattcgcggcatctcgggcggcgagcgccggcggtgagtggctgacgaagggggccaggagggttgttgggggatatgtatgagaaaggaggggatgggccttcatgctcccccttcttcatgcacagcgcaccccaccctccccggtcaaaccccccctgcggttcctccacgcccgcagcgtgaccatcggcatnnnnnnnnnngggctggcgaagggggccggaggggttgttggggggaatgtatgagaaagggtgggatgggccttcatgctccaccttgttcatgcacaacaccccaccttgagccctccccggtcaccccccccccttccctccacgcccgcagcgtgaccatcggcatggagctggtcaccgacccggcaatcctggtgctggacgagcccacctcggggctggactccttcaccgccctgaacctgatgcgcacgctgcaccaggtggcctctggcgggcgcgtggtcatcgcctcgctccaccagccctcccacgacatgttcctagccctggacaccgcgctgctcatgagccacggccgcgtgctgttccagggacgccccgctgacgcggaggcctggttccggggtcgcggcctgccctgccccccgggcaccgccatggccgagcacctgctcaaggtggccagcaaccccgccgacatccaggccctgctgcttgagcggggggggcagggggcggacagcgcggcgctcctgcggctggaggacggcggcgtgcaagtggaggggggctgcgcgcgggagggcatccctgacgacggcgcctcgccctcggacacagcctnnnnnnnnnnggagcggggggggcagggggcggacagcgtggcgctcctgcaactggaggacggcagcgtgcaaggggggggggcctgcgcgcgggagggcatccctaacgacggcgcctcgccctcggacacagcctnnnnnnnnnngcgggaacatggactccgcggccgaagaccgcagcccggaccgcgtggcggcggcctggaccccggtcgccgcggcggcagcgacgcacaagccgggcaaggtagggcgctcggcgttcggcatgagcgcgacgcctggccccgagccgcgccccgcgccgcgccgccccggcttcgcgcgccagcttgcggtgatgacgtggcgcacggccattgacatcctgcgcaaccccacgctgctgcgcctccacctgggcatcggcctgctgatgggcgtggtgacgggcctcgtcttctggcagctggacgatagcaatgtgggcgtgcagaaccgcatgggcggcaccttcttcgccctcgccttcctggccttcacctccctcaccaccgtggacctgctcatcaacgagcgcgccgtggtggcgcgtgaggtgcgcggcggctactaccgcccctccgcctacctcctgtcgaagctcacgctggacgccatcttcctgcgggccatccccgccatcctctactgggcgcccttctactacatggcagggttcaggggcggcgcggcgtaccaggcaacctacctcttcatccttgtcaccttcagctgcgccgtgggtgagcgcggtgtgtgggtgttgagggggggggagggtgctgtgcgttggagaatgggaggctgctgggttctgtgagcgggggtccatactccctcacaggggctcaggcagcaggtgccagaccgacgtgcggtcaggagcatccgtgagctccattgtcccacccagcacggcctgccattgggttcccccgcacgtggnnnnnnnnnnggtgtgtgtgttaggggggtggggggggagagtgctgtgcgttggagaatgggaggctgccgggttctatgagcgggggtccatactctctcacaggggctgaggcagcaggtgccagaccgacatgcggtcaggagcatctgtgagcttcatcgtcccacccagctcggcctgccattgggttcccccgcacgtggatcctccagccgtcacctcacttccttctctcccccaatcccgcgcaggcgccctgtccatggcggtgactgtggcgtcaaacacggcaggggaagcctcctttgggatgaacttcatcatcctgttctcgatcatgtttacaggtggggcggggcgctaagcgcagaggtggtgcagaggtagccagtgcgagagtcgaccctgacgcacgcaatcagtcgcaggatgccaagccccggtgaaacccttacacnnnnnnnnnnggtgcgagagccaaccctgacacacgcaatcagtcgcgggatgccaagccccggtgaaacccttacacagacgtgccacgacgcaagtcggcggcaccaactctacctgctcacgcgttcctcctgcacacccccaccatgtaggcttcctggtgaacgtatctnnnnnnnnnngtacggccccaactctacctgctcacgtgttcctcctgcacacccacaccatgtaggcttcctggtgaacgtatcttccatcccggcctaccttcgctggattcattacctcagtgtcttcttttacgcttttgaagccatgattacgaatgaaatgactggacggaccttcacattcatggtgggtcattatgaggagagggccgaagcgtggatgatacgacgatggtcactgcatcaacttagcatctctctcatctcatggaggaggatgtagatctgaccagaatcttccctcttggaatggagcatgcatttagctttacttgccgctcacttcgacaccctgcaccctaagccttcatatcatcgtcccattcccaatcccgacaggcctcggggtatgcccaaatagaaggcatcaacggcaacacctacctgacgacactagggttcgatgccggcgccacaacccgagacatcggcgtgctcgtgggtctttacgccggcttcaccttgctgtgcctggtgctgatgcaggcgcgcatgccccatagcaggccgcggatcaagaacatcatgcggcggctgagcctgcatcgctgaaggcatcgccctcgatggttgcaccctgtcgcttcacgcagtgcagggaggggttcaacagtcctttaatgctgcacgtgatgtgtatagtaagcacccttctgaccgagggcagacggggaaggatcggcgccgttctcaacagcttggtgtgagattcgcaaacggaacattggaggaaagaaggacagatgcatatccagcagaatccttgtctgtcggaagcagtatcgtcacaaaggtccacgatcgacggagaagcaagagctgaaaattccgagaaagtgttcggcagccgtctagtgtgactagaggagcgagtacgcccacgatgctggcgaccagnnnnnnnnnnttgaaaatttcaaaaaagggatcggtagccttctagtgtgactagagcagcgagtacgcccacgatgctggcgaccagcaatgcgatgtctggagtcggcaccaggcccgttttgggcctcccacacgtccccttcgcccacaggtatatgcaatgcgcatgtcgagtgtattatttgccactccagcacgcatcgatcctgcgatgtctgcgtcgtccatctcgcttttcaattgtacgcgagcagggcggggaccgctggagtcaagcccctccgccatgccctgcggaggtccaggcgctcgccggtggtgaccgcctccctcgtcgatccctcggcactctactccctgagcaccagtgccgccgatgcgggagggtccagcatgctggctctgctcgcgggctcggccctggtggccggcctcctgtaccacacctaccaagtcaaagcacaccgccagacgagcctggcctcggtcggtggcgttgcctcgccttttgggagctcgtttaacagcgtcaggcaagacgccacgcgcctgcccagtgcggctgttgccggcgccatggcggcacccagcgctgcacccgccgctcccatcggattgagccctctggaggagcaggaggaggtgcggctgggcgcacctgacactcgcccgcctgcagcggagtggattgctgcctggagagcagccctggaggcgtctgcaccccagctgagcaatgggaaggctgcgccagaggtatcggtgctgaagcatgccaccgaggcggagaaaacctctctgccagttgcggcccccgtggcttcgacggcgaaggtcgcctcagatagcagcgagcctcaggcagcccacccaacagtggccctggcagagaccgtgcctgagacgcctgctacggtggccgccgcggcacccacccccgcacctgnnnnnnnnnntcagttgcggcccccgtggcttcgacggcaaaggtcgccccagatagcagcgagcctcaggcagcccaccaaacagtggccctggcagagaccgcgcctgagacgcctgctgcgttggccgccgcggcacccacccccgcacctacccccccccaggccgccccgctcgtcccacctccccaggccgaggcgagcattatcgaatgcatgagctggaatgactgtgggcttgtgctcttgagcagccttgcttgcatagctgaggcagcaagcctgctccnnnnnnnnnncaggtgagcattatcgaatgcatgagctggagtgattgttggcttgtgctctcgagcagctttacttgcatagctgaggcagcaagcctgctcctgctcgactgagacctagcactctgccatctgacccccatattttcatcatccaccttctacaggcatccggccctgcctatcagacgcgactggccgagatccaggcgtcctcgctgggcgacgtgaagcgcagggtgaggatcctcggcacatgcacatcgctggctctactctgtttcccattgattaagccaggaagcatgccaaactgcattcattacgcatagcctgttttgcgcatacagcatccccagtccttgaatgcacacatgttgccattcccatccaggtggtctccatcggcgaggcgtaccagtcgaaggtgggcgagctctggtcctcgtatgccnnnnnnnnnngtaccaggaagcatgccaaactgcattcattatgcaaagcctgttttgcgcatacagcatccccagtcctttgaatgcacacatgccgccattccatccaggtggtctccattggcgaggcgtaccagtccaaggtgggcgagctctggtcctcgtatgccaagcgccaggcggtggcatcccccgtcattgcagagtcggccggaagcccccgggcaccggtagaggagaccatcaccctggacgtcctgcccaaggtgagaaggttgtcatggcaactgcatgtgcacgtctgatcgccaatgcggatgccctggcgtggcccccccaacccgtgcatcccacatccctcgccctccaactctccaggcccagcgtggcggcgcccagctggcgccagctgtgcagcgctgggtggcagacgccctgcacaagctggggctccgcttccgggccctgctggaccgactggcggccctgcaggccggcctgacgcacgacgccgctgggcgggagctgggtttcctccaggcactcaaggctgtgctgcgccagttgctgaagggcccacccccttccaagggagggcagaggcaggcgctgggggcctgatgcatgagttcggtggagacgtggtgtgcaagccgcacccgtgtactgttctgacaatatcaagtccccttgttacgagcagggggcacgcctagtcagctcttgatattagtaagatctactccatgtgtacagcttcatcaacgggcattactgccccccccccctccccgctgctgctcctcctacaaagtggcagccattttctgcttgcccatgccttggtgtaagatttatgacgacctctgagcatggcatgcagttagggccattccagagggcacaaccctgtcgcaccagatcatctaagactccccagcacccgccgccctcaagcggcagcgcctgacgtcgcgcgccagcaggatcgcagcgcaatccaggatctggtcgacggccgtgtcggcgcgcacaagcagggactcgcccgacggccagcttagctcccagacagccgctaccccgccgctatctttgtcagattccggatcccccagtcgccgtcgcctgcgccgcttggagcgcccttgcgtgnnnnnnnnnncctggtcgacggccgtgtcggcgcgcacgagcagggactcgcccgacggccagctcagctcccaggcagccgctcccccgccgctatcttcgtcagattcgggatcaccccgtcgccgccgcctgcgccgcttggagcgcccttgcgtgtcgatgcgcccccgcttgcgagtggcctgcccgagggggccgacggtcaggccgcccgcccgcagcgccgccaacaggtcccggctggcaagcagcccggcgcgtgcggcgaagaggccgaggaggtagtgccgcgccagcgctgttgcgtctggcgtgagcctctggcgcaagaaggcatgcccctccacggtttcctcctgcaccgcctcgagagcccggcgcactgcctggagaagagacccgggggggatggtcttcttggtgaaggtttactcaaggtctacagccggcgccaaaccccacccacgtcacatctgccaggacaggggcaatcactggccatcgaaaggtacgannnnnnnnnnagagaccggggggaaggggtcttcttggtgaaggttactcaaggtccacagccggcgcccaaccctacccacgccacctttgccaggatgggggcaatcactggccatcgaaaggtacgagtgcgcaaccccagccaggcacacctgcccctggaccgaggcaacctcctcgctctctcgcagggccgccagaagcttgcggggcgagcaccccagcgcggaggccaggaccgccccgtccagcgtcggccaggctgggtggaggaacaccaggtcctccggggcgtcgtcttggagaccagcagcggaggccctcaggcctcggacgagggcgaggagctgctccggcgacaagctggggaggagccgccgggtcagtgccctccagcggtccgggcgaccgagggcgccacacaatgcggcatggatctccctgcccatgtggccgccggggtcgtcgaccaggcaggcgtgcagcgcctgtggaggggacgacgagcgagaggcctggtgggctgttgaggtcactgggcggaaggggggtggacaaaatctctagacaaccaaactttgactgcagctgggcaggaaagtcttggacatgacctgtgatgtgaggcaggacatcatgcgtttccatggaaagggtgcacacccctccttttgccccgcccacactccttgctgctcccataccgaggcgaagaagcctgnnnnnnnnnnatgcacacacctccctttgccccgcccacactcctcgctgctcccataccgaggcgaagaagcctgggtccacggagagcagcgttccccccgccaccgccccctccacctcaggggaggccaggaagccggggtcgcgcgccgcgagccccgcagcgctggcggcgccgtccagctcgcaccagtagtgcggcctctgcgccaccgccaccggcgactgcgcgtgcttcccggcccagacgaggtgcgcccaggcgctgccacgctgggccagggcatagcgtgccagggcctgtgcccccattcccgagcgctggaggccatcggggtggaacgcagcaaaccactcgagcagggagggcctgcgccgcaggcagcgggacaggaaggccgggtgtcggctcagcacggggcccagggtggcaggctccgtctccacaatcgcctgtgtggcagccagggcaaaatcggaggtggaggcctccacgtccgctcggcactgcgggatgnnnnnnnnnnagggtgtcggctcagcacggggcccaaggtggccggctccgtctccacaattgcctgtgtggcagccagggcaaaatcagaggtggatgcctccacgtccgctcggcactgcgggatgaactgggccaggaggtccgagtggccggagggatggccgtacctcgccatgtccaggtcactgatggagttcatgagccattgcttggcctccaggtgcagggagggatcgctctgtgatgggaggagaggaacagggatgggcgccctgaactgccttcctggatggccctggccagtacgnnnnnnnnnnnnnnnnnnnnnnnnnnnnnncagggatcgctctgtgatgggaggagaggaaaatggatgggtgccctgacctgccttcctggatggccctggccagtacgctgtggaattaaatgtgcgagtgtcccccttggccatggacctgtgctcaccttcaagagggcatggaggcttgcagccaggtcttgccatctttgttcagccccttcgacacgctcaggtgcttcagccgcgtcagtatctcggtgctcgtagaagaggagcatttcctcgtcgggcctccttcacaaccgtgtcatggactatgcaggcctnnnnnnnnnnctgttcagccccttcgacccgctcaggtgcctcagccgcgtcagtacctcggtgttcgtagaagaggaacatctcctcgtggggcctccgtcacaaccgtgtcatggactatgcaggcctaccgaatccatgccatctcggtattctgcaaccattcagcgacatcgataatggcactacgtcatgaaaaccccttttcaatcggatgatgtgtatatattgttcacgcctctccgtnnnnnnnnnngcatcgataatggcactacgtcacgaaaaccccctttgaatcggaggatgtgtatatattgttcacgcctctccgttgcgtgataaaggactagcatcgatgaatgcttggagtgaacccacggagcttgtcaagtagctcctttgctatcttcgcaacaagttaccactctcattaggcaaacgtatcagttgtaaataactgctgctccgagcagcctgaaagaatgcaggcctttacgcctagtcgagacgnnnnnnnnnngatcagttgtaaataattgctgttccgagcagcctgaatgaatgcaggcctttacgcctagtcgagacgagacgtacatctcgttgtcgatctgggtgcgcgcgatctttcgcagttcacaaataatgaggccacagaatatcagacaaggtccaaggtctctataaaagctgcaacgtggactgatatatgcttgataatttcctcggaggactcgtgtagggctgctgtctgcggcactctgnnnnnnnnnngataatgaggccgcagacaatcagacaaggtccaagatctctataaaagctgcaacgtggactgatgtatgcctgataatttcctcggaggattcgtgtagggctgctgtctgcggcactctgggcgcggcctgtcgcaagactctgggctgcaccctcggccgatgggatccagggcgggcacatggtgctgaagacattcttcataggcttggatggccacaaatacataggttgatgcatgtgagagcgtctcgactcgcgccctgctatgttgttcatgcatccgaggtttgtagaggtggtacctcccaagtaggaactcctgtccaaagcatgtgcagctgcataccccacacacgtccctccctgatgcagttggagattcgatcctggttcaccnnnnnnnnnnaatgtgcaactgcatactgcacacacgtccttccctcatgcagttggagattcgatcctggttcaccctcctgccggcaaccagccatatgtaagggcctctgaaggtgggtacaaccatgttgctcctgcacctgctgagccacgatttcccactctgcacctacgtacaggtggccaagatcgagcagatcagttcacggaaggcgaacgacagcagcgtcatcacggtttcatggtactacaggccagaggaagcccatggtggccgcaaggtgaggactggccagaatggcctgcgtcacttctggattctgctgctgcatgcagggaactcataggagctccaaagcttgcattgggattccccgtcacctctccagcttctacaatggagcatgctcgtacatcggccctgcatctgccgtgcgccgaccaaaacccccttcaaccagcagagctaccatggaagggatgagctgttcccctcagaccactatgatgacataaacgtgcagtcagtggaggggccttgtcgtgtgctgaccaggggggagtacacggtgagacgaggggcttgggacctcaggaagacttgcttctgcatgttccatacccactctccccagattggagcatgcagtggcctcatgtaccatcttcaactgtcacaccaggaagcgacggagcaggtggccaatggattgaaagaagacgacggcatcccctgcttttacacctgcgtcgaatacaaggtgaagcggggcgaaaggaggctgcaggcttccccgtgttgtggtgaccagcttgccagagggaaagcaccaccgcagcaacgccacccttccccctcatatacacacgtggtccctacgactgaagcaggccgccaagagggcattccatccagnnnnnnnnnntgagtacaaggtgaagcggggcgaaagaaggctgcaggcttccccatgttgtggtgaccagcttgccagaggggaagcaccgccacagcaacgccatccctgccccctcatacacacacgtggtccctacgactggagcaggccgccaagagggcattccatccagatcgcatcgatgtgtattgctgctgtaacatgccggtgagttgcgatgggcgccgggggcagaggtcttgtggggagagcatgcctggatgcgctgggagcacctgcctggctgtgatgcggtcgaatactggctcatccatggcaagggttttcacagatttccgtgctcaccgctgccacctcccccaacttgccctctcagtacaatcccgacctggacatgatccagtgcacatgctgcgaggacttcttccatgcagcatgcatcggtgccaccaacgaggagcttccctacctgtccaacctcggctttgtgtgcatggaggtgaggaggcggatggcatcgtttcagcatgcaccgctgcagtgtcaccacctgaggcactcaaccgcccgctctgcacaatcaacaagatgcgaacacccgccgatcgcagtgtgccatggcaaaggaggctgccggcgccctgccgggcacgtacaggaagtgagcgcggagggatggatctgtgcggcgacgacgatggnnnnnnnnnngctcggctttgtgtgcatggaggtgagggtgcggatggcatcgtctcagcatgcaccgctgcaggtgtcaccacctggggcactcaaccgcccgctctgcacgatcaacaagatgcgcacactcgccgatcgcagtgtgccatggcaaaggagnnnnnnnnnntaacatgatcgcggactgcccttgcatctgagtaccggtgaatgatattcacgtgcagtggccctggcaccggcagcacgcaggcctcgtgtaacagcacacacaacaacgtgcaagaagaatcaggggaggcctgcctcccagtgggcagcatcgggaggtgcatgccgagcagnnnnnnnnnncaacatgatcgcggactccccttgcatctgagtaccggtgtatggtattcacgtgcagtggccctggcaccggcagcacgcaggcctcgtgtaacagcacacacaacaacgtggaagaatcaggggaggactgcctccccagcgggcagcatcgggaggtgcatgccgagcagggaccatggacgcctgcccatgcccctctagccaagcaggggtcacaagccgccgtcctcgaacgaggtcagccaggggtgagcgagggcttcctctgctgtgggcctcttggccgggtccacctgtgcgatggattggaaggggcaggggttggcacgcgaggcatgcnnnnnnnnnncggacgcctgcccatgcccttccagccaagcaggggtcacaagccgccatcctcaaacgaggtcagccaggggtgggcgagggcttcctctgctgtgggcctcttgnnnnnnnnnnatcccaggatgatctgcacatgagaagcatcatccagcccagcgaaggggcggcattgcccccaccttgggccccnnnnnnnnnngtcccaggatgatctacacatgagaagcatcatccagcccagaggaggggcggcattgcccccaccttgggcccccacctccccctcctaaacacacctggaggaggagctggagaaaagagaccatgcctgcgtcggcgtccggcaggcgccgtgccaggcaggtgcgcttgggtttcaggtactccaggcggtgcgtgtggcggttgcgctcgaacaggcgcccgtcgcgcgtgtagtacttgtggctgaacctgccccggcgcagcatgtgccgcggcacggcccccaggatgctctccagccgcgcaagcagcgtcaccagcgactcgttctgtggggggaggagacggggcggggggggcgatggcgggggggcccagggcgctgaaacgtttcgtcgccctggatcgaggcgccgggctcggcagcgcagcttgcaacccccccctcgaaaccctgcatctgacgagcccagcgacggcgctcacctggagcaggaccttgccggagctgagctccgccaggatgcagcccagggaccacaggtctatcttctggtcgtacggcaggcccaggatgacctccggcgcgcggtacgaccggctctgtgggcaggggcaggagaagagagtgggcgtgagcgcgcacggcaacctcctgggcggcctggacgcggtggcaggatcagcggaacccaagcacattcatccttccctgaaggccaggcgattggtccatccacgggcacaccagcccgccctcgccagnnnnnnnnnntggaagccaggcacattcatcctttccctgaaggccagtcggttggtccgtccacgggcacaccagcccgccctcgccagggcgcacgatccacatgcacatcacccccccctgaacccctgcctggccatcctccattcccgggtgatctggtgacacttgccctcaccaacaagcatgctccttgcccaacctctgagagccccccccgcgccccccccccgcccaacacccacctgcacgtaggtgctgaggtggtcggtgaggaagcaggaggaccccaggtcgatgatcttgacctggcagcgagagtaggagcgcatgacgatgttctccggcttcaggtcggcgtgcatgaggtcaagggagtgcaggaaggccagggagcgcagcacctggcgcgcaatgctggcgatgcggggccgcgtgaagtagggcggcgcgccgctggcgcggttgtgccgctggaactcgaacaggttggcgcgcaggagctcggtgaccaggatcaggtgctcgcggtagtaaaagtagtcgtagaggcgcaggatgccttcctcatcccccgggtcggcggcgttgacgtagcgcagtaccttgatctcgtccaggctctggtcaaagtaatccttgctgttctgcaccaggcggtgccgggggggggagggagggggttgagcggcatcaatgtgtgtggcgagggtctggtgagaggggtggggtgaagagggacatgcgctggcatgcacgaagcccttctggatcgacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaggcagacgcggaggccggtcttggtgtcgagcgcttgcaccgcgcggcagaacgcggccttgcccaggagctccaccacctggcaggagagagtgtgggagggggtaagaaactccctgtgggcgggtagggccattcaaagagcgctgcaggcctgcaacgagcggcccggcaccccagcgtgcatcacgcccgccccgccccgcccctctgcctccnnnnnnnnnnacccctcgtcactgtacagagcctcaaacgcaatgcctcccacattcctgacacaggagcccgccttccatctccctcccaccaccaccacaccttgatgatcnnnnnnnnnnttccccacttcccccttcctcagtgccaccccacctggtaacgcccggccagcacgtcgtccaggtggatgtcgaattccttggtctcctcgaacccggtggcgccgcggcggtgcaccacccgcaggctcagctcctcaaactggcggtcaaactcctccgcgtcgtacacaaagggctcccgcgcggcgggggagctgggttccggcgcgggcggcgcctcccagccgcccccgccccggccgtgcccggccgtgctggccacggagttgacgcgcaggggctcgtaggccgcgccgcccgccgcctcgcgcccgtcca

SEQ ID NO: 48608 - DNA, 61 bp, Chlorella protothecoides
tcaggggaccgagccggaggaagtcggtgcaccccgcctccaagaggcctgtgcgcggatt

SEQ ID NO: 48609 - DNA, 61 bp, Chlorella protothecoides
gtgctgccgagtccagtacaggcatagagaactgtaaccggcggcctcgtggaagacacat

SEQ ID NO: 48610 - DNA, 62 bp, Chlorella protothecoides
taggtgtgcaaaccatgtttgtggtgtgccgtctgcccctgccgtgaaggaagggatgcttg

SEQ ID NO: 48611 - DNA, 61 bp, Chlorella protothecoides
gccgcctcctcctgtgacgtgtgtggggagaggggttgagaggttgcagcatgcttagtca

SEQ ID NO: 48612 - DNA, 659 bp, Chlorella protothecoides
  modified_base (101)..(296): a, c, t, g, unknown or other
  modified_base (372)..(565): a, c, t, g, unknown or other
ctgtgcttgggcttgcgtgagggcaatggatggattgatgggcgactgtcggtttcaaaccatctggagtcttgtggatgtggaattcaggcttcatctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgttcctcccacaccctgtgctgtttggtctcgggcaaccaccgattccgaccaccctcactccttgcaggtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtttgctcctgcgcttctgttttgttataggaagaatgccaggtcccctggagcgttcccactcagcatgcgctctgcacaatcctcaatcc

SEQ ID NO: 48613 - DNA, 61 bp, Chlorella protothecoides
cctggtccctgccaagccggccgagggggaggaggcagccaacaggggccagaaggacgct

SEQ ID NO: 48614 - DNA, 174 bp, Chlorella protothecoides
ccacaggatgggtgcgtgctctttggtgccctggccttgggctgtgccccaagggccatggggctggttgtatggctcgccaggcatcgctgttgtcacgactcatcgggtgctgccgtgccctattctcaccgcgtttctcacccctttttgcctggcagacaccgagcccct

SEQ ID NO: 48615 - DNA, 61 bp, Chlorella protothecoides
gtggtggagggccgtgcgcctgcagagaaattggcggcggtgcaggcccggtacgccgccc

SEQ ID NO: 48616 - DNA, 61 bp, Chlorella protothecoides
tgtcgagtggtgaaggttaatgggggggggggtgatgcaaaactccctttgtgccatgacc

SEQ ID NO: 48617 - DNA, 61 bp, Chlorella protothecoides
cagcggcgtgaacatcatcgtgctggcgggcgacgaggacggcggtaaggaggcggagggg

SEQ ID NO: 48618 - DNA, 61 bp, Chlorella protothecoides
tcgccgtggtggcggtggcggtcgtgggggggctcgccggcgagcgattcgccctctgcgc

SEQ ID NO: 48619 - DNA, 61 bp, Chlorella protothecoides
ctggggccagctggaaaggacggagggaaacgtgaagcgggcgcgtgacctctggatcaag

SEQ ID NO: 48620 - DNA, 75 bp, Chlorella protothecoides
cgctgcaccacgacaccaaacatggccccagcacgcggaaacaccatcccagctcgcctgtttgccaggggctgg

SEQ ID NO: 48621 - DNA, 61 bp, Chlorella protothecoides
ccaggggctttcaccacagccagtggatggggcagcatgtagctgatttagcacataacat

SEQ ID NO: 48622 - DNA, 61 bp, Chlorella protothecoides
aggtgtggtgtcatctgcaaggtgggcgtgcacctcaggacactcctcactgctcccagtg

SEQ ID NO: 48623 - DNA, 61 bp, Chlorella protothecoides
ctcgccgtcgacgactgcctcgccactctttgctgcatcggcagccccgccgccgtcggca

SEQ ID NO: 48624 - DNA, 71 bp, Chlorella protothecoides
agggctgctgctgctgaggctgctgctgctgctgctgaggttgaggctgcagcatgggccatggtggttcc

SEQ ID NO: 48625 - DNA, 37611 bp, Chlorella protothecoides
  modified_base (121)..(181): a, c, t, g, unknown or other
  modified_base (602)..(720): a, c, t, g, unknown or other
  modified_base (1677)..(1686): a, c, t, g, unknown or other
  modified_base (3066)..(3206): a, c, t, g, unknown or other
  modified_base (3281)..(3290): a, c, t, g, unknown or other
  modified_base (3478)..(3487): a, c, t, g, unknown or other
  modified_base (3868)..(3923): a, c, t, g, unknown or other
  modified_base (4684)..(4693): a, c, t, g, unknown or other
  modified_base (4885)..(4894): a, c, t, g, unknown or other
  modified_base (8164)..(8173): a, c, t, g, unknown or other
  modified_base (8424)..(8433): a, c, t, g, unknown or other
  modified_base (10342)..(10353): a, c, t, g, unknown or other
  modified_base (10443)..(10452): a, c, t, g, unknown or other
  modified_base (11270)..(11279): a, c, t, g, unknown or other
  modified_base (11906)..(11915): a, c, t, g, unknown or other
  modified_base (13053)..(13062): a, c, t, g, unknown or other
  modified_base (13143)..(13152): a, c, t, g, unknown or other
  modified_base (13280)..(13289): a, c, t, g, unknown or other
  modified_base (14360)..(14369): a, c, t, g, unknown or other
  modified_base (14790)..(14799): a, c, t, g, unknown or other
  modified_base (15176)..(15185): a, c, t, g, unknown or other
  modified_base (15651)..(15660): a, c, t, g, unknown or other
  modified_base (16386)..(16395): a, c, t, g, unknown or other
  modified_base (16809)..(16818): a, c, t, g, unknown or other
  modified_base (16967)..(16976): a, c, t, g, unknown or other
  modified_base (17104)..(17113): a, c, t, g, unknown or other
  modified_base (18317)..(18342): a, c, t, g, unknown or other
  modified_base (18528)..(18537): a, c, t, g, unknown or other
  modified_base (19498)..(19507): a, c, t, g, unknown or other
  modified_base (20037)..(20046): a, c, t, g, unknown or other
  modified_base (20154)..(20163): a, c, t, g, unknown or other
  modified_base (21039)..(21048): a, c, t, g, unknown or other
  modified_base (21365)..(21374): a, c, t, g, unknown or other
  modified_base (21828)..(21837): a, c, t, g, unknown or other
  modified_base (22863)..(22872): a, c, t, g, unknown or other
  modified_base (24337)..(24346): a, c, t, g, unknown or other
  modified_base (24862)..(24871): a, c, t, g, unknown or other
  modified_base (25153)..(25162): a, c, t, g, unknown or other
  modified_base (27663)..(27672): a, c, t, g, unknown or other
  modified_base (29061)..(29070): a, c, t, g, unknown or other
  modified_base (29264)..(29273): a, c, t, g, unknown or other
  modified_base (29821)..(29830): a, c, t, g, unknown or other
  modified_base (30905)..(30914): a, c, t, g, unknown or other
  modified_base (31393)..(31402): a, c, t, g, unknown or other
  modified_base (34817)..(34826): a, c, t, g, unknown or other
  modified_base (35521)..(35530): a, c, t, g, unknown or other
  modified_base (36276)..(36327): a, c, t, g, unknown or other
  modified_base (36479)..(36488): a, c, t, g, unknown or other
  modified_base (36556)..(36565): a, c, t, g, unknown or other
  modified_base (36633)..(36739): a, c, t, g, unknown or other
  modified_base (37332)..(37341): a, c, t, g, unknown or other
ggcgccgggcgcccagcctggcgtgctgccggcgcgcggcgacgccgacgcggagagcgacggtggtgccgcggtgctgggctccccctccaccgcgccgtcaacccccgccgcgtcctcnnnnnnnnnnnnnnnnnnnnnnnnnnnnnnnnnnnnnnnnnnnnnnnnnnnnnnnnnnnnngggcccgaagagctgggcgccgaggtaggtcccgctgctggcacgcacggccatgagcgcggcggcggaggagctgccgccgctgtcgctgccctcgtcgcccgggccggtcaggctgtcctccggctcggagctcatgcgctgcagggcgggcgggcgagagggcgtgggctcgcccgcgttgcgggccgggccgcagcccggttcctcgccgcccaccccggccccctcgccgccctcggccgccgcgacctcctcatccagcacctcgacgtacagcgtaaacggcgccttctcgcggctattcagcaggttggactcgcgcggggccaagcgcactacgcgccgcgcccgcgtgcccatggggaaccagacagcaacgcccttgcggctcgccgcctcgatctgcacgttgatggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggggtgagcagaggggtggtgggggatgactgtgtatgggagccagggcatggagaagcgtccatgcagacagggaaaccgtgaggcggagacgaggcatgggcacacagacctgtgccaaggctcctgggctggtgcaggtgcaccctcatcggcactgggtctacagtcctgctcaaacacaaaccctcgcccataagccctcaactccccaccccctcacgtgggaaggcggtgaggccagagctggcagtgcacagggcgtcgatgaagtccagggtggcgccaaaggtggtctgccgccgccgcggcgagttcggcgggctcagcgccgaggccgggtccgggctggtgccggaggcgcccggggaggcgggcgtgcgctccagccaggcctgggccccctcccggccaccgctgtcggtgctggtggaggctctgcgccgcgggccgggcgccggtgtcgcgtggtcgtcgcgcccgcgccgcgcgccgacctgcgcctcgacaccctgcggcgctgagtagcccagcaggccctccacgccggtgtccatgaacacggaggagtaaaccccagagccgaagccgtcgggcgacatggggcggggggaggcgcagtcgggggaggccgcgcgggaaagcgtgtcgcccggcgcgtcgcggtcgggggagccccagcgctcgcccgcacccagcagggagggcacgtgggagggggtggaggagaggacggacagcgtgccgcgcgggctgcgcggcggggacgccagccccatgtccacgaaggagggggagatgcggagggggggtaggcgcgagtccttgaacggcaggtcctgtgattgtgcatgaggatggatgggagggtggtcaagcagggaccaggggacagatgggccatccagagattgggcaggacatggtagtggacgcgcgagctcgcgggaattacnnnnnnnnnngttgtgcatgaggattgatgggagggtggtcaagcatggaccaggggacagatgggccatccagagcttgggcaggacattgtagtggacgcgcgagctcgcgggaattacaatctcgccaggcagcagagccaggatgcccatcactgcggggcccttgcgggcagcgcccctctcatcgtccttcacactcacccacgtcccctcaagggccgcctgctcgcatcgatcccgcagcgcgatgacatgcaggtcgtgtggattgtcctgggagatggccagcagcagccagtacgtctgcgtgggtgggcatggttgcgatggtgggaaggggagcctttgacgtgttgtagcggcactcatggaccaggaaaccacaggccgcagcggaaaagcacagcccaggacacctatccccatgcctgcggcgtccatggcatcgccttgcaacgctcaccttgatcgcgatgcggagggagcgggagcacaggtcgatgatcaccctctccagcgagctgttgggtcggatcatgcacagctgcgtgagctgggagaggtacttttccacctccctctcaggcagggtgtacaaacggttgcacaggtagtcctggaccccgggggagctgctcttgtaaaggtacctggggagagaggggcagggggccgggccggagtttggaatgaccttcccaccgcggccgagaccagcgcgtgccccgacaggctgcatgcgccttcttctgttcgccaggattcgagactcacgttagtgctatccaggtgtcgaaccactcgctctcgaagaagcgcatgagcaagtccgacttgcccgactctgtcacgctcgacgcgggtttgggcaccagcgcccctccgaggcggggcagggccttggtgaaactcggcatcctgatactctgttttggtcgcgtctctgccatgcgtcagcgcagccacgccatgggatgaggtcaatgacagcggcctcgccaggtgcagctcagtcgttcgaacgggaatggacgactcggccaacgtgcttttcggctcggccgtgaatttacctggtttcagcttcgcgcggtcaggcaggtaatggctgctcgtatagaggtggcacccggtcgcgagcgccccggcgagcattacgagcaggttacctttggctgccctttcttctccaggcgcttgaagcggcatgggcagaccccacccgaccaggactccttggcctgcgcccacaggaggccgaactgcctcgagcaaccagatcgaatacaagtctgttatctccaagacaagttgaccagtaccgggctttggcgccacgtttgctcgggtgatcaggtgatggcggggaccaccgcagcagcaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaagagtgagcgggcctgcaacctgcctgccctgcctggccatccgcagggagaatgcgaacaagaaggatgtgnnnnnnnnnngcctctggcttcccgaggccatcccgtgttggccatccctggcatgggctggatccccaggcgctcgccctgcatgctgcctgcatatcaggaccgcccccttccgggcccccccttacgcgtcccctccctccactcaccatataccccccaacctctacaacacaaactgaccttttcacattgcnnnnnnnnnngcaggtggactgaggtggatgctattgtagggtatggcttgtagggtgtcgagcctcacctgggccacggaagagtgagcgggcctgcaatctgcctgccctgcctggccattcgcagggagaatgcgaacaagaaggatgtgcgactgatgaacatcgaggccgccaaggccgtggcagatgcgatccgcacctccctggggccccgcggcgccgacaagatggtgcggggacttgggggggttgtggactaggtgggcagccgagcatgcctggcctgcagccttgcagcccgtggcgagcgtgctgtagaagccatacctctggcttccagaggccatcccatgttagccatccctggcatgggctggatccccaggnnnnnnnnnnnnnnnnnnnnnnnnnnnnnnnnnnnnnnnnnnnnnnnnnnnnnnnnccaggaccgcccccttccggcccccccttacgcgtcccctccctccacccaccaaataccccccaacccctacaacacaaactgaccttttcacattgcaggtggctcaggctgatggccacgtcatcatcaccaacgacggcgccaccatcctgaacaaaatgacggtggagcagccggcggccaagatgctggtggagctggcaaagtcgcaggacgtggtggccggcgacggcaccacctcagtcacggtgctggccggcgcgctgctgaagaagtcgctggagctgctggagcgcggcgtgcaccccaccatcatctccgacgccttcaacctcgccgtgggccgtgcgctgggcttcctggaggccgccgcgctgcccgtggcggcgggggaccgcgacgcgctggtccgcgctgccaacacctccctctcctccaaggtcgtgcaccagtactcctccctcctctcccccatggccgccgactgcatcctggccgtttccgaccctgcgcgccccgaggccaccgacctgcgggacgtacgcctggtgaccaaggtcggtggcaccatcgacgacagcgagatggtggatggcctggtgctggaccagcgcgctgcaaaggctgccagcggtcccacacgcatcgagaacgccaagattgcgctcatccaggtggctttaggggggaggagggttgtgaatctgggaggagacggagggccgagggggggggggggggggggggggaaaaaagcnnnnnnnnnnaggggaggagggttgtgaatctgggagcagacgaagggccgaggggggttggcagtgtgtaaagaatggcatcggggatgagggagggcaccaatccgtaaaacagtaggactgagctccagaatctcgccgctgtcggagggttacggtttttcagatactcaaagcattgcatcagtgcgaggaggctgnnnnnnnnnnggggaaagaatgccatcgggaatgagggacggcaccaatccgtaaagcagtaggactgagctccagaatctcgccgctgttggagggttatgttttttcagatattcaaagcattgcatcagtgcgaggaggctgggcttggagcaccaggaggaggagcgatgaggggcctgccccctggctgcacagccacacactgctgtgcactgcccaaatttcccatcccttccctcacccatcgtcccatgtaccatgttacagttccaagtctccccccccaagtccgacatcgagaacaatgtcatcatcagcgactatgcacagatggaccgcatcctgaaggcgagtaggaatgggtatgcacccgtagcgtctttgaaggctggaagcttgtggagcaccgactgatatgattctggaaaggccagcacaaactgaccatgaatgggtttgcctgttggcgcagtcatgtccggcataccagagagcatgcagttcccgctcattttctgcagttgtcccgcactttcctcccatgggctcgcacacacaccctccgaccccgtccccactcacatcacatgagcaggaggagcgcaactacatcctgcagctggtgaagaagatcagggcctctggcgccaatgtcctgctcatccagaagtccatcctgcgcgacgccgtcaccgacctctccctgcactacctggtgcgagtgtggggtcatgtaatggctgttgagatgtgtcggtgcatgcgccgagcagggtagctgtttgtgtcagggggtgccctcagcaacaagagcacaggaactcacgcccaagtctgcatcctgtctggacggcatgatttcttccctgttccaccccctgcttcgacccgttcacgctgcctctttacgctgccccaggccaaggccaagatcatggtggtgaaggacattgagcgcgaagacatcgagttcataaggtggggctgctggtttgggagaagctgggcgtcgagcacatccatggcccatgcctttagactctcaagcaatgcccacgccatgctccgccatcttctctctcacacacacacacacacactcacacacacacctcacacccttcccttgccaccccaaccatgcagcaagacgctgggctgctcgcccattgcgcacgtggaccacatgcgcgccgacaagcttgccagcgcgggcctggtggaggaggtgcacgtcggctcaggccgcgtggtcaaggtgacgggaatcgaggcgcgcggagcgaccgccaccgtgctcctccgcggctccaactcgctggtgctggaggaggcggagcgctccctgcacgacgcgctctgcgtcgtgcgctgcctggtccagaagcggttcctcatcgccggcggcgggtcgccggagatcgagctggccgtcaagttgggccagtgggccaagaccctggtggtgagcgagggttttggaggtattggggtggtggtggtggggggttaggaatgttgtaggggtgtgttgtgtcaggcgtgtattgttggctgagggacatcagttggtgcagcctgcattgtcctgggattttgggacggcgtctggttgtgaggttgggtatcgaggtgaagatcgagggaggaggctgcgccaggggcaccgtctcttcatgtgccttggcagtgactcgtgtccaatacccatctgctatgacccccccctcaaacactacacccttgcagggcatggagagcgtgtgcgtgcgggcgtttgccgaggccctggagatcatcccgggcaccctggcggagaatgcgggcatgaatcccatcgaggtggtgaccgagctgcggcggctgcatgccgcagggcaccaacaccacggtgacttgatgttgttttcagcacatgaggctgatgggtggctggactgactgttccaaggcctccaatgtttgtcatgcaaagattgggcccatgatcaccgacgcctcctccccatcagccaacctcctgactcatccatgaccccatctacccgccctcccaggcatcaatgtgcgcaaggggttggtgacggacatgctggaggagaaggtggtgcagcccctgctggtgacctcctctgcgctttccctggccacggagtgcgtgcgcatgatcctcaagatcgacgacattgtgcccgtccgataggcccctggcaggctgcttcctccttttcttgtacaacgcagcagggtggcagtgacagggggtgctactgtctgcgtgtggcagattgaaccagcagggaaaggggtccgggcaccagcgccatggcctcctgcagccttcggcaagtgactcagacggtctcagccgccattccatctgcaccgttgcgtcctgcatcgctgcacagtgagggacccggcaaggacgctcgcacctcccacctccagacgagcgtggcacctgtagaggagctgccaatcccccagcatctcggcccgatctacgccgccaggctcctcaactgtacagctggatgagctcgtcggagaccgccgcgggcgtgagcacgcccaggtcggtgaaaaggagggagatgtaggccggcggcgtgaagtcgcgcgaggggttgtccaccgccacctggggcggcagcagtgggccaaagtcgatctgcttgcgctccaggggcagggcgcgctgactcagcgggtacaggcgcgcgaacttgtacgactcggccgccacgtaaagagggacagagtgcgcccgcgctgcgatcgcaatctggtaggtgcccagcttgttgatcacgccgccgttctccaccactgcctcggcgcccaccagcaccatgtccaccctggcaaggaggaggaaagtggggaagctgggatgggggagtatgattgtgggataggagagggagcagggaagaggaagtgggggtaagaaggggaatgaaggggagggcacaggagggtcgcggcagagcagcaagcgcccggctggcaggcccagccaggagcatggtatccagcatgaccagcgcggcccctcctcccagctgcctggccagggtccaagcatcacagcaaagtcctcgcacaccacgcacttttccattacgtaacccacgccactgtccaggacgagagaggtgggcacgcccgagtccttgagcgcgcgtgcggttgtgatcccggtctcgtcggggcggccctctgtcacaatcacattgaactgggtgccctgcgtggttggaaggggaggcnnnnnnnnnnggcgcgtgcggttgtgatcccggtctcgtccgggcggccctctgtcacgatcacattgaattgggtgccctgcgtggttggaaggggaggcaggccggagcctcaggacgccagggctagcctcctccaggtgccaacgtattgaaatttcagtagaacagcaacccgccaagtctagcagcgccccaagcccgcacaatggcatcccctcaccgctgctacggccttcctgagcaccgccagtgccacgnnnnnnnnnnatgccaacgtattgacatttcagtacaacagcaacccgccgagtctagcagcgccccaagcccgcacaacggcatcccctcaccgctgcgacggccttcctgagcaccgccagtgccacgcgggagtacccgtggcacaacacggtgaatcctgaccggatgaacctctgaccctgctcagcaatcgcagcgcgcgcccgcttcgaggtgtctgcgaagagattgggagcggggccgcagtcaaacactgacgatacccatttcggagcagtaaacacctagatacttcatattcaggcaatcaagtggctaaagtcaagaagacactttcaatatctggatctccccatagctggccactgtcagcagttaccattcactacgacaggtagctcacctgcaaagtggcgacccctctcgatcagcttcttcttcaccatcgcaaaattgtccagctccaaggcagatgtccgggttgtatacctcaggaataggtcacaccctgccttgagggagatggctgtgtcgttgcatctgtggggagtgtgggtgacagtaaggagggaggtgaggatttaccgggcgaggatttatgggcaggaccttgtcagcacatggacccattcagggctttgagatgcatggcaagttgcacacaggtcaaacgctctcacgttgacttcccaggaaccccacctttgtagggcattggcagcgtccttgagctccttctccagccccatcacagtggaggccgagctggaccgaataacggaagtgagggctgtaatggcagccaccgccacggccatatcactggaacgggccagggcctcatggaattccctgaccactgcctccgcgttcacatacgtcactggatcgagcgtaggtgagtgggcgggtgatgccgagacagtgtacaaagtatacataccactgtaagcggtgatccaatgcagaccagaatctctgcaggacgagcccttaccatctccggagtgggaggagaagggacccctgggacggaatgcagtaggcaacgccccagaggacgtgtttcgcagcatcgtgccctggccctccgccgcgcttccgagcttccttcaggcccttgctaccattcgaacaccgcgaggagatgtctgtattgtgaaagcacttccaatgtgcagtccgcacttagtatgcttgtcgcggtgtgatcaggcatgtccaggagtaggcgcgcgatggacgagcgcgccctggtctgcgcaggctgagtcggattcgaggggcatctgaaggctgcattaggcaacgacgtctgcgagatcacacccgcccaaagcgcttagaccttcctatcacctgtcagactcactgaggtgactggatcgcacatgctgcgctccgtattgataggagttcttactgggagcgcttacgccaggcctgtcgcgtcaggagctcctcggtgcctggctcgtacctaccgattcccagaccaatcagcgaccatgtcgacctccaccagctccgacgaggtgtgtttcaggaatgagtcgagtcaattgaaagcaattgcaggacgctgggccgcgggcgggatcccggatgcagcaccggaaccagggtttcctccagctttagattgtaggaggatgaggcgaccctcacccacctttcccacccctcccttcgactagatcctgtacgaggtcaccaatggggtggccatagctaccctgaacagaccaaaagctctcaatgccctcaacacaaacatggtacggtaacatggcagggggtgctttgctggaatgtccaccactgtttgcccagagcctctgggcctgatgcagcacccatcaccctactccgaccttgcaatgcctcataactcaggtcagaaccctactgaaannnnnnnnnnnncaccgtacgcctgtttgccctgctctacgacacctagaagccccacttgcccacacatatcccgtgcttgatcctccctaggcattctgnnnnnnnnnntatcttgtgtcgtcctcaaagccgcaggcgaaaaggtgaagcagcctaggcccctgtcatcaagcctgattgggagaggagtactataccgtacgcctgtttgccctgctctacgatacctagaagccccacttgcccacatatctcccgtgcttgatcctccctaggcattctgcgccgggggcgatgttaaacaggtggcgcagcgagcgatggccggcgacacgcaggcggggtctgacttcttccagaccgagtacctgctggaccacctcatccacaccctgcgcaagccccacgtggccctcatcgacggcatcacctttggcggcggggccggggtttcggtgcacggcaccttccgcgtggccacggagaggtgagggcaggtggacctacatgtgactgcccggtgccgtgccgcgtgctctttgctctgcttgaagccagtgcggcaagccatggccatccctgccaccgctcctcatcccacctcacgccactgcaccccatacaggaccctttttgccatgcctgagtgcgccattggcctgtaccccgacgtgggcggctccttctacctgcccaggctgccgggcgggacaggcctgtacatggccctctccggcgcacggctcaaggtgcacagggcttgggcctggggcgctcttctatggggtcgggatagatctctggtggcctgtttgggcttgcatgatggtttcaggagaggttgggtgccaccaaatcgtaagacggctggcgatcaatcatccctgacctccttttccacccctccccagggagcggatgtgaannnnnnnnnngggagaggttagctgccaccaaatcataagacggctggcgatcaatcatccctggcctcctattccacccctccccagggagcggatgtgaagcatgccacgctggccacacactacctcccctctgcgctgctgccggagctggaagcggccatccaggggctggggcatggggcctccaagcagagcatcggcgagctgctggacagcttccaggctcgcacacaagttccagccggggagctggccgcccagaggtgagctgacggatgtttgggacggaggatgtggggctgggcttgacctgctcctctgcgcaatggccgaaggcttgacactcaccatgaagcaagcagctccgatgaaccgtgtcctctgccaccccccccctcgaggtcaggcgggacatcgacgccgcatttgttgggcggaaaagtgtggaggaggtttatgcggcactggagcaacacgccaaccagacctgggcgaggggtgtgctcgacctcatacgcaagtatgcatccttggggaggaaggggggggcccagagggggggggagatggaacctttcggtgacagaggggggtggtgaatcctgagcaaagggagggctggatggagttgcnnnnnnnnnngcggatgtttgggacggaggatctagggctgggcttgatttgctcctctgcgcaatggccgaaggcttgacactcaccatgaagcaagcagctctgatgaaccgtgtcctctgcccccccccccgcccctcgaggtcaggcgggacattgacgccgcatttgttgggcggaaaagtgttgaggaggtttatgcagcactggagcaacatgctaaccagacctgggcgaggggggtgctcgacctcatatgcaagtatgcatcctttggggaggaagggggggcccagagggggagggggatgaaacctttcggtgacagagggggtggtgaattctgagcaaagggagggctggatggagttgcaagtggtgagtggaccctgccgtaggtccacttttaaatccccgctccccttcctgcctgccaacaaacgacatcccttcgaatgagatccagccgtcagcaaactcaataaccatccctccacctacaatcgttgcccaggggctctcccacgagccagaaggtgacctttgagcagttgaggaggggcgctgctctccccaacctggcccagtgcctgtcgatggagaatcgcatggtgcacaacgttctactgaaccccaggagcgacttcgtggagggtgtgcgggcgatgctcatagaccggtgcaacaagccgcagtggaacccagccacgctcgcagaggtgagggaaggggttggggagagggagaagggggaaagaagcttgggcagttagagagcaatccctcatgattgttccttgcaagtcagcattgggtttcctgcggctgctttgtaacccttgtactgccaaaccacgcccctctgttcccctgccttgccccctttggccatgttattaatccatcgtgcccacctgtcatcaaccctccacacatatcacaactcactgcaggtgacggacgagtatgtgcattccttcttcgagaggccagcaggcattcccgacctcaaccttcccacacacggcagtgcaaagctctagaagagcaccaaggatctacgctggtgaggatctgattgtaccttttctcctgtggccacatcattgtgaccagacaagtgtcattggaagcatgtacaaggaannnnnnnnnnatggggatctgattgtaccctttctcctgtggccacatcattgtgaccaaacaagtgtcattggaagcatgtacaaggaannnnnnnnnntcgccactctgtgcccctgccttgccccctttggccatgtcatgtatccatcatgcccgcctgtcatcaaccctgcacacatatcacaactcactgtaggtgacggacgagtatgtgcattccttctnnnnnnnnnnagagcctcgtcaggctggccggacagggctcgacagaggcgtctggcacaaggtcagtgtcacaagcgcatcaggccatcttcatgccacgcgacgctgtgccacgcagcatgtagccgtcggcggcaggacccaggccactggcatgtgtgaagatgctgttccagatcttcttgttggcgttggcaggggccagctccgacaccttggacttcttgggcgccagggcggcgggcagggtggcggtcgggggtccggcgcgcttggatcctggctcggccgcggtctcgcccgtgccaccgttgctggcggccactcccacggcgcgcttctccttcttgctggcgcgctgcgcctctcgccgtgcagccagggccgagaccagggcggcggcctcctccccggtggggttcactgggatccagctctcaggagtgcacggggaggcggccagctcctccactacctttgggacctgggaatggaattggcagggggaagttctagactgtgcttggaataggtatgagctcaggcaaccactactgaccagaaggccagcaacaggcagcatgccatttcgtgatagcggcttgctacagaagcctcttgacaccagacagaacacactccatcatgaggaccatcagcccttacacacccctcacctccttccagccacgctcgctcacgaccagccccgtcttgaagtggatgaggaaccgggccttgccattaaagtccagacccgtgacaggacagacgaaatgagcgctgccgtctgtcagtggaaacaggggacatggttactaagggaatgcagatgtgaggtcctgcacatgttgcaccatgcatatggcttgagcatgtaaatgtccaaggtgacaacctgcttttgttgccattggctgcagactgggtgggcatcagagaaaaaggagaatctgggcgccataccggttcagttcagtccctcaccaaccctgtaccctgcaccacctcccagaccttttgggccggcctcctccagcttcaattctacgacatgcttcagaccctggatgtgcttcnnnnnnnnnngagagcagaatctgggccccataccagttcagttcagtccctcaccaatcctgtaccctgcaccaactcccagaccttttgagccggcctcttccagcttcaattccacgacatgcttcagaccctggatgtgcttcaaacctgtcggcagcgacttggagagcagggcctgtagcaaggcctctttgttgaacaggttccccagctcatccgccacaatggggcgactcagtggctcgccagacaggtgacacgtggtccaacgtgctagcctctcttcttcaggattcacctgagcgaaatgtggcaaaggaagggcaggagaacatgagcagaggcgtgatgtgagccctcccagccctcccgcgtcagggtgtcaagcagcctacgctcgtcctaccttgtctggtttgcgccccannnnnnnnnnctgatgtgatccctcccagccctcccgcttcagggtgtcaagcagcctaccctcgtcctaccttgtctggtttgcgccccaggtacatctcgaggtagcaagatcgcgactcggccccggtggcacctccatccccgccccctccaagcagacgagggaggatctcgagaacatcccatggcttcacccctgcctcctccaggctggtctccaagctgcggccattgtgccggacaacctgtggtaatgaatcaaccaaattcgagtcgagttatgatgaaatggcgttatgtctgtcctgattctccgccatactacagcaaccccactcaccagtccctcataagacggtccaggattgctggtggcgcagaggnnnnnnnnnngatgaatcaaacaaattccagtcgagttatgatgaaatggcgttacgtctgtcctgattctccgccaaaatacagcaaccccactcaccagtccctcatacgacggtccaggattgctggtggcgcagaggagcgagatgacctccttcgaatcactacgagggcatgcattcacgacatgctcatggtcattcagccggacaaagagctgcatggtgcggacccgctgctgacttatgtgaggatgtgctcttgcaatatcgctcggtgccgtcacttacgacgccaccgtggggtattctggcgtcctttgtagtctggatgggtcaaaattgtcgtcgaagggatcggtatcgcactcttcaacatacccgcaacgacaaggaacttttcgcgcccgtggcccctttcccctcgaacacaacagcacccatgctgatggcgacttgacagaggcacgggaccnnnnnnnnnngttgtcgtcgaagggatggaaatcgcactcttcaacatacccgcaacgacgaggaactttccgcgcccgcgcccccttttcctcgaacacaacagcacccatactgatggcgacttgacagaggcacgggaccgagcaagagaaagaacagtggccatgcagcagcattgtgcacatcctttctcgcaattgaccttccaaatgctgactctcggtgggaggcctctcgggaaagtcaatcattcactgccaaaaagaagacgggtattcagaggggagtgagcatgcggtgcaccgcccctcacacggcaaagtagggcccaactcccttgactccgagcccggggatgccctcgggcttggagtcggccttggcgtcggtggtgtctgcgggtgcgtagacgaccactgtgcgtgacggcgcatacaccttcatggagtgtgggcggttgtcgtagttgccctcctgcgggcagggagaccgggggagtggcggtgagagtcatgggaaggaggattaccaggtgcttgaagggaacaacattactgagtgcaacattcgtcccagctctgcgcagcaggaaattaagcagtgcccgctgcaccctggaggcatcaggtagccgccgccacacctggctgattcagtcttcaacaaaattccccagaacagatcccttcccaacagtacatctgcgtgagctcactcacctctgtgtggatctnnnnnnnnnncggctgattcagtcgtcaaccaaattccccagaacagatcccttcccgacagtacatccgcgtgagctcactcacctctgtgtggatctcggcgtcatacttcttgctgacgttggtgtacccgccaaacacctcctcatcactgctcagcacaatctggagcgagggtgggaaaggaaagggagatgaacggctgacggatgtgggcaggcaatgggccggcagcaaggcccccactcacaagccacctgattttgcagaggctgtcccgcacaaccccccgtccccccctcctcaccttatatgggccgggcttgtatgcgccgaccttgtagtcggtgaaggacgacacggggtggaagttgaacacgaagatgaggtcccctgcaaaattaggtgggcgcagtggcaggnnnnnnnnnnggggagatgaacggctggcggatgtgggcaggcaatgggccggcatcacgggccccactcacaagccacctgattttgcaggggctgccctgcacaaccccccgtctccccctcctcgccttatatgggccgggcttgtatgcgccgannnnnnnnnngggcagggctctgcatcccgcaggccagccagcagctgtgttcgggttcatgcctactccgcactttctattggaatctgcacgcacacatccgcactccaacagctactcaccccgctcgaccacannnnnnnnnnacactatctattggaatccgcacacacatccgcattccaacagctactcaccccgctcgaccacaatgaccttgtcgccctcgtccttgcgcgacacccactggtgctccgctgccacgaagccatacgcctgcggggtgatgggggtgtgactggcttcaacgggcctgcgcatgtcgattcggcccccgggatgaaggcacaggcccgctccctgtcggcctgctcaccccgcagcagggtccttggccgcgagaaggttcacgccatcttcaccgcaaacgcctcctaccccagcccccgagaacaaacgccgtcaagaaaggcaaccagccggcgcacaccttgtccaggtggttcatggcgcggtcaaaggcggccatgaacttgtagcgcaggctggggtcgtcggccaggtcccagcgccggcggcacttgtccagggacccgccgttgccggggacaaaggcgcccgtgctggtgtcgtaggtgtcgtcacgtgggaagtcgatccactcggggtggccaaactcgttgcccatgaagttgaggtaggactcgccccccaggcacatggtgatcaggcggatcatcttgtgcagcgcgatgccgcggtccaccgcgccagagctggttgggttgggagtggggggatgggatttatggggggaggtgtcgaggtgggatcgttggcgcagcggaggcaggtggcctatacagagccctggggtggcagcgtcgctacgtggggccttggtatgaagcagacagggccaaagggcggcaggccttccttgtacccccgcatctgtcccagctgcccaacccacacccacagtccactcacctgggtccggagagggacatgcgctcgtacatgtccttgtccatcagccagaaggcgatggtcttgtcccccaccagcgcctggtcgtgggactctgcatacccctgtgccagggcgaggggcaccgaggaggtgggcggacggaggatgctggacggggctgcttccggggatgccaccaatttcagaccgaacagcccccctgccccagcgccagccagctcaccacgcagggctcggcgtagcgccggttggtcatggtgtgtgtgaggttgcccatgttccatgagtaatcatcatactcagaaagcagctggggggagagggagaagggggggggggggggggggacgcccnnnnnnnnnnnnnnnnnnnnnnnnnntgatggacactcaaggtgaaatgctcggtcagatggtcgtcggccaggctgagtctgggtgtgaggtgcagagatggctgggcgaggggcgatgccgcctcaccacgccgacgaaatcagccatcccagcagtgcccagcccgcacactgccatcctggcaggggactcctgtatctcctgggatnnnnnnnnnnggccgtcaaaaccaggcatcccagcagtgcccagcccgcacaccgccattctggcaggggactcctgtatctcctgggatgaccgcgcccccttcccctcactcccgcacaccacccccacctcgatccacttgtctgcgatggccatgttgaggcggtagtcgaacccgacgccgccctcctgccagggcctgcagaaggtgggcatgccagacacgtcctccccgatggtgatggcagtggggaagaggtcgtgcagtgtgttgttgaccagcatgaggtacaccacagcgtcgacgtcggtggccatgccaaagtactcgtcgtagttgccggtgaaggccacctgcaggccgtggtggtggtacatcatggaggtcacgccgtcgaagcggtagccgtcgaacttgtactcgtccatccaccagcgcgagttggagagcaggaagcgcatcgtctcccagttgccgtagttgaagcagcgcgagtcccacatccagtggaagccgcggccgccgccgtggaagtacatgccgtcggtgccgtcaaacatgttgatgccgtcctgcgtgttcttggaggcgtgggagtgcacgatgtccatgagcaccaccaggcccagacggtgggcctcgtcgatcatggccttgagctcgtcaggggtgccgctgcggctgctcacgccgaagaagttggtcacgtggtagccaaaggagccgtagtaggcgtgctcctggatggccatgatctggatggcgttgtaccccagcgacctggtttgagggtggagtgggagggggggatggaggtgcagggggaaggaatggatgcccagggtgcagggaatagaaagctcaaggactggaggggcgggcaccccctcctcatgatcaagcgtggagcagctcgcgaccgccaggccagcaagggccccccccagtgcctgcagcacagccttggnnnnnnnnnnttttgagggtggagtgggggggggggatgggggtacaggggaaggaatggatgcccagggtgcagggaatggaaggctcaaggcctggaggggcgggcacctcctcctcatgatcgagcgtcgaggagctcgcgaccgccaggccagcaaggcccccccccagtgcctgcagcacagccttgggttccgttccctgcatgtaccaaccccgaagccgcagcaaccaccaaaccctaacaagtacgccccacaggaacacaccggatgcggggcaggacctcatccttgaactccaggtaggagttgaccttggggtccttggaggacatgcccacgtggcactcgtagatgcgcaggtcgcggggcctggcgggaggggccgtgcagacgtcgggtggggtgggggtgaggactggtcccccatcgcaacatgggcgatccggcacagtgcacacttcccacccccccaagagtctcgccagggtgtcccactcccgctgacgcaccggtccgggcgcgggtacttgaannnnnnnnnntgcatcatgggcgatccggcacggtgcacacttcccacccccccctgagagcctcgccagggtgtcccactcccaccgacgcaccggtccgggcgcgggtacttgaannnnnnnnnnggggcgcccgcctccagcggctggtagtgcaccccgttgtactggatctcgttccactcctgcgtcgcccacttgatccaggcaggtatgcgctccacccactccccgtacgccgtctccagccgagtcttgatcttggtcctggtgtggtattgtggagtgggaggggtccgggggagggagcatggggaggcaaggagtcccgagcagggcggcaggcatcggcaccgacagcaatgtgcgccggcgcagctggccgggagaacagccctcccagccagcctgcgctgtggcccgccccgcccacctgtgggcgatggctggggtgccgtcctcgttgtcgggcaggaacagctgccagaccccaaagtcgttcctggtggcccagtgctcgggacctgccttccacccattgtactccccaatcagggccaccgcctgcggtgaggtgcagggcggactggcgtgggcgctgggcctcgagcagaggatcaggcgctgatactgatgaaagcagcagcgcagtgcagtcctcgtcatccatccgctgtgcaagcgccatgcccggccgctcccccagtccctgccacctttgcaccgggcgcccactcccgataccagaggccctttttgccctcatgctcgccgcggttgatgccgtagtatttgtaccctgtgggaaagcgatggacagcctcaggcgtccggatgtgctcaaagacggtgggtctgcgatgtctgaaaccagcggccacgtcacacttcggcgtctacacaggcataagcattgggacgaatggtctggtgttcaggactccgcattcagaaaacatgtggccgatatcacacagcatcacccaccctgcgagaacttgnnnnnnnnnnatctgaaaccagcggccacgtcacactccggcgtctacacaggcataagcatcgggacgaatggtctggtgttcaggagtccgcactcagaaaacttgtggccgatatgacacagcatcacccaccctgcgagaacttgtctaggccgccctcgttggcatcaatggctgaccggatgcttttgaagatatgccaccgatactgcaggcaagtgagggatgggacacgaggatggagagaaaaaggccatgagagggaggctgtcaccttctgatccagcttcccgcccagtgggttagctgccgcccttctaacannnnnnnnnngtgggacacgaggatggagagaggaaggccatgagagggaggctgtcgccttctaatccagcttcccacccagtgggttagctgccgcccttctaacatgcaagcccctcctggccagacggccccggtcatgaaagtttgactgctctcctcaagcgtaatcatggtttggcataccttgaagtgatcagcatggctccagagggaagggtcccacttcagacactcggtcccatcatgggccggcacaggggagatctgacccgggacttcctggaactcaaacatggggttgggaggatgtcgagccagagacgaggctgagattcacacctcagcatccatcccctttgcataaaggtcatcctggtccacatgcactgccgatcccgtctgcatcctcctcgaggagcgcaacaaagagtgcccggtgggacgtcttcagctcaccacnnnnnnnnnntacatgcactgccgatcccatctgcctcctactcgaggagcgcaacaaagtgtgcccggtgggacgtcttcagctcaccactgcacccattctccccaacccaacccagccccctccattctcgccacacctggaatgcaaccccgtcaggcacatgcttgactggagaccagaagtcctctggatcttgtggctctggattggaggtcttagcagccgtggcgccgccattgctgccattggtacgggtggagcccaccgtggcagtgctgaggggcggcacttccactcctgcatcggacagcttgcccgagagcttcttcactgcaccatgaatgaaagagaccggaatgaaacttgttgacggcttgtaggtggagcgcacacagtcgattgagctgatcgagcaagtagcaggccctgcatcgactctgccccaggagccccatgcacaccggaggcctcggtcttgttgatggactgcttgagtgccgcattctcgcgcctcgcgacgtcgatgggagattgctgattctctggagtggcactcaccggcacaaagcgggagcctggtcggggagcggcgtactgagggtgacgtcgtgggccccgggcagtggggggagtccgatgtgggatccatgccggccctacacacaccccgacaccgcacctcgcccacaatgcttgacactacaaggcacggcgcggggtcttgcgactggcgccactggcatggccaccccgcgagtccccgcgagcttgagctggggcgccattctcctcggtattgagtcaaccctgggagccggctggattagacaatccgcataaccccaaagctacagcgatggtaggtagcggtgtgatgggagtgctgtatcgaagcaccctgttgggatcacaactggttgcttctctcggcgctcctgcgctggtgcacggtggaaagactgcctcaatgcacattgtgatccccaacccgcggttcgtgtttctcctcgaacaacatcgtggtatgactgnnnnnnnnnntatgcacattgtgatcccccacccgcggttagtggttctcctcgaacaacatcgtggtatgactgttcgttacacatagattgaggcatggccatcgcgagatcggaaggcgcatgttttggggcagggtaggtgtagcaactcccgtcattgcgctgcctccccttcatcttcgtcctccgggatggagggttgggtggaatgcgcgcgaccggtggagccacccttgatgtcctctcttaatctcttcagctcctcctccctccttcgctgctccgtttcggcgtgcacctgttttcgatcgcgggtgttgatgaagggaaagctcggtatcgggatgcgtccgaaccctactccagcacagattcaacgcccacgctttcacacgagcccagcaatatccaatggctctccccttccccgactcaccgccttcctgcgattgagttccgggaggtagcctgcctcgtactctttacggcactccgccacagccgccatgaaatcgtccatcccctctccagtgatggcagagacgcccactgccttcagattctcgtagaatttctccagtacgagggacatggacctgatggcgagctcaaggtgtgagggtaggatggagtgaaggtgtgcagtgctcggcgaggccaggggagccgatgtaaagctggagggggccagattccaccagcttgcctgtcatcctccagtaacaccttgcgaattatcttttggattctgcacttcccccgcctttttatggagtacggacacacacctgctgaggctggctgcgtaggtcgtatcagatgccagggcctcgtggaagatctcaaagtcctgcatccactccaccgcaaagtcgtgccgcgccacgtcgaccttgttgaatgcgaggagcatgggaagccgtgtcttgtacaggatgctgcatgcctgtggtgtgtgtgtagtgggggggagggttcaagcgctgagccctaagcgccactcgtatgtctgacgtgtgatattccgagtcgctggccgtggaaccaccagggcccactgacctgcagcatgttgctcatgaaggtctggggagcggtgcatcgtggcgtgtccaccacaaagaccacagcggtgggcagcactgtcgcaaacgcctcggtgatgatggccccggaggccgaccaggtgaaaatctcgatctggccgggggtgtctgccaccacaaagtctagaggggggtcccgcggcttggtgcacaggtctatgacctggtcgaagcgcgtggcaaacaggttcagggaggtgaggatggcgccattgggacccagggagtactccttcatcacattcttgtagtggatctggtgagcgtgtggatgtgggattggtgtcgagacaaaggcgggggaggcgtaggccgaacgggacaagggtggggatggcgcaaggtagattcctcgcaggcctgcannnnnnnnnnagggggaggcgtaggccgaacgggatgagggtggggacggcgcaaggtagattcctcgcaggcctgcatgctgatgctggaccaacaccctcgaccactgcgatttctcagggcagcctccgactccaacactttagagtggcatgcagcacagctctggtatggctctgaacctatgtccctgctcccttgacccatctcgcaccgtgtctcggatgtcgacgttagagttgtatggcaccttggcgacggccgggtccaggttcaagaggtagccagtcttgccagtggcagagatgtgggaggccaggcgctgcacgaacgtggtcttcccagatcctgccatgcctgtggagcaggcatcctagaggctctggtctgtatctcttgctcacagaagaaatgcagagaaacccaatctggcttctcgatccatcgccgcggcttacttccaaaaccaaacacgccctgtcctacctatgataaggagcaccgtgggggctgtttctcccaagnnnnnnnnnntgcttacttccaaaaccaaacacgccttgacccacctatgatgaggagcaccgtgggggctgtttctcccaaggtagatggcgcggcagtgtcatcatttaaggtcaggcgctgcagtgcttcgtccgggctcgtcatggtgaggtggttcccaggccgcagtcactatctcactgcaggtctccgctgtcccaatatgcatctaaatatacaatacaatgttagtttctatggtcgtatgagtccatatgttgtcgctgttcatgtgtcagggcgcgggcnnnnnnnnnnctttagtttctatggccgcatgagtccatatattgtcgctgttcatgtgtcagggcgcgggcgctgtcggggttcttcccgatcgcgcgcgcgcgatcacagtgcccacgactaagcccaagcttccatcttgtccgtcccctggtacttgagacccattcgatggtcgaatactgcatctcaacattagcatagcccctcggcgtgcatgactcggagcactggctagctggggccaaggctggctcagcccctgtgaccgtgtttacatcctttggtgaggacagccatgtctacacccgggcaggtgctggatgtgagatttgagaccgtccgcaaggagaccatcgagcagctgcgcaccctgaaccgggtcatcttcccgctgaactactcggacagggtgtacgccgacatcctcgcctgcggccccgtctcccagctggcctttgacagggatggcgagatggtgggggccatcgcctgccgcctggagaacacctcagaggtgtgtgatgccgaggagctccccagcctgaattgcaggaaggcgtgcagggtggtcatatgggtgctgctggcaccggccacaccttgcatggtgacatgaaagcgtcctgggcagccaatccctgccccaacacagccccccctctcctcccctccttctctgtgccaagggcccggtgctgtacatcctgacgctgggggtcctggctccatatcggcgtctgggcgtgggtgctcgcctgctcggcaatgtgctgggcatcgtgactcgtgacctgccggaggtggtggccgccgtgctgcacgtgcaggtgggcaacggcgccgcgctggacctctaccggcacgcgggtttcagcgtggggcctgtggttccggggtactacccccgcctcaacccccccgacgccgtgctgctccgcaagcagctccgtgactgactgggagtggcggcgcggcgacgattgcgccgggcccaattgtcggtgccgagcgctgtccgtgagagtgccgcgtcgggacgcctctgatcacccgcaaacccttccagagtgcaaagattgttttcagacccactgtactttttcttccctggcttttacttggtcctttcctcagcactgtaacagagcacactgcaggatgctatggccgcggattgaagcatgcagctccgggggtgggtgcagagcgcgagaatgctcgctgcaggcatcagcccccctccttcccacatgtttcccttgccacgcctcagttgatgcccaggtcggtctcatacacctcgatgctcttgaacagctccgagaaattgcccttgccgaatccgccgcagccgcccacctcgtccgggttggcggccagggggcaggcctgcgcggtggcgcacgcggcgcgcagcgtctcctcgctgggctggatgtggcacaggcgctggatgatctccacaaacacggtgggccggtcgcccagcggcttggtgaagatctggagcagcacgccctggtcgtcgcggtccaccagcaggcccagctcctcggcctcggacagctgctcgggggtgagcgcgtcgcccaccttagacggcaggtcgcggtagtaggcgtcggacgggcggggcatgaactcgaacccgcccgcgtcgcccacagcgcgcatggcgcgcagcgtggcaaacacgtcgtccgtcttcagcgccaggtgctgcagcccggggccgccgttctgctccaggaaggtctggatctgggacttgcgccgcgtgccccgcgtcggctcgttcacgggcagcagcaccatctcgttgttgctggccagcaccatggagttcaggcctgagtcgatcgtgcccacgtcctccgccgtgaactcggcgaagtcgtgcaggcccagcgcgcgcgtcaggtagtccacctgcgcgcccaggtcgggcacgttgcccaccgcatggtcggcgcggcggatgccgaagcagcgggggctggggcgcgcctcttcctcgtaccccggcaggtaggagccggagtagtcgccggacaggaagcgcaggaccacgtcgccgtacagcacgatttccgacaccgtcagcgacccacgcgcgtcggccagccgcgtagggggctgcacggggatgccgccattggcggtggagatgcggaaggcctccgccgcgtcctccaccacgatgcctaggaaggggggaagagagtgagggtgtgaagggggaggggagtaagaatgtgaaggggcttggaaggcgtacctcgatactttagatgaggattgcacacatgctcgtgatatggacagtgcaagaatcagggggccaagaaggggccgggcaaacatcctgacgccaggctggggtcccaacagtatcacactgggtcagacatgcgccagagtggatctgcaaattgactgcagctcatcactgtgcccgctggatgtgcatccaactatcaattccccccacgacactgcaccaaatnnnnnnnnnngtcacaccgggtcggacatgcgccagagtggatctacaaaatgactgcagctcatctctgcgcccgctggatgtgcatccgaccatcaattccccccacgacactgcaccaaatcctaccaccgcagccgacgcacccactgcgcggacgcccaggccgtggttcctgttgaaggagtgcgcggcgtcgacgtcgtaccagggaaccggggagccggcgtccgggccggaggcctcgccccccgcgccgttgtagggcgcagtgaaggtgaagatgagctggttggagcgcatgacatagctggcaaacttctggttccccgtgccctggtcagacttggctacctgggacagccccaggcccaggccaaacctgtgtgatcggggaggggtggagggaatcctggggtgcgttgcttaaggattaagcactggggcccaggtgcattttgcgcgcatccgcccggaagtccatgcccggctaccacacacaccggaaggcatttacggtggcggaaaccgctccgacaaggtggaagtcaccccataatacctctgcaccgagattgcctgcactttacctgcggctggtgtttgtcgcatccccgcagtagaactcaaagtggtggaagcggtggatggggaacttgtcggtcagcgggttgtgacgctggaagcccttggcgccgaccagtttgcgagctatggactcagaaggggggttggcggcagcagtctcgacagcacctcccatggacacccaggtagatttgggggaccggcgcgatgcggccgaggggacacgcaatgggcgagagctgcaggttgcgaaagcgcgtcgtatatgtgtcaagcaaagatgactgtgacccaagactggcatggacgacgagtaacagcaatgaaatggggccgcggaacgaaaccaaaatctatggcaccgcggggctgacgtcgacaaggcggagacctggttttcttgtcagctgaaaaaggcacgcggcatccccattcttgatggaatttgtctggattacattcagtcagtcggaacggtaaaaagttgcggcttaggtgagagctggatcatgagcacgatggctacgtagcctgtgatcagatccaaccctgcccgctgaagaaatcgtataggcgtagcatgcgctgcacatccacctgcagatagggcacggggcacgggcacatgaggcggtctttgtgattggtaacaggttgaagagtcactgataggcttcgttcctggccacaatggatcagcaacagcagggtatttgcacagcaacatacagggtgcatgcaagtctcccagggcaggcaaggccgagcctgggctcccacccacccctagccctccagctggggtgcaccnnnnnnnnnntaagtctccaagggcaggcaaagccgagtctgggctcccatccacccctagccctccagctggggtgcacccagaagcccacagtgctgctcaccttgaaggggagcgcggtgacgtcccccggggttacaacaccacgcctttcttggacctccaggacggaagccttgatggcgaggtactgcgccggcagnnnnnnnnnngccacggctttcttggacctccaggacagcagccttgatggcgaggtactgcgccggcaggtaccgctccgaagcgcagaggtggcgctcctgccgacgtgagcgagtcagcagtgtgtgggagaggcactggatactcaagatgtgtcgtcgtggctgaagctggcaagggctccccatcacatccccggcgttgcaagcaccgcctgctcccatgccccggctttccacctgctgcagcagcacttcggcgtccggcagcgctgtgatgtccagcagcgttccgcgctttccacgccacgccgctaggcccgacgtccctcgcccctcctccacagtcgtgcgcttctggtgcagggacatggcggctgtggaggtgtggggatgggtgtgttacgcttcggggattcacggctgcaagctttggcagcagtttgtcgtgcttgggctgcgtggcatgcgtgccgcggggccgcggctccaccacctggccagaggaggcccagctgcacccctccccccgcagcacctcaccgtgtgcaaagccnnnnnnnnnncaggtgtggggatgggtgtgttgcgcttcggggattcacggccgcaagcttcggcagcagtttgacgtgcttgggctgcggggcatgcgtgctgcggggccgcggctccaccacctggccaggggaggcccagcttcaccccttcccccgcagcacctcaccgtgtgcaaagcccaggccggagagcaggtgctcctgcagccttgcctcgtcgatgggaacccggttgagccgcatgcgtgccgcctggctgggcggcgcgttttctgtgcagtgtggagggggggactttgggctgtgctgcagggagaggattaggactcgtctgcagaacgcaggactgaatggagcgtggggaccccccagacgccctcctggctttgagtctggtcccagccacgacacaaaactccccccacctgccgccatagcacccctcgtcagtcataccttttctccggggtcgatccccgctggcctccagctcatccacctcctcaaaggtgcgcaagcccagcgccctgtactcctgcagctccgcgatcctggcacagagccgcgcctcagcctgcaaggatggatgggtggctttggggtgggagggatggcatgggcagtgggaagcatgcggcgaccaggccagagtcctccaccgcccaagagctggctgcaatccatcgtgcaggactccgcgcagctgcctcgtgccctgcgccaccggcactcgcaacacgccctcctctccactcagcccccgcacccaccagcatgccgtcggccagcgcctcgtactgcgcctggggcaggtaccgtgcaaaggcacgcagctggccggccatggcgcgctctgctgcgctacgccgccggtccacggcctgcgggacgggggaccaagctttgtgggggcagcaggatgcattggcggtgggggtgggggctgacacagacgacatcaacggaccctgaacaaggcaccaccatatcctcaggctcatacccatacactttccaaaataggggtgccttatcctcaaacagtcacaaccccccctcctctcccctctacgcaccgccnnnnnnnnnntggtggtggtgggggctgacacagtcgacatcaacgggccctgaacaaggcaccaccataccctcaggctcatacccatacactttcccaaataggggtgccttcatcctcaaacagtcacacccccccccctcctctcccctctacgcaccgcctggcgcttgacgttgagcaggccccggtccaggatgaaggcccggcgctggtcacgctcgtccagccgccggttgtagatggcgatcagctccagcttctgcgccaccacctcctccgagtcctcctccctgcggtggggtgtcgacaaagcgctgaaggggggtgtttggggttgagtcccaggttgggactgtgagggagtatgggtattccccactcttcaccatgtgcctgcaacatagggaaccctggtcccaatgaacacattccatgactccctgtcagccatcaataacccacctgaactccatctcggagatgannnnnnnnnntaaccctggtcccaatcaacacatgccatgactccctgtcagccatcagtaacccacctgaactccatctcggagatgatgcactccgcctcgtggtcgtactcctgctcaaactcgtttcgcttcaggttgtactccgtctgctgagcctccgccagcgctacctgtgaggcgcgggcggagaacaggcttgggtaggagcgcgtcccatgtgaatgcatgcccctgcacaggagctgggtgggcgggcgctgcggcctccccgggcctcgtccctgtggggcctcccctccggagcctccgcaggaaaaccacccgccacaccttggccccgatctcagcaggcgaggctgccgccggggtcccagccacaccagcccccagtgggtcctggaggatgttcgcctccggctccagcttgcgcacgctttccagcggggcccgctccgcgctggagggcgcgcggctgtcggccgcgcgctgcggctgcgccaggtcgtgcggcgcgggggcgtgcgggctgcgcccggccaaggcgtgcccagcggcggtcgacaatgtgctgccggggctgggcctcccggacgcagtcgcccccgccgcgccgtccccgggcgcgtggcggggctcggggttggcggccagtagggcggccgccaggttctctggcgccacgctgtggcctggccccatcgcaccgccgttggcggcgtcccaggcggccgcgccgggcgtgctctccgacttgaccctgggcgtggccgccggactggccagggcgatgcgggcggaggccatcttgtttagggtggtgctgcggtgggcgtcgatcaaggcctggatgtcaacacccgccatggcgggcgagggctgcgggtcggggaagcaggcggtctccacgtacaccgacatgtagtgggcgcgggcctcgccggggtcgcgccccacgtgctctcccactgcctcccagttccccaggccatacagctccacgccctccaccaggagtatctcctcatccgcctggcagaatggtgatgatgatagggtttgtggatgtgagtgcatgagaggggcgggctcaaagggaccagggatgtgcccgatcaagggagctcatagccatgcagggggtggaagcaatttcaccacgctcccacacgatataccccgacactgactgcgcacagaccgaccaggagtcgctctgcccagactcaccccccattccgggtggtagatggggaaggacaggttgccgaccactttgtaggcatggtcgctgctgtgcggcgtgatggccgcccccaccgagaagcagtccaggcagaggtcgaagtctgggcagacggcgcagcggatgtgcagggcattggacaggtccttgtggcagtagtcgcagtggtacagccccctcccggtcctggaggaggggaggggttggcagtgggaggggtgggaagcggaagggggccacccagagtcctttaatgcatggccagcttgtaatcggcacccagcctgttataggacagaagtctacctcatcgccggcgccctagccggctcaggagcatccaagccaatggaaatggctgctactcactttttgccgagcagggagcggggcccagttccatcgtccaccttcctccgcttactcctgcaagtgttaagccggatactcaaggaggaacaagacaatatagttcccggaaaccacgctcctccatcgggtactcctggcctcacctcgtgccgagaggcaccggaggagccatcgctggctccgcccgtccctagcctgtgtgcatgaacagcgcaggttccactggcttaatcaaacttgatttttagtgacgagcttgtgcgtgcgaagcttggacgtccgatccgtcctcccacgacagctcatgtttgcacctcgcgtaaaggtgagcgtaccggcttggtgtctcttccatgacccggccctcggatcaggtcagctcgtgcatccattacctcggcttcaccctgcacgccacccttacgagcccgaccctgtatcaatttccttctttttcaatcaaaaagtgcgacgcaggtagtgtgtaggctcgatggcgtccatgtccatgatacggcaaccttgccgtggggtcgagaggtccctccaggccatgcctgcccccatcagggtgcgggaggtgcctaaaccgcgggagccgcgtgcatgcgaggattcggcgcattacgtatcggccacggccgcgtgggacccccatgcgaatcccggcagcattagtgctgggtgcacttgtgactcggaccctcccccccacccccccaggtggctggccgctgcgcaggaaggggcgccaggaagacgggcgtcagcctcttcccacgccgtcaggctcccatgaccatcacatcggcggtgggttgggggtaatggtgtggggaagcacttgacagcacatgtgctgggctgatgggtgtgcagcccgctggatcgtatctatgctcggggctggcaacatccactcccgccctcttgcagctgggtgactccctggaggagtacctgcagaccgcgacgtctgaccccaacctacgccggctgatgacggctatgtcggaggccatccgcaccatcgcctacaaggtgtcggggtgttgagacccgggaaggcgtgcctggttttcagtgcgctgacactgctctcgtgctgcgcgtggcttgttttcatgctggcgcgcagtgtagctgtctggagggctgcgcgttgcacactcgacgcaccgctcccctccccaccccaccccaggtgcgcaccgcgtcgtgcagcagcaccgcctgcatcaacacctttggcgacgagcagctggcggtggacctgctggcggacaagctgctgttcgaggcgctgcgctactcccacgcctgcaagtacgcctgctcggaggagaaccccgagcccctggatgtgggtggtgagggcttctccgtggcctttgatcccctggatggctcctccatcgtggacaccaacttctccgtgggcaccatctttggggtgtggcccggggacaagctgaaggacatcaccggccggcagcaggcggcggcgggcatgggcatctacggcccccgcaccgtctactgcatcgccctggctgaggcgcccggctgccaggagttcctgctgcaggacgacggcaagtggctgcacgtcaaggagacggaacgcattggtgagtcctaaagtttggggtgggggtgggggtgcacggggagtctcttagcaggcacattattgcatggggtggagggaaatgatctgtgggacgggctccccaggtaagcactaggtgagccgtcgcgagactatcaaaccaggatgagtcgagcaccttccgatacaggagnnnnnnnnnngtattgcatggggtggagggaaatgatcggtgggacgggctccccaggtaagcaccaggtgagccgtcgcgagagtatcgaaccagggatgagtcgagcaccttccgatacaggaggggtgaacttctcgctgtcagtgacctgatacaaaagagccctggtgcaccccctccctctggtgttcactgcctgccttcccctgagccatggttacatcctccccgctacccccgcccccccccaccctaacaatttacccacagaggagggcaagatcttctcccccggcaacctgagggccacctttgacaacgcagagtaccagaagctggtgcagcactacgtgcaggagcagtacaccctgcggtacacgggtggcatggtgcctgacgtcttccagatcatcgtcaaggagcagggcgtgttcaccaacgtcatctcccccaccaccaaggccaagctgcgcatcctgttcgaggtgtgttttgtgtgtcgggggggcgagtgtggttgttgaggtttgggcaggatgcatgtgtcggaccggcccctgcgccccatgggtgccgcgaggggggccaaatcttccatacaagcgcggaagggagcaatgcgcatgcccacgaagaaccaaccaggccctatcaccctgtccttggagtctatatgccagtcacttcccctaaccccctctnnnnnnnnnncacaagcgcggaaaggagcaatgcgcatgcccacgaagaacccaccaggccctatcaccctgtccttagagtccatatgccagtcacttcccctaaccccctcttcccaggtcgccccgctggcgctgctggtggagaaggcgggcgggcactcgtcggcggacggcaagtgtatctccggcctggatgtcgagatcaagcagtacgaccagcgcacccagatctgctttggctcgatcaaggaggtggccaggttcgagaagatgctgtacggcaagtcggagcgctttgccaaggaggagcagctcgtggcatgagcctgcgctgggggttgtacctggaggcgctgcggcacagtcgtggcaggttggacggccgagaagatagctttttcttgtttgtaatgtctggaacggtcgctcgcgcgcaagtagtgcttgacgagccgggagtgtaccccaagaggcttctcctgaagaggattcacccagcaaccacccggggtcaaccgatggttcccagtcaaactgaggtttcgaattgcgggagctggctcaacaatgaagaagtggtactacacaccgtcagggcgccacgatcaggcccctgcccgctgaggacactgcggcgtgatcaccatggcatgcttgatgagatggcgattgtgaggggaagcggcctgggtcctcgcgaagcctacgccaagccgggagcgacgggccccgagctgtgaaacacattgtgannnnnnnnnnnnnnnnnnnnnnnnnnnnnnnnnnnnnnnnnnnnnnnnnnnntcgggatcagatgcgctgagcaggtttcgcgagctggagtctcaggtgggtggggctgtcggaggtcgaggagcacccggatgtggacattggtccaggttggcgatttatgcaaacatagcacttccttctcatgcagtgggatgcccaannnnnnnnnnttgtcgaggccctgctgcttggactaagaggcataaaactcttgtatctttctgtatcatgcctgcannnnnnnnnnatgtcgaggccctgctgcttggactacgaagcatagcactcttgtatctttctgtatcatgcctgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtggacattggtccaggttggcaatttatgcaaacttatcacttccttctcatgcagtgggatgcccaagagaatcgcgtctcccagaggattgccaagcaagatggcagcgatgttgccctccagaacaaggcgtcgccgggacaaagggttggggggagacgtgagaggtatggggaggccagcccgcccttccgagccgaggccaggagcacacccctgaagtccctgcacctttcctctccccaccgggtcgctgatggcatcgggtacatccatgagagagggtccatttcggctgtctatgaccgcatgccatcagggaagcacgggctaggtggccatgccgcaggaagctcttcaaccttgcagcatttagatggcttgcactccaagtattccgcggagaccgacgccctccaggtgcgcaatgcccagaggggcttgcagaggagttggaactcgcggcaaagcgcgcaagtcccaattccctgatgtcagggcggtcaatccttgcaaccctgccgccgctctccccgtccgtgggtgccgagcccttggatctgatgagcacccctccacacaccctttnnnnnnnnnncgaaaagcgcgcaagtcccaaattcctcatgtcagggcggtcaatccttgcaacccctgccgctctccccgtctgtgggtgccgagcccttgaatctgatgagcacccctccacacaccctttcttccccacccaggcccgcctccagggcctggagcgggagtgcgccaggatggcggacacccgcagcgatgcccaggcccagttggaggcgcttgaaaggcgcgcggccggcgcggaggccgcccgccagcgcgctgacgccgagct

SEQ ID NO: 48626 - DNA, 61 bp, Chlorella protothecoides
ggagtggcagaagatggagagcccggtgctgcgcaaggcgctcggcatgcaggtctggccg

SEQ ID NO: 48627 - DNA, 25005 bp, Chlorella protothecoides
  modified_base (505)..(514): a, c, t, g, unknown or other
  modified_base (938)..(947): a, c, t, g, unknown or other
  modified_base (1327)..(1336): a, c, t, g, unknown or other
  modified_base (1600)..(1609): a, c, t, g, unknown or other
  modified_base (1975)..(1984): a, c, t, g, unknown or other
  modified_base (2296)..(2305): a, c, t, g, unknown or other
  modified_base (2625)..(2634): a, c, t, g, unknown or other
  modified_base (2878)..(2887): a, c, t, g, unknown or other
  modified_base (6094)..(6103): a, c, t, g, unknown or other
  modified_base (6388)..(6397): a, c, t, g, unknown or other
  modified_base (6756)..(6765): a, c, t, g, unknown or other
  modified_base (7727)..(7736): a, c, t, g, unknown or other
  modified_base (11031)..(11040): a, c, t, g, unknown or other
  modified_base (11851)..(11860): a, c, t, g, unknown or other
  modified_base (13809)..(13818): a, c, t, g, unknown or other
  modified_base (14070)..(14079): a, c, t, g, unknown or other
  modified_base (14179)..(14188): a, c, t, g, unknown or other
  modified_base (14842)..(14851): a, c, t, g, unknown or other
  modified_base (15338)..(15347): a, c, t, g, unknown or other
  modified_base (16712)..(16721): a, c, t, g, unknown or other
  modified_base (16773)..(16782): a, c, t, g, unknown or other
  modified_base (16906)..(16960): a, c, t, g, unknown or other
  modified_base (17836)..(17845): a, c, t, g, unknown or other
  modified_base (17939)..(18035): a, c, t, g, unknown or other
  modified_base (18242)..(18251): a, c, t, g, unknown or other
  modified_base (19822)..(19831): a, c, t, g, unknown or other
  modified_base (19953)..(19962): a, c, t, g, unknown or other
  modified_base (20057)..(20066): a, c, t, g, unknown or other
  modified_base (20335)..(20344): a, c, t, g, unknown or other
  modified_base (20561)..(20588): a, c, t, g, unknown or other
  modified_base (20854)..(20863): a, c, t, g, unknown or other
  modified_base (21236)..(21245): a, c, t, g, unknown or other
  modified_base (22167)..(22176): a, c, t, g, unknown or other
  modified_base (22581)..(22590): a, c, t, g, unknown or other
  modified_base (22766)..(22808): a, c, t, g, unknown or other
  modified_base (22892)..(22901): a, c, t, g, unknown or other
  modified_base (23661)..(23670): a, c, t, g, unknown or other
  modified_base (23990)..(23999): a, c, t, g, unknown or other
gcggcctgcgcccccggcgccgcgcccggcggcgacgcgcgcacgctctgcgccctgcaggccctggccgggcccggcgctggcgacgacgacgcggcggtgatcgacgcccagcacctgttcagcgtctacgtgcacgcgccgcccggggtgcaggacagctcgctgccgcccctgttccaggggcgcctggtcagcaggcgcatcgacgccgcctgggggtcccacggcctggtggaggccgcgcgcaacctgctgtgggaggcgtacaaggagcccaccaaccagaggttcatgctcgtcagcgagagcgacatccccctctacgacccgatgaccatgtaccagcaggtgggtgtccctggggggcgttgggggggggcggttgtagagtgtggtcacatggggatcggaaactgcgcccctgcttcccatctgggtggtatggggccccagcgcactcctgtccttgatgtgaacctgcttgattcgggtgttgatcggnnnnnnnnnnggcgcccctgcttcccacctgggtggtacggggccccagcgcactcctgtccttgacgtgaacctgcttgattcgggtgttgatcggggaaccaatgctcaatctcaagcctcatgcccacgtcagtacactctatcgccaccatccgccccgctcacgttccaatgccttgccgctatcccctccccaccctgcagcttgtcagcgaggagggctcacgcgtcaatggctgcgcccacagccgcacagaccgaagacgctggacgtggcggatgagggtgagaaagagggaattaggatgtttggccccatggaggtgatgtctcatgggatacaggctgtgtcacccaaccctgcatggccacttatgggcgagactgcctcaccggcttcatgcatccctcgtcgagcagagcgcaaaccnnnnnnnnnnctgggcgagactgtttcaccggcttaatgcatccctcgtcgagcagagcgcaaacctgaaggcgtaccactggcggaagagcacacagtggtgagtggacttgcagggcaccacgaagagagggtacttggccttccattggtcctgaatgtatacactttcacacatgagtgattatcagggttcctgctgtagtgctcctccctcactgattgtaggtgcatgaccctcccttccacgtcgcacttggccacaggttcatgctgacaaggccccacgccgaattggtcctgggggacacagaagtctacaggaggtgagccgggtggaaggcgtgaaagggggcacaaatcgtgctgggtgtgggaaatgtttgcaannnnnnnnnncacaaggccccacgccgaattggtcctgggtgacacagaagtctacaggaggtgcgccgggtggaaggcgtgaaagggggcacgaatcgtgctgggtgtgggaaatgtttgcaaatgaagacaatcgcttggctggtcacagaagcatggaaactggggcttgtgtgtaaacattgctcgtcgggcttgacgttgcgaatattgtgtacaatggcgcgcgtgtgtatcaagaatggcaccttgtgtcgcgcgtcaggcgccctnnnnnnnnnngaactggggcttgtgtgtgaacattgctcgtcgggcttgacattgcgaatattgcgtacaatggcgcgcgtgtgtatcaagactggcaccttgtgtcgcgcgtcaggcgccctttttccaccacgccccagccaaatcaccgctttgtcacacctcggcagatttgaggagcattgctggtacggctgggacaacgattaccgacgctggagggactgtttcagcgacgaggtgggaactgttgtactgaccctcgtttcagggtcccttcattggtctgctgtggagggagggtgagtgggaccaagggtgcagtttccggctcaccgtgcacgcagcaaccccctcggccccccttcttccctnnnnnnnnnngccaggggtgcagttaccggctcaccgtgcacacagcaaccccctcggccccccttcttccctgccctgcagcactacatgccgaccctatttgccgtgcacaagatccaaactgactcgaactgcggcgcggtgggcgtggccgccacaaattggagtggcggtgcccacccccggtcttacaggttggtgtgtcagggtgtgcgttggagcactgcgattcgaatgctgctccagggtacattctgggatacaacgatccaagtctcatcaaaggtccaagtcgctgattcttgcagcctgcctgagtannnnnnnnnnccaaatgctgctccggggtacattctgggacacaacgatccaagtctcatcaaaggtccgagtcgctgattcttgcagcctgcctgagtatgtctatgcccacccttcaccacagtctctcaccttctcaccgcagccaagaggacgtcacgcccgcgctcctgacagaggcactgaggtcgccgcaggacggctgcgatgcccagtctgcgtgggaggcggcccagaagatgtttgtcaaggtggacgaggccttcaacaggtgtgggggggttggtggtggggaatgggaggggaggggaagagtctgaggaagaaannnnnnnnnnccaaggtggacgaggcctttaacaggtgtgtgggggggggtggcggggaatcggaggggaggggaagagtctgaggaagaaagctcccactggccatgaagtcccatgtgcccctgcatgaggtctatcatgcagtcgaggcagcctggtggtcgttctcctgcctcaagtctatcccggccttttgcatactgagacaccgcgcaaaacaacatcccacaccacgcagcggcctgtgcaaggnnnnnnnnnnccctgcctcaagtccatcccggccttttgcatactgagacaccgcccaaaacaaaatcccacaccacgcagcggcctgtgcaaggtgcccctgccggagtacgagagccatctgacctcgctgtgcaaggtcacggcgcgcaagttcccggtggaggtggtccagcagaccgccacgctcttcacggactgcaacaacggcctccacctgctggcccccggcgtgtgcgctgcacacgctgagcaaggcggcgagtcgctgtcctaggagcagcgtgattcgcccacgtcccagtgaatggggtgccagagcaccttctcaaagggcgttggatcccagttttggagctgggcattgccctccatatcagaaatgaaaacccattccttttctcatttttacaacaggaggtgtgcctcccttggcatggaaaatctgtaattacgttttgtaacattcagctcttgggtttgtctttgctggaccccatgggtgggttgatgatggtggaaaagggccatgccgaatcaaacagcgcgtgcctacgatcacgaggcacagggtttgactccagaggcatcctctggctcactgggaatgcagaaaattgtgcttggacgggtgtcctgcaaatattatcctgctgtaagctcgaggtctgcgagtcacggtcccctgagattgcatgagcagacgagcctccacctgccgtcacactcgaaagctggaagatacctccgcacggcgaggctcagtcaagtaaatcagctatagactagtaatggtgcgcaatcattgtttatgtaggttttgggcgacacgctggccgcgtgccgcatctacgcgattcaggtgttggacggggcagctgggtgccagcagggaagcacgcgtccgaatggctcagggcaggaccacgcccactgcttccatgcaggcactggattctgaaagggacattccaggcccgctcctctgactctggcgaaacgttccagagtcgttggcatggagagtgcgcccactgccccctgacagcgcttgcagggccattccctggagcctgcctcccatgccggccccgaaggctttgctcagcccccgtaggggggtggtgggttggaagtcaaggacagctttccgccgcatgctgctggtcttcataggaatggcgacggtgggcctagtcatctggggtcgcccggcgacggttgagctggatgccgcacaggctggggactcgagcctcccaggatccatgcatgtgcagggaaagctgagtgtgcaggtgagggacaggtggcctggtgactgattgattgagatttcaagaggagggacaatgggcagcggtggttggagagagcgccggaggggatgcactgcattggggctcaggatctgacttggctgctgcaggagggatgcttatcaaggcatgatgctcaatgtgatgtggagccgacttctgcagaccgttgtgtgagtggatagattgccataatgtctgactgacgtcacctctcaacccttacacacacaggatgaggactcacagagggctggagtggacacggagagcgaaccagaccctccccaaaaagttccgtttgcacttaacaccaccgcagtcctcgtgccgccagagacgctgccaagtagtccagatgcctgtgctgaggtgactgcaaagacggatggtgggcatatcttagacactctggcttttctagtgacacttgagcctgcatggtgtcactctgcgcgtccgtacaatcgaagactaccttgctccttgaaactgcctgcaatccccatgcagcggcttcaacgctgcctgacaaaaaccagcccgtccctttgcattcggccagtaacagtatcctggcccagatcctcgtctcccaagacccgtatccccacccatgcaaatcccggtcacaggcgcggggcatacccaaggtcgccctgctcttcctcacacgcggggacctctacctcagccccgcctggaggctctggttccagtctgcggccggcgtcgtcccccgcaccgccgcccgctgctccggggtgtcttccgaggccgtgcgggcagactgccccggcccggggcccaccgcggcactggacctgccagacgagcgcatgatagacgcgcagcacctcttcactgcctacgtgcatgcaccccccagcgtgaacggtgggtggccgagtggcgggagggggagctgcggtggtcgtacacttgcagggggttgacagctgggtgattggtcggggggtggcggattggacaagggtcaccgtgcagaggaggggcaaagagttcagcaatgtatactcatctccttgaatcggagccggatccactgcatgtctgagcgggcccctggctgggcccctcccttgtcccatggcctagttgcacaatcccaagccaccctcgcagtactcaactaccctctccacacaccaactcccccctctcccccctcctctgcctatgtagcctcggagatccagcccctgttccgggacaggctcatcgcggcccgcacggagacctcctggggcagcataaacctggtgtatgcggcgcgcctgctgctctgggaggccttccgcgaccccgccaacacccgcttcgtgctgctgagcgagagcgacatccccctctacgacgcgcgcaccttccaccaccagctgatgcaggagacgctgtccaagacctcagcctgccctgccacagcgcaggacaagtacagatggaacaaggccatgcgggtgggcgtgtgtgtgtgtgtggtttatttggggggaaaacaaagtggagggcgcggagcacaggtcggtgctacagagcaccgtgcctggtgatgctgtcattcgccgataaggccgtgcatttctagttggggagaccatttgatttcataccattggccatgcctcccccatgcattcctgctccccgcagtccgaccggctgggcatcaggcactggcggaaagcttctcaatggtgagccaacgtcgtgaggcatgcgtgatacagtgttcgaacctcaagcattgctctggtgtccaggctcctgagctgaggagcagcctgtctgcgggcgggggacaagcttgatcgtagtagggaacccatatcctttcattcccgcgcacatgcaggttcatgctgacgcgggagcannnnnnnnnnaggagacaagcttgattgtagtaggggacccatatcctttcattcccgcacacatgcaggttcatgctgacgcgggagcatgcaaaggtggtgctggaggacgttcatgttttcaaacagtgagcagtggggacctgtaagctttgtgggagcggaagagggcgcctattgtacccatgcctgcccatctttgcggctgcctcccgccctgcgtgccgaccttgcacaccgttctgaatgtggtgctgtatgtgacttctgcatcgtctccatttccctgtctannnnnnnnnngcctgtaagctttgtgggagcggtaaagggcgcctattgtacccatccctgtctacctttgcggctgcctcccgtcctgcgtgccgaactcgcactccgctctgaatgtggtgctgtatgtcacttctgcatcgtctccatttccctgtctaggtttgaggcgtactgctacagcggttgggaccccgatattaacaagtggaggaactgctacagtgacgaggtgggctcagcggcatgattgtcaagccggggggggttggggagggagaggggggtaaatggctctgccaaaagtccacgcatacctgccacagagtttttcgcaaggtctttcctgcgacagctgcccattggtnnnnnnnnnngtaaatggctctgccaaaagcccacgcatacctgccaccgagtttttcgcgaggtctttcctgcgacagctgcccattggtgcgccacacccgccacaccctcacgtgcctccatcctttctacctcggcaacccggcagcactacctggccacgctgtttgcggtgcatggactgcagcagaccgagaactgtgacgtgtggggcgttgctgcggtggactgggggcatggaggggcacacccccgctcctatgcgtgagtcgagctggcagggggtggggtgtttgatactggcagctgacggtgtaggagcctgcaccgagcaggcattggcagagagtggccatggcaatgtgtgtccctgtgcagccgggatgactgggcaggacatcggtacctccccccgggatgcctgtcacctgcgtcggactggctgaggcaccctcttatcaccacgacgatcagggctgaggagaccacggcagacctggtgcatgccatcaggacgcgccacccctgtcagcccgtggcagccatggaggctgctcagccctactacgaggtcctggatgccaatcgaccccttgaacccctcaggtatttccagaatgggttcctggtatctggcatccagtggggagctgatgactgcaagtgctgctcttaattcgggactggcgggagcggtggtggatctgcggaggtcgtatccgggttgtcgttggcagtgtacaccattcgcggctgcgccaattctcaagcaatcgacattctgtgatgcatccctctctttaaccttgagggaatcgttgcagtgacgcgcaatgtcgcaaggaggccactcggtccggcaaggagctcccagcggtgtgcagtctaactgctcggaagttcccaaaatcgaccgcggaggcagtgcggaacgttttcgtcggctgcgacgagcgtctacagctcgtcnnnnnnnnnntactgctcggaagttcccaaaaccaaccgcggaggcagtgcggaacgtttttgtcggctgcgacgagcgtctacagctcgtcgaccctggtctatgccagattccattgaagtaggggtcccccggatgtccattgcattccatgccggcgggttgtaggggggcacgttggcgccgtacagcagagcaagcatcactgtaaaggatggcgtggccagcaacatgcctgtcaagaaggataaatttggtccactatgactttttgcaatgtgcttcgacgggaatggtgacgacaagtaccttcccgcgtacggattgcgcgtcttgcacggcgcagcgcgggccggacacctatcaccgtcaagtcaaacaccgcgcatttctggacgaccatggtgttggccaacgaattgggttattgtgctgcctgacacagtgctgtgtatgtatgaatgctgatcgtgtaagacaggccgccaaatccattgcgctgatgaccgtgaagctctcgaggcagtagcctctgcaaggtgaggagtaactccaaccaaactgcgagaaaacgacgtgaagcacgactggacgattcccagcacattatatcgccgagcttgctcaattacaaccattcttaagtgcgaccttctcgcttcactcgcgcacaagtagttgggcgacttccgtggtgggaggaatcaagcacggcacccgctgggctctcgctgaagctatcggagggaaaacatccccagaccctggttctagtactgattggcgcgtcccagctcctagcgggcgctgccagacgatgaagaaggtggtcgtgaaaccccaagctacggggaccatccgggcactgctaggcgagaggaaactcgtcattggcctgctggtgggtttcgcgctactgtcagtggcctacaacaggagtagcgagattatgtacgccggagagctcatcaggcatcaagcgtcccccctgtcggatccttcggtgggtccaggaatcgtgtccgtgcatggctttcatggtcactttcgaaaactgccaggctgaccgatggtgcacagacgggccggggttgcaagcccccatctcttgtattggaagcagcaaccttctttcaagctttgagaatgagaccattcacaccgcccccccacaggtctcccctttgtacctggaatttcccacaaactcaaccttgtcggacactgacgcatccggcgcacctgcagagcctgagcaggctccaaaaccacctgagaacgctgcaaaggaggcgttggaggcagagcctgccctcctggaggacccagtgacagaagaacagagcagggacgattgcgcacaggttggtaccctgcttgggtggttgccgaccgcagcagacagaggggccttgcttaacgatgcgtgagactccctggcagacgttgagtgcaagtctcgcatcacatttgtcatccaaaacactttgtgcttgtcgtcacgcccctcaggcactgggcgtcccgaaggttgcacttctcttccttgcaaaagagaacatatggctgcatgaatcgtggcggctctggttccagtcagcgtctggcgtcctcccgctacgatcgcttcagaagcatggctgctcaagatccacagtcaccctcccagaggcatgtcgaggtacgatccacttgctcagtgaacgctggcatgctagccaggctctgcatggaaagactcatatcggctgcctctgccactgcaaatattgtcatacactcttgttccgctcacccttgcaggacgaggagttctagcaagcactgaggtggcagaggaagacatcattgcacagcagagcctcttcagtgtctttgtgcatgtcccacctgaggtcgacggtgagcaggcgctcccctgaccatgatgctccacccgcgccgggaatgtgcctgggttgcatgtgtgcccaggagtgaggggtgcacgagttgcaggcctcgcctgtcacccccgtcgtggctcgaagcccacaagtgcaccctcacaacttaccgcagagaccaagatcgcgcccctgttccgcaaccacgtgcttccgaggcgcacaatggcaaagtgggggagcatgcggctcgtctatgcggcccgcctgctcatgcacgaggcgttcaaggaccctgccaaccaaaggtgcgcgtggctgtgcggtgaagggaggtaccttgcatggccagctggccaggcacgccgcccctcatgcaacggcctcgttcggcacgtgggctgccctgggtggcgctgaccctcctcctgcttcccgccctgcatccaggttccttctcgtgagcgagagcgacctgcccctctttgatcccgtgaccatgcactatcaggtgagagcatacctggtaacatggcacccctctacgcgggctgcttagtggatgtgcagtggcttgaacttcctcgctctcctcactcggccaccctgcggccccctcccaggccatttctgagtcgctctcccggatatctgcatgtccgagctcctccgtagataggtatagatggaacaagcgactaaaggtagggtcctttgtgttgtgtgagtgcctagctgagggcaggcctgcatcagagtcgcctgcggcgtatgttcgcggacacatcacatccttccccacatgtggggtccaatgcaatgctgagggtcccttccgcctcaacactcatgcagtcggcagtgctgaagacgagtcactggcgaaaggcctcccagtggtgagagggtctctttggtgcaaggtgtatggttgtacttctaccacatgtaccatcgctctcatcagcaccctgaaaacacgactccatcttcttaattctccccttcccaggttccttctgacaagggagcatgcacgggtagtcctgggtgatacccacgtctacaggcagtgagtttgttgaaggactgctctgattgtgctcccccgcccagattggggcagtctttgtgccatcatggatttacctggcatggctcctggtcaggctgtcaagcagagcacccaaaatgctctgcacttacgctccgacacaggttcgaaaagtactgctacccggggtacgacccctctgtgcaccggacgcggagctgctatggcgacgaggtgggccttggatgacgggggcatggagggccacagaggccactgctggaactgacgggcgagccagatatcggttccagggcccacagaccctcaccgtgtggtgactccacccatgctcagagagcgnnnnnnnnnncatgacgtggctttggagggccacagaggccactgccggaactgacgagcgagccagatatcggttccaggggccacaggcctccaccatgtggtgactccacccatgctcagagagcgacagtcaaccccctgtcatccccctcacctccctgcagcactacatgcccacgttgttggcagtgcatgggctgcagcagtcggaaaattgcgatgttcgaggggttgctgcggcggagtggagaggaggagcccatccggtcacatacaagtgagttgcttgcttcgagagaggggcaaatatcccaatctacatctagctggggtgcgccagacaggcctctcgtgtggcgctgttgctccacaactttatcaggcagacctgggccccaacctcgtgtccctcccgaccaagctcctccccccctgcctttacacccccattttcccagaaccgcggacttggagcccgacctgatccatcagatccgcaccaaggacgaccagtgtccggtggaggagacacgtgccattgcgcgaagggcatatctcacatatgagcgagacgagccagacaggtgggtgcagttgtggagatagggtagccatttggggcaacaaaagttgcattccgagttacatatttctgaccgctctggcatgacacctgagcaggcaggcacgaggcacatcaagggttctgctcaccctgcacccacatccccctggccttgacccaaagaacactccaacacacaatccctacagggaatgggactgtggcttgctggcgccccagtactatcccatcnnnnnnnnnnattctgctcaccctgcgcccacatccccctggccttgacccaaggaaccctccaacacacaaccactacagggagtgggactgcggcttgctggcgccccagtactatcccatcatggaccccctttgcagcctgaccatgcgcaaagtcagcaatgagtcggcctcgcatgttgctgaaaccctcttccgacgcagctgcgcaaacggactgggcctcatcgcaccagccttgtgcgatgctgggcctgaagctgcctgaagattagcccccctctccatgctggctcaagagcctgcactgggatctcgacatccagagggctcaaattctccttatcacctttcccatgctgatacaccacttcgttaccgctctatgccccttggatccctcactgggatcacctcggctatcacagtgtaaggacttgtaacattgacagtgataaagaatgtcaaaccagcccgagtctgtcatcttcatggagcagtcattttgcgcgacaacagagtgtccaacccatgcttcactttcgatgagtaccctggtctctgcttgatgctgggcggcaacctcagatctcaaagcggaaggggacaattctgtctgaactgcagttccatgtcgtcgaaataggtggcgatctgaagcggatcgggaagccctccgatgctcttgatatagacatttttcttgtcccccgaagcatatatgacccttattacgcggaacaccacatgaattgtccagcagtctgtggtggtaccgcactcgctcgactgatctccgttctgcagcaagcaataacaatttaacatctcgagatctggatctgttgccaaggaacaaccctagcttctttataaacataacaaacatctccatttgtctgtccttaaaggaaactaccagtacaatgtcaccccataaagttcacaggctcgcgcgtcgctttccgatcacttccgatgcggcttccgcctttacaacgggatttgcacatccttctcatactccgtttgggcctccttccagagatattcctaaaacccacatcaaaccattttgcctcactcaaggtacgacaggacgagcatcagagcacccaccggcgactccaggaccgctggtttcctgaaccccgggaggggcctggcgtatcagcctccacgacgatgctactagaccagcgaagccggcagggcttccctatcaagctgctcgtcgcctgtgcgattttcatctctggactggaggtcctgagccatcatgattacctgcccaccattccctgggcgagcctggtcagctcgggcgcgtcgctccggcccgcccgagacccacctttcaccgccaccgggccgggcgtggaagatcacgtgtggggtcttcccccagcggaccacgatatctccaaccctgcgcttctggaggcgccccaggtcctcgtgagcagtccagacacatgtgcccaggtgtgctggctgcatgtatcggggcgagcagggtcttcctcacgtaagctcggcgaatgcatgtgtactctcattctctccaggagccgagcccctgtcccccctacgaccaggcgctggcagtgcccaaggtggctctactctttctcactcaaggcgtgatgcaccatgcggaggcatgggccctctggtttgcatcggctgctggacacatcccattggcaaacctgcggcaggcgggctgcgacgcatggcacagatccatcctgggaccgctgggagcctgtgacagcagcgtaggacccaaggaggcagcagagctggatccagaagacatcatcggcgcccaacacctcttctctgtctacctccatgtaccccttgatcgagacggtgagaaaattgaatgggtgctgcaggccccttgtgtttttgaatagggcaccagggtagatttacatggtgcactgnnnnnnnnnngccccttgatcgagacggtgaggaaattgaatgggtgctgcatggcccttgtgttttggaatacggcaccagggtagatttacatggtgcactggagcttcttgcaccccagagtggtgcctgtgcctgttgcaccctctgtgaggaaaatcccgggtttcatcctccccctttcccctccccccttccatcccttcccacctttgatagttcttcaagtccatcctctcttccggaagcacctcatctctnnnnnnnnnnaattatacctgcaccagcagcgaccatgctcagtcatgaatctcgtacacaatacgcctttctcaatctccagatttgccctcgtcagcgagagcggtcnnnnnnnnnnccccctccccccttccatcccgtcccacctttgatagtccttcaagtgcatcctctcttccggaagcacctcatctctaggcgcacgaccaccacatggggctcccccacactgtccatcgccatgcggtacctgctgtgggaggcgtaccgcgatcctctgaacgagaggtgggaggggttgcggtctggggcttgcctacgacttggtgcgcagagcagacactgcggcacaccttgagtatgggcagtggtctggcgggcgagggtggagcatgtggactcacatctgtagatttcacctgcaccagcagcgaccatgctcggtcatgaatctcatacacgatacgcctttctcaatccccagatttgccctcgtcagcgagagcggtcttcccatctacagccccgtcgtgttccatcagcaggtgcccccgggctcccccttgtggaagtggggccgcaagaatggtttatgtagactgggtacggaggctgcctggtctgaatctcctgcacagggcaaagcttccctcttcgaatggaaattactcttgagccgaatcctggtccgcatccctccctcccatgcagttgatggccgagcaggagtcgcgcgtggacggatgcaaatccgagtccataccatttgagnnnnnnnnnntgaatgggaattactcttgagccaaatcctggttcgcatccctccctcccatgcagttaatggccgagcaggactcacgcgtggatggatgcaaatccgagtccataccatttgagaggtttgtgccagccatggagtcggctgccctcaagaggtggcactggaggaagacaatgcagtggttcatgctgactcgagaccacgcaggagtggtcctggaagacacgcacgtcttcaggcagtgagttgggctgtgggaggaagtgagggttacagaaggtgatgtgctccctaagagggctggcacgtgctggcctccaactgtgctgacatatccagaagcctagcccttgcaacagcattgctcccgtggtttttgtctggggcgtttgactgcaagctcaggacaatcacaacaatgtactttcgattgccattcactccagattcgaacggtactgcttccacgacgccgtggatgacaaannnnnnnnnnaaaggtgatgtgctccctgaaagggctggtacgtgctgccctccaactgtgctgacaaatccagaagcctagcccttgcggcagcattgctcccgtggtttttgtctggggtgtttgactgcaagctcaggacaatcacaacgatatattttcgattgccatccaattcagattcgaacgatactgcttccacgacgccgtggatgacaaagggaatcgtcatttctgcctgatggatgaggtatggagcctgaggtgatgctaatgtcattgtcctgtgcctgcctttgactgacctggactggcctgcacctttcttgcggtctcgatcacagtgttgagacagttggtactgaggctgatggaaaacagtgccccgctcttcctcgcagcactatcttgcggttctctttgccgtgcatggcattcaagccgcgacgaattgcggagcgcgcagcctgaccaaggacgattggaccatgggggggagccatcccaagaccttcaggtgggtacgatagccgggtgtccaacttcactttcagtgtggatggatgtactccatatgatgggctggctgtgctccgagcagcaaatggcgacatgaatgcatccctgctgaatctaggatcgacgacgacccagcagggtagctcgaggctgccactaacggtgcatatgccaggctactgatcgcaccatgtcagagtgttttgcttcttcaaatcctcatgtgtgtttcgctccacaccacacataccatttcaggtctcatgacgtcaacccagagctcatcaagtgggcgaggtcggaggagggcatatacatacccaagtacggcgccctcacgccaccccccttccactgcaaccacacggctgcaatcctcagtgccaatgccgcgatgggcaccctgggcggcgccagcgtgcgtcaggtgtgcgacagaagtggctctggaggcatgctggaccctctgccttcacgctgccgcctgacggtcaggaaggtggctggtgatgctgcatcaaaggccgtcgaactcttcaaaagctgcgcacccggcttggagctggtgcatcccgacctctgccaggtctgagccttgacttcacatacccacggccacaaccgagcaaacttactcgtgtattgaatcagaccaccattcttgtcccaaggaaagcctcccttgcaacgtgatgcccataactgccccagaaaagcccattgcttgtttcatatgctcttgatgtcttccccatccctgcaagacgccagatattcggatctggtgtgtcttccaagatgtgtaatggggggaatgctcgtcagtacctacgggcgagcacgtggacaaccctnnnnnnnnnnagtctcgcggcgctctgtaaaccgcgagccgaagcatggctagatactcaannnnnnnnnncaataggggggaatgcttgtccgtacctacgggcgagcacgtggacaaccctgcgcaagttgggcagggatggcagagtctcaccaagaccccatcgcagatgccaattttcttcccaagtgtnnnnnnnnnnnnnnnnnnnnnnnnnnnnnnnnnnnnnnnnnnnnnnnnnnnnnnnggggctaaccttgcgagagtgccctggaccccccctccaggactcctggtgccacccgcgagaacgggcgtgcccaatcatcttttggtacattataaggttgtgcacgtggtcccgggtcctttgttggaccctgaaagcaattccctgaaagcgaccgcgtcgcctggcgcgacgggcggatgaaaacgtcacggagcatagaggcgagcaagggcgccgacccgtcgcactccgggcatggagtcgaagcctcccgtgcaagtagctcggatgatgggactgcgcagcgtggaggctccctctcgcgtcggggctcccgtacatccctgccgcgcacgagcagcgctcgccctgcaaaatcagtcacactcccggagggcaaggccttcctggtggtgaccctgctcttcctgctctccctgatcatggcggcgcacctcttcagaccccgagatatcctgctggatgtggacgagatggaccttcccatgacggtgagctctggatttggaaacgtcagattggagcctcctgatgccggccatcagcatgcagggcaggctgcggtcagggcagctcagggggcctggatgccacaggaccgcacgagcgcacgctgtgccatatcctccgtgggctcccacccacggcattttgcccacgcaggacacaagcttctcacggcaagcatccctgggtatcccccccacacctagcctggatgacgacaggagccgggatgccaagcagctgcagaacagtatagcaggtaatgcggtgactcattccttgattgttggggctgatataggcgaaaaggtgtgcatcatgcaaggtgcgaagtgctggatgagtggttgggagttcgcagtnnnnnnnnnnactgtgccatatcctccgtgtgctcccacccatggcattttgcccacgcaggacacgagcttttcacggcaagcatccctgggtatcccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttgagtgttggggctgctataggcgaaaaggtgtgcatcatgtaaggtgcaaggtgctggatgagtggttgggagttcgcagtccacccacccttgactgatacaagcagtgagggtgcctgatgagcaccaatttaacacttcctgccataccaaacatatgcagtcacaagctatggcctggtggcccaatcggcacccagcnnnnnnnnnntgcaccgatttaacacttcctgccataccaaacacatgcagtcacaaggtatggcctggtggcccaatcggcacccagcccccctcctgttcatcccgcatctcctctggccgtactcaaaccggcaagcagctgggatgagcgcgggaacacctgcaacatggtaagtcgtgatgagtggcaccactttgcttggaaacgtgggagcttgcatctgtacaatggggcgctgcctcggttgggatcagtcacatctttctcaatgaaaagcaaggcattcaaactactcccatccattgttaggcattggaattggatcgtgtggccttgctcttcctaacaaaaggcgacctcttccaccaccagacatggagtgcctggttcaggcacgtcgggttggccaggctccaataaacatatcaagatagaatctgcaatgcgcaaatcgaggactggagactttcatgcatgccacggctcaccttttctttgattcctggcaaaacaggtcggcgcagggaatgctcccagtctcaaacgtggaggaggcagtgtgcaacaacttcacaaccgcggaggccctgcgcagcttctgtgacatgaccggcaccgactctgaggggcagcgcgccttggaccccgatgaggtggtattggatcggcagtacctgttcagcgtgtatgtccatgcgccgcccaacattgcaggcaggcagggctggattctgtcaggaggaagggttgagtgatcgtcttttcttcaaaaagctcgcttgtgaggagttcacctcggcccatattcgttcccagttgggttcatgtggcatacagttgtttcctggtcgtttaccaacacaggtgaatgacatgatggtgtcagtaacacacagcattcctctccctacttacttgcaccttgcagagaaggatatgagaccgcttttcaagggaaggctcatcaaggataggatatacactggctggggatcacaccaactcgtggaggctgagagaaacctgctgtggcacgcctaccaagaccctgccaacactaggtgtgtggaaggaggcggagaggtgcttttgtgcgggcttcaagaattatggtggtcaagattttgatacagtgttctgcatgccaagtacgtttgtagaggcccactgcccaatatgcagactaccacttttcaacccatggctcacctcgactgccaacaggttcgtgctgctgagtgagagcgacatccccctctaccatcctcttgtactgtacagccaggtgcggtgacggtgaaggaattgtgttgggaactccttcctccggtgaggcagaccctcaaacttactctgcagggccaacgggagccctgtttccgtcttttctcttctagggatgtaaagctacaccggtgtgtcctgggcgctgcactaccaaggcttcttctcaactgacggcagtggttttccatcctcatgcatttacacaccacatccaggtgatggccgagaacctgtcacgagtgaatgcctgcaagagtgccaaccaggaccatcggcgctggagctggcgnnnnnnnnnnttcaaactcactatgcagggccaactggagccctgtctccgtcttttcttttctagggatgtaaagctacactggtgtgtcctgggcgctacactaccaaggcttcttctcaactgacggcnnnnnnnnnnaatgtcggtgagagtggcagagaagtgtatgagggttgcaagcaacgcttccgaatctccagatcatgccgtgcttgctgatgcactggtatccnnnnnnnnnngatgtcggtgagagtggcagagaaatgtatgagggttccaagcaacgcttccgaatctccagagcatgccgtgcttgctgatgcactggtatccagatgtatgctcaaatgcctttgcttgcagagaaagggcctgaagagctcgcactggcggaagagctctcaatggtatgtccagaaggcgtgtgggggggaatgaatcagggctacatcattctatcttataatacagatgacgaacaccacttcaccatcgtggacccaccgtnnnnnnnnnncaaggcgcatgggggggggatgaatcagggctacatcattctatcttttaatacagatgacaaacaccacttcaccatcgtggacccaccgtgctgaagctcgacccctctccctgcttcttgccaggttcatgttgataagggagcatgctaccctggtgctgaatgacactgaagtattccgcaggcgagttttggaatgcagcagggttgtcannnnnnnnnnnnnnnnnnnnnnnnnnnnaccttccctatgccttccattccacagctttgaggcccactgcaggggggggtacgattcggactaccgacgaaatagggattgcttcagtgatgaggtgggtagaggtgcaaagtgtatcagcttggggaatgcagtcgttcatgtgcggtgtaggaggcctgtcatcaagccactacgacgccccttctcctgatgtgcatgcactgcttccgaaagtgattgccatccgttgtccgttgccacacccgcagcactacctttcnnnnnnnnnngctacgacgccccttcttctgatgtgcatgcactgcttccgaaagtgactgccatcccgttatccgttgccacacccgcagcactacctttccaccctactagcatcgcgtggcgttcagacagaggagaattgcgaagtgtatggcatcacctccacggaatgggcttacgagggctggcatccgcacccgcattcctacgcgtgagctgtgggtggctgaccaggcagaaaataagagtgaatactaaggggatgtatgcatgttgattatgatgaaactgggcctgttgcacttccaggttgtaatttacatgttcatctgatgtgtatgcaaagttgcctctcttcccaatgacaggcccagggaggtnnnnnnnnnntataagagtgaatactaaggggacgtatgcatgttgattatgatgaaacagggcctgttgcacttccaggttgtgatttacttgttcatccgatgtgtatgcaaagttgcctctctcttcccaatgacaggcccagggaggtgaacgcgcctctgatccgtcgcctgaggggatcagccgacagctgcaagccagagacactgatcgccgaggcaatggcagggttcgtgcacgtggcctcgatcgcgccatacaggcaagtcatacattgggtgggagggtgggccaagcttgcacttatctgcagaaggctcccttgttcccttgatggggaaattgagctgccctgggctcctcatcatcgagaatacctaacaaagcatcaatcgcatgcccacagtggtcctgagtgcgaggggtcccgtgatgcgggccctatcctctcctcggggaccgccctgccctcgacctgctacgtgctggcgcggaagttcccaaagattacggcgcggctggtgtaccgcgtcatgacgaactgcagctcgggacttgacctgctggcccctggacagtgtctcgagggcggggagatgtggatgcggaatacccagtgaggacagtgtttggtcggtctgcgaacagccaggcagatgcggtggggagggttagatggctagtatgccaatgttgcttgcccaatccagactgagtttgttcctgacgtgtcggcctactgcgatgaagcggttttcaatgcaggcttatgcacaattattcatccattattgtgatttgcgaacttgatattatggcaggggcaggggtaaaagctgattctgggcgcgcttggtatggtcgagcacaggacaatacagcaagtgggaacaacttcgcatccaacctcttgcgacccaaatatacnnnnnnnnnnaacaggacagtacagcaagtgggaacagctccgcatccaacctcttgcgacccaaatatactctctcaacatgcgaggacaaggtatttcgtatcatggtcccgccctggtgtgcggaaatcagaaagacatgctacactcgggacgtctatgagccctccgatgtaagcctctgctaacggagtgtcccaacctcggcgagtaccaatacttaaagatatcagatgtgtataatcttgcacctcacatgccgcaggactcttttgctctatgcgatgctctcgggagcgttctacagggtgcatcaggccccgcaccccagctgtaagtgtaaggtggggaatgtgtcgtggggtagtgaaatgagattttgtatcaatgcttgtacgagtcactcgcaacaannnnnnnnnntcccgcaccccagctgtgagtgtaaggtggggaatatgtcgtggggtagtgaaatgagattttgaatcaatgcttgtacgagtcactcgcaacaatgctctccatgtctccgcataatcaacgctgtacctctttcaagtgcattctggaccttgtagatgcctggaaatagggannnnnnnnnnnnnnnnnnnnnnnnnnnnnnnnnnnnnnnnnnnagggtgtgcttggagaaagctggaccaatagaaagggcacgggcaccaaataagcctccacctgcccacataatgcacctgcannnnnnnnnnaaatcaacgctgtacctcttcccagtgcatcctggaccttgtagatgcctggaaatagggagtgggagcgggtatgtcatctgctcggccgtgcgactcctgcacgccttgggtgtgcacccagcccatgtaatggccactgactgcagtgctgccgctctggaagctacagcagggaccttgcaagctcaccaggttatgactgtggacgtgcgtgggggtgtgcttggagaaagctggaccgatgaaaagggcacgggcaccaaataggcctccacctgcccacataatgcacctgcatcttgtgatttgtctcaacccgagctctttgatcacgccaatcccctccaacagattgagggtgcagacctggtgcaaacagaccttgtggcggggctgggagatcggctgcagggatgcgtggacctgctcctgttcaatccaccctacgtcccgacccccgatggcgaggtcaccctcggcaccaccatcacggctgcatgggcgggagggtggaaagggaggcgagtcatcgaccggctgctgccccaggtcccaggcctcctgtcgtgcactggccacttcctcatggtgtctgtggctgccaacgagcctgagggtaagtgcccactgccctcggatgcaggcagggaggaatcgcgcgcaagtgcttggaccctaggcacatccagactgtgtcgcaggcatgcagggtccattgcttaggagccctcactgttatgcttataaagagcgcttnnnnnnnnnnactgtggctgccaacgagcctgagggtgagtgcccactgccctctgatgcaggcagggagggattgcgcgtaagtgcttggaccctaggcacatccaaactgtgtcacaggcatgcaggatccattgcttaggaaccctcactgttatgcttataaagagcgcttcccaaccaccacagtactgctggaagcattacgaggctatggcctgagggcggaggtggtgctcacaaggagtgccgatgaagaacgactgagcattctacatgcctggcaggactccatgttgaagacgaactcgtagggcacaggatcggctnnnnnnnnnnaagtgccgatgaagaacgactgagcattctccatgcctggcaggatcccatgtccaagacgaactcgtagggcacaggatcggctgtgaagatgttgatggcagctcactgtctgttgaagctcatctctgagacgatgctcagtgcaaaccctgccaacaggaggtgcaagcaatatgaaaaactcctttgctgcacagtaatggtaccttctgccatggctgcctcctagctcaggactcgtgcgataacctctgtgagactgaatcatgtgcagtggatcaatgagctggaattctgaaggggtacaggccaggtttgactggagataagggaatttacacgtccatgagggatggagtgccgtcaccaacaatccagggctcgagcagggcagactgcaaaacgctgctgctggggctaggttgctggcaccacacttcaccccctgggcaaagaagattggaaggggctggccgcacagtgctggagagcgtcgtagatgacattgtctccctgcctgaccagcaatatacaatgtgggttctgggttcgacgtgttcctgaacagaaaggacacaatacccctgcgaaatcctttcggaaccgtcagcaattgtcctcagctggaccagggatcattgacccgggccgcacagacggccagcgtgctggcggcctggggcgacagcttcccccccgcatccagctccgcaaacaggcgctgcctccaaggggtgcgcaggtgggccatggccttgtcttccagctggcgcaccctctccctcgacaggccgtaagccagccccaggtcgttcaggtccatcccctggctcgaccctggggaggtcctgtccgacccgggcgtcccctccatgctcagcaggccatagcgcagtcgcagaatgttgcgctcccgcttgggcagcgtggaaaggatgaggttcaaattctgttgcaatggggggaggggtatggtggtgagtggggggggtgggggggttga

SEQ ID NO: 48628 - DNA, 61 bp, Chlorella protothecoides
cctcgttctggccgaggtgcaccggcgggggggctatgctcatgaagaacatcacccgttc

SEQ ID NO: 48629 - DNA, 72 bp, Chlorella protothecoides
cagccattgtggggcctccttaaccgtgccccctccatgcaccctccctgcagatccagaaggccttgaagc

SEQ ID NO: 48630 - DNA, 61 bp, Chlorella protothecoides
tcaatgtaacacaccagtcccaaggtgtcgacccgatgcaagcctatcacggagggttccc

SEQ ID NO: 48631 - DNA, 61 bp, Chlorella protothecoides
ggactggtctcacgaggtggcctggaccgaggaggaacgcgacgaggtcctggccgaccgt

SEQ ID NO: 48632 - DNA, 67 bp, Chlorella protothecoides
gggcaccgactttcatgccaggggaggggttgaggcggtgctcgacttcctgcacgccgcgtttgcc

SEQ ID NO: 48633 - DNA, 61 bp, Chlorella protothecoides
cgtctggcgcagctccgccacgctcgccagcccctgctcgaggacgggggtcaggcgagca

SEQ ID NO: 48634 - DNA, 325 bp, Chlorella protothecoides
  modified_base (264)..(273): a, c, t, g, unknown or other
ccgaggtgcaacaaaactcacagaccaacgcggattaagccttccagaaaacaatgtcccatccccgactaacagcgggagtttccgaccgatctggcgctgtggacccccccgcggggtgctgtgcatgctgcgcatcgaccccgttgcacttccaggcgtcgcgcgcgcgcgctatccagtcggtgcgaccttgggacagattgccagccggtcccccaccaccgaaaaacgaaatagactgcatgttttctcacaccttcnnnnnnnnnngtatgcagagcttgtcaggccaccatctgctcccgctgcgcctccttggccg

SEQ ID NO: 48635 - DNA, 101 bp, Chlorella protothecoides
cgaggagtttgagaagcggctgaggggggggtgaggatctcatccagtgcatgcagggaggcgtggcggtgataccagtgtgcatcccagtaagcagctga

SEQ ID NO: 48636 - DNA, 62 bp, Chlorella protothecoides
ccacccatgccaggcacgcacctcgtcagacgcggtgggtgcgaccggcgcggcctcggcct

SEQ ID NO: 48637 - DNA, 61 bp, Chlorella protothecoides
gtcgcttcgctgtgcgctgtggctggggggggcatggcttgatctcaaaacgattcctttt

SEQ ID NO: 48638 - DNA, 73 bp, Chlorella protothecoides
ccgaccacgggaggaggtcctggcccaggtgccgcgcgggcccgacgcggaggcccgcctcgcggaactcgcc

SEQ ID NO: 48639 - DNA, 61 bp, Chlorella protothecoides
ccgtgctcgccgagctccaggactggcaggtgagcggggtcggttgatgttttggttgtta

SEQ ID NO: 48640 - DNA, 61 bp, Chlorella protothecoides
gctcagccgctgcccaaggcgcaggcgggggcggcgtacaagggattcgggacagaagcgc

SEQ ID NO: 48641 - DNA, 61 bp, Chlorella protothecoides
ccaccaccagctgcaccaggggcggggggggggttgatgcagcgtcgcgcccctcagcgac

SEQ ID NO: 48642 - DNA, 61 bp, Chlorella protothecoides
cttcatgtcattagggacgagacaaggggggccgacgcatccacgccgcacctggtgaggt

SEQ ID NO: 48643 - DNA, 63 bp, Chlorella protothecoides
gttcgttgcctctcatcaactcccttgccaaatcccccccccccccccccccccaaaaaaagc

SEQ ID NO: 48644 - DNA, 61 bp, Chlorella protothecoides
agccctcataggccgcggagtggaggggtgtgtttccggccgcctccacctcgttcacatc

SEQ ID NO: 48645 - DNA, 79 bp, Chlorella protothecoides
cttaacaccttccctttctcatctgatgcaaaaaatgtcctgccactttctagctccactggtggggtgaatagtgcat

SEQ ID NO: 48646 - DNA, 40842 bp, Chlorella protothecoides
  modified_base (148)..(157): a, c, t, g, unknown or other
  modified_base (871)..(1002): a, c, t, g, unknown or other
  modified_base (1133)..(1142): a, c, t, g, unknown or other
  modified_base (1502)..(1511): a, c, t, g, unknown or other
  modified_base (2804)..(2813): a, c, t, g, unknown or other
  modified_base (3197)..(3367): a, c, t, g, unknown or other
  modified_base (3456)..(3465): a, c, t, g, unknown or other
  modified_base (3554)..(3563): a, c, t, g, unknown or other
  modified_base (3777)..(3803): a, c, t, g, unknown or other
  modified_base (6396)..(6405): a, c, t, g, unknown or other
  modified_base (6747)..(6756): a, c, t, g, unknown or other
  modified_base (7098)..(7107): a, c, t, g, unknown or other
  modified_base (7497)..(7506): a, c, t, g, unknown or other
  modified_base (8338)..(8376): a, c, t, g, unknown or other
  modified_base (8532)..(8541): a, c, t, g, unknown or other
  modified_base (8633)..(8865): a, c, t, g, unknown or other
  modified_base (8921)..(8930): a, c, t, g, unknown or other
  modified_base (8986)..(9061): a, c, t, g, unknown or other
  modified_base (9575)..(9584): a, c, t, g, unknown or other
  modified_base (9782)..(9791): a, c, t, g, unknown or other
  modified_base (9969)..(9978): a, c, t, g, unknown or other
  modified_base (10381)..(10390): a, c, t, g, unknown or other
  modified_base (10943)..(10952): a, c, t, g, unknown or other
  modified_base (11954)..(11963): a, c, t, g, unknown or other
  modified_base (12093)..(12102): a, c, t, g, unknown or other
  modified_base (12191)..(12200): a, c, t, g, unknown or other
  modified_base (12439)..(12448): a, c, t, g, unknown or other
  modified_base (12520)..(12529): a, c, t, g, unknown or other
  modified_base (13408)..(13417): a, c, t, g, unknown or other
  modified_base (13762)..(13771): a, c, t, g, unknown or other
  modified_base (13865)..(13874): a, c, t, g, unknown or other
  modified_base (14063)..(14072): a, c, t, g, unknown or other
  modified_base (14295)..(14358): a, c, t, g, unknown or other
  modified_base (14610)..(14619): a, c, t, g, unknown or other
  modified_base (15001)..(15010): a, c, t, g, unknown or other
  modified_base (15383)..(15392): a, c, t, g, unknown or other
  modified_base (16186)..(16195): a, c, t, g, unknown or other
  modified_base (16792)..(16801): a, c, t, g, unknown or other
  modified_base (17899)..(17908): a, c, t, g, unknown or other
  modified_base (18414)..(18423): a, c, t, g, unknown or other
  modified_base (18630)..(18639): a, c, t, g, unknown or other
  modified_base (19069)..(19078): a, c, t, g, unknown or other
  modified_base (19539)..(19548): a, c, t, g, unknown or other
  modified_base (20511)..(20520): a, c, t, g, unknown or other
  modified_base (21520)..(21529): a, c, t, g, unknown or other
  modified_base (21959)..(21968): a, c, t, g, unknown or other
  modified_base (22203)..(22212): a, c, t, g, unknown or other
  modified_base (22553)..(22562): a, c, t, g, unknown or other
  modified_base (23163)..(23172): a, c, t, g, unknown or other
  modified_base (23510)..(23519): a, c, t, g, unknown or other
  modified_base (23699)..(23708): a, c, t, g, unknown or other
  modified_base (24369)..(24378): a, c, t, g, unknown or other
  modified_base (24813)..(24822): a, c, t, g, unknown or other
  modified_base (25407)..(25416): a, c, t, g, unknown or other
  modified_base (25684)..(25693): a, c, t, g, unknown or other
  modified_base (25936)..(25945): a, c, t, g, unknown or other
  modified_base (26595)..(26604): a, c, t, g, unknown or other
  modified_base (26901)..(27080): a, c, t, g, unknown or other
  modified_base (27154)..(27163): a, c, t, g, unknown or other
  modified_base (28038)..(28047): a, c, t, g, unknown or other
  modified_base (28550)..(28559): a, c, t, g, unknown or other
  modified_base (28960)..(28969): a, c, t, g, unknown or other
  modified_base (29138)..(29166): a, c, t, g, unknown or other
  modified_base (29393)..(29402): a, c, t, g, unknown or other
  modified_base (29608)..(29729): a, c, t, g, unknown or other
  modified_base (29811)..(29820): a, c, t, g, unknown or other
  modified_base (30038)..(30047): a, c, t, g, unknown or other
  modified_base (30392)..(30401): a, c, t, g, unknown or other
  modified_base (31092)..(31101): a, c, t, g, unknown or other
  modified_base (31935)..(31944): a, c, t, g, unknown or other
  modified_base (32542)..(32551): a, c, t, g, unknown or other
  modified_base (32928)..(32937): a, c, t, g, unknown or other
  modified_base (33260)..(33269): a, c, t, g, unknown or other
  modified_base (33332)..(33341): a, c, t, g, unknown or other
  modified_base (34019)..(34028): a, c, t, g, unknown or other
  modified_base (34335)..(34344): a, c, t, g, unknown or other
  modified_base (35564)..(35573): a, c, t, g, unknown or other
  modified_base (37156)..(37165): a, c, t, g, unknown or other
  modified_base (37548)..(37557): a, c, t, g, unknown or other
  modified_base (38714)..(38723): a, c, t, g, unknown or other
  modified_base (39436)..(39445): a, c, t, g, unknown or other
  modified_base (39721)..(39730): a, c, t, g, unknown or other
  modified_base (40131)..(40140): a, c, t, g, unknown or other
ggcgcggcgccggggccgccggcgccgcaccgcgccagcagaccggcgggcaccaggctggcggggcgggcgagtgccaggcccgccgaacgcacgcccatgggtcgagagggcgctgaggcgggcgtcgctcccggcgccggcggcnnnnnnnnnncccgctgaacgcacgcccgtgggtcgagagggcgccgaggcgggcgtcgctcccggcgccggcggcgtcgcagttgtggccgtcgcctgtgtaggcaggaggtcacgctggaaggcgtcgcccgccatgaaggcgtccagggggtccacctcattgtccccctccttcccctcatccggcggcgcacccgcggtgggcgaggtcggctccagcgtggtgctagccagcgcggcgtcgttctgggccatgaaggcgtccagggggtcgatctcctcgtcatcgtcagcgccgaccgcggcgggagcatggttcgtcgtgcccagcgcgccgcgctgcggcccctcctcccctgcaatgtgcgacggagtggggttcctggctctggagggctctgatgcagggaaacacacgcgccagcaagttgattcaatgcagtgcaggaagtctgtatgtgcagtccaccacttcgagcgggcaaatgcatccagtcatgcacttgacaagaattgcggcctccggggtaacagttccctgctcccaaagcccgacaccctgaaccctgctccatcccggcctaccttcagacacagcgtgtcgcaggggtggaggtgggggcgccgaacccccgtttgaagccagggtggcggcttcctgggctcgctgaccgctatcgccctcgtcctccgaggcagaggcctcatcttccaggttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggcttgctgcaatgaagtttgcatgctctgcctgctctccagacaaggaacagcacagaactgttccaaggaaccccaggcagtgcactctgcaccctctctggcattgcatctgcccacctgccgccnnnnnnnnnnggggcttgctgcaataaagtttgcatgctctgcctgctctctagccaaggaacagcacaaaactgctccaaggaacccaggcagtgcactctgcaacccctctggcattgcatctgcccacctgccgccatgcgagcatcctcttctcccgccggtcgtcgatgggtggggccgccttcgcctcctcatgctcttctggggcagtgtcctcgttgcgcctgcagtgcagggaggagagtgcagagtcagaacgtctgcgctgggctgtctgggcagcatgcactcctcaccagcgctgctcgtcaacagtggttcaagctctccaccaagggaacagcgcacctccgcttgctggccggnnnnnnnnnntgagcgctgctcgtcgacgatggttcgagctctccaccaggggaacagcgcacctccgcttgctggccggcccattgctgtcgctacccgagctccgggctggtgacacactcctacggcggtctcccttgtgcctctgcaccaagtcgagggacgtgagggtctagtatgatttgaaacggggggcccatccagcaattcagtgcagtggggccaaggcatgctggtaagaagcaggccacgagcttggatgtatctccccagcatcagaccttgtctttacgtcggtgccgttctcgatgctcgctgccctccccgtgacgggagtggtcccgatgatcaccgccgctgggtcgggcaggcaggtcgcggctcccactgctggggcccatcccgggcgctgcagatcggtgttgggcatggatcggcatttgatagattgaataggagcaagaaaagttacgaacccggagaaacatggggtggggactccctggatctctcaagcgtttgtgctccccggctttcgtacagggaagggcacaccatccatgcgaacacaggttcacgtacctgggcaatcaactgccttccgagagcagggggattgtggcgatatgagctggtctatctggagcggatcctcctacggcgcatggcatccgctccgactcgtctgaaacaccgtgctctgtcctccgacgtgagccagcccaaagtagcgtcgctttcacagctctccccaaagacgtgggtctcggatgtatttgaatgtatggattcccaaagtcatgtcggcttggggattggccggcatccaaaaagatgggcctgggtctgtcgaggcgtggcgtgaagctccctcaggtggccccaggaagaaagtccgagggggtccccctggtattctccttcttgatcacaaccgctgcaccaggcactcagtaaggtatctgcatccatgtcaagcttgggtctgtattctttcagctcccaatggcaaccccatgtaatctgtcagcttgaaggaacctgggtcgttgggccccgcccccgcctgcttcctgatcacgccatggtgcatgcgccagctctggctcctcctgtcctccacgtagtaacgcaatgccaggctcaccgcagagaaagccagctgttgcggggcggaacatgggatcaggagttggctgctcgttgtgcatggcatgattgggcacatgctgaaccaggtcgaggctggccgccaattacgcttcagcacttggtccaaagttctagggcatgcatccaccnnnnnnnnnngggtcgaggctggccgccaactacgcttagcacctggtccaaagttctagggcatgcatccacccgcccacaaccccaccaccacgcacctcgttccaaggaatgtcctcgaggggaaacaggcgagtctccagcgattccggggcctgagctgcaaaggtgaatggcggtgccagcctcgcacgaaacaggaggtacgcctggccgatgccggggatgtcaaagtgcacgtaaggcgccacaatttccacagcagcgccggcctcctcaagggtctcccgtgccgcgccctctgcgcaccggggaagggccaggcgggactgatcacgtgcagctaatgatcatgccccggcgcagcatcgccgccctggggccgacccaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatacaccccacctggagcggggcccgggtgacaatggggagcccgggtgcgtttgttgcacagccactcctcattcaaacaccgtccnnnnnnnnnngatgcaccctacctggagcggggcccgggtgacaatgtggagcccgggtgcgtttgtcgcacagccactcctcattcaaacaccgtccnnnnnnnnnngggcgggactaatcacgtgcagctgatgattatgccccggggcagcatcgccgccctggggccgacccaaagaggccgttctgaagcagctgcagcaagcaactcaccagcagtgctctcttgcagctccatgtacccggccggcaccgtccacttgcccagctggggctggatgccccgccgacacagcagcacctggtcctcatgctccacnnnnnnnnnnnnnnnnnnnnnnnnnnnatgacacctgcgccacagcacctcaccacgttgcgggggttgatgtagtgcacgtgggagcaggcggagcagatgtggcgccagcggtcctccgaggacacgaatctcagatctacgggtccagcacactggctgcagaagtggatggtcttggggggggttgggggctgggtggcccccgcctgatggcccatgtcgtgtatgaccctctggccaggcccatgcccggcccggcgcgttggcagctggtgcagcagcaacgaaggtcgcggcaagatgaacctcagtaacaatggctgcgggggaatgggggctgcatgaccaatgaatgcactgccaatcccttccaagccattcatgcaggccctcagccacgcaccgccgggcgcagcgcgatcctcagagtcatgagctcatgatggcatgttacagagtagggaagagtcggatattgaagagctttgaacgcaattggctggatcttcaacgcaagcacggcgaagtcaccggccctggcttgatgtcggacgccagcctgacacggaatccacggcctcttcctcgagatgcctcattgggaaagtatcagcattactgttattgattacatatacttcatcattattgttgacatgtttgaatgaatagagagcgggtttgaaaagaatgaagccggcagtgcttctgttcacattggcacttggcagcgtcaccgccctcgacttcgggttgccatgggcatctctgaggccctcgcgctcaaggagtcacagggaggaggcccagatcacttccatgccgggctacccacacacacccttcccatcgcgacactacggcggctacatcaatgtcgacgcctctaggggtcggcgcctcttctactactacgtggagtcagaggatgactcgagcagtacccccctggtcttatggctcaacggcggtccagggtgcagcagtttcgatggtgtgtgggttgggtcttctggtgtgaacggtggtgcacattatttgccttgatgtagaccactcgaagggtgacctgagctgtacctcttacccacctacccaggctttgtcaaggagcatggtcctttcaaggtctctttcaagggccgaccagatgccactggtgagttgaagcagaacatcaggctggatgacaaccccttcaggtgcctggctggtggtggagggtggggtgattcgggatgctgggtggacaccaagcccaccgcgtgcttctgcacctctacactccaaacgtcagcaaggccacttactccccccctgccgctcccaacgtcagctggagcaaaagcgcgcacatgctgtatgtggattccccggcgggggtaggcatgtcatactctgacacccgccaggattacgtgaccaacgacacagccaccacggcagacctgcaccacttcctgcgcctgtggctgcaagagtacccggagcatcgtgagaccccattctatgtggcaggtgggtggcctggccagctcacatgtctggaagagggagttgagagggtgggggacccaggctgatcatgcagcaaggagggctgtgcactcagaacgtactcctggtcctcctgcactgcgtctttgagaggcacgggctacaggaacccaaccattcatgacagaggtttgtgaggccaggtctgatgggtctccacccctcctcctgcccctgactttgcaggcgagtcgtatgcaggcgtgtttgtcccgctcctggtccaggccgttctcaatggaaatcaggaatccggtcgggcccccatcaacatcaaggttggtatttcggagactgggcgatgcagccttgaagctggggccagggaggggactggggcaaggcatgagctccagcgtgtcgcacagcaccatctccttgagtaggtcacggcctttaagacccgcagctcgcatctcaacatctccagtgctgccatcgcctcgccgccctctcacctgcgactccttcaccccccaccagggatacctggtgggcaacccggtcgctgacacggagctggatgccaacagcgtgcctgcatacctggcctcccagtccctgatcagccaggccatgtacgaggcagccgtgaaggcctgcgacgggggtcgcttccacggcaacccttctcgggcctgctctgaggcccaggacgccatggatgctgcgggtgagcgtgcatggggttgcgacgtattatggtgcttgtgctgtgcgtgggatgcaggctgggcagggccggagccacgagtcatgggctggcctgtggtgggccgtaccgctgtggccaggaggggcgggtaccactgcctccggaaatctcattcttccacgccatcacagctgcatccattcggcctgcaagttcacttccagtgcactgacacgcacccttgcacacccacgctgcagtccgcgacatcaaccactacgacaccctggccacttgctaccacggccggaacccctacatggtcggcaagggccccgaagcgatggatgccgagccacagatggccggcgtccggcgcagcgcgcacagcgcggggcgtttggnnnnnnnnnnccgatggatgcggagccacggatggccggcgccgggcgcagcgcgcacagcgcggggcgtttggctgctcggctggagcagcacatgctaggccacacccctcggtgcctggatcaaaggtggggatgggtcaggtggagaggatctcctcctcctcctgagggagacagaaagccgacctgcagcacagcatgcagcgtcacgctgccggaatgctttgcctgctactatgtgaatccagcatgaggccccagccaaggaggaacgcccagcatatatttccgcggcccggcagccctccctgcccacctcccccccccccagaaaacaaacgacgccgcnnnnnnnnnntctccttctcctgggggagacagaaagccgacctgcaggacagtatgcagcgtcacgctgctggaatgctttgcctgctaccacgtgaatccagcatgaggccccagccgaggaggaccgcccagcatatatttccgcggcccgccagctctccctacccacctccccctccccaaaaatccaaacgacgtcgtttctgcgatgcaccgcgcagggagatgtgggccttctgcaacgacgagcgcgtgcggcatgccatgcacgctgcgcccatctcccacatcggcgcctttgacgagtgcaccaacggcgacaggatcgagtacaccagcgagcacgacnnnnnnnnnncgccatgcacgctgcgcccatctcccatatcggcgcctttgacgagtgcaccaatggggacaggatcgagtacaccagcgagcacgacagcatgctcggcgtccacgtggagctcgtgcggcggggtgcgtcggtggcgttgggtggggttgggctacgctgtgagaaagctgggccgggacaggagctggggcacgccgatggtggggaaagccgctggccggggtgggcacgcccctgcacagtcctgtccccgcccccacaccccacccctccttcccccttcccctgagcgcctccctgcacgcgcccgctggcaggcatgcgagcgctggcgtacagtggcgaccacgacatgattatcccgcacacctccaccgaggcctggannnnnnnnnnccgcaggcatgcgagcgctggtgtacagtggcgaccacgacatggttatcccgcacacctccaccgaggcctggacggcggggctgggcctgcggctggagaggggctgggcgccctggcgggccgacggcgggcaggtgggcggcttcgcggtgcactaccgcggcctggtctacgccacagtgcgcggcgcagggcacgccgtgcccgagtccaggccgcgggaggcgctggcgctgttcacgcgcttcgtgcgggggcgtggggcgccggcctgaggagctgcagggccagggggcggaacgcagagaggagtgcgccggggtgcagccccattgtctggtcctttgctggggcctgttacccagcagcacgctgagatccttcctgacaacagttcgatgctcttcacaagggggggagcatctggtatccatgatgggatcacgggggggaaggcaggcagggcagtgtgcagttcagacagttttgcgggcttcttgattgaaagtccccgaggggggggggggtgtataagtgaggggtaccgtacaagaaaaaacacctactccctggtctggagacgcggggctcgctcagcccagggtgattttgcgcttgacgctccttcgtttcttcctgtacagcattacagacacgacgccagcccccatgatgaatacagggatcgtcctgaccagcagacccagctggttcagctgcaatggggttggggagggggttctgaagcgacatcactgaagaaaggcagcaagcaatgatggggcccacgaggctctggctgcaaacgtctcccaaacccgccgccccnnnnnnnnnnnnnnnnnnnnnnnnnnnnnnnnnnnnnnncgcgcgtcagccagtgcttgatgccacccgcgacgatggagggcatggtgttgttgccgggcaggaaattggactgcacagggcgtgtgcaagcatgtgtggggggtggcagtcgctcacaggctggcggcactggcctgtgcctctccctgtgcnnnnnnnnnnctgcgggcttcttgtttcaaagttctggtgggggggtttgtggggggtcccgctgggggggacacctactccctggtctggagacgcggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtccacaccccaaggtcgcgccacacacgcacgctggagaggcggaagggctcctnnnnnnnnnnatccacaccccaagttcgatccacccacgcacgctggagaggcggaagggctcctnnnnnnnnnnnnnnnnnnnnnnnnnnnnnnnnnnnnnnnnnnnnnnnnnnnnnnnnnnnnnnnnnnnnnnnnnnnngtttgactgcacagggcgtgtgtaagcatgtgtggggaatggcagtcgctcacaggccggcggcactggcctgtgcctctccctgtgcgttgcatgctgaggatagcgagcacggggccctctcaccaggttgggtgctgcgataggtgagggccgcgccacctcgctgatcacgtcgcaggagtacgaggagaagccctggggtggggcagggtgcctgagtttgggggtccaaggcgcggtggcgggccctggcgaggctccggtgcaccatgccaggccgctgacccatccctggccctcccaagcccactcacccgcactgccctgccctccggcgaccagccccactccttgatgtgcaggttggcctcctcccttgcggtcatgggggcttctgcgaccgaggcaaggggagggcgcgcttgacagctgctgcatgggttcttcttcgggggaggcaggccgcccatggcgccggcaggtcgcccgccgagacacatgagcacctcgnnnnnnnnnntatgggttcttctttgggggagggaggccgcccatggcgccagcgggtcgcccgccgagacacatgagcacctcggcatgcgagcgacatccgagacatcgaccaggggacgtccgtgcccagcgcgtcgccgtcgctaaaacggcaactctgtcaatcgcgaccccaccatttgcatctcccccccaccagttgcannnnnnnnnnggacatcgaccgagggacgtccgcgcccagcgcgtcgccgccgctgaaacggcaactctgtcgatcgcgaccccaccagttgcgtctcccccccaccacttgcatctcccccccaccacttgcatctccccctccctcccccgatcccgctcacccagcttgtagagggcgctgttcnnnnnnnnnnacatctcaccccaccagttgcatctccactccaccagttgcgtatccccctccctcttccgatcacgctcacccagcttgtagagggcgctgttcttccggtccgtcttggggtggtacacgcacacctcgtcgatcacggccaccttgtccggggggtaggaaagcagggcgggccacagccagtccaggccccagccaaagtaggcgtcgaagagggtggggcgcaccatgcgatcgaacagttccatctcgaagatgggggccatgatctccaccatgttcacgtagcgcagcaccatggagcgcacggtgaacagcgcgcggtacggcgtccaggacctgcgtggaaagcgcggcaggcaggggatgattggaggatggttggggatcggttgggggcnnnnnnnnnntgtggaaagcgcggcgaccaggggatggttggaggatggttggggatcggttgggggcgcgcggggagacacagagggccgatggtcaggcatgggacggtgcaagctcactgggcacttggggtggccatgcacatccagtgggagccctggagcccagaccccagggcataggagcatggacgaggaacactgtcagcagccaccgcatgctgggcccaatccaggctgctcccccctcccatggcaggcgggtgcaaactcacccaggctcgttgcagacgctgggctgggcaatgagcaggtcaaaggcttcaaacacggcgagggctgtgttcaggacctccccaccggccacctcaaggtcatcatctatgaaggagatggctgggaaggagggggccggaatgcatgtggatcagcatcagcgagagcgacctgttcaatcaacttgccgctcatggacgtcaggctgcacaagcctaccctcacaactctgctcgacaccgacacacacccgtgcacacaaacccctccgcactcttgtatgctnnnnnnnnnngccggaatgcatgtggatcagcaccagcgagggcgacctgtccgatcaacctgccgctcatggacgtcaggctgcacaagccttccctcacaactctgctcgacatcgacacacaaccctccacacaaacccctccgcactcttgtatgctttccggatgagctgccagtcggagtgtagagtgaatcgccaggccagccgccatttggcgccctggccggcaaacacctagcgggtggggtggggtgctgtggccagtggggctggccagcatgtaacgacagggcactggctcctccttcagcgctcctctccacactctggcaatccggctcgaccctctcacctttgtgcagagtggacagctcttagcagggttgctgccgtagtatatgaggtacagatcccatgtggcgtgctccgggtcggtcatccaggatgaggcattgaatctgtcccctcccaggaccaccacaagatggcgtcgctcagctcgcctgcaacggatacatgagacggtcactctggtggctgtgatgctaccatgaagtgatgggggacatgttgtgcagcacgggcaagaatggtttggtgcccggtagctccagcccctgcgccaagcgcatttcaccccaggctctcgagcacccagcgctcgtccaaaggcatcaagcatggcacccccgcgtacagttccccacgcactctgacttcttagactcgttgagggtcctgagtgctgctgcttccctatcatgcggtgcaacagcagcattctgtctgagcctttgctggtgctccttcaggtactcttggacctgccgatgcatgtcggccttgtccacttgctgtggcggttcacccatgggcaaggtcggtactgtgaaatgaaacgaagtggtagaggatctgtttccttctcagcgacgcaaaggcaaactcggtgccaccaggtggaaactctgtgtttgaaaccctggaccgcagcctccggcagtctgnnnnnnnnnnagtcggtactgtgagatgaaatgaagtggtagaggttctgtttccttgtcagcgacgcaaaggcaaactcagtgccaccaggtggaaactctgtggtttaaaccctggaccgcagcctccggcagtctgnnnnnnnnnntaagaggccgacaagccttgacctctcatcataccgttctgatggacagaagttacttcgagacgtccaattctttacagtcaaggtcnnnnnnnnnncgcgttgcacaatactcctttcaccttgagccagagctactccagctgtcccgagcagtaatatacatgcaaatatatatttgctcggcatcgccgcgacctgcggctgctccagagctgaccgagagtgtcgcgacactgccgtcgctccaagagcccgactagccttgacctctcatcataccgtcgtgacggacagaagttactgcgagacgtccaattctttacagtcaaggtcnnnnnnnnnntcaccccaaaaactggtgtgtgtgctggtagtggagagggccgtgcatacgcgatcttcaatgttacaatgnnnnnnnnnngctagccaatttgatcgccaggcggaagcccccacgtgaaagatcccccccgccccctccctgtgcaggacgagactaccaccagatcgtcgcatttaacattcatgcatgagatgtgcaagcatcacacagcatgctcagattgcaggcacctaccacaacatcaattcaaaccaaccaatcacccccaaaactggtgtgtgtgttggggggggggagaggggcgtgcatacgcgatcttcaatgttacaatgaggaatgttctcattgcatgccgaggtcacgtgaaccgatatttttcacttgctcgttaatttccgcacacgcactctaggtttcctcagccagaagatcatgaaggtgatggccaagccagcgccataaaagggaagcagtctccacgctaccacattcacaacagcctgtaggcccggaggagtacttcgtaagatctaatggggagtgctggtgtttgcagacagcatccaacattctacccgcgcagattgaaggaaggacgtcacctttgctgctatcagggtgggggttgcctttcccttcttgacaatgccgaccacatcacaggaccactgagagaatccctgcaaagatcagcaaagagctcacgtatggtttctcacgcagggtgagaacttgcaagagtactcgccgacatcgaggactctgcagcggttcaggctgccgctgtcgacacgccagtgacgaggtggacctccccactccctcacattagttatggaaagggaaaacttcaagcaacctgccgccgccacccatgcatctactgcaagccaagacataccctcggaccaaacatcctcctaccacacctttgaagctctgacattgggatcgaannnnnnnnnntgctccctcacattaataatggaaggataaacttcaagcaacctgccgccacccatgcatcttctgcaaggccaagacataacctcgaaccaaacatcctcctacaccacctttgaagctctgacattgggatcgaatctccactctgaaaagcggcgagcctcctcctcctttgccgtgtagggagccactgttgatgtgacagagggatgctccttgaaccaagctcttcagaatgaatcgcgaggcaaaaatatccaacacaattcatggccgattgtacgccttccctagcaattcagagtcccacgccgtgtctcaatcaaagcctattatagcaggacnnnnnnnnnngaacatccaacacaatttatggccaattatacgccttccccagcaattcagagtcccacaccctgtctcaatcaaagcctattatagcaggacnnnnnnnnnngaatacatgagttactgctgcagcctctgagtctgtttgttcatgtctaacaatatacgagacggggcatgccatatgagacccaggcgtacggccccatccctgctcccttgcagccccaacccggctcacccatagtgagcgttgtacagggtgagcctcacgagctcgtcgaagaagtccatgtcnnnnnnnnnngcggattcagggtggaagaggcagacctcgtcgatcacggcaattttgtccgacggatatcccaggaggtctggccagatccagtccaggccccacctgggtaagtggggagataatacatgaattactgctgcagcctctgagtctgcctgttcatgtccaacaatatacgagacggggtatgccatatgggacccaggcgtacggccccatccctgctccnnnnnnnnnnnnnnnnnnnnnnnnnnnnnnnnnnnnnnnnnnnnnnnnnnnnnnnnnnnnnnnnaaggacctgcaaaggagggggccacagggagtgggaacacatgacggcttgaatccctataaggatcaatgtgtccacacctactcggatgagtgtcgcatatccagggtgtggctggacacctggggcctctctcacgcctctgcactctacacaaagtcacacctggaggcggggcagtgcatgtcaggatatcagtgcctggcagggtcagggcatgccacggcaacccctccacccctcaccagtgcnnnnnnnnnnggcctctgcaccctacacaaagtcacacctggaggcggggcaatgcacgtcgggatatcattgcctggcagggtcagggcatgacacggcaacccctccacccctcaccagtgcgcccggcagacactgggctgcgcgagcaggagtcggaaggcagtcaccgctgcaaacgctgtgttgagcacgcccacgtccgccatgatgaggtcatcgtccaggaacgcaatggctgttaagccatcgaggacgggtgagggtcagtgaccaagtgccagggcccaaaacacccacagccgtagccgttgtaagctggcgtggtcctgagaaggtttgaaagccctcccggtatctgtgctccccattcctgtacctttgtaggtgnnnnnnnnnnggagggtcagtgaccaagtgccagagcccaaaacactcacagccgcggccgttgcaagctggcgtggttctgagaaggtttggaagccctcccggtatccgtgctccccattcctgtacctttgtaggtgctgcgcatagtttcccactcgggcaggagcgtgaggcgccatgccaacctccacttggggcccctgccccgatatacctggggatgagatgcgccgatgggatgtggtgacaagagggataaaaaccgttcaaataactcagaataaagagatgctgtggaaggatagggacgcacagattgcgactgcggggccagccaataggccggggctccaaggagcggggatgacagccataatatnnnnnnnnnncgcgccgatgggatgtggtgacaagagggacaaaaaccgctcaaattactcagaataaagagatgctgtggaggtatagggacgcacagattgcgattgcggggccagccaataggcctggggtccaaggagcggggatgacagccataatatccctcccaaaccccagtccaacccgcacaaagcgcaatgaggtcaagcaggtcaccttgctgcactctgcacacgtgatggtagccgcattgccatagtaaatccagatcaggtcccaggtccttgcccctccaagggatgtccactttgtggggtcaaagtcatcaccgcctgctacaaccaccaggtcccgtggctgggactctctaggaaggaggagtagcgcattccgtgactttcttgcaggtctaagagacactctgcaacatgtctccctggatttcctccagatcagggtggtacctggctcactgcaatacttgccaaggatgccagcaccgcctctactcaccaatcacccctgctcacccttctacaggactcttgagcctttcaaatgcagtctgacgcactcgagtctcttctgctaggttgccgcgcatgttctgcaatcggaattgctcagcataagcgttcactcgcttgtggacatcagtcctgttgtatgcccagtccagtgccggtggcaactcggtgaggactggagcaggggggagtagggcagcaggaaaggtttacgatacaaactgcaatgttgtcgcccaaagatttttgctcaacagggcaatacaagtcctgcnnnnnnnnnnaagtggggcagcaggaaaggtttacgacacaaacttcaatgttgtcgccccaagacttttgctcaacagggcaatacaagtcctgctcccgggggttgagccaaggagcgccgaccaactcacgtcccacccaagtgacagtccagaaacagcatcgcaccggtttcagcagaacggcagagggtaacaaataccattacaagccagaggaggtgcagggccggcccatgtaaaaggcaaggaagcctctgtgaaccttgcggccactcggccattgggggtctccagccagaacagtgttcgaaacacgcgttcccactcacgcaaggttatcccttactgtcattctatatatcccaatttagaatgaaattggagaaggcgcgggtgagtctgacttgaaacaacacgtccgagacagaggcacgtgggttttattgaatcattgaatcggcccagctgctccgtaggagatgcttctccagacagcgccctctcccagcaacagtcccccgcctccccgatcaccttatttgtggtattatttttactcgcggaaggtgttcgcgtgcgacaaggtggcatgaagtagccagnnnnnnnnnnctctccagagagcgccctgtcccagcaacgctcccccgcctccccgatcaccttctttgtggcattaattttgctcgcggaaggtgttggcgtgcgacaaggtggcatgaagtagccaggagaatgcctaggccctcacgagcattctgggtgtttgccgtgttgaccgtggtctctctcctgcaatgccaggccgtgcgctccagggaggaagatcgtgagttgggaggatccctctaacagttcccgtgaaccctattcctgtgcgcttgcgctgacagccatccccgtctgcgtcgtccccctgtgcagccgatgtaaaggcgcgacgtgcagccgcggccaacgcccgggttgagcgtgctcatgcacggagacgggacccaaacttttccaatgtcacagcctccgtcttcgactggcaagctcgattcctggcgaaccagggagacaacaccaccgccctgacacccgccaagaacaagaccggcacctggtggaagggccttttctcccgagatagcgccgatcggtggaccacggccatcgtgaacggggagtgcgagctgaccaagaaataccagcccgccaaggactaccttgtgatcgtcgcagtgggagacacaggcaaccccctcacgtgagaggcctcgtggcttttgggccacgcctgggtttgatgtgtgcctgtgtgctgaggaagagtgcttgctgctcttccaacgcctgtgcaccggctgacagggacttccaggctgtcagatcatctatgggctcagctttccctcaggagaagctgtgtgtgccaactgcctcatggccaacgcaacacaactcgcaggtggctcaaccatgccaagtgggccaacttcgacctggtggcggtttactttggcgacaacgcatactttgactgcccccagtgcaaaaaggtgtcctgattgggcgaatggtgggacgatgttggagcactggtggagttccccacgccatctacctggggaataaccggtggcaggcgccagatgcacatcatcgaatttcctggccgacaggtgcacatctcctctcgcagaatcagaggaccatgcatgcttnnnnnnnnnnatgattgggcgaatggtgggacaatgttggagcactggtggagtttcccacgccatctccctggggaataaccggcggcaggcgccagatgtacatcatcgaatttcctggccggcaggtgcacacctcttctcgcagaatcagaggaccatgcatgcttctgcaacctgcccatgcccggatgcaacgcaggtgtaccatggcaaggcccagaagttccgcctcttctactccctgcaccaaatgccggagtggaagaacctgacggcgcagtacaaggcggtgatgacggcagatgatgacctggtcatgtccacctgcgagatcaacaggtatgggaagagagtggtccatgagcgctggaattgtgcaacgagccgcaccacacgaggcgtgcgggcttcctcattgctggtacctggtgcgctcagttgcttgacaaagtctctgagagagttcgccctgcgtccccattctctggagcagggcgttcgagatctttgagnnnnnnnnnnggtctctgagagaggtcgccctacgtccccatgctctggagcagggcgttcgagatctttgaggagaacaacctgctgatgggccagataagcctgtgtgaaacgcaagaggtaggagcttgcggtagggccctggagttgggatgcgaggggtcggccgctgctcctggtcctggatacactgtcacccggcctgcacaaggaccnnnnnnnnnnaggagttggaatgcgaggggttggctgctgctcctggtcctgaatacactgtcacccggcctgcacaaggacccccccacccccaacccctctcgcagtccttttcctactggcggctgatgtaccagcagcccgacaaggtgttgcgctacgtttcatttgtggagatcatggcgcccatcttcacaatgcgcgatggattctatgacgacttcatcgtgcccaccctgtacgatgcctacacaggtaacacgagatccggatgtgcaccctttcttacatagattgtgcattcccgagggtgaacagcctggggtagctgaaggagggctggaatgggcagtgccagctgaacaagtcacctcttcctaaacaccccttccccctttattccccattcccccaggctggggcctggactttgtgtggnnnnnnnnnncaatgggcagtgccaactacacaagtcccctcttaccaaacaccccttcccgctttcttccccacccacccccaggctggggcctggactttgtgtggcccttcctgctcaagtaccccaagaaccgcatcgccgtcatcgacgaggtgtgcatggtccacccctccaagaagctctccggccagtccatctactcctccggcgcgccctacgatcagcgcgtggaggaggcgcgccgggaggctcagtttggctacacccgcgcggccgtgcggcggctggtgagtgcgcgagggaaggaaagggccacccacgacgtggcactgccgccgtggtctggtgatgggtgcacatgctcggaatcggcccatcgttggctcactgagccttgttgcggcgctggggggatgcagggccgaggatgtatcacgccgagtcacaaggccatgtgccagccatcnnnnnnnnnnagaaagggccacccacgacgtagcactgccgccagggtctggtgatgagtgcacatgctcgggaattggcccattgttggctcactgagccttgttacggcgctgggggtatgcagggccgaggatgtatcatgccgagtcacaaggccatgtgccagccatcgagcgcctgggccggcccccgctccacctcacccctccaccatccatgccgccagggctaccccttctatgcggtgcaagagtttggcgcgctggagcgccaggcgggcgggaatgcgctggaccggatggacctcttcatccgagccaggctgggccgctggttccccctcctcctgggcgcccagacctttgccatcgccgtgggcctgctcctggtcgcgatccggctcatacggcgccgcgtgaagggaaagcgggtatgaggcggcgggccctggggcagggccgggctgccgatgcgccgagcatcaaggtgatgaccaactcagtgaagggggctgttgtggccgctggaacaacattgcacgaacaaaggccattgcaggcatacttgctacaaacccttttctgacgcagcttgaacccatattcgtgcttgtaaggctttcccttgttcgagagtggagcaatgaggaccagaatccgtgatgcacaagtgatgtcctggaatgggagcattcctttgtgtcgatgaacgggcgtccagcctgcgtcccaagtttacaaaagatacgctctgaacatcagcatcttgaagtgagagtgccataaacttcccgggcaacaggtgtccctgccatcttcacattcatggtgaacatagaatcggtgactgtcatgccaatggcagtgataggctaagaggacataccccttgcatatgccgctgtatgctggtattcagattcgatactgcgagcttcacgttgatgtactggaagccagtcacaaattcannnnnnnnnnccacggtgaacatagaatcggtgactgtcaagccaatggcagtgataggcgaagaggacataccccttgcatatgccgctatatgctggtattcagtttcaatactgcgagcttcacattgatgtactggaagccagtcacaaattcattctgtcctgccaggcggttgatatcctgggagggaatccaaggcgatggatgaaccctgtctcaaagctgcaggagagctgccaggggctttgcctcgacgtcgcccacctgaagggggtgagaaggtcgaggctgaagctgccagtggacacattgtattacatgttgacatgcctgcactcccgaaactctgcatacccctcacctctacaagaaccctggtgcgctttgcagcaggaatcaggatgctgcccatcggctgctgcctggtgctatcaggtatgagaaaaggagacattgaaccgttgtacattccccaaacgattcatgctgcctgttttggattgcttgctggcacttcacagcgcctggccgcacccaagcagcagcggtggactgcaacaccacttgccctcacccaccaggttccatcgtgctcatcaattatctcctcatgcgctccagccaggatgatgtttccatcagcatcgagacagctcagctcgcccacaaggaccctcccgtcgtcgatgaacaccttcagcttgcggtataaaagtcgagctagcctcgcaccggcctcagtattttccattcctggtgggtcacccatcccggatcggaaagactcgtttcggtgcaatgagcatatcttgtgtctcggaggaggactcctgctcgtgctttgtgtgaaatgcccctccgctgtgatttcgggagctccaggctcgaaagttcctgatcaaccccattttccgactatattgacaagtaaatcgatgacagaaaagtatatgtgtctttctcttcgtgtggcaccctttttgacagttcctcggcccgcatcttnnnnnnnnnngtcctgatcaaccccattttccaactatattgacaagtgaatcgatgacagaaaagtataggtgtctttctcttcgtgtggcagcctttttgacagttcctcggcccgcatcttgtttttaacacggggcactcgttgtctcgaggatgcgccgaagatcaaccggtcctcggggatcagccggagtgatcagcctttaaattatattgtagtgaagaacagatgcaaaagcagacgccaatccctcgggagatctatcgtttgttcgtacagaccgaggacgaggtcttggcctgcttccaggtgagacgccgcattgaccacacaagcagtacatcccaaagacagtatagcaccattaccacgagactgttcccactgcaggcacaaaagtgtgtgcctgggagctcgagccatgcaggccagagannnnnnnnnngagacagcatagcaccgttaccacgagacagttctcactgcaggcacaaaagtgtgtacctgggagctcgagccatgcaggccagagaggcccacccaaggtcgtgagatgtgtggtgatccatgccttgcactaggtcactcctcacccttcctgctcgcagcacatccaacaccgctgccacacccttctcgcagcctgtgtcgggggagaggttcctggtgctcacgtatcnnnnnnnnnncaggtctctcctcacccttcctgctcgcagcatatccaacaccgctgccacacccttcccgcagcctgtgccgggggagaggttcctggtgctcacgtatcggaagcggagccgactcaaggggctgaagggcacgctccaggtctgcaagctcgtccaagggagctaccaggtgggagagctggcagctggggcctcttggttcattgtgcctgctcaaatgggtggtgccctcaagtaggtaccctgaacaggaagctgcactgtagttggagtgatgatggctggctccctgcaacgaccaccagtgaatgagcatgcccaggtgattcgctgcactnnnnnnnnnnactggctccctgcaatgaccaccagcaaatgagcatgcccaggtgattcgctgcactcgactgccgcgagcaggtccgcaaggctttccgtacaaaggcgctctctcgcatggagtgcttccccggcacgggcctggtcgagctgtccttcttacgccacgccttcacctccggggaggtcaagctggcattcaggctgagctccgatgccctgcgtctggagtttctgggcatcctctacgacttttgcacgtaagggtcactttcaggaatgcgagtgcagtccgggggtgtgggagggtcaccaggaacaaggcctgccctcctcacctgtatgaccctgacagtcgcccttgcatcggcgcacccgcctcccccaccccccttgtgacgtgcaggaagcaggagcactgccagccagccatgctcggcatccaggacctggagctgagggtgttcgccgccgatgccggcgcaccccaggccaaggcgactgcgggtgtggacctgcccggggtcgcctcccagcccgcccccagggccgcgaaaccgcacatcgtccaggggcgtgcagggtctgtttcgaggaacccaccgcgcnnnnnnnnnntgagctgagggtgttcgccgccaatgccggcgcaccccaggccaaggcgaccgcgggtgtggacctgcccggggtcgcatcccagcccgcccccagggccgcaaaaccgcacatcgtccagggtcgcgcagggtctgtttcgaggaacccaccgcgcgaggatcggcagctggagacgctgctggccctcgtggcgggcgcgggcggcagcctggaggaagtcaccctgcagctcaccaccgagctggaagccctggaggtgagcactttgtggagagggttggggggccatggaggctcaggcacagcgtggccggggctctgcgctgcgcagccannnnnnnnnncagaaggttggggggctatggaggctcaggcactgcgtggccggggctctgcgctgcgcagccatcctggacctcgctggaccagcgccccgacgccatgactcccccaccctcgcccatgccaatgaaggatgcgggggtacatgagctgctggaaagcgaggaccaggtgctgagccnnnnnnnnnntcccatgccgatgaaggatgcgggggtgcatgagttgctggaaagcgaggaccaggtgctgagcctgaggcaggacctggatgccaccatcggcctgctggacgacctggaggacaacctgtccatcttcgacgccaagatggggctgatgcgccaggacgtggcaggtgagggaggctgcccccgcatgtcccggcgctctgccaggcttccgcatgcctgctggtggcgggggcgcgcccgttccccgacctggaggccccgccacccgccccacgcctgcgcctgcagccatcgaggtgcggaacaaccagctggagacccagtcgcgcaacgacggagcgctgctggacaccctggactcgctgctcagtcagctcgcactggggccggacaccgagaagatcctcatgcaccgccagctcagcatgtcggggtgggtgatgaacagcctctgtggacggggggttgttttccacatcgaactgcatagtcccgccacgccactgccatcagtgactgccatcaggaggggttggtccatttcagtgctggccgttccataatctcattgcaccctgcccatgctggcggctgccttgccgtcagagtcagggcactgtcgagttcccatgacgctgcatgcacctggtgcataccnnnnnnnnnncgaacagcctctgtggacgggggttctttcccacattgaactgcatagtcccgccacgccactgctaccagtgactgccagcaggaggggttggtccatttgagtgctggccgtgccataatctcattgcaccctgcccatgctggcggctaccttgccgtcagagtcagggcaccctcgagtttccatgacgctgcatgcacctggtgcataccaccacagggtgggcgcgtttgtggccgcctttgacgagctgagccgccgcgtggtctccctcagcagcacctctggggccctgccgggccacctgcgcgcaatgacaggtgggtggtgctgtggggtcctgtgagaccggccgactatgccagccgagggaaatgatgtgtggtggcttcacgctgttgaatttcttcccactttctctgtccactaccnnnnnnnnnnaaaatgatgtgtggtgtcctcactctgttcaatttcttcccactttctctgtccactacccagtaccaccaaattccctctttctgtcaaggggtgactcgattgatctttcaaccccccaccccctccccctctctttccgctaaaacgcagcgattcagaggcggggggtggaactggcggcgctgcagcgcggcgccctggccagggccgtcgcctttgtcgagtctgagctcgccgccggccaccataaaggcgtcgacctggccggcctgcacgcccatgcgcggcagctgcgcccgctgctggcgctcgcggcgcgcgtctcccccgccgacctcgaccgattgcggcgcggctactgcgccgcgattaccgcgctgctcgctcgcagtgcgcgggagatcgcggaggcggcgcgcagcgccgccgcgcagctgaccaagacgctgtccgccgcgctgccggcaaccccagtcagccaagcgtccgtagccccacgcggccagtcctttgccatgtgagctagggctttgaggggggagggggggtgggggggtgtttgaaagagaatgggtgagtggnnnnnnnnnnttgtgagttagcgctttgagggggaaggggtggtgcgggggtgtttgaaagagaatgggtgagtggggtgggcgcagattggggggctcatcaggggggcctacgtcgctgagacaagctctatgccagcgacgatgcccgaatgggctccagaaattgtggtagctgctcacgccagaagttttccgcatcccccaccaggcctcggcggcaggagaacgcgctcctcgcttcgcgggcggacccggaggcacgggcggctgagccnnnnnnnnnncctgccagcgacgatgcccgtatgggctccagaatcggtggtggctgctcacgtcagaaggtttccgcatcccccaccaggccccggcggcaggagaatgcgctcctcgcttcgcaggcggacccggaggcacgggcggctgagcccgacgccccggtcctggagacagcgtttgtcaccgggctccagtgagcactggggagggctggggtgggagggaggacgttgactggatgcagattnnnnnnnnnnagggctccagtgagcacttgggagggcaagggggggagggaggacgttgactggatgcagattggggaaaaggcatgcgaagaaacggggtttactacttactttctggtgcgaggctgcctggcacgcccatgcagccatgttcctggccccacccttgtgtcgcctcccaggaagctgttggacacgttcatccccctggctcagcgagagctggacgtggccagcgagatattcggttgcagcgaggacggcagcgacccggggcctgcggaccaaggtccacgggacctgggcgaggtcctcgtctcggggcctggccagcacatcctgagcctggtgagggcgggccgctgcagtggcagcgggctgggaagggcggtgcaagagaggggggaggagggtgcatgggttccacctgctgcaggatgcgccggacagctccagcaggcgatgcgctggatgcatgcagcgcgaccgcgtggcgtggggccggtgtttgcattgctgtgcccagtgttgctggagcctggccacgcgcaaccccttctcgtgtcaaaccatgccgcaggcctcggaaatgcagggcccgcacgccctggcgggcatccctgccctcgcagccgtctttgcctggcagcggcggctcnnnnnnnnnnacacgccctggcgggcatccctgccctggcagccgtctttgcctggcagcggcggctcacgcggtctgggcaggggaaaggagaggacgaggtggcctctgcactcctggggctcctcgagcgcgtggaggcgcagctcaccggtgctgtcgatgccgcgaacgagagcagcctggccggcatgcgcaggtgcgaagggtgtgtgtttttggaggtggtcccggcgctgcatgcctgttgcacagacactaccatcattttcgtctgtgcatgggccaagcgagagcataaccgtcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagcgtgcggcgcgtggaggcggcgctgagccagggcggcccggggccgcgcaactcgcccggacgaggcgcgnnnnnnnnnnaaagggtgtgtgttttggaggcggtcccggcgctgcatgcctgtcgcacagaccctgccatccttctcgcccgtgcatgggccaagcgagagcataaccgtctcgcgcatggataacgccggcgccctcactgccgccctttccaccccccggcgcaggtatgtcgcgcagcgctccaccagcgcattgtccgcctcggcggtcaagtcgacgcatgtcctccctttcctgccacgcttcctggaaagcgtgcggtgtgtggaggcggcgctgagccagggcggccccgggccgcgcaactcgcccggacgaggcgcggggctcgcgacgctgagcggcgtccggggcgggccgcctcggccgtccccctttggggccgctccaggcgccgagcccggcgccgctgcagcggggcaggctgccgccctgtgagtccccggctggctgtggatcgatggagatctgaggtttcatcgcaggaaaaggaatcagttggtttacttcacatgtccacctgttgcagccacaccacaagaacctgaaaccccactcacacaagcacccacgccggctgcagagcgctggcccgccgcagctgggccacgcagctggcgggcgcgctggcggcggtgggcgaggtggcagcccgggatcagaagcacgggccccgcatctgcctggagaactacgtcctcctgcagcgcacattccaggcgaggcgcctggtggcggggagagtgcatggtgggagggggtttccgcgcagtgttgtgcagggcaggtccttgtgttctgggccaggcacagcccccctgccgcttgccgtgccatcgggcttccctcgacacgccagattccctcgccacgcggtgcannnnnnnnnnggcatggtgggagggggggtccgcgcagtgtcgtgcagggcaggtccttgtgttctcggccaggcacagcccccctgacgcttgccatgccatcgggcttccctcaacacgccagattccctcgccacgcggtgcagtcgcggcgggaggggcccctggctgatgtcgcccagagggtggacacggagtgccatgccgccgaggccgcctacatcgagcagcaggtggactactttggcttcaccccggtcctggcgctgagcagggtgcgagggagtggcgctgatcatgcgctgttggactgcatcgaacggggttgactcgcgggtttcgtggccgttcgtggggcaccaaaccatggaaagcgcacatgaattccatgctgcaagtacccaacaaacccatgtccacacctgcatccccatccttgcagaaactggatgatctgtgcaacagccagcccagcacccggcccccggcccccatcagcttgtcagacgcgnnnnnnnnnncatcatgtgctgtgggagtggatcgaatggggttgacctgagggtttcgtggcagtttgtggggcactgaaccatagaaagcgcacatgaattccatgctgcaagtacccaacaaacccatctccacacctgcaaccccatccatgcagaaactggatgatctgtgcaatagccagcccagcacccgacccccggcccccatcagcttgtcagacgcgacgtcgatgtttgcgtgcgttgggggtgaaggggcacacacacatgcatggcagcacgcagggggactgggtgtcgagccacgtgctgacatgctctcatcccgtcgacggcttccaggctcccctcatcatcccggattcaaacaataatcttcctcatgcagcacctcaacaaacggtctnnnnnnnnnncgcgtgcgtcggggtgaaggagcacacacatgcatggcagcacgcagggggactgggtgtcgtgccacgcgctgacatgctctcatcccggcgacagcttccaggctcccctcgtcatcccggactcaaacaataatattcctcatgcagcacctcaacaaacggtctnnnnnnnnnnnnnnnnnnnnnnnnnnnnnagtgactgtctgcctcaggcccttgatacctcgcaccatatgcaggctggaggccatctgcctctcgcgctgggagcgcattcccaagcagctgcgtacctggtaccctacctttgacctcccactcactgtgccccagctcaaggcacaatttttgagcacaaagcccatgcagaccaaggcagcgccgtgagagtcaagatggccctccatcatgccctgtaacnnnnnnnnnnggccaagaagctgggggctctggctcagcgtctgctcaagcattttgggagcagcagccccgaactggtgccgcgcatctggcagaggcaagaggggcgggcggattgttggggagagcatgcatcatacacccagtcatcgccctgtcaaagtagctgtctgactcaggccctcgatacctcgcaccatatgcaggctggaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatacgttcttgcataatagcatcatgtctgcaggtcgaaagtacgaatgaggatgacgtaattcatatccagctgcgcgnnnnnnnnnnaaatacattcttgcataaaggtattatgtctgcaggtcgaaagtacgaataaggatgacgtaattcatatccagctgcgcggtggttgcagcgccgttgccgaccggaagatcggcgccccgggcgtggcatcaggccatacacatggtcagcattgttgtcgaaacagggagatcacttagtgtaatacgggcatacattacactcatatcagacgnnnnnnnnnntgcgccccgggcgtagcatcagaccatacacatggtcagcattgtcgtccaaacagggagatcacttagtgtagtacgggcatacattacactcatatcagacgttaggcttggatcgacgcagtcctccacaatgaccactctggcaggcaaactcatgcccaagcgggatgccacccccgaggtgaccatcacctccatcaaggacgagacccggaccatgaagtctgtgcaatggttcggaacgtgagcggtgtagatttgcagagcagtgatgggtctcgatatagtatctagggtaatgtgaacgtcagagaatgttttgtatctcacgcccatcacagnnnnnnnnnnaagtggtgtagttatccagagcactgatgggtctcgacatagtatctagggtgatgtggacgtcatagaatgttttgtatctcacgcccatcacaggaaggacattcgggtggtcgaagttccagttccaaaagtcaccgatgagggtgatgtaattcttcgtgtcaccaccactgccatctgcggctcggacctgcacttttacaatggtgccatgcccggaatgaagaagggcgacatcgtgggacatggtgagttgtggtgcatccaatctttgcatacgagcgttgcacatcgaagaggcctgcgccaaactattccctccacttgatcattcaacattgcagagttcatgggcgttgtggaagtaagaatataaggagaagcattgtgcgcctgaaagatgagtatcttcgaagcttcattgcaagggacctggggacaatgctcattaccacactctccattgcttctccaacacaggccgcgggacccaatgtgaagaagttcagtgtcggagaccgtgtcgtcgtcgccttcgacatcggatgtggatcttgtttctattgcaataaggcaagagggaggtgttataactgactgcatcgcttggtgtcagagcgcacacaactttcccttcaacatctgacatggtctaccagtcttcgccatgcagagccagttctcctgnnnnnnnnnngtaactgactgcatcgtctgatgtcagagcgcacacaaaatttccttcaacatctgacatggtctgcaagtcttcgccatgcagagccagttctcctgctgtgactccaccaaccccagcaaggagcaggagttcttgtatgggcataacacagccggactgtttgggtacgatgctgggcattcttctcctaaagggtggtgtgtcaagggtataggtcttgatattttcctgggatgtgattcatttatacttcttctcagtagatagtatcatggggtttcgctcgctgaaattttcgaattatttctgcaggtacagccacatgactggaggctgggatggcggccaggcagagtacgcccgcgtcccgtttggtgagtttgcactttggggtgtcagcctgggcgaattcctcctcccagctggtgcttgcacatcaactctcgggccctatgcctgatctggctctccaatttgtctctcgctgcgcgcctcagacccttctcctcgtcctcaaccccctgtagccgatgtcaactgcctcaaggtgccggagggcatgcccgacgacaaggtcattttcctctccgacatcatgcccactggctggcatggcgcagagtgcggccaggtgggagagggcgacaacgtcgccatctggggcgccggacccgtcggtgagtgggaagagctgttgtgggaggtggatgtgattgccaatgtcaccaaattggtcgaggcaggatggtgtgaattttgctgtcatttggttcagaatgaagtgtccctgaacgtagcatggcttgcgaccttgtactgaatcccaatgcnnnnnnnnnnctgtcaccaaattggtcgaggcaggatggtgggaattttgcagtcatttggttcagaatgaagtgtccctagacgtagcacggcttgcgaccttgtactgaatcccaatgcattataaagcgtgtccgtcccaagcactgcccaatgctcccgcactcaacaggcctgctggcggcccagtcttgctacgtccgcggtgcagccaaggtggccatcatcgactcggagcagtacaggctggactacgcggttgctaagctgccaggcatccacaccgtcaacttcaaggaggtcaaggtgctggaggccctgcacaagatcttccctgtcggaccggggcctgatgtggccatcgaggcggtggtgagtggccgaagttttcctgtgtgtgacgatgtgaagcatgagcagcatcagtcatggagtgttcaggtcctttggctctgggtgcgccttgctggcatggcttaatccgcgggcatcggcacaaatgcacgaccctgtccagtccctcaaacacagagactctgacatgactgctctgctgcaacagttgagtacccccgtcctccttctcaaacagggcttgcactatgcnnnnnnnnnngattttcttgtgtgcgacgatgtgaagcaggagcagcatcagtcatggaatgttcaggtcctttggctctgggtgtgccttgctggcatggcttaatccgcgggcatcggcaaaaatgcacgaccctgtccagtccctcaacacagagactttgacatgactgctctgctgcgacagctgagtacccccgacctccttctcaaacagggcttgcactatgccacgtcttggctgcacaagattgagaaggccctcatgctggagaccgatccatccgaggtccttaacgagatgatcgaggccactcgcaaggtggagcctctatgaggggaatacagaagcttgcttcgggacgtgccgcgatctaagtccatctnnnnnnnnnntgagatgatcgaggccactcgcaaggtggggcctctatcaggggaatatcgaagcttgtttcgggacgtgccgcgatctaagtccatctgcaactctcaggccaagccaagcccctcactcccaccgcgcagcatgggcgcatctctgtgattggagcgtacgcaggctactgcaaccacttcaacattggcgccttcatggagaagtaagcgatcgggggggccacaggcgaacgtgttgcatccctttgggttcccgactccaaggctgcacaccaggagttaagattgcaatctcatgcacatcaaccctctctgtgcannnnnnnnnntgtcaagctgatgcaggcaagtccctttctggtggttgcaaaattgtgataggatggtttgtnnnnnnnnnnaggccacaggcaaacgtcttgcatctctttggattcccgactccaagactgcacacgaggaataaagattgaaatctcatgcacatcaaccctctctgtgcaggtcgatgaccatgagtggtgggcagactccctgccagaaatactggcccaccctcgtcaagctgatgcaggcaagttccttcctgatggttgcaaaattgtgataggatggtttgtattcaatcttgcaagaaagacaaccttgagattggcctggtgcactctaatcagtcttgatcgccaaggagccctgccctgggattcactgagtctcatcgcccctgccaactaccccattgcctcacaggagggcaagctggaccccaccatcgtcaagacgcatgagcttccgctggagcaagctcccgaggcctacaagatgtttgacgagaagacggatgaggtggtcaaggtggtgttgaagccagcactgaagggcgagtgaaccggacgtgctgtacctttgaggtgtcgtcaggcctacatctctctgaacgacagcaaagggtctggtactactactggctgagctgcgtgtgatcaagcatgtgtgatctctgagcatctctgtgaccaagatcatgattttacatactcatcatagaatccctgtgtcttcatgtgtgtctgctcatnnnnnnnnnnctctctgagcatctctgtgacctagatcatgattttatatactcatcataggatccctgtgtcttcatgtgtgtctgctcatcaatagcaattgtaatgtgtctgaagaatacatagatacgtccctggatcggcttttgcccactgttaccttcctgttgaaacatccgttccgagtatcagctggcaagtcctgtaaaattgtgctatttgcaatacccggagcactcttcacaggatgcgtttgaactcgaatttgtgaatgttgtaccccctcccgacagcactcggctcgcctggtgactgnnnnnnnnnnaaaaacatccattccgagtatcagctagcaagtcctgtaaaattgtgctattcgcaatacccggagcactctttacaggatgcgtttgaactcgaatctgtgaatgttgcaccttcccccgacagcactcggctcgcctggtgactgggagctgctcgcccagggagcagccaactacgtcctccagcgacaagggccggaccaagatgtgagtgcgtgggcggcctgttttgaagcgagcaaagatggtccccatcacaacctccggagaccctcggtctgggcgcaggtgggttggcttctgcgcatccccaaaatccggcagcccccggatctggtgtctgcctttcttgagacccagatctgggcaccgttcctgcaaggcctgaattcaggaaacccggcagacctggatgagtcctacgtccgcctggtcatgggacccttggtggatgccaagtacctccctgtccaggttggggatgaaggtggtgctgggattatgtggggccgggggtgtttcctgcaactgctctccttcaagttgcctgccactcagtgctcatgatgtcaactcccaaccctccctcgcccctctctcaacagcactgggtcccggtggaacctgccttcctcgtcacactggcgcagaggccatgcctcgagcggctggatgttgatgtgcgacgtgtcatgctgatgcgcgacagccgcctgctgcctgccgacaccagcagcggccgggacctgcgcccccgccccacggtctccgtcgagatcaagcccaagtggggagcgctgccgcacgcccacaccgtgccccctcagcaccgagtcgccaagctgggcgcctcacgatatcagctgcaccagcatctcaaggcggccaccggcgccatagaagtgcccagcgagtatgaccccctggacctcttctccggcgaagccggccgcgtctggactgcactgcaggccctgggccgctcaccgcagaataactttctcacagccgtggacgggaagccaggaggcctgcactccgcatccctcgccctgctgggcccctgccgtgctgtgcacgacacgcctggggcggcgctgctgactgtggtccgggacgtgctcgtgcaagaaggtacggcagagcgatcggttggattgaggggtgaggaaaggcggtggaatgatctggggcatggagctgatgggtttcatcgccnnnnnnnnnngtggggaaaggcggtggaatgatgtggggcatggagctgatgggtttcatcgccaagacgctcccacactcgatgggcaccccaaactcaggcacgccactgccctttcagccaaccctcgttctcctgcttcaaacattctcagatgccctggcccaaatcctggatgtacagcggctctgctccacggacatccatgctgtgcatgcgcagtaccaggcgctgctcgacgcggcctcgcccgaggtgcgcgagcaggggaccctgccgccaactccagcacttgaggcggccctgagcctgctgcgcgactaccttacctcctgcacggcccgtgactgtgccctgctcctggcgctgcgtcgagaaagctctggcggggggcccatgcggccgcagacggcggaggccccgggccgggtcacgctccatggcggcggcgccgtgttctaccgtctgaccgtgatagacctggacaggaagccggtgtccaagctggcgcgccacctggcgctggacgccgagatcatgcgtgtggccggtggcatcgagcccgcagccgaccacgacctggagtgatctgggatgcaggtgtgcatgcttggctgggcttggtgtggggcgacggcccctattggtattggctccccaacccctgtaaaccataggccacatgacgagccaatgatcgcatgtcaagtcatcacaagcctggcaaagttcgattatggaatcttagagcagcaaaggtcacttgacactggcacatggttgcttggggtggggaggagcccaaccagcgtacccgagatgatcctcgacattccgcgggggggtcccctccacggacagcacaggtggtgagcacaccactgactgatcgcccgccaagtcagcgagggtgcacgatgtgcagcctggcacggggtgcaatggccctcagcgtggcggcggtgacggcctcctgactcacgcttgcctggcggtcctccacaaggaccacctcctcgatgcgcgaccagtccgcatggccccggaggcgcatgcacaccagtgcgcactggagcggcccaagggaggggttgtacgccacgctttccacgtagccgccgctgacggcggggcccgcgagctctgcccccaggcgcagcgccacgccagagcggcagagggagtagggcgcgtggcagcgggccgcagccgcgagagcagcctgtgtgagctcctggacaccgggatccagcgacgaatccacggccgcgagggcctcgtcgggggccggatctgagctggagcctggcccgccggccttcagattgccggagaggaggggcctcagccccgggccggagcccagcaggtcggagggccggaaccgatggggcaggagctggtccagggacaaagggggggtgcctccaaatgagatccgcagctcctcctggggcaggagggaggcgggaacctggttcggaagggcctcgctgccgtgcgggcggctgccgttggacagtaagcgcacatcccatcagcggctgatccctcctcaccgatcgccacgctcaccacctcgttcagctcgnnnnnnnnnnacctcgatgccgtgcgggcggctgccgttggacagagagcgcacatcccatcagcggcagatccttcctcaccaatcgccacgctcaccacctcgttcagctcggccatgaactggcggcagtgtccgcagggcgcggcagagacggcgatgtatcgcagggcggtctccccgtgctgtagcgcgttgaccaccaggaactgctccgcatgcaccgaggctgacaggggcacgcccggaaactccatgttcacgccggcataaacggctccggaggcccccactcccaccgccctatgtgtgtgttcttggtggaaggaggtcagcccggcttcctggcagcggagtaatgctggccacggagatgcatgataccggcaatcnnnnnnnnnnttcagcccggcttcctggcagcggagcgatggtggccacggagatgcatgataccggcaatcatgccaatgcatggtaccggcagtcatgccactcacccgactcggaaccccgagatgggggctatggcattggctgcagctgcacggatcagggcgtcccacatgccggcctgccgcccatcggcatgtgctcgtctcagcgcacggaacttgtccgctggaatgagcatgtcgagggacaggagctgggcacattcttcgagtggggagggttccggacaggcagcccctgggagaggttcacacccgttcggtgcctgcgcttgtgcagagagaaggcagatcaggccatcattactggtgcttagaggtctcggcatgcaagtacgatcttcttggtgctccattccacgccctggtcgtgagcccagctcaccggcgtgcagggagcgaccccagccgaacgccgggcacccatcgtccaggagcccccgtcctcctggacgactcgatcctgcacgctgtgatgccaattgcgacattacctcggcggcctgcgcccggcagggtccatggacattcaagggtttcttgcaagtaccgaatttgggcgcgctcttctcccatgatctcggccctccccacgtgccaactaaaagattgtcattacaagcaaggtgcccgatttgggttgtctctctagcatatcagggcaattggcaagggtcaagcaggtgctcttctgatggatggctctgactatgagtccagaccaagttgtttatgggacagagggagggcttggcatgctctcgtaggggagaaacgttgcttgaaatcaagggacgaccacccacaccttcacttcagcaggctgcgcagctgcagcaagagggcggggttggacttgatggcgtcgtccagacccctcaccagccccagggtgccctccggcgtctggcacagctcctccacgctccgcattgcgacgcccgtgcgcagcgcctgcgcaggaggtgaaggagtggcgaggtcaggatgcaggggagcgagcgcgtttgcccgcgcagcacactcgcatgtccatcgatcgggaccccccctcacatcgccccatccccacacccccgccatcccgtttccaccttgagctcnnnnnnnnnnatcagaatgcagggaatcgagcgcgtttgcccgcgcagcaaactcgcatgtccatcgatgaggggcccccctcacatcgtcccctcccccacccccccgccatcccgtttccaccttgagctccatggcgatgcgagaggcgccggcctccgcctccgcccaggcgaggaagcgcgcgtcgtcgcgccacagcgcctccgcgtcgtccacggcccgcgccagcacggtcccgcgggaggcagcctcgcccagcgcgtccgcggcaggcaggggggaggacaggaaccaggagcgcaggcgggcgagggcctcgccgggggacagctccgcgtccgcggccgccacctggcgcaccagcgactcctgcgccagcctgcggcgcaggcgcgcagcgaagaaggcgcgggaggaggcccagggcacgatgccgcggatgacgcccttggccagcatgcggacgggaccgtcgtgcatctggcgggatggagagggtcgaacatgggtgacaatgacgggagggcttgcggcgaggggcaggtggtgcggggcatcgatggccacgcaaaccttcactccacagagctgattgctgcgggtgtgaagagccccacatcgccaggcttcaacctgcacgaccatttgtgccatctgcgctgcaagggcaccgggtgccatggacgacccccccaaaccccagagtctcacacctgcgnnnnnnnnnntccgtcgtgcatctggcgggatggggagggtcgaacgtcggtgacaatgattggagggcttgcggcgaggggatgtgcacgcagggcaggcgaggggcaggtggtgcggagcatcgatggccacgcaaaccttcactccacagcgctgatcgcagcgggtgtgcagggcctcacatcgccaggcttcaacctgcacgaacatttgtgccatctgcgctgcaagggcaccagatgccatcgatggaccccccaaaccccagagtctcacacctgcgnnnnnnnnnncgcggcgctcccgctccaagcacccaaggggcccccttgctgcagaccggtgcaccgcctgacatccaaccatcctcccatccccccctttcctcaccttgatctccgccagcttggagtccaggcggtgcatggcggcaatcagctccgcgttcctgaacttgatctccaccacgccctggggctccagcaccgccccctgggccaggagatgtgtgagggggtgctgaatggtggtgcaaccatcacatgatctcaagacaggtcctgccggccccctcttcctcccaatcacacacaaaggcgaccactgaagcagccgtcccgtcccaacaggacaccattgcaaggaaaaacgggactccaaccttcctacctgtgctgtggggtcggcgtacatnnnnnnnnnnaggagatgtgcgagggggtgctgatgggtggtgcaaccatcacatgatctcaggacaggtcctgccggccccctcttcctcccgagcacacacaaaggcgaccagtgaagcagccgtcccgtcccaacagcacaccattgcaaggaggaacgagactgcaaccctcctacctgtgctgtggggtcggcgtacatctcgatggctgcggggttgatctgggagtccaccaccacccaggcccccccgcgcagctcgcaccccggccccaggtagacggtgacggggtggcggtaggtgcgcagcgcctccacgatctgcgacccggcctgcagcacgccctcgaacaggtcgcgctggccgccggagaagccgcgccagttggccaggatgaagaggggcaggccctccaggccaaactcctcgatggcctgcgcggtcttcagggcggagtccgggtaccacacctggcccgcctgcgggatcatgcgctccgcggagtcgggcatgcccgggtcggcgggcacgtgcagcgtgaccgtgcccacctccaccgccaccacgcccacgggcaggccgcccaggcgcgcgcggccggtgaccacggtgcgcgcccagccggcctgcgcctcggtccagctgccgcggtcgaacagcccgccgcgccaggcgggcgaggggtctcggtcccgcacgccgccggcg

SEQ ID NO: 48647 - DNA, 61 bp, Chlorella protothecoides
cgctaaaagccttcctaatccaatgcattcacccagccaatctcatactctttgaacctgg

SEQ ID NO: 48648 - DNA, 154 bp, Chlorella protothecoides
cctccttgcagcctggattgcgatgctgaaaattcaccagctgctatgcgaggaactgggtcttctccttggtgttgtgatctttcggatggccatggaacccagcttccctcaatcctgtcgaatgatgcagcctgctgaagaggagggttcc

SEQ ID NO: 48649 - DNA, 61 bp, Chlorella protothecoides
cctatgcagcttctgcccggggatggagcgggggacgccctcgggcagcaccacacgcgcc

SEQ ID NO: 48650 - DNA, 61 bp, Chlorella protothecoides
gtcgaccgcgcagcgcgccgtgagggaggcggagcaggaagctcagagggcggagtccgcc

SEQ ID NO: 48651 - DNA, 65 bp, Chlorella protothecoides
ttccaccgcaaatctcggcatctggacccctcactccctcaccctgggcccctccttcgacgcag

SEQ ID NO: 48652 - DNA, 61 bp, Chlorella protothecoides
tgcatgcgaagcatggccaccgcgactcccaccttggagagcgagcagcgggatgtggcct

SEQ ID NO: 48653 - DNA, 61 bp, Chlorella protothecoides
cgccgccgaccgcgacgtgggcccctggctggcggcggctctcaaggagcggcacccgggc

SEQ ID NO: 48654 - DNA, 61 bp, Chlorella protothecoides
tgtcccgccgctgacccaagaggctgtctgcgtgtccgccaacacggcctcctgcatggcc

SEQ ID NO: 48655 - DNA, 76 bp, Chlorella protothecoides
ggagcgatccaccaggatcctggtagccgtagagtgtctcacggctggacagaaggcttgcaccgctgacaaggat

SEQ ID NO: 48656 - DNA, 61 bp, Chlorella protothecoides
ccacccactcctcgctaaaggcttggaagggggctagattaatgtacagcccgccttggga

SEQ ID NO: 48657 - DNA, 61 bp, Chlorella protothecoides
gcatgaccatgggcatgcttgtgcccatgggtgtgcgcatggtcgtgcccatggttgtgcc

SEQ ID NO: 48658 - DNA, 77 bp, Chlorella protothecoides
ggatgtcagcatgcccgataataaatcgtcaaaatgcagggtttgcgcgtgatcaaggtcttggaatatacatcacc

SEQ ID NO: 48659 - DNA, 71 bp, Chlorella protothecoides
tgggtcatgcccacggcctgcgccttacaggggtgccaacgggggtgctcaagggccacgccatggccagg

SEQ ID NO: 48660 - DNA, 61 bp, Chlorella protothecoides
agcggttgagctcgcgcttgaggctggaggtggtgtcgcggtgaccctgcaggaagtactg

SEQ ID NO: 48661 - DNA, 62 bp, Chlorella protothecoides
gcatctataacgtggcgctcgacacggagtaccggggcacgatcgctgcggttgcccgtcgc

SEQ ID NO: 48662 - DNA, 124 bp, Chlorella protothecoides
cacgcgcagtgccccactctcctcgatggctgccagaacgacgacgacgtgccggatggagggcctgtctgctgggtcaccctccaggcacttctcaatcagcttcttcagctgtgtggggagc

SEQ ID NO: 48663 - DNA, 200 bp, Chlorella protothecoides
gctggccctgcacggcagccctgcaattctcgaccacccccgccccgccccattttggcgcgagcatttccccctgtctgtaattgacgatatctatcgctgtgccagggcaagggagtcgtggcagaagggttctgggcgtcgttgttttggcagaatgcgggtgccctaagcccctgtctgttccaccagtctcgttg

SEQ ID NO: 48664 - DNA, 78 bp, Chlorella protothecoides
ccccttggatgtgtcgccgctgcaccactccggccaaactggggcgtcgccgtcacacacgatgcattgtgttccaaa

SEQ ID NO: 48665 - DNA, 70 bp, Chlorella protothecoides
cgtggcgccggggtcgctggacgccgtgcctgagggccgcgcgatgcaggactcggagctgtctttgaac

SEQ ID NO: 48666 - DNA, 61 bp, Chlorella protothecoides
caacagaatgtatgcatacgctgttgcaagcaagccactggcttccttccctacatatcct

SEQ ID NO: 48667 - DNA, 61 bp, Chlorella protothecoides
agtccgccgcggcaactggcggctcaggggtggcctccttgctgctggaccccgcactcgg

SEQ ID NO: 48668 - DNA, 65 bp, Chlorella protothecoides
gctgccttggtcttggccacgacagctggcgctgccgaattcaggtctttggcgttctccttatc

SEQ ID NO: 48669 - DNA, 29531 bp, Chlorella protothecoides
  modified_base (307)..(316): a, c, t, g, unknown or other
  modified_base (787)..(796): a, c, t, g, unknown or other
  modified_base (1884)..(1893): a, c, t, g, unknown or other
  modified_base (2145)..(2154): a, c, t, g, unknown or other
  modified_base (2369)..(2378): a, c, t, g, unknown or other
  modified_base (2480)..(2489): a, c, t, g, unknown or other
  modified_base (2738)..(2747): a, c, t, g, unknown or other
  modified_base (3642)..(3651): a, c, t, g, unknown or other
  modified_base (5583)..(5592): a, c, t, g, unknown or other
  modified_base (6782)..(6791): a, c, t, g, unknown or other
  modified_base (7017)..(7026): a, c, t, g, unknown or other
  modified_base (7417)..(7426): a, c, t, g, unknown or other
  modified_base (10132)..(10141): a, c, t, g, unknown or other
  modified_base (10603)..(10612): a, c, t, g, unknown or other
  modified_base (11522)..(11531): a, c, t, g, unknown or other
  modified_base (11749)..(11964): a, c, t, g, unknown or other
  modified_base (12022)..(12031): a, c, t, g, unknown or other
  modified_base (12744)..(12753): a, c, t, g, unknown or other
  modified_base (12953)..(12962): a, c, t, g, unknown or other
  modified_base (14747)..(14756): a, c, t, g, unknown or other
  modified_base (15059)..(15068): a, c, t, g, unknown or other
  modified_base (15663)..(15672): a, c, t, g, unknown or other
  modified_base (16812)..(16821): a, c, t, g, unknown or other
  modified_base (17408)..(17417): a, c, t, g, unknown or other
  modified_base (18298)..(18307): a, c, t, g, unknown or other
  modified_base (18474)..(18624): a, c, t, g, unknown or other
  modified_base (18681)..(18690): a, c, t, g, unknown or other
  modified_base (19145)..(19154): a, c, t, g, unknown or other
  modified_base (20663)..(20672): a, c, t, g, unknown or other
  modified_base (20821)..(21031): a, c, t, g, unknown or other
  modified_base (21122)..(21131): a, c, t, g, unknown or other
  modified_base (21390)..(21399): a, c, t, g, unknown or other
  modified_base (21470)..(21479): a, c, t, g, unknown or other
  modified_base (21694)..(21760): a, c, t, g, unknown or other
  modified_base (22134)..(22143): a, c, t, g, unknown or other
  modified_base (22348)..(22357): a, c, t, g, unknown or other
  modified_base (22710)..(22719): a, c, t, g, unknown or other
  modified_base (22935)..(22944): a, c, t, g, unknown or other
  modified_base (23865)..(23874): a, c, t, g, unknown or other
  modified_base (24991)..(25000): a, c, t, g, unknown or other
  modified_base (25637)..(25646): a, c, t, g, unknown or other
  modified_base (26003)..(26012): a, c, t, g, unknown or other
  modified_base (27607)..(27616): a, c, t, g, unknown or other
  modified_base (27940)..(27949): a, c, t, g, unknown or other
  modified_base (28014)..(28141): a, c, t, g, unknown or other
  modified_base (28302)..(28311): a, c, t, g, unknown or other
  modified_base (28742)..(28751): a, c, t, g, unknown or other
tggccgcggcggcgcgccccgcccagggaccgcgcgctcggcgagcgggcgtcgggccccgccccagcggcgcgggggagggcgttgagcacgctggagggcgtgccggtggtggccgccagcagggagatctgggggcgggggcgggggcccgtggatgcgccggcgcagcgccgcgcgctgccggtgccccccgaccggggtcccatgccccgcagccccgtgccgaacaagagcatggcgggcgtggcgatgcagctcgggggggccacgcggcacccttgcagaggggtgtctgtcagctcgnnnnnnnnnnaatgcagctggggggggccacacgacacccttgcagaggggtgtctgtcagctcggcgtccatcccggctgcgtgcggggagggtttgtgatcaggatggggtttgtgatcaggatggggtttgtgaacaggatggggtttgcgaacaggatggggtttgtgaacaggatggggatgatgcatggaggggatgctggcgccactctgcctggaccgagggcgagtgacgaccctcggtccttctattggcccaagacctcagcctggcagcaggagccgctccccgatgcaaggcgcacagtctggccacatgccggtgggcgaccccttgcatcgccagaggcggcgccaaacccacttccacacccgtcgattgatccagagtgtcagggccctccccttccccagctccaaagtcctccccagacacatgatggacacagggaccctccccaccctccaacctccaannnnnnnnnngggctgcgtgcggggagggtttgtgaacaggatggggtctgtgaacaggatggggtttgtgaacaggatggggatgatgcatggagggccctccccttccccagctccaaggtcctccccagacacatgatggactcagggaccctccccaccctccaacctccaagtgcccaccctgcatggcggggctgtcgatgcccagctccaccaggctggtccaggtgtcggggtccagggtcaggtgtgcgggcgggcgcggggcgcggcccgccaccgctgcgcaggccgagagcagggcggaggggccctgagccagggccggggccgggcagtcgggctgctgggtgggaggtcccgagcagccgccgccccccaccggcagcagcaccacgcccagcgccagggggagggcctggcagcccggggggcctgtcacagtcggagcgagggacgcggcggcgccgggggcggcggccgccgccttgggcccgccgtatgccgcatgcgcgaccggcggcagcggcccctcgatcaacatccccgtcgctccgcgcgtcgcatccccggacagctgcgtggcatcctggttcggcccggcgtcgacgctctcgcgccggcgtcgccgggaccgggatccagcaccgctcgcctgcggggctctcgtggcctcgtcgctcgccgccgcttccaccttgccgcgggccttgtgacgtgcagatggcttggccacgggtctggggccggtgccgcccacggaggctctcctgggcagcgtcctgaagctgaagctgggcttcctctcctccacactcggagcaggggcgcactggccggcagccgcgctgtctggctctgcgcatcggtgtggtgaccggctggggagaaggctccttggtggggcaccctccatccctgcacacaccgccggaccccaggagtaacggcccggaggaagccagatggtgtgctcgtctccatttctacccaacgacacagtgcaaaacgccctctctcaccatcaaggtctggcacaaagtcgctgggcagccgcaagtcgccggtgggcgcggccacccaggcatccaccnnnnnnnnnngtccaggtctggcacaaagtcgctgggcagccggaagtcaccggtgggcgcggccacccaggcatccacctggggctggctgggcggggaaaagaaagtctggtccaccaccaggctgctgcgccggccactgcgccttggacccagcaggatgatgggcgggtccaggttgggatcgggcagggcaggcagggctggggcctgggcaggctgcggctcgctcccgcccgccgtcgcattcggcggctggtnnnnnnnnnntagcaggatgatgggcgggtccagattggggtcgggcagggcaggcagggcgggggcctgcgcaggctgcggctcgatcccgcccgccgtcgcattcggcggctggtcgctcgagggagagcagccatcctcatctgtggggaagggtccaggatggagtacctcagcgcgggacttcggcctgagagacacccgggtgcgtctctctgtgcatnnnnnnnnnnggggtcgtgttggcagcggaattggagtttctcaaacacaacagtcggtcgaataagaccatggtgtaccggtttggaacgtgcaacagccaccaaatcgannnnnnnnnncgggagagcagccatcctcatctgtggggtggggcccgggatggagcacctcagcgcgggacttcggccgcagagacacccgggtgcgtctctctgtgcatgaaggtcctctcggggcaggtcaccccgcttgctcccatcgtgcagatccccgacccagcactggccatccatgccatcgatgagcgcgtctcctgcacgcacggagcctggctgtttcgacaaagcttaccttgactgtcgcctggnnnnnnnnnnatctcctgcttgtacaaagcctggctgtctcgacaaagcttaccttgactgtcgcctggtcggtccacccagggcctgaggcctaagaattccccttgctccacctgaggcgatggggagaggaggaatggtggcacagagggatgtgttggcagcggaactggagtctctcaaacacaacagtcagtcgaataacaccatggtgtaccagtttggaacgtgcaacagccaccaaatcgacaaatccatgcaagctagccgctcaccttgcgccgcagtgtggagttccaatgattcttcaaggcattgtcggtcctccctggaacgaactgggctagcttagcccactgcaagtccagaaatggtgtaaagtggttgctagtggatgatcggctaattaagtccgaggacaggcatggggcctcttgacaggcaaacccagaggtatgtctgccgctgcgcacaccaaactcagcagaaagcatagccccgtttggagctctaagctgcgctgccatgcctctgaataagacaacaacacctgtcatgcacgcagcccaattcccgaatactcctggaccagcaagatgaccacagggttcgcacctggttcccatggcaggcatggaagcggacgacaacctcatcctcttcctgagtccagtttccgtgcttgatggctgggttcaggtggttgtgccagcgctcccggcactgcttccccagccgaccctgaaggtggcctgccaccaaggtccattgcttggcaccgtaatggtcgaccaacctcagaatgagttggtcttcctgtgattggagattgagggggggcaagcgacaatgggtgagaaggaagatacaatcgagggaagcatgtctctcgcaatccagcagnnnnnnnnnngttggggattgagggggggcaagcgccaatgggtgagaaggaagaaaccatcagagggaagcatgtctctcgcaatccagcagacactcacaaagagtcgccgtctgaggacgagatcgtgcaggaggatgctggcacactccactgtatgaacatctcctgtcctgggtgtgaggacagcatgggcatcaggtcaccctcccaccaccggcccacatgctaaatgcctgcccgtacctgtttcgtccagggtcccttgcagacctcagggttcagcactttttgccagcgatggaaacactgggcttccgttcgattgggcagtagcatagctgaaagcatgagcatatgcgaggggagtggggaataattagccggagagagttgcacaaggagggtggattcgacgagtgagccaaccatgaaagcagagggaagcggcgctgggggcacatttacgctgcgcaacctgcttggcattcacagtgcaagtggctgctaatcggatcgccaccctgcacctcacctatatgcccccagctgccaggtccattggttgccacatgctccgtcagcatggcgtcctgctcatacaaagtgcagacttgtctcagtcctgggcgtcggggggtcacagaccaggtgaacggccacagcacactcccctgatcaccattcccaagggagcccctcacctcctccttggtccaagccccccgcgaactccttcggatgggctcctccatggacctgtggagcaatgatcaattgagtttcaccgatcaatttcctgcctgggactcctccagtgaatgcttgccattgcctccgcacctggctgccgaccggtcgacgcctccagccggttccgatcgtcttcgcttccctcgccctaatctccctgcgccaccctttgtggggctgtcttggggcatgatggaggtttctctatgtcgaccacgctcgcaagtctgtttcgcgatggctggcatggatgttaagtctgtcgctgcaaattttgagccccgggcgccaggctggcacgcggcgcgcatgctgtgctgtgcgggtctatggggcgtcatgtggcaggcgaaggcgctcatgagcacatttgcatcttgagcgagcatcaatcagctcttctagcgcccgacggtaatacgtgattgagctgcagggtgtgtgtccatcgaggagcatccaaaggcttgcctgcttgaatttactatgcaacccctccagatcacaacctgtcaatgagcctgccgcgctctttctgacgccgcaaaattgcatagcatgtacattccaggcagcctcttccagcgtacagatttttcagggtacacatgctccatcccgctcacatcaaggtacagagagttcgttccgccatcgaatcggagcgcaggcatcggcgggggatcccgccggcacctgccgacgcaggccggtgtgcgccagccccgccgaccgccagaccagccgccccacgcacagacccccccattcacgtgttgctggccgccagcgtgatggccacgtgggagcggtcgttgccacgcaggacctccacgtccagcgcatcccctacgctgcgcttgtccagcgcgcggaagaggtcggacccggtcttgaccctggcgccgtctatggagatgatgatgtcccccagcaccagcctgaggatgtgcatggggggttggtcatgtccgggacggtgggcggggggagcatgcatgtgcgtgggtggcaagggtatacgctgacgccatgggaatccaggggtcaggcttcgagaagcgtggactcatgctatgtggctgagcatttacatgcgggcgggtcaggaggcacccagacgagcctctgtggcatccaccttggcactcggcccttcaccagcctacactgcctctgcctcatcgnnnnnnnnnngggaggcacccagacgagccccttgaggcatccaccttggcactcggcccgtcaccagcctacactgcctctgcctcatcgaccacggtctggaagcatgccgtgcggccacgtcatacgtccccctcccaacccccccaccaccaactcccgctctcgcctggcccatgcccatacccacccacctgccatactcgtcacgcgaggtgcccttgatccccgcctcgtccgcggggctgcccttgcgcgcgtccagcaccagcacgccgcgcacgcccagctgctccgccgactgctcgggggcaaaggcgatgcccagcatggggcgcgtcacccgcccgaagcgcacgatctggtccacgctgctgcgcacgatgtccacggggactgcggcgcggggatgggtgtggggattgggaggggggttgggaggtcggtactgctacttgggagcgggcattccgggaagagacgggcaacatgcccttgcgactctggcctcatgctcagtggctgctacctccctggcgtgccgcaccctcacgcccagagcgtgggcccgaccaagccgcctgtcaaccgcgcgccctcctccacaaaaccaaataacccacacgggccgcatcactcactcgcaaaccccacgccgctgttggcgccagacggggagtagatcgcggtgttcacgcctggcatcggaggaggggtgctgggatggggttgttggtgctcctccagtcgctcccagggacccacccctgttgccatgccacacgaggccacgctccctccacccacatctcccatgtcccttcacacacaccaacacatcccctccgaggctcgagcaccccctaccccctccccaccgatgagctcgccgcccgagtccaggagcgggcccccgctgttgcccgggttgatggcggcatcggtctggatgacgtcctggatggggcgccccgtggcgccagggatctctcgccccgtcccgctgatcacgcccgtggtcagcgtgtgatccaggccaaaggggttgccgatggcaaacacgcgctggcccaccttgaggttggcggagctgccgatcttcaggggggtcaccgacttctgtgttgtgttgattggggggtggaagaaggcgggatctgacgggtggatccagaaggtcgaggtgcacatcagggggnnnnnnnnnncgatcagggggtggggagaaggcgtgatctgacgggtgcatccagaaggtcgaggtgcacatcagggggcacatgcccaggcacaggtctgggacagagttggctggacagaggcagccgctgctcagtccatgctcccgcgcctggcccgccacaaccgccacacctccctctacccctactacatacacaaaagcacatgcccacgcccctctgccctcgcggnnnnnnnnnnaggaccgccacatcgcggtcttggtccacgcccacgacggtggcggggtagtcctcgccccccgtcatggtcaccagcacctccgacgcgccgcggatgacatggtagttggtcacgatgtggccctgcgcgtcccagaccatgcccgaccccgcgccctggggcacctccagcatgttgagcgtgaaggtgtcccgcctgcggtggagggatggtggtgatggtcagctgagagtgtggaggcatgcaaccgctgcactgtggcacaatgcaccacttgcatccagtatgatgctcaggcaggccagcccctggaagcgtcgtggagcagatgaggaggcccaggttaacaacgcccatagcccacatgcctgctggccaggttggtgannnnnnnnnntctggaagcgtcgtggagcagatgaggaggcaaaggttaacaacgcccacagcccacatgcctgctggccaggttggtgatgtacaccacacccggcttggaggcctggaacaggttgacggtggaggtctcgtcggaggtgaggaaggtggtggcctggctggccggtggagcaagggctggggagcccaacagggccagggaggccagccccgcgatgccatgctggagcagatgggacagcgcggagccttggccatcagatgaagcgcgggacaccgcctgcagcctgtctgccctgccacgcgcagggcgaccgcatggggagctgtgcggccccctcggccgtgggcgaccgtggctgaggggcacagcctggtgtgcgagagaagtaggcaccatgcctggccagaatgaagacaaatggatcggatgaggtgctgtagactatgctcctattgcccgcgcggcttgcatgtcgatgtgggcgctcctggctaggtcgggccggtacaactcaggacagatgttttccagctgaacagggggaagccacacaactcaggctggatgccctttgcatgtcattaccgagtgatggaaggctttcgattcgtctcgcgatcactgcgatgacggagcccactcaaaaccctccccggaatgtctggttcgggaacccagcacgcgtttcttggcagtgcattcgcagctcctaacttcgggccaactcccgatatactcccgtccaggctgcccaatctgacaccagatcccagcatcttatatcgatcacagtcgaatccatctcgaaatcgcgcatccgagcctgtgttgcgaacccgagactttatcacaatggcaacccaaaccgctcaacccaccgagacgatcgtgagtaggatccagaatgggccagtgctggcacgcgcacattggtattatatgaatatgtgcccgtgatcatacagtagcaccccgcctcacccttttgccatgcagccatgggagctgttcgagaagaagatggagcagaagggatccagccaggccgcgatcggagccttcaggcacaactacgagcagctcgtggcgggtgtcaccggcctggtgaggacatgcctggtgttagttgaggacgatggctttcttccagcatggctgtgatgcttgagtggtgtgatagcccagcgatgcaaaggggtggaaactatgcttactgtatgtcgatgtaagtaaatcctgacaaccctctatttacacccttgccatgctgacagcacacgttcgtccccctcccttgccataaaactgacagctgccagagtctgacatcgagtctgtgacggagctgccatacctggagtccctgaagagctccagcagcccggacaacctgcaggagctcctgtcccagaccgtggtgctgaagctgaatggcgggctgggcacctccatgggcctggagaaggccaagagcctgctggtggtcaaggacggcaagaccttcctggacctgatcgcggagcagatcaagtacacccgcaagcagtacaagtccaatgtgcgctttgtgctcatgaactccttctcgacctccgatgacaccaaggcatacctcaagcaggcccacaagggtgcgggcgctgggagttgggggctgggctggggctggggtgtgcgcctcctgggccaggaagtctggtcccaaatggacaaggtagagatctcagtgtgcttggcgttctctggcgcagatctgatcgaggaggaggacgtggagctgctgcagaacgcctccaccaaggtcgacgcggcgacgctgaagcccgcagagtatccggagaaccctgacatggagtggtgcgctggatgtggtggggatggcaagcgctggagcgccctaggtggcgggcgctgcctttggggtgatgctgggggtcttgagagctgttcgtgctgcaatgtcaccaggcttggcagcggcatagggccgcgagggtgctatgccatgctccccttactgcatcatcacctgatgtagcaccccaggatggcatccaacctgccatgtacagtgagacagcgcaacttattcccccaagtgcaggtgtccccccgggcatggcgacatctacccctccctgctgggctctggaatgctggacaggctgctcaagaagggactgaaattcctgtttgtcaggtgcactaggagattggactttggtagcacttgatctggcgactagttacaggacgaatgccaagggcatgcgtgcagagcagtgcgcggggtctccaacctacatcgtctgcatcccttgtagctccagccatgtgccacctctgatggatacacatgtaaaccaactgtccccctctacctcctccctcctggtcccagtaactcagacaacttgggcgccaccctggacctggacctgctggcatactttgcctcctccgacaagtcctttgtcatggaggtggcggagcgcaccgcctcagacaagaagggggggcacctggccaagcgcaagtcggatgggcgtctggtgctgcgcgagagtgcgcagtgccccgacggcgacaaggcggcctttgaggacatctccaagtgagagcaagggagggagtgtgcgaagggggatgatggtaaggtgatcggggcggcatgtttggctacccatacggcgatgatcnnnnnnnnnngagggagggagtgtgcaaaggggggtgatggtaaggtgatcggggcagcatgtttggctacccatacggcgatgatcttcccagggagctggaagggccgtcacctgccatgcttgatcagtcggtgtgtatgcctggagcttctggcgggatatcctccgcaccgagtagatggcagaggagtgtggattgcctgcccaaggtactcaacctcgccggtgtagccggttcaaagtcgccaatattggaaccttccaccctcccaggcacaagttcttcaacaccaacaacctgtgggtcaaccttcccaagctgaaggccgccctggatgcagctggtgaggcacggcggagggcagtgtccggcctggcccccccttgggacgagacagggagatgcaaaggggggctctgcagaagtaggagggggcgacgcactgggcaacattgctggaatggcaannnnnnnnnntggcggagggcagtgtccggcctggccaccccttggaacgaaacagggagatgcaaagggaggctctgcagaagtaggagggggcaacgcactgggcaacattgctggaatggcaatacagctggggtcttacgaggccgttgggcgctgaccccgtcagtgccagggccctctccatgtttaccctcggcagcccccaatcccctgatcccggccctgccatgtctcacacacactcgtttccaacctcccagatgcccttcccatccccaatgcatacacactccctgcccacccaacccccaggcggcgtgctgcccctgcccctgatcaagaacaagaagacggtgaacccccgtgactccggctccacccccgtcttccagctagagacggccatgggtgcggccatcgagtgcttcgacgactccggcgcggtggtggtgccgcgctcgcgcttcgccccggtcaaaacctgcgcggacctgctggtcctgcgctccgatgcctacaagatcacgcaggccagcaccgtggagctcagtgacgtggcggcgcccgccgtgaagctggacgacgctcactacaagtcggtggagggggtgggtgggtgggggaggggttgagggaagttggtggggcgtctcattgtgtagcgtgcagggcagggagcagcgggtgcagcagccgcggtgcgtgtgggtggtgctgagcatggtccagcttctgctctgtgactgccacgccaggggtgccagggacacctcatgacacggctgatgacgaggacgagacgacgcccggctggcaggattctggatatgatgtcgccttcattgctcgactcctcccccaccccccccccaattgacgccaggttggtggacaagatggatgcgctggtcaagannnnnnnnnncccccccatccgacgccaggctggtggacaagatggatgcgctggtcaagacggtgccctccctctggcaggccacctccctgacggtcaaggggccggtccgtttcgaggccggcgtcgtgatcaagggcgacgtcaccctgatcaacagtgagtgctcgccagcctgggataccacgacgcccaggcggtactttccgagtaatggttgctcgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcaccccctgcacccgtccctcttacgcttttgagcacttttgtctcgctaagatgnnnnnnnnnnaccatcctgggataccacaacgcccaagcggtactttccgagtaatggttgctcgcatgctggcgatccggcgtgtctccacccagccactgaatgcccccttccaccccacccacacaggcaccgacgagccgctgccagtgcgcagccgcatcctggtcagcaccaccatcgacctggcggaagagagcaagtcaaaggcctgatgggtggggtccgcgcctcctcttgttcgccacacctccctctccgcccctgccttgccaagtgtacccccgcacccgtccctcttatgcttttgagcacttttgtctcgctaagatgctggacactgagggccctctttggacaatcaatggtttcacatggggcaatggaactcatgcgggggcatcgatgccgctggccagggccgctgcagctgagggaggaaggagggagcgctgttgttgcaaggcccgtttccgctggagcgcggtgcgaatctcctgctgcaggcgagcaccaaggtcagagtcgagcttctcctcggcgtgattcaggaggtagccatcaaggcctccatacttgtcgatcgtgctgcgttggttgcaggtataggagatggatgagaggtctcaccacaagccgccggggctggccagtcccaccctgctccttggagctattccatgcccatcaacatcaacaacgcaccgaagggcactcgcagnnnnnnnnnngcaccctgctccttgaagctaatccatgcccatccccatcaacaacgcaccgaagggcactcgcagtcactcggacgcgcacggatctctccaacgcggggctatacagatttacatactgggagtttggtcgccagaagcgacgggtcctgtgagttagggaaagtagtaatgacgacaggacctggcggtattggtgnnnnnnnnnntccagaagcgacgggtcctgcgagttgaggaaagtcataatgacgacaggacctggtggtattggtgctggacagtgtgcgctgagggtcgacagaacagtcccttccctgcagctccatgcgctcacttgttcttgccgtcttcactaatgttgtttccagagcggatttgctttccagcgtacaggccgcgacgagcacggttgaagacgccccgcaaggccacctccacgccgagcggcatcgccgagactgcctgtcgaggccagcagcaagtgcctgcacgctcagttatcagattatttgcaatgtaagattcggcttctgcactctcctacctcgtggaagtgattgactcacgtcgcccagggcgcgaagagggcagcacacagcatgtccgctcctgcttgcgagcgcggtggtcctcgaagcgacagccagcgatccaattgagcaaagcggagcatgcgatcgcccaggaagctgccgatcagaataatctgactcgactcgataaagcggtgagcccgattcgcagcacgacccctggtgacaatggggctgccaacgcaaatcatcgcccagctcgtcatcacctccgtggttctaggagcgctcaagcactccggtatcatcaggtgaaactcgtgcagggctccatgctagcctgcctctcgagccactccggcatcaccccgccaccccctccatcttccagggtggagcctgagcgcattggtgatcccacggtccggtccatcttcaagcaagcggtgagtggacggcgcagtgggcctgtccacgctgttcaatataggctacctccaagatttttctcccccaaggatcacagctccacgccggtcctgcaggtatctctgggcgaaactgtggccgtgaagagccatgagatgtatcatgaaatcacaaaatcttgatcggagcacacccacaaggggctggaagcctcaacgaatcgctgcaattggaattactcggtactcaaaagtagcagctggcgctgatgtgttccctgatcttggccatgacaatgtgacagctcccggtgctggtgttccaccatcctatggacacccggcctataattccccaccatcacccctccccctgctcatgtaaagcggccgtttacagaggggaagccttttcagtgcagatcccacaatcgattttagctgcggtgtggttgctatgcaggtcgggatggcctctggctgctccatccacaccttgtgagcgatgccagccgactccagggatgttgcagtttttaggagctgtgcttcgtttggcacctggagcaccacctggtaacaggacacaggggaaacgggccaagggtgggcagatgactccaggtcgaagggctcgacatgccagaaagtgaaattgtgggtgcagctctcaagtgcaaggggacggccagtgcatttaaatccgtgcatattggcatgcagatcacttggaatcctccatacactaccggcccggccccaatggccctcagtgcacaccttgcgcatggagtcgatgtttgcggaactgcagtactcctctgtggactttgctcccttgctctcccacactgctgccacagcagcatggcacccctgcgccatcacactgcccaggctccaggcctgctccttccatagatcctctcggatgatgatgtactgaatgaggggatcctcactgcctgccatgctggcggaggtgcctgccacagccctagtccgtgctccacgagcactggtgagggtnnnnnnnnnntatgtactgaatgagggggtcctcactgcctgccatgctggcagaggtgcctgccacagccccagtccgtgctccacgagcactggtgagggtccagggcccactgaaagatgtcacggatgggtcgaataggcctgagcgcgatgctgtcgaatgatgctgtatcaatccagcaagtcgagcgcgtggacgggggaatggaaccgtgaccgctcccggggttgctcggcaaaaacacccaaagagccgcccagacatgaaagttatcaaaacgctcgtaccgattacagtgagatgtgaggnnnnnnnnnngccactgaaagatgttatggatggatcaaataggcctgagcgcgatgcggtcgaatgatgctgtatcgatctggtaagtcgagcgcgtggacgagggaatggaaccgtgaccgctcccgacgttgctcggcaaaaacacccgaagagccgcccagacatgaaagttatcaatgcgctcgtaccgattacagtgagatgtgaggagatgtcccctacgaactccccgtacccgtggatacggccgcagcagggatgtggtgggtgggtacgctcgaggaggacggttcctgcgggatgtcaccccgatcctgcaacgaacacagactctagaccagtacactttcacaggaaaatacgatgtcgacacaaaagaccgaaacgaattcacgtatgcatatgaaacatcagtgcggggagggacaaggagtcaagcagagcactctgcagtgctttccaagccgtgcgcgagcacgtcaagctgcaggggaaggcggcaaggggatcgttgtgttctctacaggaaaagaaggtgcaatgcgggaacaaagatggtgtgcgcaggcatcgcctcaagcctctgctgcgcggcacgccnnnnnnnnnnacaagcagagcactctgcagtgcttttccaaaccgtgcgcgagcacgtcaagctgcagggcaaggcgacaagggggtcattgtgttctctacaggaaaagaagaggcagtgcgggaacgaagatggtgtgcgctggcgtcgcctcaagcctctgctgcgcggcacgccctcagcctggccctgtctggttccaggcggacgtcgtcatacacgtgtccatctgcgggtagtggtgcgatggtttggaatgggggggagttggggtggtgtagcagaagagggtgagcaagagttgagtctgagcatggacctcgtgcaggaggacccaggtcatggccatctcaggcctgcggcatggctgtggccaggacggcacagaccaccggctccaaggctgtgatcaagacccccccccaaaaaaagaaacaatttccctaccacttctcccgctccgctcccccagaaaacaaaaacacccaccttccgagccgacaaactgcagcgtcatgccgccgcgcggctcgacatccacacgcaggtacccgaatcgctcttcggtgctggacacccagtcgtactgggagcgcccgatgtgcgacagcttgtggcccgcagtgcccacctgcagggagcagcagggcacgtgtgatgtggtgttcccgaggtgcatgggcagcctgaacaaggctcctagctgcaggccctgcaccgggccccgcatggaacagcaggctggacgtgcacaagcacaccccttgcgctcaggtccatcgccccctggcacagccctgactcacgatgaagtgcatcatgccgccctcctcgcgtcggatgcaggtctcatccagcacattgcaggagctggagtaggagtggacgtgccccgacaccaccacatccacctcgtagcggttgaacagctcctccaaatggtccctgggcgtggggcgcgggggcgcgggtgagcacgcgcatggcgaggcggtcacgtggggggcccagagggcacgcgctgggtacgcagtggtgtggccgtcgccttccagggcttcaccaccgactccccgccgccggctcccagggcccccctcctcctcaccaccagacctagggcctcacctgaggtgctggcccacgatnnnnnnnnnnccgtggggcgcggggccgcaggtgagcacacgcatggtgatgcggtcacatggggggcccagagggcacgcgctgggtacgcggtggcgcggccgttgccttccagggtttcaccactgactccccaccgccgacacccaggccccctttccccctcaaaaccagacccagggcctcacctgaggtgctggcccacgatgcggttggacttgtgggggaagacgacgtacatgggccggtgcatgcccaccaccacccagggcgtggtgcagcggtccacgcgtgccaggtcccgcttgatccactgcgtggtgtttgggaggggggaagggttgggtgtcaagaagagacgggccacccctggaaggaccagcggtgggagcgtcgctcccacccctggtccagtcacacgggccatgagtgggaggtaacgccagctccctggccgggccacaggcctcctggctggtcctgccactgggtcccggggctggccagcaggttcccctcccgcgccttccctccacccacccaagactcgcaacccctcacacgatccccaccaccccacccaccttgtactgctnnnnnnnnnnaagagggggagggtcggggtttcatgaagagacagggcatcctggaagcaccaggggtgggagcgtcgctcccagccaggtcaagtcaaacgggccatgattgggaggtaaagccaattccttggccgggtcacatgcctcctggctggtcctgccagtggatcccagggccggccagcaagttcccctcccacgccttccctcgacctccccgagactcgcaacccctcgtacactccccaccaccccacccaccttgtactgctgggagtggggtgagaggtcgtgctccgtggagatggtcaggaagtgcactgggccctggccaaaggagtaccagaagggagggttgggcgccaggccgccgtggttggccgcgccgcacgccgcgtccgcgccggcccccgccgctggcgccgcatcgggcgagggcaccgcccccggcatacggtccagggtggggttgcggcacccgtcgggccccaggctcgcgttgcccgcgttggcgccgggggcccagtacccacgctcggcaaaggagggcatcatgaagtgcttggccgcggccacgccgcactcgccgccggagtcgttgccaaagttgccccagtcgggggcgtacggcaggtccgcgcccgatgcgtcgggctcgtgcgagttcttgtgctcccagtcgtactcgtggttgccgatgcccaccatgtagggcacgcgggaggccacgggctcgatgctgtccatgaacgtgtcccagatctggggcgggggtcagggtgagggcagggtggagggtggggcgtggttcatggcatgatggtgccggattctgggggcttcccttgcaggtacgagctccagaggtacaacaaggccacaacaannnnnnnnnnatctgcgccggcccctgccgccggcgccgcatccggcgagggcaccgcaccccgcacgcggtccagggtggggttgcggcacccgtctgggcccaggctcgcgttgcccgcgtttgcgccgggggcccagtacccgcgctcggcaaaggagggcatcatgaagtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgggcagtgaggacaggcactcgacccccatccatacacaccgtcttgtggccgnnnnnnnnnngaggttgggggcagggtggaggtggggcgtggtacatggcatgatggtggcggattctgggggcttcccttgcaggaaccagctccagaggtacaacaaggccacaacaacagcccctgcggctaccagcagtgtcaatgacacgggtttcctgttcagcatacgggcagtggggacaggcacgcaaccccccatccatacacaccgtcttgtggccgttggcatacgccaggtcaccaatgtggtagatcagctccgcgccggcctccacctcgtccttgaggcagtctgcggtgtcctgcgccctgtggtagcagaggatgggtgtgtgatgtgagggcacagggatactcagcggtctgggttggacactgagacagcagctgggtcctcatcggagaagatcatcccattgtcaggggcagtgcctccttggacaggatggtcttcaagannnnnnnnnnatctgggtcggacagtaaggcagcagatgggtcctcatcagtgaagatcatcccattgtaaggggccgtgcctccttggacaggatggtcttcaagacggtaagcagaagaccctcaaaggctgcccaagccatctccagtaagcaacaaagtggcctcctaggcacgagcaggctcgatgagatggccctgcacatcacccacacacccctccagccctcacccaggggacttggcagcgcggtgctcagattctcccatgtccccaaaggcgatgaactttaggccagcgtcgggggagggcgcggagggggcacggaagaacaccgacgacccgtgcttgacctgaggtcgtttagatggaggcattcccgctgagcatatgtggcggcgcataataggattacgctcctcaaccccatgcctttggtgtgttccttgccctgagcaccccgccccaagcaccccttgcaccgaccttgtagcggtagcgagcccccggcacgagatccgtcagcacaacagagtgcagggacagcggggagtagtcaaagtcccgcgcgggcgccgagcacatgtcccggctgctgtaggatgacatcgaccctatcagctcattggccccgggcggaggctcattaggctgggcattctcgtccgccgtccagagtgccacagaggacgggcagctgcggcgacgagggagggtggtgggctggtgaaggagtgtgcaaccaccggggcaccctctttggcagtgcagcaggggcgaccttggttgtgccaggagccgagagaagcaggcgggtggtggcacccctgcaatgtgcccgaggagcctcacaccctgccacacagctcagcagcaagcagccactcactgcacagagacctgcaggcccttgtgaaggcggcaatctcacctttctccctctgttcgccaggaaacgaggatctcactcgcgtctcccgtcaatgacaggtgcacctatgcaggggtaccagccaatagcgtgctgagctgctgaggagcaggaacaacccctcggtgacctggtgataaggacaacggagcaggacgaggcctcacagaccaacatctacctcatggggagcgcagtcgtgccgattcgagtctatggccagaccgtcctgcaggggccgggccacggaggccacacgctcgacactggtgatcagcagcagcgtcaggacgaggcccagggtgccctgaaccatgccaagcggcgcaagatggtgctcacgaagcgatgaggaagggccgtcagtcgagggcgccctactatgagctgggcggcaggggaggcgctgccagaagttgaaatgagcgggacgaggttttccaggttcagacaagtttgtgatgggttccacactctagattgcgaaacaatattatcaggttagtttttcccgcaaagggaatcaacttccgacaggtgatgggaatatcctcagcttagtggacggagggcggagggtcccggnnnnnnnnnntgttagttttcccgcaaagggaatcaactttcgacaggtgatgggaatatcctctgcttagtggacggagggcggagggtcccggggacaagggtggatcttggatacgctctctttcgtacgacgacctccgtgcatgcgtttcctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtgaagcgctgtctgagaagctaggagtcctgaaagaccctgtcatctggacagttggaagaatggacagaggtcctgctcatcattgnnnnnnnnnngacactcctcagggacgccccagacaccacagaactggtgtttggagatggagttcttacccacctcattctcaggtgaatgcgagggtgtaggcctttgagatgatgcatcatgcccgttgctggtcatggaatgaggacctacggcgggtgtaaggtttgagctgaaccagctgggctgtgtgtgtcatgtttaacagaggctgagcaattctttgatcctctcgcaaggtagcaatgtgttctcattcccctcccnnnnnnnnnnctaatgtatatttaccggacactaaagccaatcatggtggctgaaagtgagtttgctgcattcaatctgannnnnnnnnnttaatgtatattaaccgagcactccagccaatcatggtgactgaaagtgagtttgctgcattcaatctgaaggggagatacaagtcaggagttgggcaacttggggcatacatgggtgccaaaaatgtgaagcgctgtttgagaagctagcactcctgaaagaccctgtcatttggagagttgaaagaatggacagaggtcctgctcatcattgnnnnnnnnnnnnnnnnnnnnnnnnnnnnnnnnnnnnnnnnnnnnnnnnnnnnnnnnnnnnnnnnnnncgtgacgatggtcacccacatcaccatctggatctgaacccagatgaggacgtagcccctggagagcatgaagtgggccagcatgatagcgcctggcaggcccaccaggacgcaggcggggaggacccagagggttcccacccagtcccacaccgtccagaatggccgggtggggacctgcatcggccgagccacctgcacgagttacatggctgattttactttgtgggcagcaggatcagaggcagagcgcaggagacatgcgttcatggcctcatgccacagccaggcaggcaggcaggtaccccctcctgacccttgatcgaaggacgcctcgccctgacagcagatcgctgcaggactgaatggaggcnnnnnnnnnntccaccctcccacctgcacagtgtacaccacgatggagctgcggagggcctggctggggaggcatgaggtggggcgtgtctgtgtgtgtgcaggccgagagcacagatggtgtgcatgggtgtgctcggcgccaactgagggtctcggcatgcaaagctgacgtgaccccactctctcaatccgcagacatggggtgtgcatctnnnnnnnnnnaagacgtgcgttcatggcctcatgccgcaggcagacaggcaggctggtaccccctcctgacccacgatcgaaggacgccccgccctgtcagcagatcgctgcaggactgaatggaggcaaacgggcagagatgctcccctcccacacccctctcacccggtacaagaatctgaatcgcgcccggtactccatctgccaggcgatggctacggggtatgctccggcgaccagcaacctgccaagatgcacaccccatgtctgcggattgagatagtggggtcaagtcagccttgcatgatgagaccctcagttggcgccgagaacacccatgcacaccatctgtgctctcggcnnnnnnnnnntccaccgaaggctcggagagggggaatgcatcatgtgcacattgcattgcctgcacagaaagtcccgcagatatctgcatgcacatacactgcagtaccccagcggcttgcacgccctacttgcaatctgtacagggatgtacagctcgaacggggctctcgggatcacaaaaagggcgttgagttgcgcagcacagccactgcaagcgggcaaannnnnnnnnngccatttaaggctcggagagggggaacgcatgtgcacattgcattgcctgcacaaaaagccccgcagatatctgcatgcacacacactgcagtaccctggcggcttgcacgccctacttgcgatctgtacagggatgtgcagctcgaatggtgctctcgggatcacaaaaagggcattaagctgcgcagcacagccactgcaagcgggcaaatagcatgacagggaggggaatgagaacacattgctacctttcgagaggatcaaaggattgctcaacctctgtttaacatgacacacacagctcagctggttcagctcaaaccttacacccgccgtaggtcctcattccatgaccagcaacgggcatgatgcatcacctcaaaggcctacacccttacattcacctgagaacaaggtgggtaagcactccatctccaaacaccagttctgtggtgcctggggcgtccctgaggtgtgttgagggagtggcaggtcagccaagccgggactcaccctgttcttaaagcccatgacagcccaaatctgacaatggcatgtgcagtggggcctcttccccctttcacatgttgcagaagacggtcgtcgcccagtacacggatccaaggggtaccagcacatcacgccaggcagcccatgttcgggggtgcaaggtgttgaataccacagcgatgaggatgaggctcatggagcaaactgcatgtggggatgggggaggtcaccatgctggagggcaggtaggcagcctttaaccctctgccccagcgccgaaacccaggcccacccaccatggaggacgtccaagggggactggatgccatgtgccctcaagaccttgtaggtagagtccgcatggaatgcctgtcatgtggacgagtgaggttgagcattgggtagaacannnnnnnnnngtggatgccatgtgcccccaacaccttgtaggtagagaccgcatggaatgcctgtaatgtagacgagtgaggttgagcattgggtagaacagcgctgccctgtcagcgggaccatctgactcggtgcatgagtgaccttgagcccggtccatccccatcgaaatcgcacccccatcaaccggagcatggctcgatccgatggctgttgccgctggcacagatctctcctaaactcctcctccaacgttttgtttcgaaagcgttgagagagaacttcgaagacggtcgagccagtgcatggccttgccggctggtgcgtgccaccctgcgacccccacccatgcgcggtcgcagagctcgctggcatgtggatccatccagaagctttggaaggcattgctcaaacaacccccccgcgcggtgacggtcgtgcgcgagcacaaaaatgctagacccccccgctgtgtcggatgggcctgtttggaggagcctcgcgctttcctacaggcctacacagagaattcactttgttgcatgaatttctgccggacaacttaccatctgatgctcaaaagccttgccttgatcccatgacacagataagcgtcaaggagcatgggttgttctgcagacgaaaggtggattctgttaccttggccctgtccgaattctgccccagattgggccagctcaggcagtcggatccatcctcctcggcaaatgctcgtgccttcactgcacgcagattgattcgtcagtgcacctcacctgcatgccgactctgataggaaccccctcttaactttgctggcgagacatgttgatgacacgggcatgtagtctgtgcgtgaaggaattgctgcacagagcagaggaagaccttgctgactccaaggctgtacattcagaaagaggtggcacatttcaaggtaggggagcacgccccctcgctctgctcatggaggcttgagctgagagtgagagggcatggggtctggcccccggcagctggctgcattcctgaaaattcggagagggaaagttccagcgatatgaagcagcggcagaacaaactcggcggaaaaatataacgccgacgaccggacacttggctgtnnnnnnnnnnttggggtctgcccccggcagctggctgcatgcctgaaaaatcggagagggaaagttccagcagtatcaagcagcggcagaacaatctcagtggaaaagtataacgccgacgaccggacacttggctgtcgatggcatgcagtatacaaataaaagggatcgatagagacattcagcgacaggtgagccctgtgaattccgtcgacccctgggccacgaattgaggaaggggggcggggagtggtaggggggagggggggccagcctttcggtggagacgctgtcgaggttcatgcacgtcccctcggtacagggcctgtgggttggggtggggttttcgcagcaagaaggcggtggcaggccgcccgtggcccccgccctatgcttgccagcgtgccgcgtgccggctcatgtcaggacgaagatgtagtagtcgtacacgatgatggtcccagaccaggccagcatgaggaggtagatggcccaccatgagtaacccgtcttcagcatggaatggcagatgaacatgggcccatgcagggcctgcagcaggaacacggggagcagccaggtggtgcccagccggtccagggtggtcggcgccggcagcctgccggggcggctgccggccacctggnnnnnnnnnncggttcccagccggtccagggtggtcggcgcgggtagcctgccggggcggctgccggccacctggccggggcacgagggtgggttggtgagtggccaggtgagaagggggcagggcacaggcgtcgctgtgacttctgagtcagaagggtggatcgcagcgtgtgtgccggggcgccggggcgaggtcctggtgccggagcaggcgcagcgacccagcgccacagggcgctgccgcaaggaggatgcctcgcggctcccctgcgaccatgcgcccccggtcccagccatgccgtcagcctcggcgaggaccgggggctgctctccgcgaggagcctgcgagccctgcacccccgggnnnnnnnnnnctcgctgtgacttctgagtcagaagggtggaccgcagagcgtgtgccggggcaccggggcgaggtcctggtgctggagcagccgcagcaacccagcgccacagggcgctgccgcaaagaggatgcctcgcggctcccctgtgacgatgtgtccccggtcccagccatgctgtcagcctcggcgaggaccaggggctgctctccgaggagcctgcgagccctgcacccccgggtccactcacctccagtaagaaattgtaccgcgccttgtactccgactgccaggcgatgatgcaggggaggagcaggccaatcagggtgtgcagcaggaggacgccgaccgtctgcgcgatggaatgagacccgaggcctcgggcccaagccctggaaggcatgcgtggacatcctccctgcctccacacacatgaaagaactgccaggcatcttgcggggaagaggtcccaggccccttccaatgctcctcatcccacatacacgccgtgccccacctccgagtgcccgcgctgccaggtgtacagcgccaggatgccgtaccctggtgaagaggatggggggagaggggagggggcatgggtagaggtggatggcatggcctgcgccgcaccggaagccatgcctcatgagacacagggggcgtcgcagcccgaacaggggccatgacatgcacacccctgctaccttggttgccctcgtccccggcgcaccgagggcctgggtggggatgtgcctgctcacgaggcagcgctggaaaaccatcgactgcaccacgagcacgtcggtgccgctgcagagggggcgtgggatgcgcacgcgcctggcactcagtgccgcggcatgctcgggagcgcatgcatgcacgatgggcccgtgccggtgtgtctcgggatgtcatggcaaaccctcgatgcttccatgatacccgcatgcaggcgcacagcttccaccgccccgatgactgggccgagtgtagggtccctgcacaggcctgacacccacccaccagtctatgagtctagacaggatgcctgtgcctagcagggactcccctgtgtgcggcttgtacctgccagaggagcggtgcttgtgtgacatcacatgtccagtggcacacatgaatgatgagcgcgatcaccaccatcacttccaactcacaggaatatgtgtagtgcgacggtgtgcgacaggagcacaggtgggaggatggtgttccagccctcttgccacacggacggccgccatgagggcagcatgagaacggccaccagggcagcaaagttgcacactgaggcagtgataatgaatggaacagggtgaacatgggcaaaagaggaaggcttcagcgataaatactgggcagacacatcgaggagcccctggtgcaaaagtactctcgccccaccatcacgcgccatccatgccccggcgcacccatgagcgcggtcatccagctgagcgcatgatcctccttcagcaccttgtacgttaccacgagctcgtaagcctggggtcggcctggggagggtcctatcagccccggtccgtaaaaaccctggagattgcaacagccggaccccnnnnnnnnnngcgtcctggggagggtcctatcagccccggaccgttgaaaccctggagattgcaacagccggaccccaggaccgcacccacgcaccaccatgagtctcgacatccccaggtcgatgccgaactgaattgagccgacatatagtcgataggcacgctccaggcggtcgttggtaaagtgctgcaacacgggccgctgcaagtttcctatcttccgctcgtcacctggccgcttcgacacatcccccttccaccgggtcatgggccctgtcgcggcgccagtgcgacgatagagaaagcacagcgctgataatagacggacccagnnnnnnnnnngagtcgataggcatgctccaggcgggcgttggtgaagtgctgcaacacgggccgctgcaagtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagaatatgtacatacacagcgcgggccattttggggtgcgcagtacttgtccatacgactgaaatttcccgtgcgcgaatcggcccctcgtccgaatcgcgggtcaaatagagtcatcaggcgaaactggtcagtgctctaaataaccctgagatccgtgnnnnnnnnnnacgggtcaaacagaatcatcaggcgcaactgatcagtgctctaaataaccctgagatccgtgttgagttcagagcgttttactgcgtgcgaggcagagagtcagcaaccgtacgggtgaatacataaatcatgcagatgtcaaaattgggaaaagggtgactgagggggtgtgacttgagatgacggtgcccagttcacatgcagttggggctggcgaagaaagagagtcaactctcaacgcatacctatccgggtatatgacttcataatgtgggtctgctaggtagacaaaggggaagaaagagcaacactgtgccctccagcggtcagcgagaagccatctcaagtggccgggctattcaggccaggatgtagaagtaggcatcatacactacgatcgctccagaccaggccagcatgagcgaatagnnnnnnnnnngaacgtgcagatgtcaaatttgggaaaggggtgtctgaggggtggtgacttgagatgacgtgcccagttcacatgcagttggggctggagaagaaagagagtcaactctcaacgcatacctatccgggtatatgagttcataatgtgggcctgccaggtagacaaaggggaagaaagagcaacaccatgccatccagaggtcaccgagaagccatcccaagtggccgggctgttcaggccaggatgtagaagtaggcactatacacaaccatcgctcctgaccaggccagcatgagcgaatagatggcccaccatgagtaccccgtcttcagcatggaacgacagatgaacatgggtcctgtgagacccatgagcagaaagtcagggagcagccagaccatgcccaagtggtcgagaagtgtgaggggtggcagcctggccggccgcactttggcaacctgtggggtgggcagggtatggcaaaggttgactggaagctctgaacaagagcatcggcatgctgtggccaccgcaagatggacctacagcttggttcccttgccaacatcgatggcctttggctcactttcgccagcacataaataacatggttgcatgccttgctgctccacccacatggtcaccgacaggacacgtcttggaagcaagacctgtggctgccatgcccgacaactgcctactctaccccatcacattccgacttgatccacctctcgcaggaaggaaaagcgagccttgtactctgcttgccaggcgatg

SEQ ID NO: 48670 - DNA, 72 bp, Chlorella protothecoides
gaccgtgggtttcttgttgtaccgcgcaaggttgccagtctccccagccatcttgtcaaagatatcctgcag

SEQ ID NO: 48671 - DNA, 80 bp, Chlorella protothecoides
cattcggtggtgaaggtacccgtgcctgattcccgagactcatcgtacttgatgcagtggccttgcactttgagccgccg

SEQ ID NO: 48672 - DNA, 61 bp, Chlorella protothecoides
gaacagccccgtctccaccgccagctggcgtgccccgggcttcaggtcgccgaggaagggg

SEQ ID NO: 48673 - DNA, 71 bp, Chlorella protothecoides
caatcccgaggctaggcacacgctgcggcacggagggcagcctacacagtactcatgcatggaggtacacg

SEQ ID NO: 48674 - DNA, 61 bp, Chlorella protothecoides
gcgcctttgccgacctgtacggcgggctggggcctgacacctggcatgtcgtcaacggcga

SEQ ID NO: 48675 - DNA, 61 bp, Chlorella protothecoides
gttgctagcagcttattcccgcggacgggacatcgctggcgcagttggttgcctctgatgg

SEQ ID NO: 48676 - DNA, 75 bp, Chlorella protothecoides
gagcccagctctgtggctcggtgcctgtctcacagcaggctgttgggccactggattaccctccagtgtccaccg

SEQ ID NO: 48677 - DNA, 61 bp, Chlorella protothecoides
cagggcgcattgtgtaggctcgggcagggcatggaccctcatctggagagcatccatgtca

SEQ ID NO: 48678 - DNA, 16019 bp, Chlorella protothecoides
  modified_base (108)..(117): a, c, t, g, unknown or other
  modified_base (1951)..(1960): a, c, t, g, unknown or other
  modified_base (2027)..(2036): a, c, t, g, unknown or other
  modified_base (2836)..(2845): a, c, t, g, unknown or other
  modified_base (2922)..(3012): a, c, t, g, unknown or other
  modified_base (3089)..(3098): a, c, t, g, unknown or other
  modified_base (3156)..(3165): a, c, t, g, unknown or other
  modified_base (3472)..(3481): a, c, t, g, unknown or other
  modified_base (5586)..(5595): a, c, t, g, unknown or other
  modified_base (5941)..(5950): a, c, t, g, unknown or other
  modified_base (6418)..(6427): a, c, t, g, unknown or other
  modified_base (6483)..(6492): a, c, t, g, unknown or other
  modified_base (6937)..(6982): a, c, t, g, unknown or other
  modified_base (7069)..(7137): a, c, t, g, unknown or other
  modified_base (7375)..(7384): a, c, t, g, unknown or other
  modified_base (7702)..(7711): a, c, t, g, unknown or other
  modified_base (8401)..(8410): a, c, t, g, unknown or other
  modified_base (8535)..(8544): a, c, t, g, unknown or other
  modified_base (9265)..(9274): a, c, t, g, unknown or other
  modified_base (10200)..(10209): a, c, t, g, unknown or other
  modified_base (10817)..(10826): a, c, t, g, unknown or other
  modified_base (11219)..(11228): a, c, t, g, unknown or other
  modified_base (12697)..(12706): a, c, t, g, unknown or other
  modified_base (13233)..(13242): a, c, t, g, unknown or other
  modified_base (13549)..(13558): a, c, t, g, unknown or other
  modified_base (13712)..(13721): a, c, t, g, unknown or other
  modified_base (14755)..(14764): a, c, t, g, unknown or other
cgcgccacccacaccgtgctgctgcctgtgatcgatgactccggggcaggtgggtcggtcaatgcgtcgcgggcaggtgagtcagtcgatgcgtcgcgggcagagggnnnnnnnnnntcgcccgtcagcaagaccacgcgcaatccgcggcggcgcagcgccgccaccgtgcgcgccgcgccgggccgcagcccgtcctccacagccaggctgcccaccaggccccggccggcacgcgccacccacaccgtgctgctgcctgtggtcgatgactccagggcaggtgggtcggtcgatgcgttgcgggcagttgagtcagtcgatgcgtcgcgggcagagggtcctgcaggtgcatcgggggtgagtcgggctgtcgacgcttccatcgcagggtccccgccgtcgccgcgctgcgccgcgcagatgccgagcacccaggcctgccggccgactgccgtgacggcgccgtccacgacgccccagaccccctcccccgccaccgtcgtgacctcgctggcagaggggatggccaggcctgctcagttgaacggggaggtgtcactggggtgaagctctcatgctatcttgtggccaaggacaattcctgcaaactcttcgacggtgacatggcactcaatctcgacgccatccctccacaccaccgcgcacaatccagcgccctccacgaccagcgccgcacctctggcgcgcgcggcatcgatgaaggcgtccgccagcgggtgccgcgtgacggattccagcgcggcggccagggccagcgtggcgtcctcgcccgcgccgcgccgcgccactaggcgcggccgcccctgcgtcagcgtccccgtcttgtccaggaccacggtgtccacggcggccagtcgctccagcacatccccgccaccaatcagcacgccgcggcgcgcggcggcggaggagccgaccagcacggcggtgggcgtggccaggccgagcgcacaggggcaggccaccaccagcacgtccaccgccaggcgggcggcgaggacgtagggcgcggtggcgcccgcggcgcccagccccgcggcctccacggcgccggggaacagcgccgcgccggggcccgcccagaaggccagcgtggccgccgacacggccatgatgccgaagcagaagcgccccgccaccgcgtcggccaggcgctggacgggagcctcgcgtgcctgcgcatcctccaccatgcgcgcgatgccggagacggtggaaagcgcggcgctggcgctggcgcgaacgcgcagcacaccctcgtggcacacgaccccacccttgaccctggccccgggggcggcggggaccagcctgcccaggaattgattggttggggagggggggattggtgaggggggaacttggcgggcgtcactgtgctgggccgggcagagaggaggaataggatggagtccttttgcctacaccaaggccccgcccgcaccctcgacatacagcaaccctcgcacctgctctcgccggtcaccagcgactcgtccagggaggccctgccatccaccacctcgccgtccacaggcactcgctccccgggcagcaccaggatgacatcgccgcggcgcaggatgtcggtggggacctggcgcgaggcaccgctgccctcaccgtcgtcgatcacgagccgggactgctccgggatcaaattggacagcgcgctgaggtccactgcggggtgcatgcgaggggctggtggcgatcactggggaattggaccacctcgacacaatacaacctcctgtacacaaacgtgggatccgcccgattctacacctgcaggtacatgccaggccagtgcatgcagggacaggcaagcgtctccttaggctggccgtacagacccacacgtatattaagtgccacactcccccccaaaaaaattaatgacattccgccactcaccagaggcctnnnnnnnnnnctagacagcgcgctgaggtccactgcggggtgcgtacgaggggctggtggcgatcactggggaattnnnnnnnnnngacagacccacacgtatattaagtgccacccccccccaaaaaataatgacattccgccactcaccagaggcctttttgcgagcccgcgcctccaaggtcctccccagcagcacaaaggcgagcagcatcaccggctcctccagcaggctggcgtccaaggggatgcccggcacaaacgcactggcaaggcctgtcccaaaggcagtggccacgcccagggctatcagggagttcatgtcggggtgacccctgcatgttgagggtggaacatcaccgtggtggacactgcacaggcaggtgatacagatgttttggcggggggggttgctgcaggccgcgcaagtcagagcgtcgccaaagcccatcaggctcagtcccactacaagctccccttgctgtcccagccatacacagatgaaacccacaaaattctcctacctggacagggctcgagctccattgacgatgagggtgcgaccaggtccagccagggcagccgctccgatgccagcgcccacgtagggatgccccagccagccccacacgccggagtgggcatgcatggtcagacccagagcgtgcaaagcgtggccggcatggtgcaggaggcaggcagacgccaggccccacgagatggcggcgttccaggtgctggggaatgtatggacaggaagtgttggcagtccaagcgcaaagtgacacatcaccctcctcctgtccgccagaaccctcacaacctagatccccgcctggcagcagctgcctccctagacaagaagaaaaggacagcaccgctcacnnnnnnnnnnggaaccttcacaacctagacccccgcctggcggcagctgcctccccagacaagaagaaaaggacagcaccgctcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaggccagggcgcgtaccgcacgcgccgtcgcctcatcgtctcgtgcctcgatcaccgccccctccagcaccaggnnnnnnnnnngggacgtgacgatgagggggttgggaggctcccacaggatccaagggaggggcttgcnnnnnnnnnnctctgcagcagctcctcctccctggcagcctccttctctgcgcccctgccacgcagatcgtgagcctccctgggccgaatgatggagggaaatccggccgaggccagggcgcgcaccgcacgcaccgtcgcctcatcgtctcgcgcctcgatcaccgccccctccagcaccaggttgacgctggcgctggagatgcccggctgccggaggagggtgcgtttgaccgccgacacgcagccgccgcacttcatgccactcacatccagtacgacggtgtggggtgcaggctctgggcggtgtggtgccnnnnnnnnnnccagatcattcgcatttcatgcgtggcatgacatggttctgcaagtgctcgaccagcatgcaccagcctgaaagagaccaagagtgtacctgagatggggggagtcacagagactgtggccgtggaggcagcagcacatggtctgcagctctggaggctgggcctccttcctgatggccgctgccaggtagaggataggtgtgagagaatcacaaagggtctgcgaccatggcccaacggggcaggatggcagatgggcgagaacgccgttgctttactggtgcatggggcataacctgctggaagcagatgccaagctcggacgcaatgcagcatccgagcttggctcctcgctaacgtttgcatcagctacgggtatctttaggcagaatgcattgttttcaaggcccacatgctctcgaatgtacgtctgcttcctcgcactgcgcgctcgtcgtcgtatcctccatgatcatggagacttcccgccacccgaaaccatctgctgcgtgctgggcttcacaactggcgatgcttcctactggacactcagcccgtcaaggtcagcacgagccctgctccatcccgccaatgcaaggggaatcatggcagctctccgacgggctgcggccctcgcactgcaagcgaccgtcaggggttgtcgttccctgactacgtacactggagagaatgtagcctacgtgcaggcaatgcagtccccattggcgttgtatctgactcccaaacatccaaactacgctcttaacaatggtgagctgggttttggggtccgcgcaggcaatgctagcttcgacaagagcggtcgtgaacgtctgagcctgcaccatcggtgatgattgcccctcctcatcgactaacccattgtcggccacattcttatgcagcggtattggaaggctgctggatgagcccccttgcggcacgtgtcctggatcccaccgcggtcatctcgcccctttgtgccaccaaagtctctcagccgctgtcggaagagagcagtgagcacaccgcccgtgccatgtatgccgattctgtgaggagaaagaggaagcacaagatgaacaagcacaagcacaggtctgtccacacttccccggaatgagatgatttgctgcctagggagcttggatgtagggctgatcaagctctgcacctgctgagtgcatcttctcactgtcttaccatccctttattgtgtgcacaggaaacgcctgaagctcaaccgacgataggaattagatcagaggctgctctgtcgccggcgccaaagcaggggctgtgtgggtagtttgggcggctgctgctcccgcggcaaccctatatgaggatgcatccttgcttttgcattcaggtcctttgcattgacagctgttaggtgtactgtacatactgcacacgacaggacgaggttgatctagagtaatcatcacagaaatgcgcgagaggctggcttggtcactctggccatgccgaggtgggcctccatgagggagtgaaggtctgggggtgccacctcagagtcaccaggcaagccaaggtaatcctcgaatgagaagtcgtccagggccccagacatggagtcgaggccgatgcgagaggagggcaggcctggtaggcgtcccaccctgcgacgtgtgggggacaggtgtgaggagtccagctcagaaccaccacacaaaaggcacggtacatccttgcgtgttgcagcgcaggtcacagccacacacctttcaaggatctgccgctcgatctgaatgcgggccggcaggcccgagccatacacattcttcagcatggccatcctgctctcctccacggtgctccgcaggccggcctgcacctgcgcgacggggtgcccgctctttgcaccatccttcaatgtcacgagcccattgcggagcgcatcgtggggtgctgtaagaagaggcaggctcgcagagtcctgcagtgtgcaagggggagcgatccctgcttgaggatgcaccggacacaggcgaaatgccaggcagaccagtgcatccgatccgaggatccgcatgcaatttggtcaaacacacgatcagaacccaccattggcgctggcnnnnnnnnnnacagtgcctccgatccgaggatccgtatgcaatttggtcaaatacacgatcagaacccaccattggcgctggcgtgggcagtggcctgcctgtcaccgctgatcctcgaccctctgcggtctcctatcgcttggctgacttctgaccaatgattgtcggatgatggatgtgtatatttatggatgttcctggatcacaaacaagtcaatggtctccaagcaccagctatgctttcgggcgtgtcctggcgattgccaccttggcgcagattccgaggagagtggggaagctgctatctggaccgctccccctcttctccacccctttcgccctgcagcgtgcacannnnnnnnnngcatgtcaatggtctccaagcgccagctatgctttcgggtgtgtcctggcgattgccaccttggcgcagagtccgaggagagtggggaatctgcaatctggaccgctcccccgctcctccacccctttcgccctgcagcgtgcacatcccggcatgtgctgtaatggtatgtaaacatcaagactctgtacagtgctcaagtcaggcagcgggtggggggtgcgaggggtggaaggaatgtgtcgagagccctgcacacccgccccgcggtctcagaagctggcgagcaggcgctccacggccgcgtgcacgttgccgctgctagccaccagggcccgtaggttggtctcccggtcatagaaccccatgtcctgcagctgctgcagctgcgtggcgtacgtggcctctggattggcgggcggagcaggcaccgcagaccccgccgccccgcccatccccgcgagcatnnnnnnnnnntgagagccctgcacaccagcccggtggtctcagaagctggcgagcaggcgctccannnnnnnnnncggcggagcaggcgccgccgcccccgccgccccgcccatccccgcgagcatggcctccatcccgcctgcgcccgcggtcggccccccgaacaggctgcccaggggcccgcccgacagccgctgcatggcctcctgcatctgctgcatggccgccatgttggccgggtccatcatggccgccagcatgtccggattggccagcgcggcgcgcatctccgggttctggcgcagccccgcggccatggggtggctctccatcatggactggaactgggatcgcccctccggcgtggccagcatggcgcgcatctgctgctgcgcggccgccatcatcgccgggtcgcgcatgaaggccgacagcgcctcgttcaggccgccgccgtccccgccgccgccaaacatgcccagcgggggcagcccgccggtggctgcccctgcgcctggnnnnnnnnnnnnnnnnnnnnnnnnnnnnnnnnnnnnnnnnnnnnnngcgcctggcgcggcacccgccggcgcgccccaggggttgggcagcggcacggcccccccggcgtccccgcctgtggcgggggggggnnnnnnnnnnnnnnnnnnnnnnnnnnnnnnnnnnnnnnnnnnnnnnnnnnnnnnnnnnnnnnnnnnnnnggggcagcaaacagggatgcaaagggattggcatcagcagggctggcccctgcgtcggcctcttcgccatgccccgccgcattcaaaattggctgcgtgggaccgggatgcggggccggggtgaggcctggctgggccatgccgggctggggtgatccgggtccttgccatgcctgcccgctgcccagcctccacgcaagcggcagatacccagcttcagggtggcgcccgggcaccnnnnnnnnnnaagcctccactcaagcggcggttacccagcttcagggtggcgcccgggcaccagaccctcccactgacaaccacgcacgcccgccccgcacctgtatctgttcgtggacctggcgcagggcgttgaaccccccgggcatgctctccaggttgctcatggcgcggtccatgttgcgtgtgtgctcccgcatcaggctctgcaggcgagcgtcacgaaaagatgaggcgtggatgaggcaacgctgccactgagaattccgtcgtgacaatccacaggagtccctccccgggtctcattcctgcctgactggcatgcacnnnnnnnnnngcgctgccactgaggattctgtcgtgacaatccacaggagtccctccctgggtctcattcctgcctgactggcatgcacagtcccccaggacgccctgagcagcctttcgtcagcccaggcatggcccattgaccctcgcccaggtctactcatgccccccccacccaccatgctagggccccacctccccaggtccctcagccagtctacccggtcccacccaacccgacgctcaccgggttgcccatgatgcgcactatgtcctggagcatggccgggtcattcagcacttgggcaacctgcgggttggcctccgtcatgcggcgcagcatggggttgttgctcaccatgtcccgcatgaagtcggggttgctcagcaggctctgcatggcagggttggctagcgcagcgcgcagcgcgtcggcctgggcggcgccccccggcaagccctcctgcaccgtgtggagtggggaaggggttggtggcggcggcggcggtgggccaagtgatgggcgccagcagtgccgcactccatcgctccctgccgggcgctgacaaccatgaccctctcaggaaacccccatcacaattcgccgtttcctcaccatgccaaagggcgccgccgaagggatggccccacccgcggagggagcagccccggctggggcgcctgccgccggctgggctgnnnnnnnnnnattcatagcagagcttgactagcccgtagaaaacaaggaaacctccactcacacgacaatccaaccccaacccctccactcctgtgaggagtcacgcccactgagacggagcactccctgcgcannnnnnnnnntttcacagcagagcttgactagcccatagaaaacaaggaaacctccactcacacgatgatccaaccccaacccctctactcctgtgaggagtcgcgcccactgagacggagcactccctgcgcagcgttcccacgctcaagcgccccctttgacccacctgttcacaggcggacccttgctcttgaccatgtgcaccacgtggtcgtgttcaaggcctggatagagcgagtgggggaccgtcatgcggcgatatgatcgaaccttcccaccttcttctccgaactctgccctcctgatcaccccaggctcaccatagctctccactgtggcatgatctttcaacacttgccccttgtagatgagtcggatcaggtctgcaggggaatcgcaggccctggcgacttccgtcttgagatcaccgaccgtggcctccctcgtcgtcttcacctcgaagggcggagagcccgttgtgggcttgatccggagggtgatctccgccatggtgttactgggccggcgactgaggggcccaaggacgagaaatggcgatgtgggggcggggcgtggagggatttcggggccgagggcgcgtcccctgaaatcgtggtaccgctgccgccgtgtaggcacctgcaaagcatccttgcccctgctgatccccaggccctggccctttcctaaatccaccacgcctatgcacacagcgttcgacgcaagttnnnnnnnnnncgcatccttaccccttctgatccccaggccctggcccttccccgaatccaccgcgcctatgcacacagcgttcgacgcaagttacatgtcggccagtggcagatcgcctagcgtccagtggacttggcgccagccttgccagcggcgcggggcacgttcttggcgacagacttgccggcggccttgttggcagccttctgtccggccttggacgccttgtccttcttggcgcgctccttgatctcgcgcagggcggcctcgcgggaggccttgcgctgctcgggcttctccgccttcttcttggcgatgacctccagggaggtgcccgccacggagcgggtcgcgttcttggtcacggccctcctcttcttgcgctgcaccagcagctcttggtcctgggggtgggagaaggagcacgagggggtgttggatgaccatcctgcacaggagtcgcagagatccacggcagcccctcattcgcagccaacccaaggactcaccttgcggtgctgcttgcggtagagggtggtccacgccagcttggcgggcctcttacgctggttgtacagggacttgcacttccgcctcaggaacaggaattgctgaacggtgtggggcggagagggtggggtcagcgggaatcaagacacccatggtgctggccttgctggaccatccccacccagctccatgtgcccgaaagcgacgagcgcctacgaacctgtccatcaacgcggatgaagaggatacccctgccggggtaaatcctcaggccactgaagcggcaggtcgtggtcctgcggtgagggagggatgtggtaggtaaggacatcgcgtgtgttgtgttacggcgaggcccagtgtaagccttcccgatagtaggcgcgccgtccagcggatccatccctcgctcccatagctcgagnnnnnnnnnncgttgtgttacggcgaggcccagtgtacgccttcccgatagtgggcgcgccgtccaacggatccatccctcgctcccatagctcgagactcacttgagcaccattctgcgacgtgaagaggggggcgagggggtaaggaggggggccgggaccgggaaattcgtgcagcgagccgcctcgtatcgaaggttcgcctcctcctgacaggcccgccgaagctcacctgctcctcctctgtgacctatagaaagaggggtgcaccagctcggagtgcctccttggctctctcgcagaggagaccttcgacccgggcccgcctccaatagtggcacagtacttgcagtaccactgttacattttcattgcatcgatggtccatgctcctcccagacatgggtccacatgcttgaattttgaacagcgatagcgctctgatccctcaaactagcagcattcattgattcaatgtcttcccgggagccgtcagggtagcaggggctggagtcgacggtcgcgcaggggtgttgaccgcctttagtgtgtggacctcaccatgagaatgtacagatgctaatgggcttcctgggacagacgcatgcgctgtgacnnnnnnnnnntatagtgtgtggacctcaccatgagaaagtacagatgctgatgtgcttcctgggacagacgcatgcgctgtgacagtcattaatacacactcaccagttgtcatggcgttggtggggactgcccatgcagccacccagaccgagctccccgccatgccggaattggatggagcacaagcggcggtcatggtgcgattactccaatccatggagccgctggtgcactcggcgcttgatgccaacctggcctgcgacatctgcgctgaggagcttgatggtgtgccctggcatgggccccggggaaatgaatgctatggcccaccacctgcacccaaataagttctgtctctctacgctgcgaacctcatggagatgggccagagtatatgctgnnnnnnnnnnccatgggcgccggggaaatgaatgctttggcccaccacctgcacccaaacaagttctgtctctccacgctgcgatcctcatggagatgggccagagtatatgctggggattcaagcttgacgttccccgcttgtttcttgcagaggagctgcccgggctgcccgaggcatcgggcctgggcggtgggccgcaccccccctccatctcggccagcctacgcagcggcctgcgcggcgcagtgctccatctggagtggcacccctcctttccaggccacctcctggccgtgcacgcaggggcagagcctgggtccgagccaggggaggccgccaccctggcggcatgggacaccgtcgccccactgcacccccgctggaccgccgccctccccgccagggtgaccgccgcctcgcgctgccccctggatccacgcccactggccctggcatgtgagtacggcgaggtgggcgtttgggccgcggacccgcgcgcctcgcctggctgcgcgcccgccctcttggtggggccggcctgccaggcggcgccctgcacctgcatggcctggctgcccggggtggcggcagggaggggccagctggtggctgccggcgccgagccggcctgctcgctgttcgccacgggggcgctggacgggagcgtcgcggtgtgggaggccacgggcggcgggggggggcggcacgagcccgccctccgcgccaggctgacggccgaggcgggcggggggcccatgctggtcacggcgctggtgccccttccccgcacccaggccctgccccagccggggacgatgctggtggggtgcttggagggcagcctggccctggtctcgcccggacacaccgaggtgggcggcgaggcgggtgcactgtcgctcatgcacgctggccaccgcggcttctgggggcgagactgggttcactcagactggagttcctcagcagggagtggggagaagagtgggtgaccagggcctgagctcctcaccgattccccctctgctccctccttgcccttgcccctttgcacacgcatgtgtcgcagccacagtcaccgagctgccccccgccgcacaggcagctcaggccaccctggcagcccacgcttcccccctgggcgccatcgtggccatgaccctgcatccagaacttccgggcttaatcctcattgtcggtgggctggggtggggcctgtgccagccgtcgagcctcgaggacctgccacccttcttcctcagcccctcggcccctgccgcccacacctgcggccgctggagcccgaccaggccaggtgggtcttttccgcgagcatgcccagcctgccgcttgcagaagttttgcatgatgctggaatccggtgaagattgtcagccccatctgccatcccctgccactcgttgagcctcatgtcaagtatgtttacgcccctcctcatccagcggtgctgtgccnnnnnnnnnnctcgagcctcatgccatgtatgttcacgcccctcctcatccagcggtgctgtgcctcgggagggcagacggcctcatggaggtgtgggaccttctccgggggcagagctgcccggtccaaaccctccaagtcacagacacggctgtgacgtcgctggagtttgatcccgctcagcagggccaggtgggcgcggaggaggcagggggaggagcctgggatggcacagctggccaggaccaccttggttggccatcatgcgtgggtggacatgcacccctgggaggttctgcatgtcattgaagcagtcagtgatctccccgtcatgcgaaccgcacccaggccgtggctgttgggacagcgactggggaggtccacctggtgcagctgcccagagccgtccacaggcagagcattcgagaactggaggacttcctcacatggttcaaaggcgaaaagcgtgcatttttggcggcagaaagtgcccaagagaccgccgtcgagcatgactcggcgggaaaggtaaggannnnnnnnnnatcacatgggtcaaaggcgaaaagcgtgctttttgggctgcagaaagtgcccaggagaccgccatcgagcatgactcggcgggaaaggtaaggagggaggaggggctgggcagggtaagtgggtaggaaacccagagcccttgtccacaaagtcttgtgagtactctgcatgcaggaagggcaagaattggatgcccatcgtgccgaggaagcacgcgacatgagtgctggagtcaaggccctccgcagtgacagatcgggtacttgtcaccccattgctatagttgaggacgaggaattcttggcnnnnnnnnnntcgcagtgacagattgggtacttgccaccccaatgctatagttgaggacgaggaattcttggcagcgttgagggagtgggagctcaaagtgggtgttccggatgctggagaggattgatcgggggaatgggtccttaagagtgtcatgcgcacnnnnnnnnnnagttccggatgctgcagaggattgattggaggaatgggtccttaagagtgtcatgcgcacagggccaaccaggtgctggtgccaagggaggatgtgctcactccggtcctgctgtgatgccccgggagcctcatcccgggcgcgtcagacccatcgccagaatgcgccgagggccggggaagtcatgaccgatgagataggcccccgacattgtcttgccatgatagtagaaggtccctgtaccactctggcgccctcacgtcgctgatttgaggcgggtccaccgggtacctttggctgccagtttgatagctgacggcagaaacaaaccctgtcgtgcatgaagctgccctactgctctgctttcagacccgattaaggagggagtagagtactggtccccatctaacagaataagaggccagcagacagtgcactcccccctcgcgcggtccgcatggccactgctagccttccggtccaggtggccgtgacatcgacccattgtttcggtgcgcccagatggagtatctgatgcttacaacaacggagggcatgcgcagaggagattgcttgggtctcctgcgtgagggaggccgactcgcatccacctcatggacaatctggaccctggggaactgtagcccttgtcctgcgtttgcccaaattgacatggagcgtcacctgaattggaatcatacgcccatctacccatgcaggcctcagagaaccaaggaggaagaggcaatgggctcgccagacccgttgtcatgcgtcagcagccggcaagcctaagcggcgggtggtcgtgactgggcagggtgtggtgacgagccttggtcaatccactcaacagttctacgatcagctgctggctggggcgagtggcatcacccacattgaaggctttgacacgagtgagtggggagggagattgccggctgggtttgttggcagggggagctggcatgaacatgctagcaaaggcccctcttggagggtacaatgatcatgattctcctcagcaaagcaannnnnnnnnnggattgccggcttggtttgctggcagggggagctggcatgcacatgctagcaaacgcccctcttggaggggccaatgatcatgattctcctcagcaaagcaacttgtccttgacgcgccctcaacacacccaccccggcaccaggcgactactcgaccaagatcgccggcgaagtcaagtcagtggatgcggcgccatatgtggcgcgcaagtgggtcaagcgcatggatgaggtcatgaagttcatgtttgtggctggaaaacaggtgagggggaggagggctggagggattggcggagggttgaagatggccagtacgctctgcctgcagctcagcacactgtctttgctggggtggcatgcatggccaggctcagttctaagagcaaccgcccccgcacacaggcgctggaggatgcggggctcccctttgagggacccggcctggaggatctagaccgaaagctgtgcggcatcctgatcggcactgcgatgggcggcatgacaacctttgccagcggcgtggaggccctgacgctgtcgggtgggtgttggatcttagggtttgaaggattaggggtgaagaggggaggcaatgaagttgtcgggaggatgcatggaaccccctcaggcctgtcgccaccgctgtggctggccgaggttgccgagagggccgcatgcgtgcgcaagggttctgtgtccccccatgactttgctttccaggtgatgggagcacagagtgtgtggattgtccaccatctgccacctcccttcgaccagcattccccagacctcaccccccccaccacccaaccccttcccgcaggccaccgcaagatgaaccccttctgcatccccttctccatcggcaacatgggcggggccatgctggccatggacctgggcttcatgggccccaactactccatctccaccgcatgcgccacgggcaactactgcatcatcagcgccgcgaaccacatccgcaacggcgacgccgtgctcatgctggcgggcggcgccgacgccgcggtcatcccctcgggcatcggcggcttcatcgcctgcaaggcgctgtcgcggcgcaacgacgcgccggagcgcgccagccgaccatgggacgcgggccgggacggctttgtcatgggcgagggcgcgggcgtgctggtgctggaggagctggagcatgcgcgcgcgcgcggcgccaccatcctcgcagagttcatcggaggtgtggtgggggggggctcgggg

SEQ ID NO: 48679 - DNA, 100 bp, Chlorella protothecoides
gttggcagcctccactgtggtcaggcaccggaggtggagtgtgaccatcgcaagcgcgcagtgggtgctccccccaacactcttccccaccacccctccc

SEQ ID NO: 48680 - DNA, 61 bp, Chlorella protothecoides
ggagtacgcggggctcgttggcgaatacgcggggctcgtgggggagtacgcggggctcgtt

SEQ ID NO: 48681 - DNA, 75 bp, Chlorella protothecoides
agccacccgctgggccggcgagtgtggatgcgacttggaacggggcgcttggttcctggacgacggtggcgcagc

SEQ ID NO: 48682 - DNA, 61 bp, Chlorella protothecoides
tacgagctggagctgagaaaggggggggggattggtggagggaggtgagtcctcagtgctc

SEQ ID NO: 48683 - DNA, 61 bp, Chlorella protothecoides
gaaccagctgctggtggagatggacggcttctccaccaccgccaacgtggtggtgctggcg

SEQ ID NO: 48684 - DNA, 61 bp, Chlorella protothecoides
catcatgcaggctcgatcggctgatggagggctgcactgttcatacgaagcgatcatcgaa

SEQ ID NO: 48685 - DNA, 116 bp, Chlorella protothecoides
ctcctggggggcatgggagggagtggtgtggggggcgggctttgagcggagcatgcatgcaccgggccccattccctccgccagaacctcgagcacgcagggccattctcatgcgc

SEQ ID NO: 48686 - DNA, 78 bp, Chlorella protothecoides
ttccttcgtcgccttgcttcagacgagcacgatcaccttcaggtctctaaaccactgatgatcacgcaggagggcagc

SEQ ID NO: 48687 - DNA, 61 bp, Chlorella protothecoides
tcgctctttatccgtttgcaaaattcagttctcgttcagtgtgctgagggttgcgaaccca

SEQ ID NO: 48688 - DNA, 69 bp, Chlorella protothecoides
gggtgtgggttgtgcagcgcgggatgccactggccgccacaccgctccgaggaccccaggccactgtga

SEQ ID NO: 48689 - DNA, 61 bp, Chlorella protothecoides
gcggaaccccagacctgctccgagagcttcaccgccgtattcaacggatcttgccgatgct

SEQ ID NO: 48690 - DNA, 61 bp, Chlorella protothecoides
aagcgcacccgcagcggggcgcccctgggcaccccgcagggcaggggaatcgccgacgaat

SEQ ID NO: 48691 - DNA, 79 bp, Chlorella protothecoides
ccagctgcaggtccagcttggcgagctcatccggcagcgcctcgccggggtctgtgagcgtgcgagggggcattgaaaa

SEQ ID NO: 48692 - DNA, 61 bp, Chlorella protothecoides
tcatttcgtaagtggctgccctcctatttcttactttgcagtgatcgatcacggggttccc

SEQ ID NO: 48693 - DNA, 61 bp, Chlorella protothecoides
ttaaaaagttgcaaccctctaaataagaagaagctaagccatgagtataccaagaacttac

SEQ ID NO: 48694 - DNA, 61 bp, Chlorella protothecoides
cagaggatgaacgggggggagggggggggggaaaagggaagctttgcacccacaactctct

SEQ ID NO: 48695 - DNA, 102 bp, Chlorella protothecoides
caggggcatcctctgcagtctcggcaggagcagcagtggcaggggcgtctgtggctgcatcctttaggttgacctcgatagggctgatgggaatttcctcga

SEQ ID NO: 48696 - DNA, 61 bp, Chlorella protothecoides
tccgggccaggcggaggaggggcccatcttcgtcgtccgcgcccccagccaggtgatggaa

SEQ ID NO: 48697 - DNA, 66 bp, Chlorella protothecoides
gaggcgatgcgggagggggactgggtggagatggcggaggcgatgcgggagggggactgggtggag

SEQ ID NO: 48698 - DNA, 75 bp, Chlorella protothecoides
ctgctgttgattgcccgtcattgaacatgtttgcttttttctccccacccatggtgactttgggctcatgctggg

SEQ ID NO: 48699 - DNA, 88 bp, Chlorella protothecoides
gccgaaggggtcccccgccatgtcctgtgtcctgcacgcagggaggtggggggggaggatctccgcgatggggaccgggagggagagg

SEQ ID NO: 48700 - DNA, 64 bp, Chlorella protothecoides
ggtgctgagccagctgccggagctgcgcccgggtcagctccccgcgctgacctcgctggcgctg

SEQ ID NO: 48701 - DNA, 61 bp, Chlorella protothecoides
gcggatgcgctccgaccggtcccccgacccgacctgggccttcctgtccgcggcgtgcgcc

SEQ ID NO: 48702 - DNA, 61 bp, Chlorella protothecoides
gggagaaagctcacacctacaagaccgtgtaccggcgccagtagctagtatatgttgcgtg

SEQ ID NO: 48703 - DNA, 67 bp, Chlorella protothecoides
gggggggggggggggggggggggggggagtcgggcgtacgccttgagatcaccttctcgcccgggtc

SEQ ID NO: 48704 - DNA, 61 bp, Chlorella protothecoides
catccgtcaggtgttcagcagtgcggcggggccgtccagagaccaaagcgcgtcatttgtt

SEQ ID NO: 48705 - DNA, 69 bp, Chlorella protothecoides
tgggtgccctgcgtggttggaaggggaggcaggccggagcctcaggacgccagggctagcctcctccag

SEQ ID NO: 48706 - DNA, 74 bp, Chlorella protothecoides
ccagctcggtcacgcggaactcggagctgtcggggtcgaggactgtggccagcagggcattgatgctgtggctg

SEQ ID NO: 48707 - DNA, 203 bp, Chlorella protothecoides
cacccccctcctggatcgcctgactggggcctgcagcaccacgtacgtgcgaatcgggggagagggaggagagagcgaggagcgggggttctcaggggtgaaattggctggggcgaagcatcgtgcatgggtgtggactattcaagatcaggcggaggggctgcagggtaataaagcaaatcccttgcccttgcacgccctcc

SEQ ID NO: 48708 - DNA, 16823 bp, Chlorella protothecoides
  modified_base (692)..(701): a, c, t, g, unknown or other
  modified_base (946)..(955): a, c, t, g, unknown or other
  modified_base (1395)..(1404): a, c, t, g, unknown or other
  modified_base (1776)..(1785): a, c, t, g, unknown or other
  modified_base (2117)..(2126): a, c, t, g, unknown or other
  modified_base (3558)..(3567): a, c, t, g, unknown or other
  modified_base (4558)..(4567): a, c, t, g, unknown or other
  modified_base (5167)..(5176): a, c, t, g, unknown or other
  modified_base (5993)..(6002): a, c, t, g, unknown or other
  modified_base (6491)..(6500): a, c, t, g, unknown or other
  modified_base (6595)..(6604): a, c, t, g, unknown or other
  modified_base (6878)..(6887): a, c, t, g, unknown or other
  modified_base (7298)..(7307): a, c, t, g, unknown or other
  modified_base (7564)..(7573): a, c, t, g, unknown or other
  modified_base (8024)..(8033): a, c, t, g, unknown or other
  modified_base (8278)..(8342): a, c, t, g, unknown or other
  modified_base (9740)..(9749): a, c, t, g, unknown or other
  modified_base (10276)..(10285): a, c, t, g, unknown or other
  modified_base (10944)..(10953): a, c, t, g, unknown or other
  modified_base (11593)..(11602): a, c, t, g, unknown or other
  modified_base (11835)..(11844): a, c, t, g, unknown or other
  modified_base (12119)..(12128): a, c, t, g, unknown or other
  modified_base (12656)..(12665): a, c, t, g, unknown or other
  modified_base (12750)..(12759): a, c, t, g, unknown or other
  modified_base (14740)..(14753): a, c, t, g, unknown or other
  modified_base (14966)..(14975): a, c, t, g, unknown or other
  modified_base (15065)..(15074): a, c, t, g, unknown or other
  modified_base (15306)..(15357): a, c, t, g, unknown or other
  modified_base (15578)..(15587): a, c, t, g, unknown or other
  modified_base (15932)..(15941): a, c, t, g, unknown or other
  modified_base (16165)..(16174): a, c, t, g, unknown or other
  modified_base (16362)..(16371): a, c, t, g, unknown or other
  modified_base (16673)..(16682): a, c, t, g, unknown or other
gcccaggccacggggcgggagccggcggcggacagcgccagcgcgcccgcccgcgagggcgccacgcccgggtcagtcagccggtccagcgcgccggccaggcgcgccgccatgccggggccaggttccaccctttccacagccgcgtgaagagcggcgccaccgcgctccagccagcgcgcacggggcggggcctgcggggtgagacggggccttgcgtggcaggtccagggcagctggggatgcatgcagagagcaagatttttgcctactctcggcggtcatcccaagttcagactaagcatctcagagggccactcatgcaagattcatgcttgcaatcgcggtcccacgatcaggaggcgcagcagcctgctcacgggatcagtctcggaccggctgccgtctagagcttccctgactctgtccagcgacgccaccgccacaccggcgacggcgatggagccgatcccggcgattaagcgccatcttcgtgtcatgcgtgcagccgtacccccggccccttcactcaggtgccgaggggccgggcgcacaggcttacaaaggtgaggctggcatcctcacacctccgccgacagccagacgttgccaacagaaggcattggtatcaggcctccacataacctgtacttacggtaaagtgttgcgaggttgtcgaggatggacctcgnnnnnnnnnnaattggtatcaggcctccacataacctatatttacggtaacgtgttgcgaggttgtcgaggatggacctcgggttgagtttccgggcgaagaaggtgacgtggtctggtggagcagagttcgaaactcgggccaggtgggcatcgccgataccagaaggtgagcactccaaatggcagctgtgttctgtttagcagttgttatatatcatgttaattccagtaaggtctcagagctgaaaagggnnnnnnnnnnatcctgttcagcaattgttatatatcatgttcattccagtaaggtctcagagctgaaaagggcagtgctgcgcgggcgtgcaagagcttagcaatagctacttccccttcccggaggagattgttatattacatgggtggcgtccgacggattacacatgcaaggcagctcgttctacactacaaaatcaagaatatgtgggagggcgcatggcgtgacattgtgtctcagccagagctcgcgttccgcgccagttcctccagatcacccctctcgatggcagtgtggtagtcgatgttccgctccctcagccaggcacacaggtcgtgcagactcatgccatgaaaatctgcattaattttgtaccgtggagatgtgggcagcccctttgaagtaacctccaggaatccatacccactccccggcgacatgtgggaccnnnnnnnnnncaccgtggagatgtgggcagcccccttgaagtaagctccacgaattcatacccactccccggcgacatgtgggacccatgatcatgacgcccttgatcgatcccgatcacgctcggatcacctggtggagacgaactagttgtcgtttcgtgcctcatcgggccgtttcccgagctgtgcgcggatgccgaaaccgacacccctccaggagtgtgtcggacggacgtctgggtgtgctccccgtgggcgtgggccgtgccgctggacatggtgctactgcggggttcatgcaataaggatgttgggtgcaagggatatctcctgtgtatgggcgcgcactcgaagaacgttctcggagctgcgtgaacgcgnnnnnnnnnnagcaggtttcatgcaataaggatgtttggtgcatgggatttctcctgtgtatgggcgcacacttgaagaacgttctcggagctgcgtgaacgcggcatgagaaaggtcacgtgcatggccttggttggagactcgagtcacgccaccccacaaagcgagcgtctcggtgcacacgtactctgaaaccgctctgaacacttcccagtcactgttcccacttctctcagtcacccatcatccagctcgactgtacagcggaaagacgggcgcatgcaggggatgagtttttgcagggcaggcgtactgtgtcgagtttggcatggcaaggcagnnnnnnnnnngaggtcacgtgcatggccttgctcccagggttatcgaaaatggaaaatggaaatgttcgattatgtgagtttccggaaattttcgagctgaaaatcccaccatatcgaaaatgtttgggctattttacatcaggcgcttcatgcaggggggagggggggcgaggaggtaacacgcttggccatatgagtgttttgatctgcatcagatagcatgctagcgtccaggagatactcatggtgaaagagctcactcaagcgccaagttctgtctatggcatgcagaaagcgggagttggcacagatgtataccagatccattgcacgtccaatgtaaagcctacactgtaacgtgctgtgaacgtaacggtaccaactccacttgcattttgcgcaggctgcgcttggttccacacttgctcagcccgcccacaccattctcactgtgcgctgggtgtgcctggccccgatgggctactgccatgtcagctcgaaatttcggagtcgaatttcggaaatgtgattttcccgagtatttcgcgccgttttcctcgaaacccgcaatttcggtgccctgcttgctcccactccctgcgggggcacgccaccccacaaagcgagggtctcagtgcacacatactctgaaaccgctctggactgttcccacacttctccccctcacccatcttatccagctcgacagcatggggaaggaaggagacagacgcatgcagggatgagtttgcaggggagcatactgtgtcgagtttggcatggcaaggcaggggcgggggtggcgccctgcctgcacggaggggcttgctagtagggggggtcagtgcgcctcgactcgtaccgctcagaacaagagacaagggcacacacaggcggttcaactgggagcatgggtcgagtccatttttcaaatctcatgcgctggcgggaggggcggaaggggatgggggtggggcgatgacatgccactccagccagacccaagccatcgtccggccaggcagttgagtttttaaagtgactggtggcaaaacgcagaggccacagccgcgccggccacgactgcactcgtccaaaatgacgcggcggtgggcgtgcatgctttcttagatactagtagtagagaggtgaaggggtgtgtgcgcgtgtggggcgtgtcgcagggaagaaggggaaggatcctcaccggtcgcgcttggaaaatcataaaaccgtcccagcccgtgctggcagcagcgcgccggcttcaggctcagggaaggatcctgccctctccgccgcgacgcgacagagtgtcgctgcgccgctcagatggcggtgccgcccatggggccgtccttggccttctcccctgcgtcggcgtcgcgcgcagccttggtggcggcgcgcgaggcggtgcgcgtcgcgtcgcggtcgatgnnnnnnnnnnatagcgcgccggcttcaggctcagggaagaatcctgccctctctgccgcgacgcgacagaatgccgctgcgccgctcagatggcggtaccgcccatgggcccctccttggccttctcccctgcgtctgcgtcgcgagcagccttggtggcggcgcgtgaggcggtgcgcgtcgcgtcgcggtcgatgatctgctgcgccacctcagcgctcatgatggggcgccaggccatgtgccgcgcaaaggtgatgggcacgcgctccacggggatgcccttggtctcgggcatcatgaagaagatgaagacggtcatgatggccacgaaggaggcaaagaagataaacacgccccacttcatggcgcagagcatggagaggaaggcctggccgatgacaaaggagaagaggaagttggtggtgacggccaccgacatccccgccgcgcgcgtctccaggttgtggatctccgagggcaccagccagcccagtgggccccaggaccaggcaaaggcggagacaaagacgcagaccacgatgagcacgccgatggcggtggcggtgggcaggtcgccgtcctcgtacttgccaaactgcacggccagcacgacgccggtcacgatctgggccaggaacatctgcacaccgccctccaggaaccagaagcggcgacccaggcggtccacggtcaggatggagaggaaagtggccacaaagttgacggcgttgatgatgatggtgttcagcagcgacgcgcggcgcccactccccagggagttgaagatgacggggacgtagaacatgatggcgttgatacctggatgagtgtggggcgaagggggaacacttcagcgagggagtgtgacggggcctggcttgggcttcctggcttacggtgcagagctagatgcccagagggggtgcggcaggccccttccattgcacccttcatcccacacgctggacgctctacccaccggtgaactgctggaagannnnnnnnnngtgcggtgcagagctagatgcccagagggggggcggcagccccgttccatcgcacccttcatcccacacgctggccgctctacccaccggtgaactgctggaagaaggggatcaggcaggacaggatgagctgggggcggtaggccttggtcagcagcatggtgtaggactggcgcagggagacgaggctggccagctccgtggcctccaggatgtcctccatctccgcctccacgtccttggtgccacgcaggcgctccagcacggcacgccccttctccacctgcccacgctcgatgagcgagttgggggattcgggcagcacgatggagccgaccaggaggccgagggcaaacgcggcggccaggcccagggacaggcgccagcctgcccaccagtcctggaccccataattgaccaggccggcgatgaggatgccaatggtggtgaacagctggaacagcatgttcaggccaccgcggaagttgaagggcgcgacctcggacaggtacagggggaccacggtgttggcgaagccgatgccaaagcccaggaaggtgcggcccacgaagagcatggccaggttctgggcgccggccnnnnnnnnnngatggtggtgaaaagctggaacagcatgttcaggccgccacggaagttgaagggcgcgacctcggagaggtacagggggaccacggtgttggcgaagccgatgccgaatcccaggaaggcgcggcccacaaagagcatggccaggttctgggcgccggcctgcaggcccgcgcccaggatgaacaggcaggcggaggtgaacatggtggccttgcgccccagcttgcggcacatggtgcccgcaaagaaggaggagaacatgccagccaggaacatggtggaggtgaaggtctgcaggacctggttgtcgtacctgtagggggggtggaggaggggtagccggcatgagctgggtgtgggagggatggtgcgagcagcagagagggaggacttgcaacagcttgacaacgaattctaccgactcacttgcagtaggggctcgtgtcggaaatgcccagaacggtacgctcatacacgtcggggaagaacttctgctggaagccggccatggcggtcacaccaccggtgacaccctgggtaagagggggaaatgagtgagatgagaggcatgtgtgctgcatggagtgggggtcccacgatggtggagtgaagatgcagtgcgtgaccccgccccgcggcggaggttctccgcgcagtgacagccacatcccgtcggatgatcccgtgacccgcccaacggatgccgggaccgcccgagacgacagtgcaccgatccgcatgccacggaatccgacagctgcacactcacgatatcgtagcctgcgggggcgagggggtgggcggagattcgaactgnnnnnnnnnnaacagctgcacccttacgatatcgtagcctgcgcgggcggggagtgggcgagggggtgggcggagattcgaactggatatcatcgggagtcggaagcaagtcccggaaacctccacgagcaaaccggggccctcgaggcatcactcaccgaaaagcaggcctccacatgccgacaggattgcaacaaagatgacgtagccggtgaggcggcctccatacgcctcagcgtggaggtgctccgcacccacggccaccatgcctcctccggccatgattactctgtcgggagggtagataaatgtgacaactcaaagttgtttcccctgagtggaggttttgtggccgtacaggggctcgtgagacgtatatctcgcagccgcacttcgtgaacgttagtctgactcagcaaagaaaccgcttacgtcaaccaaaggccgcgggcccgtgatccccacggcagatggtgcgagcccgtgtggtgccgacatnnnnnnnnnngctctgtcgggagggtagatatatgtgacaaatcgaaattgtttcccctgagtggaggttttgcggccgtacaggggctcgtgagacgtatatcnnnnnnnnnnccgccgggatgacggggatcagcttcgactcgggtacctcaccaccgggtgacgggcgatgacagtcagtaatccctttaatttattaattcttataattcttttggcagttgtgtttgtcgcccacgttattctgcgagacccagcgagagcacgcgggtgaagcgccacggaaggtgcgaaatctgtgtcggagattttggatcgccccggtcccgccatattttgacggagaatctgttgggtttgggcagcagcacaccactccctcccnnnnnnnnnngacttgctacttcttataattcttttggcagctgtgtttgtcgcccacgttattctgcggaacccagcgagagcacgcgggtgaagcgccacggaaggtgcgaaacctgtgtcggagattttggatagccccggtcccgccataatttgacggagaatctgttaggtttgggcagcagcacaccactccctcccagcggcggagttcacgaacaggtcgaggccactcacaaactccagatttagattatcagtttttacagaaggcaaccagcgccatgctgagataaatctggcgagggatgtgtttgcgctccctggtgtacgtcggagagttgatagtcgcaaggaggggatgcggttctgctggtgcacgttgtggccggctcgagttgcgcgcgaccatcacggnnnnnnnnnnactccctggtgtacgtcggagagttggtggtcgcaaggggggaatgcgtttctgctggtgcacgttatagccggctcgagttgcgcgcgaccatcacggtcatatgactgtgagagtctagcgcatgtatctatgtgtagagtggaggaggtgtcgctgggcagtattttttagttggcagtgggtgcacacctaatgcacatgctagctggccattcaaattcaacctcctagtcatcctcctggcactcacgtgnnnnnnnnnngtgattgtgagagtctagcgcatgtatctgtgtgtggagtggaggaggtatcactgggcattactttttaactggcagtgggtgcaccccctatgcacatgccagcccgccattcaaaatcaccctcctagtcatcctcctggcactcacgtgtaccccgccatgcgctctcggtagcactgcatgatgacctccgctcgtcgcacggggaggtcccccgcgttgaccctgagcatggtggcctcgtgcactctgcaccaggccgggcaggggtggggttgctgccatctgactcgtcctctcaccaggaggctcccaggtcttcaggtcgatccagcgcttgacaggcagtaccagccacagcactcagtgcagccccctttcaccccggatcctttcacactccgtccttgttgccaccccgacgccccacctctggatcatggtggcnnnnnnnnnntgggcaggttccccgcgttgaccctgagcacggtggcctcgtgcactctgcaccaagccgggcaggggtgggggtgctgccatctgactcgttctctcaccaggaggctcccaggtcttcaggtcgatccagcacttgaaaggcagtaccagccacaccactcagtgcagcaccccttcaccgcggatcctttcacactccgtccttgtgccaacccgacgccccacctctggatcatggtggcnnnnnnnnnnnnnnnnnnnnnnnnnnnnnnnnnnnnnnnnnnnnnnnnnnnnnnnnnnnnnnnnngatgcacatccaatgtgggtggctgacgggagagtgcaggggctgcctcctgtcgacgcatgcctgcgccccagcccaaccacccttccccccccaagaaaccaaaaccaccgacctggctccgcccagaccacggcggtgttcagccggccgtacatgttgtgcacggagcccatgacctcctggtagaccccggtaaggaacatggccaggcggtagggttcgccctcgcgcaggtcgtgcaggggcaacgcgcccgcggcgcccaggccccccggccccgcaaaccggtccaggcggccgtcggagtcgcaggtgatgtcgcccagggtggcctgcacccgcggctcctcacccagccgggccaggggcatgacggggaacagctggccgatgccccacgcgtccaccgccgactggaagacggagaggttcacgtggtagaggcgcaccccgggcaccgcggtgggttgcagcgcgtccggcagcggcagcgagtgctcccccgccagcgtgcggatgcggtcgcaggtggcgtcaaacatgacgtccacgcgcgcgcgctccaccaggctcagcacgcccagcttgaaggcgcgcagcgcgtcctccttgaagtagcaggcgtcggagtaggactcgcgcagagagaaggcgtctgtgtggggagagtgctttgggtagtggagggcgggaggggtttgttgggtttgctcgccgtccagagttgagggtttggtgtgtgctcttccacaaagcaattcggagcgtggttctcgaatcaacaaggatggatacatgttcccatgttggtgggcatccaggtcgctcaggcacgagtgcaggggtcatggcaagcgtggttcaaaccccccttttcacacaaacacgcacacatgtcctcctccaagaaaccacccgcacccgcggtaatgttgtcaaacacctccttgaaggtggtcagtaggtaccgccccttgccccggctggcggcggccttcagctgcttggtcagcggcctgtctaggctgaactccacgctgtccaccacctcctcctcctcctcccgcagctcctcgcagcggacagggtggttgaccacgtcgaacaccaccaccgtggcgtgggaggccaccgcccggcccgactcggagatcagggtggggggcgggatgccgcggtgcacgcacacctcctgcttgcgtttgggccaaggaaggggggaggtggcttgggtagtaatgtccggaagggttggggaggaagcaggagatgcaggcaggggcaagaccaggccgcccacgacgacgccggcgaccagggacctcccgagcatgtgttgtggtaccccccgccactcccattccctgcttccacccgcctgcatggccgatacgnnnnnnnnnntgtttggggcaaggaagggggaggtggctcaggtgataatgtccggaagggatggggaggaagcaggagatgcaggcgggggcaagaccaggccgcccacggcgacgccggcgaccagggacctctagagcatgtgttatggaaccccctgccaaccccatttctctgcttccacccgcctgcatggccgatacgatgtcgttggcgtagctttgcaggctgtaggccatggaggccgcagagtcggtgaaggagccgtcgtagtccacggccagcccaccgccgacgtccaggaagcgcagccccgcgcccatctgcgagcgggaaagggaaatgggtcgggggtggggcgacgggggcaggcagacggtacattgaaagatccaggggggcatcctagacatcaccgagtgagatggagtgtgagtttgtctctgcatgcacccactctgtcgtacaatgtcctgaggggcaactaatgctcggcaattgtcgtctcaccaacaccatgcgtgaacccttgcccnnnnnnnnnncaagggaaatgggtcgggggcgggttgacgggggcaggcaggcagtacatcggaagatccaggggggcatcctagacatcaccaagtgagatggagtgtgagtttgcctctgcatgcactcactttgtcctacagtgtcctgaggggcaactcatgctcggcaattgttggctcaccaacaccatgcgtgaacccttgcccagcgcgggtgtcatgggtcccctcacccacatgcgcaccagccttccccctccacctcatttcccgcacgtgccttgaccagctcagcgtagaggaaagacgcctcccgcatgacctctttgaccatgcggatgttggtgatctgggagcccacgtggaagtggaggagcaccaggcagtccagcatgcccgccgtggccagctccccgacagcggccacgatctcgcgggcgcgcaggccaaacttggcgccgtcccctttcatggaggtgggttgggtattggacggggtcgtggacagggagggcagaaggaaagcaccgctgcagaccactgcacatgagcgtgcggccgtcgaccagggcacagatcccccccatcaaccttcccggcggcgtgccagcgaccttgcacacctgaggtgctaccccagtggcccgagtgccgcgtggccagcnnnnnnnnnnggcaccgctgcagaccattgcacatgagcctgcgcccgtcgaccagggcacagctcccccccatccatcttcccggcggcgtgccagcgacctggcacacctgaggtgctgccccagtggcccgagtgccgcgtggccagcttggcccgaaccccaagccggggcctgacccccagcttggcggcgacgcgcagcgccaggcgtacctcgctgtactgctccatcaccaccacggcgttcacccccagctcgccggcgtgcatggcctggggggttgggcggaggggggtgggatgcttgaactgggaccttgttcagggcttcatgtttcaatgccctgcgccctgtaccaccagtggcaccatgcaggccgctgaaccgcagcctgcctcacggcaccacacaccagctccatatactcggcgtccttgcacccgttgcagatgaggttgaaggcggggcttgccgggagggggatcatgctcagggccatggtcagctcggccttggagcccacctccaggcccagcccatgcccgtgctcatgggaccaacctttcaagggggtgggtgggaattgtgggggcatgggaaagcaagcgagaacatgggcaagcaatgggaggagggctcgagtacnnnnnnnnnnttcatgggaccaacctttcaaggggggggggatggaattgtgggggcatgggaaagcatgcgagagcaagggcaagcaatgggaggagggctcgagtacaaacatcatactcctggcaggaggtgcccaaccatgcaaggccacccagcaccggcagatgctggcagtgaacagcagtctgcacccgcacacacgcccaaacagccgtgcgccactcactgtagtcgagcatnnnnnnnnnngaggccacccagcaccggcacatgctggcagtgaacagcattctgcacctgcacacacgcccacaaagccgtgcgccactcactgtagtcgagcatgccttgaaggagcaggcggtccgggttggattttacaggaaacacggacctgaagcatccctggcagcgtggaggatgggggcaaaggcgtgaactcgatgcgtgtatcgaacctggttgatacacgttggacagagagaaccaagggaatccccttcacccatcctcctggatgctgnnnnnnnnnnacatggaggatgggggcaaaggcgtgaagtcgatgcgtggatcaaacctggtcaatgcacattggacagagagaaccaagaaaatccccttcacccatcctcctggatgctgcaaaccagcttcgtagtgctagatggacagaccggccccgttcctcccaagactctcgcacctgatactcgaagcgttcgatggcagctctgaaagcgtcctgggaggtgtggaatggcgtgtagaatgcagatggttgaggaaggtcatgaagtaatgacactgatgagtagcgttgtactcccactactcactccacccacggttgtggtgaacaacccgattcaatccacaagaccaccctcagcatcgggattcaggcctctcaaccgccgtcgcaccctcagtttctccaggcggtggcatgcaatggacgggaagcggaggaggaggggaggcagcaagccgcgctccttcaggtgttccacaagctgcggcaagtccaccgccgggccatcctctgcagcggcaggagnnnnnnnnnncgccagcacggtcccatttctgttaaccctcacacaaattcatgttccccctgtccgtagggctgccctccacgcccacctcccnnnnnnnnnngcactggggctgggtctcaaactgcaaaccctggacttgtcttcattcagcagagccagcacggtcccatttcagccaactctcacacaaattcatgttccccctggccgtagggctgccctccacgcccacctcccaaagggcggatggccaggttcccctcctcggcaatgtcgacatagccacaaccccatccatcgacgttgtaaagcgcccgggaggcctcggtgctccaggtggatccctcccggcccagcgccggcgaaagccctagctggcgagcctgggaggggctgcgactgctctgaagatcagcctcactggtcaccggcttgaagtccaggagcaggtctccactggacgcggccgaggtggtgtccaggtcatagagctggctggctcgtgaggggtagccacaacccgtggactgtaacttccgctcgacccctgcagcacagtccatccgacacaccagagggctggattatcccgctgcccaaattgagtttataatgccaaagtatatagcccaatggcgaggattgcagcagctgttcgcgacgttgacttccttgcatcggcccgccaccccacgggggtagtgcccgatgcatcttgaggcgcaaatgttaaacggaagggcaggatgaaaagattggccgaaacaacagtagactgaatgggactgtaatgttgtgtttctcgatgttctcgtataaaatgcatgtttaaaggagtcgtgacgtagactgcatgattgagaattgcgtgggagagtgttctttcccttgaacctgctccagcttgcatatgtgctcacgatatatattcaactatcaactctatacacaatcaatacgtcgagaaacaattgatgcgattgggtgttcctccagcagcactgacctgattcgatgggagctcggcagaggggtttctccctcatttctttcgtcagcacaagtgttggaacctggtaaaatctcacctggggacgtgccacgaccccttctcaaccattcctttcagctcaaattcgccatcttccagaccttctgacaacatggcgcgcaagttcttcgtcggtaggcaagggtcttgggttttctgatccgcttgccgtcctcctgacaccgaagctgggtgcccatcgcatgatcacctcttcttgcccattgattgttctcaggtggtaactggaagtccgtgagttgatcggagcaccgagtgtccgtgtggcatgaggctgtgccggggccctgctgaacagggtcgcgtagccgggttggatcatgctcatgggaccgctgccctggactaaaatcagcaccctaactcatcccaaccctctcaatctatcaacagaatggaacggtgaagagcgtgaaggctctggtcgagagcctgaacagcttcaaggtgcccggccccgaggtcgtgggtgagtcgtgcgcacccatccgtcgccatgggcgggcttctgaatgatacttggcatttatgctcctgtctcgagttccactcatgatgggtcgcgccagagccaaagtctgtgtcccaacccaggcatcccctacccccacccccctctgaaagatgtcgtggtggcacccaccttcctgcacatccccgccgtcgtggatgccctccgccccgagttcaaggtggctgcccagaactcctgggtcaagggcaatggcgcctacaccggcgagatcacggccgaccagatcgccgacctggggctggagtgggtcatcctggggcactccgagcgccggcacatcgtgaaggagtcggacgagctcaccgccgacaaggtggcctatgcgctgtccaagggcctctccgtcatcttctgcatcggcgagaagctggaggagcgcgaggccaaccagacgcaggaggtgaacgcccggcagctgcaggtgagggataccggggtcctgctggtatgggcagactggcaggtgtcagggtnnnnnnnnnnnnnngagcataccagaggctgcagtcgatgctcatcccccccacacacacttgtcaaaggaggtttgtccaccgctcatctccctactcatggacccccatccacacccaccatccgccatccacatccctgacccccactcctcgccaggccctggccgacaagatctccgactggagcaagattgtggtggcctacgagccggtgtgggccatcnnnnnnnnnnccgtctgtccatgggcgtgtggaatgctgtgggccatagcggctggcactccgggcatgcatgggatgatcactggcgcacagtgcatcnnnnnnnnnnaggaaatttggcattgctaccaatgtctgtctatgggcgtgtggaatgctgtaggccatagcggctggcacttcgggcatacatgggatgatcactggcgcacagtgcatcgggcctcaaacatcccagaggctgcagtcgatgctcatcccccacacacacacttctcaaaggaggtttgtccaacgataatctccctaatcatggacccccatccacacccaccatccgnnnnnnnnnnnnnnnnnnnnnnnnnnnnnnnnnnnnnnnnnnnnnnnnnnnncaggctcacgccgagattcgcgcctggctggccgagaaggtgggcaaggacgcggcggaggccacgcgcatcatctatggcggctccgtcaccgccagcaactccaaggacctggcgggcgcggccgacattgacggcttcctggtggggttggagtgtgttgtttgtgtgtgtgttgcggggagggggtgggagcaaagggaatttgattggatgtgctnnnnnnnnnncgttgtttatgtgtgtgttgtggggagggggcgggagcaaagggaatttgattggatgtgctgtgggtgggggagtgctcccagacgcatcatccagacggcgcactaaccgggtcgctgtccccgtgctggcaggtgggtggagcgtccctgaagcccgagttcgaggacatcatcaaggcggctgccaagtgagctgcctttacaatacccacttggcccatatcctgagcggttgttgtcaaagttttccgtcctgtggatcttcgtttctcgatacatgcgtgggagttcagggacgtatgcaaatcgatcggtcaggtcggggtgcagtcggttggtcgnnnnnnnnnnccggcccaaatcctgagcggctgttgtcaaagttttccgtcctgtgaatctttgtttctcgagacatgcgtgggagtttggggaggtgtgcaaatcgaacggtcaggtcggggtgcagtcggttggtcggtcaaatggttgtcactcagtgcatgtatgtgtgaggtatcggcaagacagcaagcaggcgcttcgtgcctcgcggtcgtcacacttgctcggtnnnnnnnnnntaaatggtcgtcagtcagtgcatgtatgtgtgagggtatcggcaagacagcaagcaggcgctgcgtgcctcgcggtcgtcacacttgctcggttgatggtagatggggtcaggaaagggtggccaaagcatgagatggaggtgtactgcagtgcctcttggtttgacagaaaccggctcctgggctcnnnnnnnnnntatggtagctagggtcgggaaagggtggccaaagcatgagatggaggggtgctgcagtgcctgttggtttgacagaaaccggctcctgggctcccggggagctggctgcaacatcccgtcactcctcgtgcccgtggagcgtgcagccacattgcgcctggccacccagaagcaagggcttcgtgtcgtcgtcgaccgcacgcgcctcggcgctcctggcgctggaactcacgggagcacaccgccctggcggcgcacccccgcccgcccggcggcccggcgccgccgccgcggcgacccgnnnnnnnnnncagcaagggcttcgtgtcgtcgtccaccgcgcgcgcctcggcgcccctggcgctggaactcacgggagcacagcagcccggcggcgcacccccgcccgcccagtgccccggcgccgccgccgcggccacccgggcccgcac

SEQ ID NO: 48709 - DNA, 71 bp, Chlorella protothecoides
cataccggacctcatcctcggaggctgtacggaaggaggtccatgtgggtgtgggtgtgagcttggagcgc

SEQ ID NO: 48710 - DNA, 65 bp, Chlorella protothecoides
gcagaggtgagggcgggctggtggcaggcgggcacgttgtgccgctgacctgcatcagtgactgg

SEQ ID NO: 48711 - DNA, 61 bp, Chlorella protothecoides
cggcgaagcgtcctcggggctgggagggggtggcgacgccaccgggctaggtggaggtggg

SEQ ID NO: 48712 - DNA, 92 bp, Chlorella protothecoides
ttcccctgcatgcccttcagccttccctggcgtaaaaccaagggtgtcatggtgccaccgctaggcgcgagctgacctccgagatggcgggc

SEQ ID NO: 48713 - DNA, 74 bp, Chlorella protothecoides
ggcatggggtcatcccatgcccacaggacagtatgcacaaacgccccgattcgcaccctggtcgggggtgatga

SEQ ID NO: 48714 - DNA, 65 bp, Chlorella protothecoides
tgacagccgcagcacacagctccccagacttagttgtgggagggtgcagtgtcaggcgcgtggga

SEQ ID NO: 48715 - DNA, 77 bp, Chlorella protothecoides
atgcttcctgcctgcatgagggaggcagggtctgtggaccggacacaccccgagccagccctgccgcacctgcagga

SEQ ID NO: 48716 - DNA, 131 bp, Chlorella protothecoides
ctggacgcagcgcagcaccgcctccagctgcggcaggggggaaggaaggggatttgggcttttgggggggtgggtttctggtcgatagctgttgagtcgcatggaatcggtgtcgcatgctgagcggaact

SEQ ID NO: 48717 - DNA, 61 bp, Chlorella protothecoides
cccagctcacccaaacgagtggcgggctggggcgctgtccttgaggagggcgctgagcgtg

SEQ ID NO: 48718 - DNA, 61 bp, Chlorella protothecoides
ccgtgctcacggtgtagatctacatgacacatctgcaccacccatacccctccctccgcaa

SEQ ID NO: 48719 - DNA, 61 bp, Chlorella protothecoides
ggaaggagacactctgcttggtggcgggggggacagcaatgctgtctgagatggggaccgc

SEQ ID NO: 48720 - DNA, 61 bp, Chlorella protothecoides
cggcaggtggggcggcgatgcgaccaggattactgtgtgtgtgggttgaggaggttggcac

SEQ ID NO: 48721 - DNA, 80 bp, Chlorella protothecoides
ggctgcgctgatggagtctggggcgcaaggcagctgctgcgtcgtggagctccaggtccagggcgccaggtgagggcatg

SEQ ID NO: 48722 - DNA, 63 bp, Chlorella protothecoides
agcgaggcaggaggcccccaacatggacgccagagacgcaccccagaccaccaacgcaacgac

SEQ ID NO: 48723 - DNA, 61 bp, Chlorella protothecoides
cggcgcagggtgagggcaggggggtggggacgggaggggaggggattgattcagggctcgc

SEQ ID NO: 48724 - DNA, 10671 bp, Chlorella protothecoides
  modified_base (1322)..(1331): a, c, t, g, unknown or other
  modified_base (2065)..(2074): a, c, t, g, unknown or other
  modified_base (2160)..(2169): a, c, t, g, unknown or other
  modified_base (3566)..(3575): a, c, t, g, unknown or other
  modified_base (3705)..(3714): a, c, t, g, unknown or other
  modified_base (3774)..(3847): a, c, t, g, unknown or other
  modified_base (3934)..(3943): a, c, t, g, unknown or other
  modified_base (4017)..(4026): a, c, t, g, unknown or other
  modified_base (4261)..(4288): a, c, t, g, unknown or other
  modified_base (4478)..(4487): a, c, t, g, unknown or other
  modified_base (4994)..(5003): a, c, t, g, unknown or other
  modified_base (6536)..(6545): a, c, t, g, unknown or other
  modified_base (6713)..(6970): a, c, t, g, unknown or other
  modified_base (7548)..(7557): a, c, t, g, unknown or other
  modified_base (7618)..(7627): a, c, t, g, unknown or other
  modified_base (7848)..(7857): a, c, t, g, unknown or other
  modified_base (8524)..(8533): a, c, t, g, unknown or other
  modified_base (8904)..(8913): a, c, t, g, unknown or other
  modified_base (9252)..(9261): a, c, t, g, unknown or other
  modified_base (9360)..(9369): a, c, t, g, unknown or other
  modified_base (9457)..(9466): a, c, t, g, unknown or other
ggggtcggcccgggtgcgcacggcgcggggcgacaccggggcgaccccgcgcggcgaggcgggcgacctgtgggcgccgggccctgacccctctccgctggtgccctccgtggaggtgcccgggttccgtgtgcgggtgtgcagcgcgggggaacccatgcccgcgttcagctcctggtgcaggcgccaggccagctcctcgtcagacagggagcgggccccgagcccagccagcgggggtgacggggcttcccgcgcgcccctcgttcgcaccatcaccatgatggcaggcctgggggtccgggggagggatggagcgggtgagccgaggggtggggtaacagacacaggggactgatcgagaccgcggcctgcaccgacctcccggcccgcttcagcgaaatggctgcgctcatgagacaggctcagattgtcggttcatgcacggagcgcgtgcaagcacgtccgcccgggccccgctgcgccagcgcctcacctgggatggctcgcagggtggtcaaaacaggttggcggcctcaaggccacctcctccgcggtttgctgggcagatagctgcactcactccaaaacatcaaattacatgcggtgctgaggcaaatcggtgcgagaggttgcccttcttgtcacgcaaggggttcaaacacccacgcacgacgggtgacccggcactcggctccttcgtgcccactcgcgagcgtgaaaggacatcaatatgcttctcaaacaatggcaactcgtaaagggagtggaaatgcgggccagtggggactaacgctccaatgaaccccccgggtctaaaaagtctcgggcgaggatatgcgcaggtattggcttcattcagttctggtccctcccagcgacacccccttcaatgtgcacgctcctctggtcccaaagcccattccacactgattcatcatgcctgacaacagagtacaccgagacatgccaattgcaatcttggctctgactcaatctgtgtggcccctttacttcactctggccaggcatgcagatttgcctttgcttcacccgcccccgggaaatggctttcatgtcaggatcctactcgcatgctggacttctaaggccatgtgttgcaggatacgcaagaatagcaccgaccagcactgtgatgaagtaatgcttcagccatggtgtggtggatgtgcgatgggctcctgcagcagtggaacccctgacaggagtttttatgttgaaatcctgctcagaaggtctccctcatagatcacttccctttgaatgtggggagtgctttactgttgtaccactcagtaccnnnnnnnnnngtttgggttaaaactccggtggatggaattagagaggattatggcagcagtgccgcccccccctctccctcatagatcacttccctttggatgtggagagtgctttactgttgtaccactcagtaccgtgcacgggggtgcttgtggtacccccgcgtctgactcgacgacagctgcacctccttagagttccaacgcgtaccgagagggagggctgccggtcataataccagctctctcccctgtgcacgattggcaacatggcgggcttggatcgagggggacacctcacgggcacaacccgcgtgtcgctcaaccaccgcgccttcggcgtccatcgcccacctcacgtgcggccccttgcgctgcatgccaaggctgaatctcacaccgagggtatccggcccaggttgcagcaacgtgccgacctgtgcgagcgacagctgtcctccctggatgtctccaccaccggaactggggagcctgggctgggcggcaacatcctaccccacgctcgtcccaggcggcgcctgaaggtggctgtggatgtggacgaaggtgcgtggtgtgaagagggacctgttggggtacgtgtgtgaggaagccttactcagatgttttttgtgggctcccgtcttcgtgtggcccggcacagaagctgaggcatacccatccaacccctcctgcagtgctaggtcgcttcctgcacagtctcaaccagttctgcttggagnnnnnnnnnngagggcccggtggggcggcgaatggtcggacgagaggtttgctgtgcatggttggctcagggaacacagggatgtgcaggagggcnnnnnnnnnngagcatggccgtgagtaccaggtgtctgactacttcctctacgactttgccaaggtgtggaagtgcagccaggaggcaagcaacgtcatggtgcacaacttcttcaagtcgcaccacttctcggctggcatccagcccattccaggtgcagcaaggaggggcgcgggaggcgattggtgacggtagggcccggtggggcggcgaatagtcggacgagaggtttgctgggcatggttgtctcagggaacacagggatgtgcaggagggcaggagagctgacatctcactctctccaaagtttcaccacttgcaggtgcgctgcagagcctgaagcggctgcagccctttgcagagctggtggtggtcacttcccgccagcacgtcatccaggaacccaccctggactgggtagaaacccacttcccccaggtttgtcgggtgtggtttgtggacaggagggaggagaccccggtcaagccgtgaggtgcgaggccgtcgacaccaacgacctcccaccccaccccacccccttcccaccccctgccgctccaggtcttcagcagcgtgcactttggcaaccactacgcgctggagggcgcctcactcagcaaggtggagatgtgccgcggcgcgggcgcgcaggtgctggtggacgacaacccacgctacgcggaggagtgcgccgaggagggcctgcacgtcctgctcttcgactgggagggcggctacccctgggccagcacgccggcagggccctcccacccgcgcatcacgcgcgtgcacgactgggcgggcgtggagcgggagctgcacgccctcagccgccgcctggcccaggaggagtagcagggtggcggcggcgggcacgcgctgtagctgagacgggctctgacaccacgtcggtgatggatgcccgagcgttgacccggcacatgccctcaacggacccggcccacgcctgctcactctccccctggcggtataaaactcgttacccgcgccccgtgcactctgaaattcggcactggagtcgaggcaccgggagaatgagagtgcagcagggtgccagcacggtggggtgaccggctgaatacgcaaatgtgcggaggccgctccagggtcgagagcagtgcgccggtctcccaggcacgctgcgacctcgttcaggagtggatgagcagcggggcggcgcaatgctccaggcagtagccgctgacgctgcccacgaagaagtcgtgcaggcggctgttctggcgggcggacagcaccaccagccccgcgcccagctcctccgccttgcggcagatcaccgcgccgatggagtcggtgtccgtctcgctctgggaggggagaaaagggggagggattcaatggttgcggatggggggacaccaacnnnnnnnnnntggtgatgaatgcccgagcgttgacccgcgcatgacctcaacagaccccggcccacgcctgctcactctccccctgtcgatataaaactcattaccaatgccccgtgcactctgaaattcggcactggannnnnnnnnntgccaatgtgtggaggccgctccagggtggagagcagtgcgccggtctcccaggcacgcnnnnnnnnnnnnnnnnnnnnnnnnnnnnnnnnnnnnnnnnnnnnnnnnnnnnnnnnnnnnnnnnnnnnnnnnnnaacggtgccgcaaacctgtgcccatgggccggagcgatgtgtgagccctttcaaacgaggaagaatactccgtccatgccaaccggnnnnnnnnnngacggtgcccatgggccggagcgatgcgtgagccctgtcgaaagaggaagaatactccgtccatgccaaccggnnnnnnnnnntcccgatcccagccgttcatgccaatgtctacccgccctacaccaacgagcgggttgcggcaccgaccctcgacctgaccgaaacagagcaccctgccaccttgatgaggtggagcatgggaggagggtcgacgtcgcccagatgagtcacgaccctggcagccaaaaagtcctgggcacgctgtaggagcgcctcgtaggccgtggagtcctgtggggattgggtgggggtcgnnnnnnnnnnnnnnnnnnnnnnnnnnnnctcacagacctgttgtggcaggaagtcgatggagggtgctccatactgtgaggagagctggagcctggggatgacatgcactacgtggtactcatcccctccctggtgcctggaaagtggaggacacaggcgcatgaccatatgtgatgggaggaacacggggatgcgagatccccctgttcacagcgannnnnnnnnngggaggacccaggcgcatgaccaaatgtcatgggaggaacagggggatgcgagatccccctgttcacagcgatcctcggtcgattacagcccaaaccccatgttaccacacacatttgctccaccgtgaacttgaccgctccttcacaggcatccgagtcgtccacggccagcaggaccacccggccagtcatggccctggcgcgtgcgtgggacaatctgcctcgatgatctacgcgaagcacaggctgaagctagtactggtggtagaatggtgtccacctgatctgtaccagagcactcagccccttttgtaggtcgtgccgtgccggtgaagtcgtgactcgagtgagattcaacccaggttctggcgcgcgcgatctccaccctcgcggggttgcgcatgagcatgtcttcatgacagcatcaccaagcacctggcgtgcttttggggcttttcatgacaatctcactccttcctcaagatgctggcgcaaactggtgtgcnnnnnnnnnngggggcttttcatgacaatcctgctccgtcctcaagatgctggcgcaaactggtgtgctgccgagcgtgaatgtcgggagctgtggaccaggcagcggccgagtcatgctcgcccacacagcaatggcctctgctttcagcctgaggtgagcaggagactgcatgtgcatcattatgcatcctattcttcgatgggatgccgaagcattgctatcgtttgcctccagggggcacgcatgatgcacatccgcgcacgggagtcgtgcatgatctcatcctccatgctcagcttctttcccccatcccacgcaagaccatcgccacctaggggacgtaggcctggccccagatcttcactgaccacctctgccagtatgcgcagcggactcagcatccagggtcaccagcccaccagccccgccggctgggccatcatcgtggactccctgcggcgcgccgatgtgcagctgctgagcccccaggaggttcagcatgccctgcaggctgggacccagtgcgtggtggatgtgcggctgcctgcagagttcgaggccgggcatgtttcggggaccgtcaacgtccccttcttcaggcccatctccgggtgggatgcggtcagggtccttcgcaggctggcctttgccctgtttggcatacgcacgggtacggagctcaaccccctgtttgtggaggaggtgagccgcgtcgccgccgactccagcaagggcatcatcttgatgtgtaacatcggaggcgtcattgaacactcaggtaaagatggtcgcgatgtgcagagtggggtcagctcgttgctgtggaataccaccatggcttgaatgatgggcgggctggcagttgcccaaagaggtggttccatgcccttctgataggtctgttgcatgtgaggtttcatgttggatgctcgtctgtctctcgcatagagcatccaccccaaaccctctcgcacgctatagccctcgaccaaagtccgttaattgcacgcactttaatgtgtcaagcgttctgtttatctccatcgctcagtagtggccttcatcatgccctcacaggctcgttcaaggtcggcacgcagagtcgttcgctcactgctgcccatgtgctcgtcgagtcgggcaagtttggttccatcaaggtcctgaagggcggggtcaatggctgggcggcatcagagaggccgatcgaagaaatgtgaagccaggtcctgactccttgtttacgaggagtacattcaatttttaggagactcaaccaggcaaatgtttggggagggattgtcagaggccctcccagcaataccaactgcttatttttaaaaatttgcaacccaatgcgcactttgaatgagaaaggagacttcagccatgttcacaatttgtttgggatgagacaccattgtggggaggggcagggttggacgcagggcacctcccaaacagctgcctgggtttgcgcgcgccgcagagattcgtcgttgtgcaccctgcagcaacctctacacgacgacactattcnnnnnnnnnnatttcgcatttgaggtttcatgtcggatgatcgtctgtctctcgcacagagtatccaccccaaaacctctcgcacactccagccctcgacccaaacctgttaattgcacgcaattcaatgtgtgaagtgctctattcatctccatcgctcagtagtggccttcatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctttgcaacccaatgcgcactgtgaatgagaaaggagacttcagccgtgttcataatttgtttggaatgagacaccattgtggggaggggcagggttggaggcagggcacctcccaaacaggtgcctgggtgtgcgcgcgccgcagagtctagtcgttgtgcaccttgcagcaacctctacacgacgacactattcactttcagcgtaacaatatcggatttcggcatattcagaaccgaatatttcccccctagcagacaacatacctgggagcggaactcgtttacaccgtgtggagcacccggagctcttgcaggacctcacgcacacaccgcctcccttgggacacagaaaggctgtgcgtcagacctgcaatggcgcgtcagggtgtctggcaattgcagaaactcgtcctcaactactgcgagttttccggcagcagccggggcgcgaggtgcagaaggatgggcctggggggcgaggggctagccttatgtttgtgagaatcggaagagatcctgcaggatgatggtatgtcagtggtaccaatgcgcactagcctccacccagcagagnnnnnnnnnnatcctacacggtaatggtttaccagtggcgccaatgcgcactagcctccacccagcagagnnnnnnnnnnggatgcgctgaagcagaagcagcctctgggtgcatgatcacacacagccatgcgaaggacagactttcaacggtgttcctgtgccggcatggaggacctgctttccgtgcagactgatccgacagtatgcttctactgctctacactgtgtttcagttctggttaccaaggttgatttttgcagcctggcgaggagctcaggcttgggaatgattgagagnnnnnnnnnnaacctagctctgctgtgggtacaaagctagaacttgctgcctcaagacccccacccccccttctccgtcccacaccagtgaatggtagagtgcggaccgtgggtctacgaaacgaagacccggacgagatcatgaggcaagccatcctactgcggagttccacggggcgtaaggcggcgctgcaggtgaagactcgccaggtcagcagaaacccaagcatccaaggaccctggactccagctgtgcaagatgcgctgaagcagaagcagcctccaagtgcatgattgctcacagtcatgcaaaggacagtctctcaacggtgttcctgtgctggcatagagggcctgctttccgcacagactgatccgacagtatgctgcttttactgctctacactgtgtttcagatctggttactaaagttgatttttgcagcctggtgaggagctcaggcttgggaatgattgagaggcagggtgtcagatcgcatgcacacgacaacccacgttccctgaaagcctgaaagggctcaagaacttggcacacctgtgcatcaagggatattggtcggtgtgaaggaaggcagagaaaggagatgccatctgcagcattacaccctcggcgtgtttcgaaagtatcgacagcaagcccagcaccatgaacctgcnnnnnnnnnnattccctgccagcctgaaagggctcaagaacttggcacgcatgtgcatcaagggatgttggtccgtgtgaaggaaggcagagaatggagatgccatctgcagcatcacactgtaggcgtgtttcgaaagtgtcgacagcaagcccagcaccatgaacctgccgcgagtccggcattgaatcccattgcgcgcagtgttgcacaccaaggtattgggaacattgatttaatgcgcatgccctgcaaggttcgccaggaagggccagaacgcctgggatcgccgcgatgaagaggaggtgcagctgggcccttcgactcagcctctgatgactcggataggacacccagccaaccacagccgtgtgatcctannnnnnnnnnatgaatcccattgcgcgctgtgctgcacaccaagttattggggagcattgatttcatgcacataccctgcaaggttcgccaggaagggccagatcgcctgggatcgccgcgatgaagagggggtgcagctgggcccctcgactcagcctctgatgactcagatagggcacccagccaaccacagccgtgtgatcctacacatcgattttgactgctactatgctcaggcacgctctgcatgcccccgctgcacctgctgtggcatctctgaggatttgcactgaatcccccgtttcatttccgacaaagcaggtggagcagaagcggcttggcatcccnnnnnnnnnnacccccgctgcacctgctgtggcatccctgaggatttgcactgaaccccccgtttcatttccgaccacgcaggtggagcagaagcggcttggcatcccnnnnnnnnnntgatgctagcctgccaggagggctcacgtccggctccatggctgtgctcatgccacccccacctttcccccacactttcatcgctccnnnnnnnnnnccgtgacaccccctgcgccgtgcagcaatggtgagcatgcttcgactgcctcctgaggttgggatgctagcctgccagggggggtcagccagcatcacgtccgactccatggctgtgctcatgccactcccacctttcccccacactttcatcgctccccacccgccagggagggcctcatcgccatcaactacgctgcgcgtgcccggggcgtcacccggcacatgagggtgcatgatgcacgggccagggtcccagagctggtgctggtgcatgtggaaacagtgggcgccgacgcgccgcatggcgccgacgccggcgtgggagccgatcccgccaagggagccccggctcccaaccgctcgacgcagaaggcctccctggagcgctacaggtctgaccctggggctggcggcggattgtgtgatggcagtactgcagcctgtgattcaacagggggtccccccaccccccctgtcccacattccaccctcccagacgatctacggcagaggtcctgaccctgctccatgcccagcttccgggggcggtgatcgagaaggcctcgatcgacgaggtctacatcgacgtgacggcagaggtggagcgggcactgagtcggcacgaggcacatgggggcctcctcccagaggcagacagcgtggtcatcggtgggcccctgaaccccggctcggagttcgagcggcgactggggcagggggcagggctggcggcccggctccgcgccgccctgtttgagcagctgggtgagctccgggtatgggcacggaggccgagaggcgactggcactggcgctgccaccatgaggttgcggtgcagatcccggtgcagatcccgctcagccatcagcaagcaatgatcacccccggacaccccttgcacaggctacaccagctcggctggcatcgccagcaacaagctgctggccaaggtggcatctgccatgaacaagcccaatcgccagaccatcgtcccgccccgcgccgcgctgtccctgatgcaggcgtgacagggggcttgggtgcgatttagtggtggagggaacgagcgagggcggcatccacctcggcagctggtgcccctgccttggcatgggccagcacatcgatgagcacaagcagagttgcttcccagccagcgctgatgcgattttcccccctacacacagatccccccccccccc

SEQ ID NO: 48725 - DNA, 73 bp, Chlorella protothecoides
ctagatgagggtggtggcgacttcttggcgagcggcggcggatacttcttggcgggcggcggcggatacttct

SEQ ID NO: 48726 - DNA, 6104 bp, Chlorella protothecoides
  modified_base (773)..(782): a, c, t, g, unknown or other
  modified_base (1546)..(1555): a, c, t, g, unknown or other
  modified_base (2724)..(2733): a, c, t, g, unknown or other
  modified_base (2823)..(2864): a, c, t, g, unknown or other
  modified_base (2942)..(2951): a, c, t, g, unknown or other
  modified_base (3183)..(3192): a, c, t, g, unknown or other
  modified_base (4020)..(4029): a, c, t, g, unknown or other
  modified_base (4110)..(4119): a, c, t, g, unknown or other
  modified_base (4207)..(4216): a, c, t, g, unknown or other
  modified_base (4512)..(4521): a, c, t, g, unknown or other
cggcccccgccgcagcggctgcgggcgaggccgccgcctcggcctccgcctcggcctcctccgcctcctcctcgccgtcttccggcagccgctccacccgaaagtcggggttccccgcgccctggccgatggcgcgctccgcctcacgcagaccgacgtggcgcggcgccagggtcttggggctggtggcgggccaggtcagcccggcggtggccgccagcgcggcggcggccgccgccttgctcgcaaacaccgagtagcagtgcgtcttgatgctgggcatccacagcgccttgagctccgcgccggtggggtccagcagctcgcgcaccgcacgctccgtgaaggggcgcacgaagccatcgatgcgcagcgcgcgcgtcgtgctggcagtgaccacgccctcggcagccggtcgttcggcgcgaggcgccttttgcaggggggcagcggcggcggcgggcgcgtcatcgtcgccacgcggccgcttcccgcttgttgggacggtgccggggctggcgccggccgcggcagcgccctttgtgcggacgctggtcgccgccgccgcggcagcagcggcctcggcctcctcctcgccgtagtcgaggtccaccacctcctccacgagcgatgcggcggtaggggcctcaggcttcccagccgggcttgctgcctcgggcacagggtcctctttcgactccctctcactggcgccagccaccgcaggcgtctccgaccccgctccaggcgcagccggcgcctctgccccgtcnnnnnnnnnngctggcgccagcctccgcaggcgtctctgaccccgatccaggcgcagccggcgcctctgccccgtctctgttggccaccggcccactctcctcgtctgcggccacggcctcctccgcgcccgcccctccatcctgtcctgccaccgcagcgcccgacctgtcttcgctgtgcatgctgccatcgcccttggccgggctgccatggccggagctctccacgggcacagcctcgtcgtcgctactggtgaagcgagactcactgccgccatcctttctgtcggcgttatcgtcctgggaggcctcgtcagctgctgcatccttcatatcctcgtcctgtggctcggccccttcgtctgcgctcttcccgtcagaggcggcatcagcaccctgggccagcacaggggaaatggggtgaatcatacaactatctctccgtgccactctccaccaaagctactgagaaaccgcacgcagcagttatgtatctaaagctgtacttatcatcatctcgagagcggaaattcccgcataggcactgcacgcagcctgtccatgagcacagccatccagcgcgcccatcaccccacctcggcttctttgaggaattcctccaagcgctcgatcagctcagctttctttccagtcacatgtagatctcgctttttcagctcgtccttcagcttggcaacggtcagctcgtgtacccagtcagttgacatggtgcctctcggtggggtgcctccacgacccagcacaggggaggnnnnnnnnnncacggtcagctcgtgtacccagtccgtggacatggtgcctctcggtagggtgcctccacgacccagcacaggggaggagtcgctttctgaacgtccagagggggatttgttttcgtgatggaagcgaccaagcaatcaattgcagctctgacgggcgtcgggtgggcctacaggcacccatcatgcctggggcctgctcgcgatgccatctcagcacagcagagttttccggggacgaactctgcagcctccaccccccagcttgggtggctttagcccctggtgctgcctgatcatctccttttcgacgtgaggacggctaattgttagccgagcgtcgacgaagcaaccatgcagatcttcgtgaacaccggtgagtgactggccaagactgccggtcccgctgcgtcctccgcctgtacgtgccctgcttgcccactttcgaccacttactttttaaccacctcttcatcacctcctctgacagaccgcactcatgtgctggagcttggctccggcgcgacggtcgccgacgtgaaggccgccatcgaggcgcgccagggtacgtatggagcgagtgcaggttacgcgccgcgaggctggggctcctgttcgccagcagcttcaaggagatgtctacagtgtgcgaaaacgtccgtccctcctccctcacaggagtgtgcgctgcggagcagcgcgtgctgttcggcgggcaccagctggaggatgggaccgtcctgtccgaggctggcgtcagcgacgactcccagatgtacgtctccctgcgcctgctgggtggtgccaagaagaggaagaagaagacctacaccaagcccaagaagcagaagcacaagcacaagaagatcaagctgagggtgctcaagttctacaaggtctctgattccggcaaggtggagcgtctgcgcaaggtgtgccccacctgcggcccaggcatcttcatggccacccacttcaaccgcgtgtactgcggcaagtgccacctcacctatgtctacaacaaggacgaggagaccgcttgattgcccggtgaccctcggccaatggtgtaaacgacggttggcagatggcaggaagaatacagttttgaacaggcagcagcgcaaaaggggctgcagagtgtgaatggaaaggctaggagctgggggggnnnnnnnnnncgtctacaacaaggacgaggagaccgcctgattgcgcggtgaccctcggccaatggtgtaacgacggttggcagatggcaggaagaatannnnnnnnnnnnnnnnnnnnnnnnnnnnnnnnnnnnnnnnnncgcaggtgtcgggaatttttggggagtcactcctctccgttgccattgcagcaacgcatgcacgactgcgggagagtnnnnnnnnnngttgtatttttgtgccccagccgtggtctccgcagggtgtcgggaacttttggggagtcactcctctccgttgccacagcagcaacgcatgcacgactgcgggagagtgacgcagaacctcgacatgggttggtggaaggaagatccgcgctaacatggtgcagtggcgatatgataattgacgctagcttgtactctaaacaccccggcctctcgaagccgtgatggggannnnnnnnnntgcagaacctcgagatgggttggtggaaggaagactcgcgctaacatggtgcagtggcgttatgattattgacactagcttgcattcttagcaccccggcctctcgaagccgtgatggggatccctgcggccctggggagcatgatccagtcgctcagcacatatcaattggcatggggaatgatcgccatggcagggttggccgcggcgttgcttttgggaggaatcgtggccccgtacggcaggtgaattcgtgagccgggcaagcccctgccctcactggcgcatccgggccggtcacagtatcccaaagaccacagtggtccacacaaacttcccatcacaggtacagcagctctgcatggggtcctctcattcctcctcggctggcatggctggtgagtgctttctgatgtacatgtgggagcttctccgccggtcatgaaggggcaacatcctgtaacctgcagcccatttaccgtcatgctcctgacctccacttgaggaagaccacaggtggcttcagatcagccttacgtcccccatgcagacgcaggagatcttgagcctggccatcccggtggtctggctggcggcatttgccacccaggagcagcgggcgagggtatccgaccccgtgaacgcggccctcatggccatgttcctcgtgcactacatacacagggacctcatctatcccttccgcattgtgccgggtgggtgcggaccggggtcctcccgggccccacggggtccaattggctcgccctgagaaagttgcagcagggattgatcaaccccccgcagccatgatgatgaggatgagcnnnnnnnnnnatggggtcccattggctcgccctgcgaaggttgcagcagggattgatcacccccccgcagccatgatgatgaggatgagcnnnnnnnnnngataactctgtatgggtgatggccagtgctcattctctaccctgtcgcgtccctggccccagcaggaccacactctcctcccacgcgnnnnnnnnnngcatgccgccataccccaacccctggcccccacttgcaggcaaaggcaccccactggctgtctggtccatggccgcaggcttctgtgcgtacaacggctaccttcaggtgctagtaactctgtatgtgtgatggccagtgctcattctctaccctgccgcgtccctggtcccagcaggaccacactctcctcccacgcgcaaccccaattctccacccagacccgctacctcctagaggaggcagcgatggggcgcgccatcagccccaccttcctgctgggcgccgcgctttggnnnnnnnnnnggcgatggggcgcgccatcgggcccaccttcctgctgggcgccgcgctttgggcgctgggctggggcattaatctccactccgacacggtgctcatccgacagcgtggggggcgcaggaagggctattccatcccgcagggcggcctgtttgccctcgtgtccgccgccaactactttggtgaggtggtggagtggctggggtgggccctggcctgccgctccctgcccgccacagcgttcgccctgttcaccaccgccaacctagtcccaaggtgtgggggggcgaggaatggaagggggaaaggagagtggcagtcgtcaacatcaggcatgcacaggacggggggtgggggggttgggggccagagaatcctttgtctgtccggggctgtgctttacgggcctcaccatgagctcttagtatgctggctgcctcgaggtacacaagctcctgcaccaccactcccagcggagtcttgatcatgcgatcagaactgcccgaggagcccatcgactcggtccactccttctccttctgcgcagggcactgcatcaccacgcctggtaccacaagaccttcaagacgtacccaaagcagcggcgcgccatcatccccttcctgttgtgatgtcgtgtttagtcggtcccggccgtagtacttttgtcgacatgtgcatgtctgggacgccacagggtgtcaggagagctttccaagcccagcaggggctccgattccttctcagcctcgcacaccatgcgcacacacgactgctactacaggggcccacactcagatgcgcggtgtgggtgcggacgacggtcctcaggagggggacctgggtgggaagggtggccggcctcgcaagcggcgggcgacaggcagcaatgcaatgggctcaaaggcggggcgagcaacatgggcttatgacgggggaaaggagggagactaagaatgatcatgccacagacgggggagtcgtggaacctgcgggccatcgtgggcgccgagaggtggggcagcgtcgtgctgctggcgcgagggatcgtcgctggtggggcggggggacgggcgccgatgccggccggccaggcgcagacgcgcgcgaggctggcgcagcgcgcaggacggcacagcgccatcagttgtcgctgcgctcagccctcccgctgggccttcagaggccgcccgcgcggagcgggctgtgcgctcccaggagctccaggcccagcccgtccagcccggcaccgacgccgtcgttccagcccccagggacgaacatggcggtcctgcggcccgacatcaggcgcggcggggtgatgcccagggccgaggccgccgcggcccacaggtcggcgtcgcagtcatcgccgcggggcaagggcccctgcgggccgggggacagcgccagcgccatgcccgggtacagcggcacgtgggccggctcgccgccgccggccgggccagcgtccgggtggcaggcaaggccctcgtccacggatggcactgagcccagcaggctgcgtggcgtgcccggcgtgtcggcgccgccggcccgctgcgccgcggcgatctcgtctccgg

SEQ ID NO: 48727 - DNA, 61 bp, Chlorella protothecoides
catccagcagggcgtgcacgaaacggcgggggggcagctgcaggaccggggacagatgaag

SEQ ID NO: 48728 - DNA, 70 bp, Chlorella protothecoides
cacgaggaatcctgctcccctggggaggccgccccgcaatcaggcgtgggggccgctgctgcgtcccccc

SEQ ID NO: 48729 - DNA, 115 bp, Chlorella protothecoides
cggagaggtgacatgtgggtgcaagaagggttggtctgaagggttggaggcaggattattttgcaattccccttaggctatctacatgcagacaggtgtccagcaagggcttgag

SEQ ID NO: 48730 - DNA, 61 bp, Chlorella protothecoides
ccatgctggatgcccctgtgtccggcggggtgggcggtgccgctgccggcacgctcacctt

SEQ ID NO: 48731 - DNA, 61 bp, Chlorella protothecoides
ctgggggcctgcgtgggcagacattggcgggtgtgagaagaaagtagaggaggcaagcaac

SEQ ID NO: 48732 - DNA, 80 bp, Chlorella protothecoides
ccgggcatccccgctctatcatcaccaggagccccagctgtggcaatggcgcccgctgcagcgtcaggacctgagcaagg

SEQ ID NO: 48733 - DNA, 11256 bp, Chlorella protothecoides
  modified_base (83)..(92): a, c, t, g, unknown or other
  modified_base (1154)..(1163): a, c, t, g, unknown or other
  modified_base (1237)..(1246): a, c, t, g, unknown or other
  modified_base (1327)..(1336): a, c, t, g, unknown or other
  modified_base (1462)..(1471): a, c, t, g, unknown or other
  modified_base (1887)..(1896): a, c, t, g, unknown or other
  modified_base (2267)..(2276): a, c, t, g, unknown or other
  modified_base (3391)..(3400): a, c, t, g, unknown or other
  modified_base (4828)..(4837): a, c, t, g, unknown or other
  modified_base (5106)..(5115): a, c, t, g, unknown or other
  modified_base (8113)..(8122): a, c, t, g, unknown or other
  modified_base (8472)..(8481): a, c, t, g, unknown or other
  modified_base (8997)..(9006): a, c, t, g, unknown or other
  modified_base (9999)..(10008): a, c, t, g, unknown or other
  modified_base (10532)..(10541): a, c, t, g, unknown or other
ggtcaactcccccgcgccgcggaagcaggcgccgcccgtgcgccgcgcgggtggggcggcctccaacctgggggccaagcgcnnnnnnnnnncccggcctccaagcggggccagggcagcgcgctcgccccggccagggcccccagcgccagcgtggtggtcgtggaggacggggagtttggcgcgtccagcggcgacgaggaggtcaactcccccgcgccgcggaagcaggccccgcccgcgcggcgcgcgggcggggcggcctccaacctgggggccaagcgcaagcccgggcccgcagccgccaggaagctggccgtgccggaggcagaggaggcgccctcccccgtggtcaagcccaaggtgagagtgtgtgtgattgggtatcgtgtctcgggtgttgagcctggagggcatgctgaatgggaaggtatgcgtctcatgtcgagatgagggacctgcccccctgtgacgccctccaaccctttccccccgccaggtcgcacgcatgcggcccagccccttccacaagggatcaggattgggcaagagcagcgcggggccctcccccttggccaagggcaagcccgccgccaagaagaagcaggtgcgatggagatgactgtttggtggccatttctccgttggtggaacacagggcccgcgcccctcatcacggcgggtgagggatgtgtccagcgctcctccctcaggcatgcaattccgcgactccgcacccccgctcgcaggcgaacagcgagtccgaggcggagagcgaggacggcgtggaggtgggcgactccccggccgccgcgcccctgggcccgagggtcgctgccccccggcgccaggccgccgccaaggcgacgcaggcaaagtacaccgtggatgacgacagcaggtatgagttgctcgtgctggagcagggtggtgatcgctgacatggcatggtatgcagccacacagagcgacatcaggctgggagggtggatttccactatccgcgttggatccatggctccagaaagtgatggttaaaccttgcccgcgcagcgaggccgagtctgcttctgaggccgaatcggaggagtatgtgccctctgactgacgggcctggagaggaggagtgaaatgggtggggccaggcccgggcnnnnnnnnnngtcggaggagtatgtgccctccgactgacgggcctggcgagggggagtgaaatgggtggggccaggcccgggannnnnnnnnnaaacgctccggtgcgctccagcagcgacgccacgctcgccgcctgctcagcccccccggactccagggccaggaagccccnnnnnnnnnntgagtgccctagtccctcagaattttcctttagtggctgagacgatgccccttgctgatgcaaagatttagattctcaattggtcagtcattatcggtatgagttcgggtcgcaaggatgaagcgnnnnnnnnnncgagtgccccagtccctcagattttccctctagtggctgagacgatgccccttgccgatgcaaagatctagattctcaattggtcagtcatcattggtatgagttcgggtcgcaaggatgaagcggtccttgcctgccaggtcgggcctgatgtgaacgtcagagaacgctccagtgcgctccagcagcgacgccacgctcgctgcctgctcgccccccccggactccagggccaggaagcccccgggggcgaggagggcggaggcaccctggacaatgggctcaaagcagtccagggcggcacccactccgccgtccagagccagccagggctcgtgcctgtggccaggggggtgtggggtgcacaaggggcatggcttggacgaagagtacgctcccagtagagagtacctctnnnnnnnnnngctccgccgtccagggccagccagggctcgtgcctgcggccaggggtttgcacaaggggcatgtcttaaacaaagagtacgctcccagtagagagtacctctgtcaggcatggcgaggaccacaccccactccgtaacccctccacctccccccctcccaaccaacacacacctggcgacctcggcctggagctccggcaggcagtggctgggaatgtagggcgggttgctcaccacccccccacacgccccggccaggtccggcagcactggctgcgcccaggacccctgcacgacgtgcacgctgtgctgcagtcccaggcggcgcacgttggtccgcgccgtcgccgccgctgtggggctcaagtccnnnnnnnnnnccagtcccaggcgccgcgcgttggtccgtgccgtcgccgccgctgtggggctcaagtccacggcgtggacggagcccggcccacctttgagcctcgccagcccgcaggccagggccccgctgccggtgcccaggtcgacccagggccgcgcggcgaggcgggcgtcgcggcgcagcgccgactcggcaaagtcgatcagcaactcggtctccgggcgggggatgaggacgctggggccgacggccaagaccacgtcacgccagtgcgcggtgtgcgtcaggtactgcaggggggtgcgctcctgcaggcggcgggtccacagcgcggctgcggcagcatgtttgcaaagttgggaggaggcgagtgagagaggatctgcggagcccatggctgggcttgagggaggggctcgcccaatgcttccatgccagcatggggcatgcctgatggaacagggtcaagccggcatgggttgctcgcacagtgtcccaggcctgcactggacagtccctcacgacaagactgacccagctcgtcgacgctggcccggagcctccagggtagcaagtgcaaaggcatgggaccttcaccctgcagccagctgagctcatgccggccgattgcctgccagtccctgctgacggcatcctcaaggcaacatgcatccaggaatagccagcccagttctgtctgtggaggtagggcaggggatggaatgcctctgcatgcttattgaatgggcctgatcgtgaagctgatgcctgctcatggctccatgcagcattggtatgcgcaaggcattgccatcacctgcaggtcttcaagactgggtgcatcattgccatccaagcgcttcagtgttgctgcctccatcgtagccgcagcgagttctttaaaaagggcttgtacaccctctgcgctagtctcgtggcaggcctggagctcacacagagggatgggcacttccgtggccattggagtgctgttgtgttgcatcgccgtcgaggaaagcctctgtctccttgtgtaaagtgatgacgtcaggcaccttgtcatgtgtcgccgaggctcgaggctacgaccgcaaggcactcccaggaggaccggcgttcctnnnnnnnnnnctcgaggaaagcctctgtctccgtgtgtaaagggatgacctcaggcaccctgtcacgtgtcgccgaggctcgaggctacgaccccaaggcactcccaggaggaccggcgttcctgtaagagctgcccatgcatgtatgccgcgatgcagaaagttgaatgtgcgattcatgtcatgtatgtttctataaaggcatgcaacaacggtgccacttatcaacgcggcaggcaagccgaaggatattgtatcatagcagggactggcccaccggcaggaagtacaatgaggcgcatagtccgttattcgcgccgcgaatttgacacatgaatgtatccttaaaatcggcaaagcgcacagaatgtgatgcgagcactgaagagcatcgcactcatgcatgcgatgcgtggtgcgctgttggaggggttagtttcaatttctcatcgcgctgccgagcaaatgaagcgtcacgaatcgtcacaccaacccatcgcataccttacatcgaactttattcgaccggttccagccccatgtcctcgccggacgggccaggctggctggacaaattggcagagacaagggccggcaggcacgccgcaggagccttgcagtctgtgcgaggcgcggatggcaggcaacacgtgcggctacagctcgcgccattccacacctccagcagcagagcggtggtgacgtttttgctgcaggagttcacggctcgcgggggcggatcatccctgctcgcacgatctgtcagcatctgtctggaggacgactgcgcccgcgatccgtcatcaggcctggccatcaccttccacaacccgggtcccctgaacctcacgcatgatcaactgcgtcgtctggcgaccagattcgaggcgtacctggactaccagagcaaggccggcaaggctgccctcaactcacgcatgcggcggcactgctccacattccagaggcagttgatggcggtggagcagccgccattcacacaaggccgtggagaacatggatgtttgccatgaggagcagcttaaatggggtgcactcccaacttaccctcgactgactgactgaccaactggatgagtgacggacccacagtggagcatactgacatggcatgcaatctacaacctgagcttacaaatgtatacaaggcagcaaacacggttagcggagccacaaggtgtcatgaaagggcatgggatggtgcatttgtgagaagcagacggttcgctcagctacctccgtggtgcaaaccccacagtgccggcgcccagtgttacccccaccagaagggtgatgaccatgggcaggtaagccctcacgtgatcgagaacaggcgccttgcagttccgtggcgcagctggtgaacagccattcggctttgatgcacagactagcacatctttttcaaccatggccnnnnnnnnnncgatcgagaacaggcgccttgcagtgccgtggcgcagctggtgaacagccatttggctttgatgcgcagactagcacatctttttcaaccatggcctcggcgccacgctgttcatgtgggacgttgaggtcgtccaggagctcgtacggcggaggccgcgcgtcgatcggccggccggctctgaccaccaggcggtcgtgctgcggcgaaaaggtgattggacagtgtgtaggggataaggggaatgagtctggggcgggcacggcatnnnnnnnnnnccggtcgtgctgcggcgacaaggcgattggacagtgtgtaggggctgaggggaatgagtctggggcgggcacggcatgccgtggaggagaccctgacgttccagccaccgacccagccgacggctccgccggcacactcgatccaatcacgcgccccctcatccctcacctgaggtcgggacatgagctcgctgtagcatcgccccctgaacaccacaaagtcggcgcttgaccccgggcagagcgtcccatgcccctccaaccccatggcctgggcggggacgctgcccacgctgcgtacccaatcctcgtaggggcggtccaggtgcgccatgcggcagccctttgtgtatgggggggtaggtgggtcagaggaggctacaagggatcgcggcatgctgtggagtctgattccctgcgcacacgcggcgcggcgagggctcgctgcctccgtctgcctccggagactgcagcctcgctgcgcagatccccaccactccgcactctccaccccccaaaccccacgcaaacccacctgcacgaagacctccagcatgtcgaggtcgccgtaggcgtagaactggtcgcgcgtattgtctgaggcgagggccgccggcacacccgaagcccggatctcgtgcatcagcgtcaccccgcgccagcgtggggtgacgcccaggcgccggtcctgggtccactggttgaccagggggagggagacgatggtgatgcccgcgcggcgaaccaggtccagggtcaagtccaggtcggcctgcgactggtaggccagcgagctggaggagggcagaaggaaagtggggtgttgagatactcagtgcttggtccaccatgtgaaggggaccctcggcagcctcaagcacttgcgggcacgctgatgcatgggtggatgaggatgcatcatcgccccacccgcgccgcctcaaacctgccggctgtcacccatcctccatgcacacgcagcccacccgcccagagcacagcccgcccccctcaccagcagtggccgcagaccacccgccccatgtagtcgtgctgaatggctttctcggcaacgtagcgcagccccttggcggcctcgttgccgttttcatctgtgtggaagtcgaggtccaggtcgcgctgcttggccagagtgaagatcctgcgcattgggagtggggagtgagggttgggtttcagtcccaagtttccaatagccagagaggacgccatggggaaaagtattgcacaggtgccaggatgcttggtaatgctgttaccacgcgcatcagcacgtcagcagcagctcccccccctgacctgcaacccatattcataccctgtacatccctcccaccccctcttccaccaacactcccacccccacctgtccagcagctcgccccgatcccggtcgcaggtggtccagtcgtcggcggggtctccgccgcgctcggcgcagcagacggcggcgcccagcgcgccgccgtgcgctgccaccaggtccgccagagcgcgcgcggcctcggcgtcgcggtagaaggacagggctaccagcgacacgccctggagctccacccggccccgccactcggcccgcaggcgcgagaagacgggccaggtcagcgccgtctgcgctggggtcatgttaatcaggtgcgtgcgcagcgcggcagtgccgtgcgcgtgagcgctggccaggccgaactccatgcgccgccggacgtcgtcagcgtcccagaaggccgcgtcggcggccgtgctgcggtcagcgcccgtcagggagccgtccgggttgcggctgcgctcgcacgtgtggcccttgtctgggagggtggggggtgcaggagtggacagaacaacgagggagggatgatggccagggggaggggacggcgaccaaggagggagccacaggcacccctccagctttcaacacgtcccccgagcaccgccagccaggggttgaagggcactcctggttcaacccgatcacggtcatgcaggtatgcatggcattgctgcatccaggtcgacgtcgcacctatgtgggtgtgcaggtctacgaatgtgggcaggaccatcttgccccgcaggtcgacgtgtggaactgggagcgcctggtgagcagctgcatgaccattcgggagttgatccctggctgcgcccccagctggggtgatggagagtatcttggagccattcacggtgatgtccacgagggcaaggccgtccacacagggctgcaggccctccaggtcctcaggtctgagcctctccaggcagcacacgggcacatgggccgagcgcagcgtatatgttgcctcatcggggggcaatgcgattaccctgtcgctcatgatagctccgcctcgttcagaatgaaaggggacagattgacaggataatgcctgcaccctctggagtcgagacgagagacaccgagagggtttgagccgggcgagacagagttacgcaagcagcacacaaacaatattctttcatcgatcagagagcttgcaatacttccatcacctgacaagagctacccaggaagagtgaccttgaatgatctaactctgaagacccccgcagcaggcgcagcaagaaccgcacgcaggattgtggcaggacgaggcgagcttacgacagcctgcaggggagcctggacacaaaatgatagtccagtaatccgcagtgtggcgtgcctgttaccgactgacttcctcgaatccatgtgaggtgtcccctataccttggactgtggtgtactcgagtcgggaccccgtgtacgaaagcgcgcactggtaccttccctccttggatacgtcaaacaatgccgagtgcgccctcggaggcccctctggcctccgagattcgcactgatgaggccaccacaagtgctcccaagcggcaatcctgcatcccttacttcgacgccctctggttttgctattgtgagtaccgcaatgctgctgacggcctttggcgattgaannnnnnnnnntttcgacgccctctggttttgctactgtgagtacttcaatgctgctgacggcctttggcgattgaatgcgcgcatgtgtgagtggaatccaatgtgagcatgaatattcacccttcacctcgcccccccgtgcagcccctgtgtatcaattgacagaatactatgtagagggcaagctggatgattgcacacaacactggaccaactttatcaactgcatgaagcagaagacaaaattcaaggacgtggtgaggaatggtgatcatgggaatggtgaagctgcccatgccaatggatcacttggatggatttgtttcagatcaaacagtcgctcacctccctgcgacccnnnnnnnnnngggtgatcatgggaatggtgaagctgccccatgccaatggatcacttggatgtatttgtttcaaatcaaacagtcgctcacctccctgcgacccctgcactccgcccccaggacccagaggagacatcctcccatcaccctctatggacactgcgcacccccgaggaggcagctgcagcctggaatgcagagttccaacccggcactgcctccccgcccagcgccaacaaggaaacagtggcatgaagcttgctgtgaaggagatctctgattcctgggtcacatggcccttatgagtgtgtcaggtcgagccaaacccaaactcaataactagaccggatgccccgtacagatctggctcctgcaggcagtaccaagggtggccagtgctcccgggctcagccagcagggcagctaaaaggcgatgtagatgtcttgctcgatgtcgggcatgtcggggatggtgatgcgcaaggccccgcgtcggtcgtcaaactgccaggtcagattctgggnnnnnnnnnncagatgtcttgctcgatgtcgggcatatcagggatggtgatgcgcaaggccccgtgctggtcgtcaaactgccaggtcagattctgggaggctgaagctggcagtgacagccgagccggctcccgcgaggcccagcagaggagggtgccgctgccacgaaccctgatctccgccgagggggcggcagcaggtgccgccgcgccccaggtccagcccaggacggcgcccccgacgttcagcatattgaccaggcccactggggcgaggctgaccccccccgcggccaggaccggggccagggtcacgaggcaggagccgccggcggtgaggctcactctgacctcctcggcgtcgctgtcccggaggacagtcagctcctgcaacatcaaacgggcatggtatgtgtaagtgtggcagaggtgagcatggccggcaacaccccatgctcgtgcaggttcaccttgcaaccattccgtagccaccaagaccagagcccagatggcagtctgccgtcctcagtctctccatgcatgcaacccagcgtgtggcgctcacccagatgtctcactgtgtgagccccacgcacaacctccttccccagacccctcgccacctggagtctgagacacgatccatgaggccccaacccactgacaaagacgctcacctcgtcggcatcgcagtaggcaatcaccggcaggcctgagcagcgggccgcaagacctggcacgtcatgcaccccgaccccagccgtcagcctgggcgggctggcgtcgtgcacgtggaaagcgcggcggctgcggtcgtacgccgcgccctgcaggttgaaggcggccaccaccgcgcccgtcgcattccagctttgcacctgcggggagagggtggcggtggggaggggagtgacgatcttggtgttgagcagggagggtgggcgacgctcgcgccctgacaggtgttgacttgctcgccgatgctgccagacttctcagcctnnnnnnnnnnggggtggcggcggggaggggagtgacgattttggtgttgagcggggagggtgggcgacgcacgcgccctgacaggtgtcgactcgctcgccgatgctgccagacttctcagcctcatgatcaacaccatcccgacttgcttcacagagtcaaaccagcttgtgcaatgccccaaccctcgaaggaaacacccacaccaccgaccttgagcagcgacttgccgtcccggcacacgtccgcgaagagcgagtcgggggtgggccggccggggctcagcgtgcgcagcgtgctgccgtcccgcaggacgatgcgccgcaggaggtcaaagtcgtgggcgccggggcggtcggagacgtacaccggcccgcctgtggagtcggagggccatgctggctccgcagcagagggcacggacgaggcagcgcccatgccactcccacctcaggagcccaggctggcccacggaccccggcctcccctcctgcacgcacgcaatcacaccgacctgagaccacgcgtgcggtnnnnnnnnnnccccacctcaggagcccaggccagcccgcggaccccggcctcccctcctacacgcacgccatcacaccgacctgagaccacgcgtgcggtggcgtgcatgagggcggcagggtgtcgcgagtggaacatgtcaaagtcggggacaaccagggcgcccatgaacgcggagttgtaggcgcagtttgcgatgtgtgctgtgtgggaggcggggatgaggggccagaagtcgtcgctcgcccgggcgaggttgctttggctgaacctgaagggcgcgggacggggttgggggtgtgctcgtcgatgtgggcgcgagggatggggcgcgggagttgcagacggggtcggtgcctgctggggcaggagcatggcgccatgggatgctcagccctcaaaggcctcgctctcctcgccgcacccctgggttcacctgtacagattgaccgtggagtggcacatgcagttgatgagctggttgccggggaagtggcgggccacggaggcctccagagagtcgttgtaggctccggccagcgtggcgccgcccagcaggcccagcgtgctctgccaggaggtgcgatgggcttggcgctcagcctgtctgatacaagacacccacatttcaggcagaggagggtctctctacagagagcacacccctccttgctgatggccccctgctggcccctgcaacacaccccttcctacctggacgtcc

SEQ ID NO: 48734 - DNA, 132 bp, Chlorella protothecoides
gtcaggccacgagggtggcgggtggggcaagtattcccgatggggtgttggtgtgctcgacccagggactcgatcaccttgcatcaagtgtccatggttcctggcagcaaggttcgctcgctctccaccccc

SEQ ID NO: 48735 - DNA, 72 bp, Chlorella protothecoides
ggacctgggtcgtggtgtgtgccacccgacttgcaccgatcggcatgccacccaggcgctcggcctccccat

SEQ ID NO: 48736 - DNA, 61 bp, Chlorella protothecoides
cggcgccacaaacggcgcatgtggcgcggcagcggcgctcaacgggctggccctgcgcggc

SEQ ID NO: 48737 - DNA, 61 bp, Chlorella protothecoides
ctgcaagtgtacgaccaccgcagctccccctcccgccactcggccacccaccgttcacgct

SEQ ID NO: 48738 - DNA, 79 bp, Chlorella protothecoides
atgcttcctcatgccgtgaatgttcaccccccccccacacacccccccgcaccccctgcaggccacagggatttcatca

SEQ ID NO: 48739 - DNA, 61 bp, Chlorella protothecoides
gcaggacttgggcaagaagctgctgtacaattgggagttggaacaacgccgcagggcaaca

SEQ ID NO: 48740 - DNA, 61 bp, Chlorella protothecoides
acagcggcagcggggaggcggcggggtctgaccctgccgcgccaccgacatgccggccagc

SEQ ID NO: 48741 - DNA, 78 bp, Chlorella protothecoides
cgataagctaggggcacttatgtgctctgcggtggtgtacgggcaacgccccgccctggctgcaacacgaccctcgag

SEQ ID NO: 48742 - DNA, 61 bp, Chlorella protothecoides
caatgacagtcatcctcttgatggcggggggggcaccatcaaacacaaagacgggcttgat

SEQ ID NO: 48743 - DNA, 61 bp, Chlorella protothecoides
agcatggctgagtactgtcagcagtggcgggattcttcttgagaagtgtgcaggggagacg

SEQ ID NO: 48744 - DNA, 61 bp, Chlorella protothecoides
atgttgatgtggtcgattggccttggcagggcaagcctgggagcgtgttcctccaggcaac

SEQ ID NO: 48745 - DNA, 8038 bp, Chlorella protothecoides
  modified_base (84)..(93): a, c, t, g, unknown or other
  modified_base (507)..(516): a, c, t, g, unknown or other
  modified_base (1146)..(1155): a, c, t, g, unknown or other
  modified_base (1688)..(1697): a, c, t, g, unknown or other
  modified_base (1783)..(1792): a, c, t, g, unknown or other
  modified_base (2066)..(2075): a, c, t, g, unknown or other
  modified_base (2272)..(2281): a, c, t, g, unknown or other
  modified_base (2450)..(2459): a, c, t, g, unknown or other
  modified_base (2759)..(2768): a, c, t, g, unknown or other
  modified_base (3023)..(3032): a, c, t, g, unknown or other
  modified_base (3629)..(3638): a, c, t, g, unknown or other
  modified_base (3741)..(3750): a, c, t, g, unknown or other
  modified_base (3818)..(3827): a, c, t, g, unknown or other
  modified_base (4147)..(4156): a, c, t, g, unknown or other
  modified_base (5161)..(5170): a, c, t, g, unknown or other
  modified_base (5234)..(5263): a, c, t, g, unknown or other
  modified_base (5787)..(5796): a, c, t, g, unknown or other
  modified_base (6145)..(6154): a, c, t, g, unknown or other
  modified_base (6960)..(6969): a, c, t, g, unknown or other
  modified_base (7736)..(7745): a, c, t, g, unknown or other
  modified_base (7977)..(7986): a, c, t, g, unknown or other
ctccatctggtacaaatccctgttaccagtaaaaccccttgcacccctgcgctgcctacctacctctgacgactctgcgtcccnnnnnnnnnncttcccctccaccgtcctgagtgcacgagcaccagccttcagtgtccataccaacatgaatcatcctgtgcagcgggcattcgctcactgcacaggtcatgtctacagccactcttacagagctccatctggtacaaatccctgttaccagtggaaccctttgcacacccctgcgcagcctacctacctctgacgactctgcgtccctgatgttgcaaacttaacagctccgtgtatgtttgcaggcatgtggtgactcagactgtcatcgtttaactcaaggtcgagctgccagggcggccagattaaaaatcttgcagctggcagtgaccttccagcaggcttgcttccacccagcagtggcggacttgtgctgcatgcaaccttgccaccgcttatcgctggagcatttcnnnnnnnnnngaagttaacagctcagtgtatgtttgcaggcatgtggtgactcaaactgtcatcatttaactcgaggtcgagctgccagggcgggcagattgcaaatcttgcagctggcagtgaccttccagcaggcttgattccacccagcagtgccgctcttgtgctgcatgcagccttgccaccgcttatcgctggagcatttctcggcgtgtgtggcactgcccacatctgaatcttggatgtggcctcagcggcacgtcacacagcagtacaggaaagaagcactgccagaagggcaagaggcagttcgtgaggggcgcatgaccttcacagcaatgtcagccatctccaagatcatgcccggccttatctagcaaaattgcgcccagccctgatgttgggtgtcgttggggccggccagcctgcgcaacatgaagtatggtgattagtttagaggagacttccttcaagacccattcacgaaggccttgtggagtaccgggttcagtagaagcggcggggcgttgttatcatggcattgtcgacccaaatggaaagcgggggtgctcggtccaggacatcccaaagaagtatgcagacctcttattagtccacgttgggtgggctcagttcacnnnnnnnnnnctccttcaagtcccatccatgaaggccttgtggagtactgggatcagtagaagcggccgggcgttgtgatcatggccttgtcgacccaattggaaagtggggttgtgcggtgcaggacctgccaaagaagtatgcagacctctcattagtccacgttgggtgggctcagttcacacacatggccactatctatgtgccatctcttttggtaagggtgtaactcagatacccaggatggtgagcgcctaaaagtatcagggcagggaggtctcgatattaggcacgaccagatcttgcacaatcaggacccgagacagagcatggcgttcaggctctctatccatcctaaccgcagtgcacacatctctatgattgggttgcgaggtaacggggcccaccccagcccggctcacacaacaggggcccggaaccatattggcaacgcatgcttgcccatcatacaccttcggacctatgccccgtcgctgagtcattcaaaattttgcgaaactgagtgcaagacacctcagaannnnnnnnnngttgcccgtcgtacaccttttgacctctgccccctcgctgggtcattcaaaattattgcgaaactgagtgcaagacacctcagaannnnnnnnnngtttcccccaaacctaagcacacttgttgatataatcttgacattgctcctgtctaaggcgcagagagggatgaccttgcggggctcggggcgactggccaggtaggatcgggagtcccaggggatcgacctccgcactctcagtgacccgatccgtcggttttcacatgtcgcattgccgcaaccaaccaggaggctcttccacacccggatcgtgcctctggagcagcagctagagcatgcagcaaccgtgctgcaactgcttcaggtaggnnnnnnnnnntccaggatgatgagcgcatggaagtatcagggcagggaagttttgatataaggcacgaccagatcttgcacaatcaggacccgagacagagcatggcgttcaggctctctatccaccctaaccgcagcgcacacatctctatgattgggttgccaggtaacggggtccaccccagcccggctcacacaacaggggcnnnnnnnnnngtgagctacgttgcacattgacagagcatgtcccccccacagtcctcaagttcctggaagcagagtgcccgcgaaaggcccctcgccgccgttgtccctcccccgcggctacgagcgcttcccatgtgcctttcgaactgacgatagcactgctccaaggcacatgatnnnnnnnnnnctgagttacgttgcacattgacagagcacgtcccccccgacagtcctcaacttcctggaagcagagtgcccgtgaaaggcccctcgccgccgttgtccctcccccgtggcaacaagcgcttcccctgtgcctttcgaattgacgatagcactgctccaaggcacatgatgggggccgataaattttcaccgaatctaagcaccgttattaatataatcttgacattgctcctgtccaaggcgtagagaggcatgaccttgcggggctctgggcgactggccaggtaggatcgggagtccnnnnnnnnnngatgctcaatcggtacacgattgcgtttcgttttaggcagggcatcgtcagagactccagatatttcccccataacacccgacatcgccctcctgcaggtccccggccaggggaggggcctgtttgccacgcaggccattccccagaacacactggttcacagggaggcacccatgctgtgcacgcccccaccttgcctccaccagcatgccgcctgtgcaggatgtctggcgcctggctctcccagtccaaccnnnnnnnnnnaatgctcaatcggtacacgattggatttcgttaggcagggcaacgtcagagactccggatatttcccccaaaacacccgacatcaccctcctgcaggtccccggccaggggaggggcctctttgccacgcaggccatttcccagaacacactggttcacagggaggcgcccatgctgtgcacgcccccaccttcccttcaccagcatgccgcctgtgcagggtgtctggcgcctggctctcccagtccaaccccctggatctgtcaggcctgccaggaggccgggctgcagggggagccctggtggcgcctgcacactcgctgtgactgggggccactccaggccctgtgctctgggtcgggcgacaagttccccctcctgatggcacggctggcatgcatgcgcctgcgcccctgcggcccagaacgtggggaggagctcggcgtgggggcgctgcgcagtcccccgcctgcccgcggggacccactcagcgacctgcagcacctctgccacgcccgggtgccgccgcccccgcccgagccttggcgggagcagcatgcagcactgctccgcggcctggccgccggcttggccggnnnnnnnnnncgcggcccagaacgtggggaggagcccggcgcggggccgctgcgcagtcccccgcccgcccgcggggacccgctcagcgacctgcagcacctctgccacgccnnnnnnnnnngaaagcgacggcagtggcgtgccgggcgctcgaccttgcgtggtacagcgacggcatgtcgcgcctcnnnnnnnnnnccaagcggcggcagtggcgtgccgggcgctcgacctcgcgtggtacagcgacggcatgtcgcgcctccacctcaacgtgttcaggtgcgggggatgggcggggtttgtgtggtgaagcggcagccacacagcatgactgtcccggggggcgacttgggcagggcaaagtgctgcaccgagtctcccgcccagccgccgctccctgcagccggcacgccgagcgcagacccaccgcctcgaatccgcacccccgactcgcagggtggacacgatctcgatgcacggcgcatcactcctccaggccgcggctgccagcctgnnnnnnnnnntctcgaatccgcaccccaactcgcagggtggacacgatatcgatgcacggcgcgtcactcctccaggccgcggctgccagcctgggcggggggccggtggcggccctgggcgccggcagcgcgttgtacgcgctggcctccctgttcaaccactcctgcgacccctgcctggacgtccagttcccgggcaacaacgcattgctgacgctgcgggctgcacgcgacgttgatgccggtgagcagctgaccatatcgtacgtggatgtgggcgcaggcgtgacgcagcgccagcggagcctgcaccacgcctacggattccggtgccgctgcgcacgctgtgtggaggagggggccggatctgcgggggactgaggatgcagtctggcgcgcgtggagtgcatgcatggagagatgtgggctggaacctccctgctgaggtgggaggagggccggtgcgtgctgcacgtgatggcatgtcggagggattgcggtccgagacagacgcagtgaggggaggcgtgacatgaggagctggcgtgtccaacattcgttggatcgaatcgagttcaatcatcctgttggaaccaatacactgcaccctccgcagttcaacaatcgcagcctcggtgtgtcggcatggcgctgagcagtgcccgacccggcacgaaggcccaaaccctgctcctcgccctgagctgcaccgctctgggcgcgttgatgatgtgtgcacacgatcgatggacatctgtgggattcccacttgggctgtgtccacccatggaccttttggaagagaagcctagacccgagggctggtggaccgacctgcaccagcagtatgtcgacgccatggcagaggcagacaagggcgaggtgggctggttgtcatgatagatcgatgggcgtgatgaagtgcgctgcatggcattgggtagaacttttttaggggagtaacgactgcagcgttgcccagtactggtctatggtggacgtctattcctcctnnnnnnnnnnggtccgcccatggaccttttggaagaaaagcccagacccgagggctggtggaccgacctgcacnnnnnnnnnnnnnnnnnnnnnnnnnnnnnnctatggcgaagggattacagaggggtggcagggcaccttccaagggtgagctctggggtatgggatggagcctgatgtatcatcaagggattctccagagcctcccatcatgtgtcccccccaaccaggagcgccactcaaccgaccaccctcaggaagccggtcgatcgtgcaaaggatgtcacagtcacgttcaacgccacgtttgcgaccccatatggcgcggcggcgtttggcatcgccggggacggcgtggactccttggcctggcgcctcttccatggggagctacccacgcgcaacccccccaaagtcatagtgctcaacatcgggagcaacgacctggagcgcgcccgccgcagctccccctccccacaccaggtggaggagtccatctggaaggctgtgccgcacgtcacaatgaggtcggggctggagggggggggggaggagcagcaagggcacgagagtgggggagagaggcgccttgaaatagcattccgtgctgtttgtatctccaaggnnnnnnnnnngcagcggcaagggcatgagagtgggggagagaggcgccttgaagtagcattccgtgctgtttgtatctccaaggctcaggatggtggattgacgttccatgcacatccgctatggaggaggattggtgcccggcatctacccctctgggaggctctgttggctggcccatgtcacacgaagcatatttttgaggtcatccatcggtcaggatgaggaatgttccccaacaaactacatcatcatcgtcccacacccatccttcccctcacatctcctccacgaccaccatccgcgcctcgctgccaccaacaccaggatcctgagcaccatccgccgcatccgggaccnnnnnnnnnntcatcatcatcgtcccacacccctccttcccctcacatcccctccacgaccaccatccgcgcctccctgccaccaccaccagggtcctgagcaccatccgccgcatccgggacctgctccccgacacagtggtcgtactgcaggccgtactgccacgcggcgtggacggcctcgaccccttccgcctgcccaacctcttcacttggccgctgtatgtggtgaacgagcacctcaggtggggccaggggcgaatttggaccttgctgctggcaatccccgccgcgacaattcctgccgtccctgcggtgctaccattcctctgcagctcctgcactgccgaagggcgctcacaccaccagtcctccctcgccaactcccaccctgcacctcttcgacacagccactttgccagcgaggatgacaatgtgcaattcgtggactgcgaggaccatgtgctgaccaatgaggggagcctggacccggctgcgctgccagacggcgtgcacccctcggcgccggcctaccagcacatctcccgctgcctcgacatcctcatcggggtgctggtggaggacccacttgctgggcgtgcatgacggttcgggaatcatccctctgctgagctggtcccagcagctgcggcactccgagcggcgccaaacctgtggcccccaaacgtcctggacaccgcccgctcctgccctggccctgacggcgcttctgctcgcagatgatgcacagcacgtgttgcaaaagggccggtagtaggctcttccacgagctggaccaggcaggacaacaccccnnnnnnnnnnaatgcacagcacgtgttgcaaacgggccgggagtaggctctttcacgagctggaccaggcaggacaacacccccgcaaggtcatcatgaacagctcgtccctcactgccgctgcttgagctgcagctccgcgagccggtcggccatgaactcgatctgctggcggtacagtgcgcgtgcgtccgacaggtcggcaaccagctcctcgatccgctcgtccttctcgcctacaccgcggcatgtggggattggggcgtgggaggcgtcgagggcctaggggagggtggcaaactggggcgtgtctatccgcagccgccactgcgctggccatgcatcatcccacgctggcggggtttcgctcccagaccatcaccccaccggagggcaacaccgcccggagctcccacgatcatgcgcctcctcgacgactcacccagcaggaccaagcaggtttcgcagcgcgcgtgcagcgcatccagccgaccccgcagggccgccgcctccgcggccgcgctcctgcccagctcggcggccgtggcggcggccaccagctcctccatcagcctgggaggtggttgggagcacgagcgagaatgtaagctggcagcatttcatggagcagtgtcgagcactggggagggtgtttcagccagcatcaaggccggcatgcaccaaacccagcaccaatggcggaggaagtggagcgacatgccatccccaaccctaacgatagtcagaaggacaccaggccgcagttcaccatcccgnnnnnnnnnnacaccaatggcggtggaagtggagcaacatgccatcccaaaccctaacgatagtcaaaaggacaccaggccgcagttcaccatcccgcttcctaaccccccaaacaaactccacctgtcgcgcatggcctccgcgtccgccagcgcgcgacgcagcgacgcggcgttgtcggcgggggaccccgagccctcgcggctgcccgccgaacgcggcggcgcgggcgccgcggcannnnnnnnnnaacaaactccacctgtcgcgcgtggcctccgcgtccgccagcgcgcgacgca

SEQ ID NO: 48746 - DNA, 62 bp, Chlorella protothecoides
cgacggggtctcccgaaggggcgagagtggcccccccgccgaacgggggcctctcggatccc

SEQ ID NO: 48747 - DNA, 61 bp, Chlorella protothecoides
ccggtaccgcgccagggcctcggccaggacgagcgtgcagtggccgcgctgcgagggtggt

SEQ ID NO: 48748 - DNA, 61 bp, Chlorella protothecoides
gcgcggcggctggggctggcgctgcagagatgctggggcccgggactgagggtggctggtt

SEQ ID NO: 48749 - DNA, 61 bp, Chlorella protothecoides
tgccgatcagcagctggggctgcccgcggggcagcacatcacgctcaaggttacaggaccc

SEQ ID NO: 48750 - DNA, 68 bp, Chlorella protothecoides
ccatgcaaggactgctgatgaagcatgctcctgcgaccatgtcccacacctgatgtcatcagccctga

SEQ ID NO: 48751 - DNA, 61 bp, Chlorella protothecoides
gccgttgccacccccgccgaacatgtgctcttggacgtagcccctctggcgcctgggcagg

SEQ ID NO: 48752 - DNA, 61 bp, Chlorella protothecoides
ccaggaccaccccagtcaccccgctgcctcccggcactcactcctccctccctccctccct

SEQ ID NO: 48753 - DNA, 149 bp, Chlorella protothecoides
gcaccctgcctcgaaaagggaggggaggggttcagtgcaacaggttcgcatctgggtgtgaatgccggtgaacagaagctcctgggactgggctggcatttgcagctggtggtcagacacgctcagagactgtcgggtgccacgcctgc

SEQ ID NO: 48754 - DNA, 9576 bp, Chlorella protothecoides
  modified_base (171)..(281): a, c, t, g, unknown or other
  modified_base (839)..(848): a, c, t, g, unknown or other
  modified_base (927)..(936): a, c, t, g, unknown or other
  modified_base (996)..(1005): a, c, t, g, unknown or other
  modified_base (1816)..(1825): a, c, t, g, unknown or other
  modified_base (2117)..(2126): a, c, t, g, unknown or other
  modified_base (2179)..(2188): a, c, t, g, unknown or other
  modified_base (2270)..(2279): a, c, t, g, unknown or other
  modified_base (3932)..(3941): a, c, t, g, unknown or other
  modified_base (4029)..(4038): a, c, t, g, unknown or other
  modified_base (4384)..(4393): a, c, t, g, unknown or other
  modified_base (4731)..(4740): a, c, t, g, unknown or other
  modified_base (4899)..(5081): a, c, t, g, unknown or other
  modified_base (5135)..(5144): a, c, t, g, unknown or other
  modified_base (5631)..(5640): a, c, t, g, unknown or other
  modified_base (6115)..(6124): a, c, t, g, unknown or other
  modified_base (6509)..(6518): a, c, t, g, unknown or other
  modified_base (7490)..(7499): a, c, t, g, unknown or other
  modified_base (7626)..(7635): a, c, t, g, unknown or other
  modified_base (8569)..(8578): a, c, t, g, unknown or other
  modified_base (8655)..(8704): a, c, t, g, unknown or other
  modified_base (9135)..(9144): a, c, t, g, unknown or other
  modified_base (9459)..(9468): a, c, t, g, unknown or other
gtcggcgccgcgccgggcggggccaacgccgcgcagcgcctggagggccggggcccggcgggcggcacgccgcccccgcgtgagacgctcacgccctttgcggcggtgagcgaggaggccgaggccagcggcgacacgccgcgctttccttctggcggctcaggcccgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggcgcggggcgggtgcggcggcgacgcctcgccctccgcggcctccacctcctcggtcctcacctccagctggtggcccgagctgaggatggccgcgggggaggggcagggcggcgggggaagtggcgcgtgggggcggccggggacgacgccgggcaccgcgggcggcacgccgcccgcgccggaggccggctggcggctgaccgacccggagcacctgctggtgtcggggtcgggcggcgccttcctgcacccgacgcacgcgttttcctacgcgcgcttccgtccgccgcgggacgccgcggcggggcccctcttcgtctgcgaccgtgcaggtgaggcgtggttgggggcgtgttgagtgtcctgggactgtcaagtgaggctggtgatggggaggaacaacatttcgcgatgcaggggtggggcagggagggacctcaggagaggtgggagatgaccatgacattgggccatgctgtaatcgtccgtcgcgcttcaccagcctgcgcacatcacacccatccctcctgccgccaggcacgagtggcgaggnnnnnnnnnnggtgtcctgggactgtcaagtgaggctgggggtggggaggaacagccattcgcgatgcaggggtggggcagggagggannnnnnnnnnagcgtgtgtcttcaagatcgtgctctcgctgtctgcaccgcgcagtggctgtttgatgannnnnnnnnncgggagatgaccatggcatcgggccgtgctgtaaccgtccgtcgcgcttcgccggcctgcgcacatcacacccacccctcctgccgccaggcacgagtggcgagggcttcgggcgcgccggcgcctcctccggcctgcgcgggcgctcgccggacccgtcgtgcccgccgggaggcgagtaccgctgcgccgccgcctaccccagcgcccagcaggtgtgctgctggatggacgggtgtcttcaagaccgtgctctcgttgtctgcaccgcgcagtggctgtttgatgaggttgatcccgtggcggtcgcacccgtcatcggagccgggcgaggggttcatggacagtctggccctatccatgcattgctggcacgtgcgccacagcacccgccgccgcacgggccccacgtacctcgcgacgctgccacaccccgccaccccgcagtcggagagcatcgggcggcgcaacctgcacatgttccgaaacatgaacacccggttcgacgtgatcgggggcgcgctgtactacctgctggtcgtctcggtgctgccgcgctgccgtcacctggcggcggtgctggaggcgccggattggggcaccggcctgagcctgctcctgggcgccgcggccgacaccgtcggcgacatcttcctggagtcctacgtgtcgttgctggccctgctgtgcatggccgcgctggccctgggctttgccgccacaggcggcatcggcgcaaaagggggtgagcctgcaagatgatgtgggagggaagggagggcagagtctgtggatgggcaccctgtgtgannnnnnnnnnggggggtgagcctgcgagatgatgtgggagggaggggagagcagagtctgtggatgggcaccctgtgtgagctgtgtcatgtcgagctgcccgactggcgatgggggctcaccattgacaccaccccccgcccatctcgtcctcgcccagacgcgacggccgcagaccggcagcgcccagagttcaagggcaggggcctggccgtgcgtgctcggctgggtggcttcaccacccgcttcctgtttgcgaggtgaggttgtggtgaggagtgggatgtgtgagagtgccggcnnnnnnnnnnccaccccgcccatctcgtccttgcccagacgcgacggccgcagaccggcagcnnnnnnnnnncccgacccccctaaaaaaattccgcgctcacaaacccacctcatccccccgcccccctatcacgtagcctgcactgtgccgnnnnnnnnnnctcccctagaaaattacgcgttcacaaacccacctcaataccctccccccctatcacgtagcctgcactgtgccgcgcacgtgtgctgcgcggtattcctgctcctgttgctggagctgggcatcgagaccgtgatccggcacgagcagttggggcgtgaagggtaccacagcctgtacaagtggtaccgccagtacgaggccgcccacttccccgaccccgccgacatgcgcggtgcggcggagcgctggaccctgggcctctacccgggggccatcaagtgggccatggcggccttcgacgcgcccgaggccatcgccgtgtcgcgcgacctgctgtgcgcggggcgggagctcaaccgcctgcaggctctgggctactacggcggcgtgctggcctactactggctcctggccacgcccacggtggccctggtgttcggcgcctatctctacatctgcgtcaactggtgcgggctggtggggggtattatcttgtggatgggacaaggaggggcatgccgggccgagggaggttgtgttgtggtggggcagaacatagccctgcttcagcttggatatgggagctggctggatgggggaagctggtggggtgacatgagcatgatgaggcgtccgcctcaaaggtcgagggcgggcatgaggcaaacaggaggcctctcagacagtcagggggatcatgctcctgcttcccgtgctctgggggcatgccgcatcaagccgctcctgtccccccctcctgcggtacctcaagcagagccagcagccagaccccactcacccacccacccacccacccacccaaatcctcatgcaggtttggggtgcactacgacgaggccttcagctcgctccaggtgccagaccacaagggcttcctgcgcatgcacatcacgcccgcgggcgacctggagatcttctccctgggcctggacaccgtgcccagagcctggcgggaggacccagcctggagggccccggggggtgggggtgacacgggtgcgccaggctggcgcgcccgccatccctcacgctgggtcccggtggaggtcaggggcgggtacaccctgcgcggcacgccccccgaggcagcgctcaaggtggtggactacctgcacgtcccgcgccagcgcccggtgatcgtgtgatgtaatgcagggtactgatgcccgagtgtttgtccagaagcagcccgggaggggcggcatgcgcgagcacccgcagatcggcgtgctgcgtggaggcacagcacgccccacgaaatgcgacagacggaggtgagcctcttggagcacctcatggggacatgtggtgggaatgacaccgatctgaggcgcccaacaccttgaacacacgccctcggtggcctgacgaaggcctcccgcgccgcagcccgacagaggagaccgaccatccgtgtcgggagatgacgcgcgcgaggtcctccgcggagggcaggaggtccgccagtgcctccccggcaccccctgccatcgatggcgatcagtacctgccacggcaggtggggagcgaatggggacagccataaagaggccgagcgcatgtttttccatgtacatgcactgaccgcccctgtcatgcagctcattcccgggcgagtgggcacgctcannnnnnnnnnttacagtgagattggtctgtgatattccgacgtgggaagacacggcatcgatgcgtccctggactgatgcttgatcttcctgaatgtnnnnnnnnnnccactggcatgtccctgcatccagggagcgggcaagggcaagcgcatcatgggaggcaaggtccccaccgagtcgctggtcactcctgtcgacatggtggacacacctgccgagccctctggccgcggcagcgaggtacgaaatggagtattattgggcgatgagtacttgagttgagagtttaaggctccagatacagtgagattggcctgtgatattccgacgtgggaagacatggcatcgacgcgtacctggactgatgcttgatcttcctgaatgtggagctccctgatctccacatgaccgccactgaactgcaggtcacacttccattggaggttaacannnnnnnnnnttccctgatcatcacatggccgccactgaattgcaggtcacacttccattggaggttaacaccctggttgactgccagtatcgcgacggcaagtgctacccagcccggatcatagagcgccggagactgggtgacaccaacgactacgagtattacgtgcattatcgcaagtgtgagtgacgagggtggggggtgcacaggagctgctggatatgaactggggacttggaaggaggcctctgcaactgcataagacgctacgctgctgctgcgaaccctgttttgcctggaccgtgcatttgtggttggaccaatggcccctctttgagcatcgacannnnnnnnnngcgagggtgaggggagcacaggagctgctggatatgaaccggggactcggaaggaggcctctgcaactgcataagacgctgcgctgctgctgcgacccctcttttgtctggaccctgcatttgtggtgggaccaatggcccctctttgagcatcgacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgttcctcactccaggcaaggcgtacccactttgacagcccttcttgtcactcnnnnnnnnnngtcaatagaaggatggacgagtgggttccgctggcaaacctacaacttgacaccgtcatccctcctgagccaccagagctcggtgacaagtacgctgggatggggtactgcgatttcagttcatagcttgctcattggtgttcctgccgtgttcctcattccaggcaaggcctacccactttgacagcccttcttgtcactcacgcctacagaacccggcagcaaaagcggaaggtggacgacgagcacagcgaggaggagggggagggacacgaggactttgaccccgcgcagctgcgggagcacgaggagtttaccaaggtcaagaacatcgccgacattgagctgggaaagtacgagatggagacctggtacttcagcccctttcccccagagtacagagagtgcaaggtgcagagactgggtgcatgcgggattgaaagggaggtgggggggcctttctaagtggtgagggaatgcagatgcnnnnnnnnnncgcgggattgaaaggggggggcgccctttctaagtggtgagggaatgcagatgccattcctgctctttgccctccatcaagttttcatgcaccatctagggagcccctgggtcctggtcagcccccgccatcatccaaccaccctctcttctttggtatgcacgcagaagatgtatttctcagagcacgacctgtgcttcttcaagcaccgcgagcacatgctggcgcacgtcaagaagtgcaccatgctgcacccacccggcacggagatctaccgcaacggcaagatctccatgtttgaggtggggttgagcgggaaggtgcttgactgcgcactcgtgtatgagcatggggagccgctgccgaggcccctgtgctcatccactttcctgaagtcagtgcatgtgctttgcagattctgctgtcctaatcctggccccaacaccgcatgcccctctgccaggtggacgggcgnnnnnnnnnnggtgctcatccactgtcctgaagtcggtgcatgtgcttcgtaaattctgctgtccggatcctgaccccacctccgcatgcccctctgccaggtggacgggcgcaaggccaagggctactgccagaacctgtgttacctggccaagctattcctggaccacaagacgctgtactgggacgtcgacctcttcctcttttacattatgtgcgagtgtgacgagcggggtgcccacatcaccgggtgagacgggcgggaccaggggattgggggaaggtactgttgtgtaatcaggaggctgaggtcatattcgcaggccagcgtggttgccccccgcaccaaagcttcccacgctcaaccctgcaccgattcctcaatcccgtgcggnnnnnnnnnntgcaggccatcgtggttgtcccccgccccaaagcttctcacactcgaccctgcaccgattcctcaatcccgtgcggcgacagatactttagcaaggagaagagcagcgaggagggcttcaacctggcctgcatccttacgctgcctccctaccaacgaagggtgcggcgtgggtgggagggttggctgggatcgtgtgccgggttggtagtgccttgcttgaatgagcacatctcggagcagggtgttcgtctggttgaggctccacatcgggagccctttctgcagcttccctagacccctgatccatctctgatctcctcctccactcccaggggtatggcaagttcctgatctccttctcctacgagctgtccaagattgagggcaaagtggggacgcccgagcggcccctctccgacctcggcctggtgtcgtaccgcggttactggacgcgcgtgctgctcacggtgagggacatgtgatggggtggggggggagtacatgcggcgcgggtgtgattggggcgtctgtgccagccctgtccaatgtcaccacacccctgcacccctgcccaacccaaatctcccacttccttcctccatctccaaagctgctgcgtgagcgggagggttcagtgagcatcaaggagctgtctgacctgacggccttcaagaccgacgacataatctccaccctgcagcacctgtccctgatccagtaccagaaggggcagcacgtcatctgcgccgcgccccacgtcatcgacgcgcacctgcgcaaggccggcggcgcagggctggaggtggaccccaccaagatcatcttcacgccctacaacgcggagcgcgactacaatggcgcgcgcgtgtgagggtctgtgtggggatgtgatagctgtcgagcacgagtggggggggcatcgctcgagggcctctcgaacacgatgtggctcgacaagcatcctcatctnnnnnnnnnntcgctgctgccacacgcccagccccaccccgggaataaaacaagccattgccgcgatgtatacatgggagcgcatcctgggtcacgaggggggtgcgcaggagagtacaggggtggtgcagcggcgnnnnnnnnnnggggggggggcccatcgcttgagggcctctcggtcacgatgtggctcgacaagcatcctcatctcccccctctcctgtgctttcattaccttgtgggtgcgtctctttcgcatcaacctccgctgctgccacacgcccagccccaccccaggaataaaacaagacattgccgcgatgtatacatgggagcgaatcctgggtcacgagggggattgcaggagagtacaggggtggtgcagcggcggggagcgctgccacggtgccgcgcgcagaccctcaacatccgtttcaagcgcgtcagaagcagacgggcgccagctgcgcggggcgtgggtccggggccaccagcttgcagcccagcagggtgcggggggtggcggcggcgcgcagcggcgccggcagcgcgtcgtcggggatcccggccgcgtccagggcgtgcaggactctggcagtgcgcagcgcccgctccttgaccacgggcctggaggtttgaagttttgggaaggggaggaagggggtcgccgaggccgtgcacgcggcggccaaactctgcacccccctcgcaccaaagacgggacccccaccaagccctgcgcacttgttgaagttggcctcggcgggggcgcgccccgccgcgcgcacccaggcggccgcctcgcgcagcatgcgcttcttgttggccgcctcctgccgctccgcgcgccgcgccgcctccgcctcccgctcccgctcggcggcctcggcctcggcctgctgcgccgcggcggcctggagaagggggttggtggggaccaggtcgctcagcggtgcggcagtgaaccctgttgcagtgaaggcctcgtcaccctcgtgggcctcagtgcggtcccaactcctcctacacagcaccacacggttcccacccccccccgaccctcacccctctccccccctnnnnnnnnnnagcctcgtcaccctcgtgggcctcagagcggtcccaactcctcccacacagcaccatccggtcccccccccccccgnnnnnnnnnnnnnnnnnnnnnnnnnnnnnnnnnnnnnnnnnnnnnnnnnnactccccccctgccaaaccaggctcacctcgtgctgctcgtcgagccaggcgcgcgccgccgggctggcaccgatcttgagcacgttgtagtagtaggcggccaggtcgccggcggcgcggtggggcaggaagcgcgcgcagatggcgtggaagtcgcggcccagcgcgcgcatgccctccgctactgccgcctcctccgcgggcgtgaaggaggggcacagcgcggcgcccatgcggtccaggcccagcgccgccgcggcctcgccgcccagccgtgaggccaggctgtcacgcgccgccgcgatccaggctcgcctgtccaggtgcatgctcgtggggtcagtgatgtggcaagcagggcatcaagtagagcgctggcagcacccaggccagacgcgatgcgtgggagctgactgaccagggtgtgccnnnnnnnnnnggtgaagcggcgagcagggcatcaagtggagcgctggcagcacccaggccagacgcggtgcgtgggagctgactgaccagggtgtgcccgcaggcgctgccgcacgggcttggggcctccctcgatcctctacgcatgcgcattcccttccacccctacctgacgtctcccgtaaactcaaaccctacccgcccaccatacacacctggcctccggcgacatgcttggcgcggcggcgtcctcgacgccgcccgcgtcgcgcgtggcccccacggggacgtccaccctccccgccagccaccgcagctcgcccgnnnnnnnnnnctcaccccctacctgacgtctcccgtgaacccaacccctacccgcccaccacacacacctggcctccggcgacatgctcggcgcggcggcgtcctcgacgccgcccgc

SEQ ID NO: 48755 - DNA, 76 bp, Chlorella protothecoides
tggggcgcgtccatgacctccccctcactcctcccccccccatgcacatgcacagtgtctccgtttgagtgcattg

SEQ ID NO: 48756 - DNA, 151 bp, Chlorella protothecoides
gatgctcactgaaccctcccgctcacgcagtagctttggagatggaggaagtgggggatttgggttgggcagggggtgcaggggtgtggtgacattggacggggctggcacagacgcctcgatcacacccgcgccgcatgtactccccccc

SEQ ID NO: 48757 - DNA, 61 bp, Chlorella protothecoides
atccacgcatgaagggacgtgcatgaagcaaccacgcatgaatgggcacccacgcatgaat

SEQ ID NO: 48758 - DNA, 65 bp, Chlorella protothecoides
cactcgtggccggggctgccatcatacaaaactcacccgagcctctcccggaggccccgtcccag

SEQ ID NO: 48759 - DNA, 137 bp, Chlorella protothecoides
cgcccggctcagcaggagaccctgtggcagcacagggtgcagaagagccgccgcagccgcctgtaatcatgcccggggcgtctccattgccggaagggacggcatccgagccgcgtgacagcgttttgcatggagtg

SEQ ID NO: 48760 - DNA, 75 bp, Chlorella protothecoides
gctcagcgagccgggcccggcgtcgcctggtggagggggggggggtggtgccatgcaggtgagtgggctggagga

SEQ ID NO: 48761 - DNA, 61 bp, Chlorella protothecoides
tggagtctcggcctgcagagcccctgcttgttgcaaggccgccacggcttttggtgaccga

SEQ ID NO: 48762 - DNA, 79 bp, Chlorella protothecoides
ctcgaagcggcagcgctcggccaccgcgcccgacacgatggtggcccccgtggcggcaaaggtgaactggaagaaccag

SEQ ID NO: 48763 - DNA, 61 bp, Chlorella protothecoides
ggtgccactccgcggccgaggccggatcgaacctgcccgtggccgccgccacggcgcggcc

SEQ ID NO: 48764 - DNA, 61 bp, Chlorella protothecoides
tccattttcgcgagatcgaggtggcggaggggggtatgggtggggtcctaagtacgtgctg

SEQ ID NO: 48765 - DNA, 128 bp, Chlorella protothecoides
cggagtctgtgtcccgagtgtctctctgtctcagctcccagccccattgcccttcccaacatgcccctcattctccctgccctttctgaccccaccccgaccctctcgccctgccgccctccctcccc

SEQ ID NO: 48766 - DNA, 61 bp, Chlorella protothecoides
gcgtagatcatgcccagtagctccttctcgggcgcggggtaccggcactccgcggggcgca

SEQ ID NO: 48767 - DNA, 61 bp, Chlorella protothecoides
ggctgcgccagagcacattggcgaggcgggggaaggacagcgtctcctcgtaccgctccgc

SEQ ID NO: 48768 - DNA, 62 bp, Chlorella protothecoides
acgacaggggccacgtcgcacggtggcagggcagtacttggcctgccccgccggcggggtgg

SEQ ID NO: 48769 - DNA, 61 bp, Chlorella protothecoides
ctgcgcgcgctgcagcgcggcggcgtagtgctgactcagcaggtcgtcaaaggtggcgccg

SEQ ID NO: 48770 - DNA, 61 bp, Chlorella protothecoides
cgagcaaggcattgggtacatgtgacgggggatttctttgtactcagaccagtccccgggt

SEQ ID NO: 48771 - DNA, 61 bp, Chlorella protothecoides
tgtgaatggaaaggctaggagctgggggggggttgtatttttgtgccccagcagtggtctc

SEQ ID NO: 48772 - DNA, 61 bp, Chlorella protothecoides
cagacagcccagcgcagacgttctgactctacactctcctccctgcactgcaggcgcaacg

SEQ ID NO: 48773 - DNA, 109 bp, Chlorella protothecoides
cccttcccctttgccgcacccgccgccgagacggtctccagcctgcggcccgccgcaggcaaggccacaacctctgccaccgcacccgcgcccgcggtggccggcccca

SEQ ID NO: 48774 - DNA, 61 bp, Chlorella protothecoides
gcaggacgagaagcccgcaaagaaggtcaacgccgccgaggatgccccggccaagaagacc

SEQ ID NO: 48775 - DNA, 61 bp, Chlorella protothecoides
gggaaatgaatgtcccttggcggggcggggtcctgggagtccaggctctgcagtcccagtc

SEQ ID NO: 48776 - DNA, 61 bp, Chlorella protothecoides
gtactcgcgcggcgaggtgctggggcgcaattgccgcttcctgcagggccccgacaccgac

SEQ ID NO: 48777 - DNA, 120 bp, Chlorella protothecoides
gctgcctcagctccacgctgtgggtgccatggcatggggggttggttggggagacagggtgaggggtccggcggtggccccattcaacacccatgactgctgcgcatgtcacacaccagg

SEQ ID NO: 48778 - DNA, 66 bp, Chlorella protothecoides
gccttgcacgacgtcaatctgcatggggcgggaataggggaagaagctggtgggaggtcaaatagc

SEQ ID NO: 48779 - DNA, 61 bp, Chlorella protothecoides
gacgtcgcgcgcggcgtgggaggagttgcgtatggcggcggccagccaggcctccgtggag

SEQ ID NO: 48780 - DNA, 11990 bp, Chlorella protothecoides
  modified_base (161)..(170): a, c, t, g, unknown or other
  modified_base (1015)..(1024): a, c, t, g, unknown or other
  modified_base (1080)..(1090): a, c, t, g, unknown or other
  modified_base (2225)..(2234): a, c, t, g, unknown or other
  modified_base (2727)..(2736): a, c, t, g, unknown or other
  modified_base (2831)..(2840): a, c, t, g, unknown or other
  modified_base (2917)..(2926): a, c, t, g, unknown or other
  modified_base (3333)..(3342): a, c, t, g, unknown or other
  modified_base (3588)..(3597): a, c, t, g, unknown or other
  modified_base (3819)..(3828): a, c, t, g, unknown or other
  modified_base (4651)..(4660): a, c, t, g, unknown or other
  modified_base (5540)..(5649): a, c, t, g, unknown or other
  modified_base (5877)..(5886): a, c, t, g, unknown or other
  modified_base (5949)..(6026): a, c, t, g, unknown or other
  modified_base (7101)..(7110): a, c, t, g, unknown or other
  modified_base (8658)..(8667): a, c, t, g, unknown or other
  modified_base (9312)..(9321): a, c, t, g, unknown or other
  modified_base (10550)..(10559): a, c, t, g, unknown or other
  modified_base (10720)..(10729): a, c, t, g, unknown or other
cgacgctggcgcggcgggggatggcgcggtgccgcccgacgtcggcgcagcgccgcccaacgccggcgccggctggccacccgcctccacccccgacgtggaaaacaatgcccccaaggggagcgcgccttccaccacgcgccgcaccagctcggcgatgnnnnnnnnnngacgccggcgccagctggccacccacctccgccccctcccccgacgtggaaagcaatgcccccctggggcgcgccccctccaccacgcgccgcaccagctcggcgatgctgcgccccagcgagcgcgcggcggcgtccttcgcctcgggcgaggcgtaccgccgcggcaccgccctgcccttcacccagatggtcatcaccttccgcgacgtctgctactcggtccccctgccaaaggacctcgaccggggcaaggccgacacggggggcgagggcccgcacgccggccagctgcgcctgctgaagaacatcaacggcgccttccgcccccacgtgctgacggcgctgatgggcgcgtcgggcgcgggcaagacgacgctgatggacgtgctggcagggcgcaagacggagggcgtgattacgggcgacatccgcgtgaacgggcaccccaagcaggaccgcacctttgcgcgggtgatggggtacgtggagcagaccgacatccacatcccgcaggccaccgtgcacgaggcctgccagttcagcgcgcgcctgcgcctgcccacgacggtggacgccgccacgcgcgaggcattcgtggaggaggtcatgaccctggtagagctggaccgcctgcgcggcgcctttgtcggctcccccggcgtgtcggggctgtcggtggagcagcgcaagcgcctcaccctggcggtggagctggtggccaacccgtcggttgtcttcatggacgagccgacgtcgggcctggacgcgcgcgccgcgggcatcgtcatgggcgcggtgcgcaatacggtggacacggggcgcaccgtggtctgcaccatccnnnnnnnnnntaacccctcggtcgtcttcatggatgagccgacgtcgggcctggacgcgcgcgccnnnnnnnnnnncagacctttgacgagctgctgctgctgaagccgggcgggcgcaccatctacaacggccccatgggcgacgactcggccgacctcatcgcctacttccaggccatcccgggggtggaggccatcaggccgcgctacaaccccgccaactggatgctggaggtgagcaacccggggaacgagcggcgcctggacaaggacttctccgagctgtacgacgcctcgccccaggcggaggcgctgcagaagctgctggcggcggaggcggagccgcgggagggcgtccccgacatcgactactccgcgctgcacatcgcggcgcccatggagcagttccgcgtgaacctgcgccgcaacttcctcatgtactggcggctgccggagtacaacatcacacgctttgcctccaccatcctcatcgcgctggtcttcggctccatgttctggcgcctcggctccgaccgcaccaccgtgtcgggggtgctgaacatcatgggcgtcatcttctcctccaccctcttcgtgggcatcagcaactgcctcaccgtccagcacgtcatctccacccagcgcaccgtcttctggcgcgagcgcgccgccgggctgtacggcgtcctgccctttgccgccgcgcagcagctggtggagctgccctacatcctcatccaggcggtggtctacgtctccatcgtctactggatgatctggttccagcgcgacgcgggcgccttcttctggttcctcttcctcttcttcctcaccctctgctacttcaccttcttcggggtcatggccgtgtccatcacgcccaacgttgccttcggaaacgtcttctgctccttcttcttcggcgcctggaacctgctctgcggcttcctcatccccgagcccgccatcccacgctactgggtctggttctactatatcaaccccgtggcctggagcctctactccctggtcatcgcccagctcaaggactttggggatgagtacatcgtcggtgcgttggcagtgggaaggggggggggagtgggggaagagcatgcccgaggggtctgggtggagtattccagggtggcattgcaagggatcgacggcggtgagggaagcacctgaaactccggcatgcggctggccnnnnnnnnnncatgtctgaggggtctgggtggagtagtccagggtggcgttgcaagggaccgacggcggtgaggggagcacctgaaactccggcatgcggctggccaagcacctcaccaccgcccatcacccacacttgaccgccgatcgcagggctggatggcgtggagagcagcatcccagacttcctggagagctacttcaatttcaaagcaagcatgctgggcccctctgtggccatcctgtttggtgagccgtggggtgacgcaggctgtttgctggcactgtgggtgttcgtgccccgcactggattggagctgcgcgttcagtgcgtgcaccaagggatgcgccctgctattctgctgaatcttgtgtctgggcctgggccccctcccacacacacatcctacacatccctggccaggctactcggtcctgttcatcgccatcaccgtcttcgcgctgttcaagatcaactaccaaagccgctaggtggaattcannnnnnnnnncggggtgacgcaggctgtttgctggcactgcaggttttcgtgccccgcaccggattagagctgtgcgttcagtgcgtgcaccaagggatgcgccnnnnnnnnnnaagtgcgctgggccgcaaacacatgcattgccagacgccggccaaggtcaaggccggcttctcaaacagagccgctnnnnnnnnnncagagtgctgggccgcaaaatcctgatgcattgcccgacgccggccaatgtcaaggccggcttctcaaacagagccgctaccatgggccccatagtctacattggatttgtcctactcttccctgtacttgcgatgagcctgatgcccccgagggttgtcagtgcccagactgatctgaacctgccataggtggaagtgtctatggaatgggtgttatatgcaaagtattctcgctcagtgcgatggcacgggatgctgccatggcatgtggagaacgaagtcgatgacgagccgcgaccagcggacttctcttacctggacagggttcgggccgagcctggggttgaggaggtggggtgcgactgtggagccacttgcgggcccgcctgcccctgcgcagcccagnnnnnnnnnncggaggaggtggggtgcgagtgtggagccacctgcgggcccgcctgcccctgcgcagcccagcacccgtggggccatctctacggtgccgacgggtgcctggtgccgctgcagctcggcatcgacatcgatgtgttgttgcaggagtgtggacccgggtgttcctgccagggcacctgcgtccctcccccggcccatcaggactgccccgtgcatatccgccgcatccccagaaagggctggggcnnnnnnnnnntttgctgcaggagtgtggacccgggtgttcctgccggggcacctgcgcccctccctcggcccatcaggagtcccccgtgcacatccgccgcatccccagaaagggctggggcgtgatagcagactgcaatatcccatgtggcgccttcgtttgcgagtatgtgggtgaacgggtgacgacggcggagacccggcgccgtctccgcgactacgacgccgccgnnnnnnnnnncggcgccttcgtttgcgagtatgtgggtgagcgggtgacgacggcggaggcctggcgccgtctccgcgactacgacgccgccggcagggcgcacgccctcctggtgttccgtgagatcctgccctcccagaccgccgccctgcgcatcaacatagatgcaacgcgccagggtaacgtggcggccttcatcaaccacaggcacgggggccagagagtgcccgtaggtgcctggacgggttctagactctgactgcatgccccacaccccactctttccccccccattctcaccgctcctccctctccatgcagctgcgacggcggcaacctcatcctcctggctgtcctgccacgtggctgcatggtcccctccctgcggctatttgcccgccggaacatcgaggccggcgaggagctgacctactcttatggaaccccggccggtgggcacccctcccgagtccaagccccctgcctctgtggcaccccagcctgccgtggtttcttgccccgtgaccctgcatagtactttacatgctgcctgcatggcagcgcagacaggcactggatgagaggcatggggcgacccttcccgagcaggggtgaggtccaagacgccaagggaaacaagggtgaggaggtgaaagatgccggggaccgggttacacatgtgcatcttctcagcatgggaagaagatggggagttattggtccggggcctgggcctcgcaacctatcgcgaggagcacactactgactgcctggcttacggcagggccccaggtctgacgtcggctggggtggggagcaggccgtgtgacgnnnnnnnnnngccgggttacaattgtgcatcttctcagcacgggaagaagagggggagttattggtccggggcctgggcctcgcaacctgtcgcgaggagcacactactgacagcctggcttgcggcagggccccaggtctgacgccggctggggtggggagcaggccgtgtgacgaccagctcatatgacagttcggttcactgaccgaggtggcccgtcgatcccgtcgggtgagggccgccacagcccagcacccgccgctccggccatcctcggggtgcttgggtttcagtgggcctgggcgcgccaaggccccagcagcagggacacgtcaatcctggtctgggttcctgccacggtcacccgcattccctggcccttccacttcctccggcccttctgcatcctccagcggcccttccacgtcctcaggcccttccacgtcctccggctcctccgcctcgcccagtccctgcagaccggaggcgaagaagctggagcccacccccgccatggaggcctggctcctgggcacgacgccactggcgctcccgcagaagaccatgaggggcaggctggcgccgggtccggggggcacgtcctgagggaccccggcgtccgcccccggggagcgggagtcgggggtctggggctccggcgtgcgcggtgccgccacggcgaccgacgcgacgtgcacgctgaggggcgcccgtcgcagcgggcccagcaggcccgaggcggcgcggtcgaagggcgagggaggcatatgccgaacctgcgcgtcccgaggctccacacgcattccctgcacgacacgcacgacgtgtgcgtcgtgcagcgaatgcgccgtgtggaactgcggcggcgccagctggggcggcgccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggggaggccaccagcgggggccgctgccacgcctccagtccgggccggcctggcgccacgtccgcggaggtggtcgaggcaggggcgtggccgcccaggccctggggcggctcgggatggtggaacttgcacgtgtttccaaaggagcacctgcgatttgaacaggagttgggggggcggggggtgacagtgcatgtgcaggtgaaggctgggcagtcggggcagnnnnnnnnnnagcggaggaggtcgaggcctgggcgtggccgcccgggccctggggcggctcggggtggtggannnnnnnnnnnnnnnnnnnnnnnnnnnnnnnnnnnnnnnnnnnnnnnnnnnnnnnnnnnnnnnnnnnnnnnnnnnnnncaagggggtgggggggcggggggtgacagtgcaggtgcaggtgaaggctgggcagtcggggcagggctggtgagccggcaggtatcgggctctcccgggccctccaatgcctcagcataaccccctggcctcccaactctcagcacacccacctccagtgcttggagtagtaggcacaggtcggctcgccggggcggagggggaggttcagggagttgtagcgtagctctggcaggagctccagggggtgtgaaaacttgcagctgagccgtggaagggagggggggcgggagggcacatgagagtgggagctgggcaacaacagcgcacaaacccatacctggtgggcgcatctgggcatgacaagaggagcgtggcagctgctgtgacagcatccccatcctcgcccacatcggggcagctctcaccgcgcgccgtaggcacaggtcccagtgcggaggaagaagacgcagggctgctgctgcccctcctcctttgggtcctcctcatgtgagaggcgcgaggacatgctgtgctgcgcttgtgcctgggaggggtcccgcgacgggccccactccgactctgaccaggtggggtagctgcccatgggccggtggggcaggctgagcacgctgtgcggcgaggcggacggggccagggagtacgccatgctcccggaacccatgaagggcgatggactgccgggaacattcatgggaatccagaccatggggtactgcccgtgctcgggcatcggcgaggggctcggggagtgcatggccgcccagggcgcccaaggaacgcccggcccatggggcacggctgcggcgctcgcgcggtggggtaaactcccatttttggaggaatttgatccgccgctgaacgaggcagtgcgcctgttctgagtagggaccgcgcagccgtcggcgctcatctaggccgcggtgcgaagggttttctgagcggggacctgcgggaaggttgggagggtgcggactcgcgcgaaacccgaacagcgctgcacccgaccctctgacacatgcgatttgttctggccagtgtgatggcgctgggnnnnnnnnnnccacccgagcctttgacacatgcaatttgttctggccagtgtgatggcgctggggcattctgcatcggctcacctccggcctgaaggattgtgcggcagagccgctggcctcacgccatcccactggcaggctgctgccggaccacaagcgcgaaagcgacccaatactatgaatttgaagctaatgtgtgtaaaatgagtaggtctgggtctcgcagcgttgcgtgtgccccaggacggaatccggctttccttgggttccgcaaaatcttttggagagggggacccgtgaggccggcttggcaatgcaggagccgtttggtgccttgagttggtacagggcatagtattcagtgtataaagattttcaactggcaaaaatacccattcttgttacaatattcaaggactcagaatcgccatggcgaaaggtacggggggtgcaaacaccgtgcccagtgagttggaatctgacatggacgctggtcagccgcctccttgatttgagcgcaggaaagaagaagaggcggtcagccgcatttgcgatggaccaggatgacagcggcaagcagaccggcccccctgaaggctggacaaccgagagcatcgcggatggcgagagtgagcctgcagagagcatgtacatgatgaatgaccttggcatgcttcctgaggcttgggtgtgtgcttgggtccctgcagtacgctcgcctcaccggcatttgtgagccatgcaggcatggatgtgaccgatacaggctctcaggccgcagcggccgacctcgcaccccccaggtgtatggatgttcagtgtgtgcacctgcatacttgccgatggggcatacatggttcattgtctcatcaccagcctgaggagcaaggcctccaccgcccaaggcctgcacgcctgcattataacttctacccttcacatcctgggacctcatctgtgctggcaaggcttgcctacaaggtgttttctaatcagattgaaagcatgcgccaacccagcaggaggattccgggcaagcgcggccagaagtcgcgtgcccagaagcagcgacgagcggcgaggatggagaaggggctcgcccatgccagccgagtggagggcaaggccctgaagctgagcgggagcaaggcaaaacggacctctagcaagaacctctgggtaacccagaagggccacaagtagggcactccccatggggaacgcccgagagggcttgaatatgtatgcattgccctccttgctgcactttctctcatacttgattgatataaacctctgtgtatgtacatgggatgcaggcccattcatggcctcgagcatcagggtgtcgtcaggccgggggggcaggtacaaggtttgtcagtcagtcaacgtcaatgcgagagtgagggcagcaaggggaaagaggtggggatggagggtggggtgtgcaggggtgggcaaaaacctggtctaaactgtgcaccacgacacacgtcctgtagggtccctcgacacacatcattcacggctgcaggttgcccagcaggcccagnnnnnnnnnngaggggtgggcaaaaatctggtctaaactgtgcaccgacacacacgtcctgtagggtccctcgagacccatcagtcacggctgcaggttgcccagcaggcccagcacgcagcgtgtggagttgagcgcgtcgtccacgcgctgccagctggcgcgcagctgcgcggccagccccgccgcccggcgctgcagcgacgggctagaaaggatggcgccggcgtgcacgtccagcgtcaggcgcagcagtgcctgcaccaggtcaaagcaggagccagcgcagagctgggcctccaggaaggccaacagcgcgtccaccaggcgctcgccctcgccgccgtcctgccccggctccgccagccgcgtcagcgcccgcacctcgccgtccacctgcacgggggtcagcgtgcgcagcaggcccagcacggcctcgtccgacccggggcgcggcgccgccagcagcgccgccagcgtcggcgcgcgcccgggggcggacgcgccgcccagcccacgcacgcgcgattgggggtggtgcttgcgccgtggcttggcgttggcatccgcatcggcgtcggcctccgcgtcctcatctccgtccgccacgtcctcgtccccgtccgccgcatcctcgtcctccgagccgccccannnnnnnnnnatccgccacgtcctcatccccatccgccacgtcctcatccccgttcgccgcatcctcgtcctccgagccgccccaggcggccatggccgcggcggccagcgccggctcctcgccgtcgccggggctgggctcctcgccgccgtcctgccccaatccagggacaaagacggggtcgcgccccgcgcgcgcccccgccagcgagggcaggaagaagggcgcggcctcgggcttgcgcggggcctcggccggcgcgttgcgcgccttcaccacatccaggtgcgccaggctctgccactgcgagcgcggcaacaggctcagcgtgagcatggccggcgccagaggcgccggcgcgccgctgggcgtgcgcttcgcccacgctgcgcccgccacctcgtcctccaggcgcagcgctggtgtcgaggcggcgccgcccccctcctcctcgtcctcggagctggaggcgtcgcgcagcggggccagcgcgtcggcaccctcccccgccgacatttccagctcggagtcggaggaagcgtcgggcgcgcccacctttcgcggtgtcagcgccagcatggcctggctgcgcgcggccgcgcgcgccgcggcgccctcctcctcgccctcggggtccaccgccagcgcgggcaggtgggcgtggcgcacgcgcgaccccggcacgatgtccccccccgcgccgtagatcagctggttggcccagaggttgatgccacgggagccctgccccgtggtggccagcaggtcctgggcgggggagagggacagcgaggtgaccacaccccccatgtccagcacctggagcagctgggagcctgcagtgagaaaggggttgatcatgggatggtcataagtaggattgaggggttcttgactcagaaaaaagcttctgctattgagagtgacgtgcaccgggtccaaggacaggatgccatgtgaccgcgacgaggaacaatgcacagggggccaagggaaacagcactgcaccgctcagaaagagagtcgttgaactcatgttggtggggttgccaccaatcggtagtctaacatgtatatttggttgagacatcacagcggtggcttcgtggaagggaaatgggagggcggggcgtgtaggatgccacgggcggcgtgcgaggggctgccttgtgggagtcaggcgaggcgcctgcaggcagatcgggaggcccaccgcacaagaacacacatctcgaggnnnnnnnnnnggtgagaaagggtttgaccatgggatggtcataagtaggattgagggattcttgactcagaaaaaaggttgtgctattgagagggacgtgcacggggtccaagggcaggatgtcatgtgtacgcgacgaagaacaatgcacagggggccaagggaaacagnnnnnnnnnnctcagcgtatgggtggtgatattatgcttgtcgtcacggaactcccaagggaggtgtcttcagacgaacgagactatcaacttatcatcgccaggaggtgtggtgttgtgacatggggggcaggggcggggcaggaatacagatagctttgggggtcttgaaaccacagagggagaggtgagagaggaacaagacccccctacgcacccacctggaatgtcccagacccggagcgtgccatccatggagctggacagcagccagcggcagtcctcgctgaactgcagatcggtgacccggtcgaggtggccctcgaacctcctcaccagccgctgggcctgtggatgggtgtgttggtgtggagattgtgagtcgtgtgccgagaggagacaagtgtccatggcaagccaagccaagcttgggagtccttcagaaaccggccaggggagtgtcagggtcctcaaaacagaggtaggaaatcagatcagaacaacacctgagggccacctcagttacagcaaaggggtatcagcacaccgcgccaggaatgagttagattggcgcgtaagactggtgccagaatgttgtcatcaccggtggcccgcagggaagggagggggccagcgccctgtgcgaactgttctcaggcatgcaaagaagcggacggatagcaaagttttcgatggttgcaaaccaggccctcatcatgcgcccacccacgcgccccccaaccctctgtgggacaccctaaaaagaaagggggagggaccgcgcacctcgacgtcgtagatgcggagcatgaggtcggccggcgctacggccaccagccccgaggacgggtggcacgccagtctctgcaccgccgcccccacgcccagctcccccgtcagtccgcagcgcttgaagtcccaggtgcgcagcgcgccgtcctccccgccgctgaccagccagcggttggcgccgtcggacgctaggcccgccaccgcgccgtcgtgcgcgggcgatggtcggcccgccgtggcctcgctcgccgcgtcgccgcctcctgcctggcgctggtactcgccgcggtgcaggccggattgcatgttgtagcggtgcacggcgccgtccgccgagcccaccaccgcaaagttgccgcaggcggagagcgcgacggcggtcaccgcgtcgcgcggtgcggcctcgccgtgcgcctgtccggacgcgccgcccccggagcggcgccgccccggcggctccagcacgtgctcgcccagca

SEQ ID NO: 48781 - DNA, 61 bp, Chlorella protothecoides
ttgggtggaaaggtatcgcaatggcggcggggctttacctgttgaatctctcttccaccct

SEQ ID NO: 48782 - DNA, 71 bp, Chlorella protothecoides
ggaggaggggacttcgatggagggggaggaggggacttctttggagggggaggaggggacttcgatggagg

SEQ ID NO: 48783 - DNA, 61 bp, Chlorella protothecoides
tagatgtaaaattagagcgcccggctttgcgcatttacaaggacttgattttatggctcgt

SEQ ID NO: 48784 - DNA, 61 bp, Chlorella protothecoides
cgaagcatgccaggcgatcaatatggcagggcatcatgggtctccagggctctaggccctt

SEQ ID NO: 48785 - DNA, 72 bp, Chlorella protothecoides
tagtcccaccacccccgtttccactcagagcagcccttccctcccccacctctccaccctccgctctaagtg

SEQ ID NO: 48786 - DNA, 61 bp, Chlorella protothecoides
tcaacgctcctcaatgccacagaatggcgggcatgtcgctccgagtacctcccttgttgaa

SEQ ID NO: 48787 - DNA, 61 bp, Chlorella protothecoides
cgacggcaggcgggcaggcaggcaggccgccccccagcgcccatccttccgcaccttcata

SEQ ID NO: 48788 - DNA, 61 bp, Chlorella protothecoides
actcgtgagtcctttgagagttgcggggggaggggggggggcacatctggcagctatgcat

SEQ ID NO: 48789 - DNA, 71 bp, Chlorella protothecoides
ttgtgggacgtgctcgccgcccgccccgccccggagagtaggcgccgggggctgacagggagccagcgggc

SEQ ID NO: 48790 - DNA, 61 bp, Chlorella protothecoides
gaacctgttgattggctcgccctgccctcccctgaattatgttcacttgcgaggcggttcg

SEQ ID NO: 48791 - DNA, 61 bp, Chlorella protothecoides
aggccaggctgggggccatgctgggggggggggtgggcatcatcatgtagggggacgtgcc

SEQ ID NO: 48792 - DNA, 13919 bp, Chlorella protothecoides
  modified_base (359)..(368): a, c, t, g, unknown or other
  modified_base (900)..(909): a, c, t, g, unknown or other
  modified_base (1087)..(1096): a, c, t, g, unknown or other
  modified_base (1163)..(1172): a, c, t, g, unknown or other
  modified_base (2028)..(2037): a, c, t, g, unknown or other
  modified_base (2263)..(2493): a, c, t, g, unknown or other
  modified_base (2747)..(2756): a, c, t, g, unknown or other
  modified_base (2833)..(2865): a, c, t, g, unknown or other
  modified_base (3103)..(3112): a, c, t, g, unknown or other
  modified_base (3869)..(3878): a, c, t, g, unknown or other
  modified_base (4064)..(4073): a, c, t, g, unknown or other
  modified_base (5015)..(5071): a, c, t, g, unknown or other
  modified_base (6209)..(6218): a, c, t, g, unknown or other
  modified_base (6566)..(6575): a, c, t, g, unknown or other
  modified_base (7498)..(7507): a, c, t, g, unknown or other
  modified_base (7577)..(7759): a, c, t, g, unknown or other
  modified_base (8014)..(8023): a, c, t, g, unknown or other
  modified_base (8476)..(8485): a, c, t, g, unknown or other
  modified_base (8911)..(8920): a, c, t, g, unknown or other
  modified_base (9342)..(9351): a, c, t, g, unknown or other
  modified_base (9913)..(9922): a, c, t, g, unknown or other
  modified_base (10507)..(10668): a, c, t, g, unknown or other
  modified_base (12177)..(12186): a, c, t, g, unknown or other
  modified_base (12754)..(12763): a, c, t, g, unknown or other
  modified_base (12995)..(13004): a, c, t, g, unknown or other
  modified_base (13077)..(13244): a, c, t, g, unknown or other
  modified_base (13297)..(13306): a, c, t, g, unknown or other
  modified_base (13388)..(13397): a, c, t, g, unknown or other
cggcgcgcgccgacgccgtggcgcgagacgcgacgcggcggatgacggcggcgctgcagcgcgcccaggtcatggagctgaccatcgccgggctgaagcgcggcgcgggggcgcggggcgagggatgcgcgacagcgtcgggcgaggaggtccccccacgtccccccccgagcgggcgcgagacccggggtggcgctgccggcgccgcatcgcggtgcggggcgccaggcctggcaccggccgtcggcttcctcctgccctccagcgccgagccactttcccactcacgcaacaccagccacccctcccacccacgcggcagcgaagagagcgacgccccgaccccgcgctccgccgcnnnnnnnnnncgcgcagagccactttcccacccacgcaacaccagccacccctcccacccgcgcggcagcgaagggagcgacgccccgaccccgcgctccgccgcgccctcggacgccggcagccccttcggctccgacttcacgctgcgggagttgctgcagcgcaccgccgccctggaggcgcgcctgctggaggcagggacggagaagaatgggctgcaggccgagctggcgcggctgcccgtgtccagtgccggccgcaccatcagggtgggtagcggtgggagggggggcttgggcgtgcttttgtgacccccaggggtccgtaaaggccagtttttccaaagttcctgatgccacctgcgctgcggcgacctacggcagaatcaccaacccccacctcccgccctcctctcctcctccctcgtggcaggagcggcggcgccgagaggaaatcgaggcgcggctggatgatctggagcgcgagatgtcgggcctgaggctggaactaaagcgcagcggctgccggtgacggcgatgnnnnnnnnnnatcagcggtccttaaaggccagtcagcggtccgtaaaggccagttttttcatggttcctgatgccacctgcgctgcggcgacctgcggcagaatcaccgacccccgactcccgccctcctctcctcctcccctatggcaggagcggcggcgccgggaggaaatcgaggcgcggctggnnnnnnnnnngtaggaggtctgggttccttgtgccatactcattcagagagactcgctcactctgcctcgtccgcgnnnnnnnnnnagcagagtcccatggccgggggaccccttgaacaatctcgtgaccactctgtgctgtcccctgcgccgtgctcgttgtacactgcaggccaacagggtgagggcggctagccaatgtgcctcccggatgaggtcatgaaggcagccctggggctgagaaagaagagtaatgtaaacaagtacagaggtggtgctgggaagggcgggataggaggtctgggttccgtgtgccatgctcattcggagagactcgctcactctgcctcgtccgcgccgtcctcctccgggtgaataatggccagcggcagcttgcagttctccaagaggtagagcgccacgctgccgacatcccccatgtaccggtcgctggcctccagctttgggattatggagaggggggtggggaaggtgataccaggcggccgatggtaatctctacgtagctttctgcagccagagcaactcgctgcatggcccaggaccatcgcagcgagttgcgacacgcaacgtgagcggcgctgtccaccatctgcccactcaaaacccaccttattgtgcgcggcagtgaccacaagggtggggtccaggttctgggcggcctccaggatcagggtcccaatcttggcagcaggggcctccacgttctcggcgtacaggtgcagctcatacttgacgttgcggggctgcaggaggtgcaggaagcgctggcggaggatggtcttggcggtctcgatgtgcttcagctcgttatgcgtgcccggctgctcaaactggtaggcggtgccgggcaggccgtggaagatgctcatggggggcttcatgcacttcaccacatatctgcagggggccaagggggnnnnnnnnnncatggagaggggggtggggaaggggatatcatgcggccgaggacaatctatacgtagccttccgcagccagagcagcgctgcatggccttagaccatcgcaacgagttgcgacacgcaacgtgggcggcgctgtccaccatctgaccactcaaaacccaccttattgtgcgcggcggtgaccacaagggtggggcccaggttctgggcggcctccaggatcagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgggacgagatgttgacccgggtttcgtgcataaggtctgcccacagtggcccaggcaggcacgctggcacacagcacaacattgcatctggagacgtgggaacgacacatgaaatcgatccacacactcacatgaagtgcacgacgtcgttctccttgtagacctgtgcgggggggggtggcaagggcgatggagctaagggtggaccatcttcagcactgacgattgcaccagccgagcactgcctcaagnnnnnnnnnnaggtggcaagggcgatggagccaaggggggaccattttcagcactcacgattgcaccagccgagcactgcctcaagnnnnnnnnnnnnnnnnnnnnnnnnnnnnnnnnntgcaggctctgctggccgcctccgtgtcctcggcgcacaacacgaggtttcgtttgtggtaggtcataacgcgcgagttgaggagggacggcggacaggaatatgtgcactccctcaaggtgatcttgtatatatagatctcaatacgttatcttgttgatgagtgtaccgccggctccatcagtcatcactggtaaaacattaaatgtctccgtgaacaagtttcgagacgacatgnnnnnnnnnngaggtgatcttatatatatagatatcaatgctttatcttgctgatgaggtgtaccgccggcttcatcagtcatcactggtaaaatgttaaacgtctccgtgaacaagtttcgagacgacatgtgagtaatgcacgtgctcagtcgcgccctgcgcctcgattcagagcaaaggagcacaggttctgcgattccaagatcgtgagatgcagcgtatatcgggtaagaactcgaatgtgcacgtccctcagcctgctgccgccatgtgctggctggggagggcgtcgtgatcacttcttatggcgcctagccccaccaggcaaatagcgctcgggggctcaggaaggcccgtaactttgcccaaatatgtttcagggcctgcagcgccttttgcatgatgcctttggcgggtcaggacccgaagggacccatggtccaccaataccggaagttgccgtggaaggcgccatcgacatacagttccggtgcggtgcaggggtgcaagctggcagaggaggcacggattgagatcgtgtgtgttgacttaccaatatcctccccgcagatcgagcaatcgcatcgaggcagagctgaatgagctcctgcaagtacacacccggcggaccgatggtgccgacaccgatcctagggtgagcaggagcatgggctctttgggtgattgattgcagcagtcactgaagcgatacgtatacctgactcacgtccaaactcgcaccccccccccccatacagccccannnnnnnnnncgtgagcaggagcatgggctcttggggtaattgactgcaacagtcactgaagcgatacgcatacctgactcacgtccaaactcgcaacccccccctatacagctccacctcgagctcctccaggccttctgtgcgcgggtcgccagctcctacaactcctgggtccccaatgacgccgcgctggannnnnnnnnnctccacctcgagctcctccaggcattctgtgcacgggtcgccggctcctacagctcctgggtccccaatgacgccgcgctggatagtgagtattgggttgcttgatacctgctgggtgcatgtcacgcgcacgtcgatcacatctcaatatcagcaccccgcgtgcacctcgcaggcgcgcggtcaacagtgcgacgtgcgctggcggcggggcccgcaggggcacccgcgcccacgaccccggccgaaccgctggcggtcgcacaggggtgcgacggcggccacccgacggctgtcctggccctgatcctggcgtcagcggccgccctgcccgccgccctcgacgcggcgtcgggcccaccggcgccgcccaccggccccatgcttcgttcacccgcgtcgcaggcccccgatgacgcccgcctggcggcagcgcggtccacgctcgccgcgctagcagtgctgctgcgcagccgccacaacgcggctgtcctgcgtcggctggggctggagggcctgctggccgacatcctggccggcctggtgaggtgcctgtggggcccggccgccagcgcccaccacctcgcgatcgacaccttacaagtagcctgctccgcgctggaccgctgggctggcctggggcctggggatggcgatcgcgccggcgccggcgcaggggacgacatggggcgcgccatggaggcagccccccagcctcgacagggcccggtcacccgcgggcagcaaagagagcagggcctcgccgtcccggcggcagagctgctgagcctggggagggagcgcgcgcggcttgaccccggccccgcgcacgcgctgcagcacgccagcctgcgcctgctgcgccgctgcatcgcgcgccgagcctgcggcctcggagcgcaggccgccccggcgacgctggcgctcgtggcggcgggcatnnnnnnnnnnnnnnnnnnnnnnnnnnnnnnnnnnnnnnnnnnnnnnnnnnnnnnnnnggaccaaaggcgcccaccccccgcgacctgcgtctccagacgcgctgcgtccgcgcccttgcctgcgccgacctggacgcggcccgccagctgggcctgggggagcgcttccgcgacctgctgctcgccgccgcgggggtgggcggcgaggaggcaagcctggccagtgggtctgcgcagccgtcctgcgtcagcgaagatgggagcatggccaggcccgggcgccaggcgccaggcgccacacccagcgtggtccccctcaccgccaccctcgcggaggccacagtagccctgtgggagtgggcggtcggggggtccatccccgactccaccggccctcccccccccctggacctggcgcggctgcagttcgttctggaggcgggcgtcgcggcggccgccggcgggccagcactggacggcgccgacccggtgccctcgcgccgcggtccctgcctggccctgctggcgctggcagcacacagcgtgggcgcagcgtgggcgctgcccggggccagccctgcccccagccggcacgcgccgagcgccgtgacgcgcgttgagctgctgcgcgcgtgcggcgtctacgacgtcgccttcctcgcggcgggtgatgttggtgcacggggcgccgaagatgccgtagtacgggcttcagatggtgatgcatcacctgccgccggcgaccccgtcgtgctggtcaccgcggtggggctgctggaacgcgcggccggcgtgcccgctctgcccgacgcccaggcggaggtcggtgccctggcgcgcatgctgcaggctcccagcgacgacccagccccgcgtctggccgcctgcgccgcgctggcggccctgctgcgccgcgctccgtgcaccggcgcggccgccgcggcgcgcgtggggctggaggcagcgctgtgttcgctgctcgccctcagggtgcccgaggaggggcctgtgaagctgggggtggagctgcggctgggcggcggcgagggcggcgatgcgacgtgggaggtctcgctggcaggctcgccgggcgccgcgcagcaagaggccgccctgcatgcgctgcaagcgctgtttgccgcggcgcaggcggcgcagcgctgcgcgctgcgccgctgggcgctggtgccggccnnnnnnnnnnggaggccgccctgcacacgctgcaagcgctgtttgccgcgacgcaggccgcgcagcgcgcagcgctgcgccgctgggcgctggtgccggccctcttcgaggcccacgcctgcggtacgagggcggtacggactgcctcgctggatctggtgcgcggaggggtggggtcctgttctcgagttgcatgcagggtggcgtcttggagcttcacgctggggttttgggccgtgtttggctgggtctcacttcttcactgacgccaggcaggcagggcgtggcacgaaggcctggcctgccagacgccaaaatgctcctgggcaccctgcactggttccacctcgcaaccgcnnnnnnnnnnggaagccaaaacgctcccggacaccctgcactggttccacctcgcaaccgcgatccctcctttctccccccagttgaccggactgctggccgtgcctgctgcagacgaagacgacagcctggccaaggcggcgctcgccgcgaagctgatgggtgggtggccttgcagggatgtgggtggaggtcaggggccttgcttgctgacgaccttgtactggagatgtatcaggaggggtgcaaaggaagtgtagttgagatgttcaaactgatcaaaacttccactgtctgcctgcatcccgtagcacaactctccctccatcaccccctccttcctctcaaaccccgccattacagaggtgctgacacacaaggtgcagggctggagaaagcacggcactgagcccatcaccgacctcatgtcctgcatgcggagggcgctgtccacgcaagcaggcgaactgcagcccctgttcatgtgagggggtgggggtcctggacgtatgggaagatgccagccagcaagagggcgttaagtggctgagagtatggtccctgcagcctccagggacgctcgttccattcctgactgcaccgtggccgcctctaagtcgtctctttgaaccctgcctcccgcagccaggcccagggctgtgtccagctggtgcacgcgctgagtcagcccatgcccctcatgcaactagagcccgtcgcacttgccgtgctggccacgctcagcgccctcctcaaggacagcgctccagcccgccgctcgtttgggtgagctgggtatgtgatccgcggatgaatgccgagggcgtggggatggtggagagcatgtatcaggaggcagactcttttctgcacgcatgcgctgcccgcatcctccccgacgcaaaggcagttctgtgcggcaccgaggattgnnnnnnnnnnaggacgctcattccatttctgactgcacggtggccgcccctaagtcgtctctttgaaccctgcctcccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatggggctggtggagagcatgtatcaggaagcagactctattctgcatgcttgcgctgcccgcacactgcccgacgtaaaggcagttctgtgcggcaccgaggattgtcccaccctgagggctgctggtgtctccctcacaaatgtaccatgcacaatgcctattgacatcgagcagggaggaggtcggctggacgatactccttgccgccctagagcgggcacgcggcggtctgcccccctcctgggccctccnnnnnnnnnntccaccttgagggctgctggtgtctccatcacaaacgtactatgcacaatgcctttcgacattgagcagggaggaggtcggctggacggtactccttgccgccctggagcgggcatgcggcggtctgcccccctcctgggccctcctctctgccgtcttgcacctggcgacggaggtgtgggcgggcttgaaagtggtaccattgcatttccgtgcagaatccattcggtagtcgtggcgggggagctcaggctttgataacagcaaagctgcagaatcgccttccagtccaaagggctgctccacctcacaggttgttcctggattggcccaggcacacagctgaccccccccactctcctcccttgtaccaatgcacggcagacctgcttcgacccagtggccgcaggtgccctggagggcggcacagaggcagcaccggcccgcccgccnnnnnnnnnnaggccgccggcgccctggaggccggcacagaggcagcaccggcccgcccgccgcccgccctcccgccaacatcgtgcctccaggtcgctaatccaggggcactcggcgcctacctggctctgctgcgcacagctcgatgcgacgtcgcggcgcaccatggcctgccgctcctctgcgccgtgctggaggcgagcgtgggcaaccgcgtgtccgccacagtcgcgggcaccacgccggccctgctggagtggctgccacgggcgcacccccatctgctcccgggcctgctgcgcgcgctgcgcgcctccgccggccactccctccccgtcgccgacctgcgcgccgcgctgggcctgctgcgccccggggcaggtggggacctgggcgcccaccacgacggcctgctgtctctgctgggcgaggtcnnnnnnnnnntgccgcgctgggcctgctgcgccccgggggaggcggggagctgggcgcccaccatgacggcctgctgtctctgctgggcgaggtcgcggccgaccccacccccccggccttcctccacttcgaccccggggcgggggccgggtccggggtcgagagcccggcggcgcgcgccggcctggcctgcgcggcggcacgcaccgggccgctcctgcgtggcgggctggcgctgtcggtctggctgcgccgggaggcagagggccggggggatgtggccttgatgagggagagcgaggtgccgccgaggggccggacgacgccgcgtggcggcgctctgcagggcggcggcgatggccggccaaccaccactccaggcctccagggcaccctggtctggattgaggaggcgcagggccgggccctgnnnnnnnnnnggagggccggagggatgcggccttgacgagggagagcgagccgccgccgaggggccggacgacgccgcgaggcggcgctctgcagggcggcggcgagggccggtcaagccccactccaggccaccagggcaccctggtttggattgaggaggcgcagggccgggccctggcagtggccctggactctgcagcgggcgcggtgtgggtgcatacctggtcccccgcgcatgccgcgctggccttcgacatgggtcgtgggttgaccagtggggcctggcaccacctgtgcctctcgctggcgccggggggcccgctgtcccatgcgacggccacgctgtggctcgacggccgcctgcaggtgcagatttgaggatgatgcttctggaggtctctgggcagtgcggggggacatgggggtgccctggagtgtatggcaggaagggcatcgctggctcgccagtgatacccctccttgcatgtcgacgtggcactatgcaaccacagtcaccttgtaaagatcccccccccccaatcttccctccacccaatcaccatccttgcnnnnnnnnnnactgggcagtatggggggacatgggggtgccctggagtttatggcaggaagggcatcgctggctcgccagtgatagccctccttgcatggcgacgtggcaccatgcaaccacgatcacctcgtaaagttcgcgcccccccccccatcatcttccctccacccaatcaccatccttgcaggcgcagcagcgcgcgcggtaccccgccttccgcggccacccgcccgccgtgcgcctgggcgccgcatccagccccagcgcagtcccccacccccgccccggcccttttgccggccagatggccgcggcgttcctgttcgacggcgcgctgtccgcgcaggcggcgtccgcgctgtgcgcgctgggccccggcttccactccgccttcggcgcgcacgagagcagtgctgcgctggatgcggcgccgcaggaggcccgcgcgctggtggagcgcggcgccggcgcctggccgcgcctgctgtgccgctgcggctcgggcgccggggacggatccgggacgggggcggggggtgaggtcgaaccgagccccggtccccccggcgccgtcgcttgccggcgggtcccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggtgccatgctgcgaggcagctcgctgcaccgcgccgactggccggggcaggcgctcgcggttgcggcgctcctccgcgccgcgtcgggggcgagcctgacccccgacgccgcgcgtgccgccttccgcctggccgcggccgccgggccggcgggggcggccgccacgctgcgcgcgctgtgctgtgacctggcgctgtggaccgcggcacccctggagacgcacctctgcctcgccgactgcctcgtggccctggccgaggtggggcgcagggatgtttgttcctgggcgaggtcgtgccaggggaagcagctgtgctcgcagaacaaccagccgatcggatgcatgcgctgacccggtctggcgggctgggcctgggacctgccattggggcagcggtagtatcctgatataccttcacccgctccgccctcgccttccaggaggaccctgaggcagcctacgcgacgctcagcgtgccggagctggtcgctgcgatgctcaggcacagggtcgccggcgggacagggtccgggaactcagcaccgggctggagcactggagaggccagggccgcacggcgcgcctacctgcgcgcagcggccgccctgctggaaagcaggcacgccaggccggaggctcagcacgaggcctccgcagcagacggcctcgtggtgagttgccgggaatcggtcacgcggccccagcatgaacaagagagtggcagcggggcggcacgcctctgcagggcatctgggccaaattgcacccgctgccattgccgcaggctctgggcagtgctacctgcaacgttgctgcacgatgggggttgcggtgcaacaacgcccaacctctagctgtctgtgggaagagggtctacaaccggaatcgatcgggttttccaccacctctcttccttcctttcttcttcccctccagacgctggtcgccatgctgacagggtcgggggcggcgacggagctcgtgctggacgtgggtcacaccctgctgagcatgctgcgcggcaggtcgctggcgcggcaggcgctgatctgcgggctggaggggctcgggtgcccggccatcctcctcccgctggtgaggccgggggctcaggcagtggcactggagggagggcattggtcagcctgtccccatgctcccggccacaatcaacaccaagcgaccaccaacccgcaggtggggcacccggacgagggcgtgaccctgctggggctgcgcctcatcacggcgtgctcggcgcggcccctggccgacggcgtgctcgccggcctgcaggccctgctcctgccccgccccttccgggatcaaacgcgggacgcgctgctggagatgacgtgtggcggcgcggcctgggactgggtgcggcggtcgcagatggggtggcttgcgttcgaggttgttgggatctgttctgggtgtgattggtgttttactctgaggggccaagcccatgcttcgacttggcaagatggtccaccctgnnnnnnnnnncatggggtggcttacgtttgaggttgttgggatctgtccctgggggtgattggtcttttactctgaggggccaagcccgtgcttcgacttggcaagatggtccaccctgaccgaccttgtaccaggctctgggcagccatcaaccctccaccgacgcgtgcagacatccacgagctccgtgccgctggcgatcaacccgggagtggcgccgctgctggtccagctggcgctgcgggcggcccaagcacagcgcgacgccacgctgcgcgcgctgtgcgccctggccgaggcccatgcccccaaccgcgacggtctgctggccaggccgggactgacctccctcctcctcgacgccgccctgatcgctgggggggggtggggagtggggcgtgaggctggagaggcgattcggagtggagagggaaggagggacctgaattccgcacggccgggcggcgatccattggatgaccccgcctggagcacgctgtgcgcgctgctgtgccacgccgtccgggccgtgcaaggtggcgtgcacgaccacctggcgcccatcctggcgcacgcnnnnnnnnnntcgggccgtgcacggcggcgtgcgcgaccacctggcgcccatcctggcgcacgccgccatgcgggggctgggcgccgtggaccccgaggagggccgggcagcgggcgtgctggtggacgccctgctgcgagccgtcctgggccggctggaacaggcgcagggcccaggtgcgaggcgaggatgtttcgaggagggtgtcgagggtcttggagtgggcgtgggaccgccaggnnnnnnnnnngagggggggcctgaattccgcacggccgggcggcaatccatcggatgaccccgcctggagcacgctgtgcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtttccgaggagggtgttgggggtcttggagtgggcgtgggaccgccaggnnnnnnnnnnattcagcctccccgcactcccttgctgccaatgctgaaccagcaacatcaatccccacgccatcaccatgccaggcgagatnnnnnnnnnntgcctgcaagattcatgagccatcgatggggtgggagaccagcagccctccacgtgcccggtcagcctccccgcactccctggctgcccatgctgaaccagcgacatgagtccccacgccatcaccatgccaggcgagatccccctcccctctcgggcgtccccgtccgaggacgatgacagctggacgctggtcacctcctggctggcagagccgtacctgaccaacgcctgcgagctgtgcgccctcctgcacgcccacctcgcccactccctgcccttgctgtgcggggcgcagtccccgaccgcgggtgccgactcttgtgatgagtggcggtccggcgcagccgacgcggcgcgctggctggccgatcctggggcctcgccgccgggcacgctgcccgccccggcctggcggctgctgggcgtggcgccggggccactgccgcacgacacgctggagctggaggaggcgggctggcgcctgctgcaccgcctggtcggcagcgaggcggcacgcgcc

SEQ ID NO: 48793 - DNA, 91 bp, Chlorella protothecoides
aatgaaatcagagggagaaggggtggtagtcgtggggtgctgcaggggggcggctggggttccaagcccaggggcgccgccgccggggggt

SEQ ID NO: 48794 - DNA, 68 bp, Chlorella protothecoides
catgggcggagccgcggccccggacgtcgacgcctgcgcgccgcgcgcggccaagcgcgcccggccca

SEQ ID NO: 48795 - DNA, 2113 bp, Chlorella protothecoides
  modified_base (266)..(275): a, c, t, g, unknown or other
  modified_base (743)..(752): a, c, t, g, unknown or other
  modified_base (1640)..(1649): a, c, t, g, unknown or other
ggacagggtggggacagggtggggacagggggggccgggaggtgtgcagggagcgcgacgtgtggagagaggaaagggcggagggggggcctgggcccagcatcacagcaccctgtccccatgacccagacaccaccgctcaggtccggcaagacagcaagatgcagtcctcccccgcatgaacaggaggcccgcaatctcccacacctgctccttccccctttcttccacccccccccctttccccaccttgcggaacatctggnnnnnnnnnnccccattaacaggaggcccgcaatcccccacacctgctccttccccctttctcccccccctccccctttccccaccttgcggaacatctgggcggggacaacgtgcacctcgtccaggatgatgagcccccactctcggttcatgatctcgttcatcacattctcagactcctcgctgcgcctccccgagtaggccaccatggtgtaggtggtcacacagacgcccgcggccgcggcaaaccactcgtggttggccgacgtgaagcggcacacctggtcgtcctgtgggtgggagggcgagagcattgctgagccgcggttgagtctcttcttgccaggcacatggcaggcggccatgcaatgcctcatgccccacgccctgcagaatcctcctctccttacccccccctcccccaccacctcactccctcaatccccagaagacataccccctcccccccccctcannnnnnnnnntggccatgcaacccctcatgcccacgccccgcagaatcctcctctcctcccccccaccacctcactccctcaatccccggaagacataccccatccccctcactcgcagcgaggtccacatctggaactggtacttccactggtccaccgacacggcgttggtgcagagcacgaggcaggacttcttcatgcgcgccgcggcactgacgcccaccaggctcttccccgcgccgcagggcagcacgatgatgccggagcgggcgcggccgttgccaaacatctttgccagcgacttctcctggtaggggcggtgagatacgtggggccgcagctccatgctcagcgtggggttggccacgtcgccgcggaagtcgtactcctccagcatggggtagttcagcccgccgggcaggcaccgctgcttcacgtgctccacctggcgcgtgcagggaaggagggaggatgcagggtgggcggggaggggaggtggcgcaggcgtgtggcaatgcatgcaagatgggctccatccaggatgcctgggtgcggcatggagcagcaagagctgcgcgtcgcacccccccatacccggccaggtggggggcggccccattgccacactgaaggccggacagggccgcccacccgcccacgccccccttcccacctgggctgcctcgatctcaaaggcgtgcaactcgcggtcggggtcgatctccaccgggtctatcaggtaggcggggccggccggcggggcaggagcctcgccttgggaaggttctcgagccgaaccaccgcccccatcgaggccagccgcctccccgccacctcccccctcttcagcctcctccccccccgcgtccacgtccgtcttggccagggtggcggccnnnnnnnnnnaatcaggtaggcggggccggccggcgcggcaggagcctcgccttgggaaggtcctcgagccgaagcaccggccccatcggggccagccgcctccccgccacctcgcccctctgcagcctcctccccccccgcctccacgtccgtcttggccagggtggcggccgcggcgtcgcgcacggccgcactgacctcgaagcaatcgtcggcggcgcgcaggacgcgcgccgcgcggatgacggggtcgtgcagtaggcggcgcaggacggcggggtagggcgactccacgaagaaggcgttgcgctggagcaccagcttgacctgggcgcgtccaggggagtggcgcccgggttcctggggctggggatgcccggcggcgcatccatgcacccccggatcccccccgcccaccaccaccacgcacacgcacacacgccttcctcccccacgacatccccgccgccccc

SEQ ID NO: 48796 - DNA, 71 bp, Chlorella protothecoides
acatcgcatgaccctcttccgcccatcacccccccccccgggcaccacccaggctacagcagcatggagga

SEQ ID NO: 48797 - DNA, 61 bp, Chlorella protothecoides
catagatgcgctcctggccgcggcacacgctcaccagcaccctcgccgaggacgcagcgcg

SEQ ID NO: 48798 - DNA, 61 bp, Chlorella protothecoides
cttctgccacccagatctggggctcggaggggagataatcccgacatgtttggaatcgaga

SEQ ID NO: 48799 - DNA, 137 bp, Chlorella protothecoides
ttggcacgtcctgtggaagaggggagtggcgtcgctgctcaggcagcctaccaggcggcctgggggatgcagctcccagcagtgttgggagcaccggaccgctgagctccaggcactgcagcagcacgaccatgcat

SEQ ID NO: 48800 - DNA, 61 bp, Chlorella protothecoides
tcgctggcctccagggccgccagcgcgtggcgcaccagcgcccccaggtgcgtgccgccgg

SEQ ID NO: 48801 - DNA, 61 bp, Chlorella protothecoides
ttgggggttatgcgtttagaaggggggggggaagaagggttagagtgagggtggcgtaggg

SEQ ID NO: 48802 - DNA, 61 bp, Chlorella protothecoides
cgccgcatccgctggaactacgccttcgcgctggggtacaacgcgctggccatccccgccg

SEQ ID NO: 48803 - DNA, 61 bp, Chlorella protothecoides
gcagcccgcggttgaaggcgcgggcggaggggcgctcgtcccagacggtgtacacgtcggc

SEQ ID NO: 48804 - DNA, 77 bp, Chlorella protothecoides
gcagcaccgcctggatgtgagttatgttgggttgggggggggtgacatcgtggaggaaaggacggcggtgggttgtg

SEQ ID NO: 48805 - DNA, 61 bp, Chlorella protothecoides
agccctgctcacatgaactcatggccggggggcgcctcagagggctcccatcaccgtctcc

SEQ ID NO: 48806 - DNA, 73 bp, Chlorella protothecoides
cagcgccaggaagccggggctggcgtacacgatggggccgccaggcaagcgtgggtcggtgagcaggaaggac

SEQ ID NO: 48807 - DNA, 61 bp, Chlorella protothecoides
gcaccaatctttagctggctttacggcagggggatgtgacccactgcagcagcggcatcgc

SEQ ID NO: 48808 - DNA, 6007 bp, Chlorella protothecoides
  modified_base (104)..(113): a, c, t, g, unknown or other
  modified_base (1042)..(1051): a, c, t, g, unknown or other
  modified_base (1592)..(1601): a, c, t, g, unknown or other
  modified_base (2036)..(2045): a, c, t, g, unknown or other
  modified_base (2707)..(2716): a, c, t, g, unknown or other
  modified_base (4223)..(4232): a, c, t, g, unknown or other
  modified_base (4400)..(4409): a, c, t, g, unknown or other
  modified_base (4683)..(4692): a, c, t, g, unknown or other
  modified_base (4763)..(4772): a, c, t, g, unknown or other
  modified_base (4846)..(5017): a, c, t, g, unknown or other
  modified_base (5408)..(5417): a, c, t, g, unknown or other
caggcccacgcagttccagggcagccgctgcgcggcggagtccgggccgggccgcgtggcgggggccagcaggcgctgcgccgccgactcctggtcgggccgcnnnnnnnnnntgcggcggagtccgggccgggccgcgcggcggggggcagcagacgctgcgccgccgactcctggtcgggccgcgcggcggggggcagcaggctggcgctgccaaaggggccgttgaaccctcccgcgccgccgggcgacgccatgccggcgaaactgacggcggccatcattccgtcgggggtgccatttgccggcgggggctggggcaggtggaaagagtggctggggggagccgggggcggtccgtcgccctgccacgtcgccacaggcccgccgcctgggttttgtgatggggggcccctgccgcgggtgcgggggttgggggagctagagggagccgggctcacggtgcctccgaccccgaccgaggtgtggggcgaccccaccatcgtgtcagagctgcggggcgaggggtcacctgcaagccaagggggggggaagggtatgtgttagtaaggggaggtgcaggcatgcctgggacctgtatgttgagccagacccagggacgacagggtcagcacgggacagcatgagagttgttagaccccggcaatctctagcacatacccacacttgcgcaccctgccggcagttggcaaccccggtctgccccagtactcattataatgcgcaccgctgcttgagctccctggggagttgaacacggaagtcacggccgtgagcatgcgctccccatgctctaggagggcgtccgagtaccagcccaggaaaaactcgccctgcggggactgccaacccccattccaggtctggaaaaagcccgtctcctgcattgtaatgagggcatgctgagctggtgggcaaaaagagcaagactggatcaggtttggacccctggcacgccggcacattagaagcgagccctggcacggctatacccctctcgcagcagcaccaccacccaggnnnnnnnnnnctaggtttggacccctggcacgccggcacatgagaagcgagcactggcacggctacacccctctcgcagcagcaccaccacccaggcccacggcttcagagctgccggcctaggagcggaatggccgacagaatcaccccccctcatgcgcgtttgcacccccgcacgttgagacactcgcacctctggatgtgaattgtagctcccagcgtttgaagggccagagttgccccactccgggtggccggcggcacctgcggcgcgcgccaggctggccaaggcccgcctgtcatagcactggaattcgccgatgccctgcgacgaggggtgcagtgggcgcgagtcaggcggctgccaagatgacctgctgtgtgaggcctctgaacgactgctcagctgtcattcagagaatcaaacaggccctgcggccacaaactcatccgccaacctgatacactgccacaccagctatactctcccaggacaccccttcaatcagcctcccggcttcctccttgactcatcatccagccacaaaacnnnnnnnnnntagctatcctctcccaggacaccccttcagtcagcctcccggctccctccttgactcatcatccagccacacaaccccacaccctcgtctccataacaaagttaccccaacatgtgctcacaggaaagcgccagccgtttgtctctgggtaggctgggtatcgcagctctccacacggaccggacccgacaactacctcctctatgagcgagcccagctcgcccatgaactcgtcccggaatgcccttcgacaatggtgagggaaggcgttgtgaagatggctgtcccacacccttgttctttctccctgcttcctccttgccaaacatcaagcagcatcgctggaagggagcgatcgacacgagggcggccgacagcaccccacagggcaccccgctgaagttaccaaaccccctgcccgcgcgtgcccaaatnnnnnnnnnnactggaagggagcgatcgacacaagggcggccgactgcaccccacagggcaccccgctgaagtcaccaaaccccctgcccgcgcgtgcccaaatcacctcatgaagtcaatgtagcactccatgacggagcgacctcgaagcaaccccggctccgtctctgcaaaccaggaaatgtactcccggttgcgttgcccggggctcgactcccggggccggtcggtgaagaagatgtcagggtcgctgtcgccgaccttgtggacccagggtgggaggggcaccagggcgttgtccccaacattgcccccgcaggcatgaaagctcatcaccacctggggcaagggggcatgggcatttgagtggggaacgttaaacaaccccccaacatccgcaagcagcatcctgtaatgtctgtatggccagcagaccccgcatcctggatctcacctggaattttaggcccaggggctttattgcggagaagagctggcggtaaccactccagtcatacctcctgggcgacctctccacggctccccactgccaaatggaagggaggatagagaggtcaatgctggcccttcctcagcaagcttccaggtgcccaggccagcagaaaacccccatgcatggctacccactacctccccttggagccactcannnnnnnnnntagcaagcttcgaggtgcccaggccagcagaatacccccatgcatgtctacccactacctccccttggagccactcacccacacatcgacggccacgccgtggatgccagtggccgccagctggcgaatggcgggtaaaaaccacttggaggaggcgtagcgaaacacgccgtctgcgttcaccgtgtcaagcggcagcatcaccatgaccggcacggaggtggtggcgcaggaggcgggctcctcctcgcccatgctgaccctggtactctgaaaattgctgtgcgagccaggttggcctgcacgcagggtttgtggtgggtggggagggttgcctgcacgtgtgtgccgtccagtgcgggcacgagtgccggatgcagcatgcaatccattgccctgccccagactcacccgcctcccaagctgcctggggcaccatgggccgagcgctaccttgaaagggtccgcctgaccccagggggcgggacgaaaccctgcccactccctgtttgacctctatgctacgtggatttctatgaaaggcaccgaggcgagtgtactggctggtggtgggcctgcaggggctgggcagcatagcccagcgcaccccggcggagcgcgatgcgccaagggtatcggcacagatcaccctctggacgatcgggatgggaaggaatcacgccctgcctcggccaccatatttttctatccctgcctcgggggcgctggcacgcacagcacagcaaactggcacatgcccaaggggtcggggagtacggcgttgcagcttcgcgggatgtgcacacacccgcgctttcttaggccttgacagctaacgacccagctgcttggctagaaaatttactcttgacttacaaggcacagcttggttcaacatgaaatacaatgaagagaactgttcaggggcaccctctctactccacaccctcaatcttgtcctccacatcagtgtacctgaaattgagcatgggtggggtggggcagtgaggcattgcaacagcacatggcagaatgcaggccgacacacgcaggtgcgcctcgctcagcatcattcacaggtgagcaatgcagctgaaccctccttgccccctttacacgccgctcccccccgcgtcctcacatctggcgcagcttctcaatctggtcctcggatgcctcccagtacccgcgcccattggcctccaggaaggtagccaccagcttgcggaaggaattggggttggcctgcatcaacctcgcggccatctccgggtcgtcgatgaaggtgttattagcctttgcgggatgattggggggagaggagggtttggggttgtggaggagtgacagacacgggctgagccaaaggatgtctgcaaggaagcgcaagggctgccctagcagctttcccacatcttgttgcagtcttgtgcccagctcccatcacaaaggccctggtctgtatacattgggagggtccttccagcacacaagcatgtgcctgtgnnnnnnnnnnacgtgttgttgcagtcttgtgcccagctcccgtcgcaaaggccctggtctgtatacattgggagtgtccttccagcacacaagcatgtgcctgtgagttgtgcaggctcactgaactgtaccaaacccctcaaaatactttgctcaaaaacaacctcccccccccccnnnnnnnnnngcccgcatgttgaagcgggcgtgcagcacgctgcgcacgtcgtgcgccgccgccagggtctcgatcagcggcgccagcgcctcgttcagcagccggtcgtccacgtcgcccctggggtgtgaggagaagggaggaaaggcgcggatcgaagagcgtccttttaggaacgagggctgggtccaggggggggcggcgaaacacagcgagatggccccctttcactccccgggcctgcctccaagacgtgatcactcccatccactcctcgcatcannnnnnnnnnagagatgggcccctttcactccccaggcctgcctccaagtcgtgatcactcccatccactcctcgcatcannnnnnnnnnaggtttggggttgtgaaggagtgacagacacgggatgagccggaggatgtctgcaaggaagcgcaagggctgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcaacaccccccccccccccctccaacccccccctctcacacacctcgtcgtacacccagttgtccacggcgcccgcggtggcggaccagcccatggtgttcgtcaggcgcttctgaatctcccgcacaccctcgtaaccgctggacagcatgccctcataccacttggggttgagcagcttggtgcgcgcgtccagcctcaccgtctcgcccagggaccggacctgggcgttggcggtggtggtgtcggcgatgaaggcgcgcggcttctgcccgtcgctgcgcaggccctggaccagcttggtggggtcggagtcgaagtagtggctcacgtctgtgtattgttgttttgggtgtgtgtgtgtgtgtgtgtgaagaaatggggtggtnnnnnnnnnnctcaacacacacacacaccctctctcataccccacctgaactgcaggacggggatgccgttgtcgggctggaaggagaaggccaggggcgtatcgtccaccagcacggtccgccccagcggccgccccagccgcgccaggtccttgacgcaggggtaatcagcgctgggcacggtggccggcctgtacaggcggtggtggaagcaggcggggtagcgcgcctccagctcgtcgcagatgggcaccgcgtattcggccagcccggcggtgaagagcacgacctccgcgcagcgcgcgcagcgcgccaggaactcgcccaggcccgggcgctccaccacgaccacgccggaggggttgaggcgcgagccgcggcccacgctgtaggccaccgcgccgcgcggcaggatgggcacgcgcgcgggggagaaggtggtcaccagcgtgccgtccaggtccaggcagaccaccagtcgggcaggcggcgcgccggggtccagggggggcagcagcggcgcgtcgggggccggggcgtcggcggtgtccggggtgggcggggggccggcaagcgcgggccccgggaccgccccgacg

SEQ ID NO: 48809 - DNA, 65 bp, Chlorella protothecoides
gtgagggggtgagggagcttgttctgggggtcccgggttgcaagcactgcacaggggccataata

SEQ ID NO: 48810 - DNA, 61 bp, Chlorella protothecoides
tcgtcgtctgcagggttgcacaggcgtcggggggtgagcgtgctagtggagcggggcggga

SEQ ID NO: 48811 - DNA, 61 bp, Chlorella protothecoides
acctcagcgatgtgagcgccgtgtcgggggggcacccgctcacctccttccaggccctggg

SEQ ID NO: 48812 - DNA, 61 bp, Chlorella protothecoides
tcttcccctctttccggagggactggcagggtcagctgccgggaacagcagcgcatagact

SEQ ID NO: 48813 - DNA, 61 bp, Chlorella protothecoides
tcaggtggcaacgatgtggaggctggaccgggactatacccggcaagggctggcaaagccc

SEQ ID NO: 48814 - DNA, 61 bp, Chlorella protothecoides
tgacaagggcgggggctgtaagcgtgaggggacctgtcaccctgatcgaggagatgggctg

SEQ ID NO: 48815 - DNA, 61 bp, Chlorella protothecoides
gcgcctgaccgttcggtccggcgaggagggggccggcgccgacatggcgcctgattccctc

SEQ ID NO: 48816 - DNA, 69 bp, Chlorella protothecoides
cactccagcaccggggtgagccggcgtgtgttggtggtggggaagtgatcatgattgctggtggccagc

SEQ ID NO: 48817 - DNA, 61 bp, Chlorella protothecoides
gatgcccagggggccctggccggcgccaggacccccagcgaggaccacaccgagccgaggg

SEQ ID NO: 48818 - DNA, 61 bp, Chlorella protothecoides
tgttgacacagcgcttggtgtcccacacgttcaccagcttctcctcgccgttgtgcacccg

SEQ ID NO: 48819 - DNA, 61 bp, Chlorella protothecoides
gcaccagattcccaaacggcagcagccagggcgtccccgcacctcgagcctggccagcccc

SEQ ID NO: 48820 - DNA, 190 bp, Chlorella protothecoides
gcgtcttctcgctcacattacccagcctgtccaccatctgttggcgaggggcaggggggggttaaggggtcgggtgagattgatgtgtgcgaggctgtagcagtatcagcaggtaaatctgatggcagtggacccaagcagggagaatcggccagtggcgtttgacccaggctgccacagacaccaggtc

SEQ ID NO: 48821 - DNA, 61 bp, Chlorella protothecoides
tctttacagagccatgcctctgtgatcctctaacctcaacgagtctgggggtctgcaaatg

SEQ ID NO: 48822 - DNA, 70 bp, Chlorella protothecoides
cgcgccgcatggatccccactcgccaccgtacaaacgccatgccccggcccccgccaccacctcctgctg

SEQ ID NO: 48823 - DNA, 75 bp, Chlorella protothecoides
atgcccgccccgcagcgccgtgcatcgcgggaggactgccaccagttgtggctttctggggtcgtgcggcgagcc

SEQ ID NO: 48824 - DNA, 61 bp, Chlorella protothecoides
gtcagcgccgtgcggcgtgcagccggcggggctctgaccatctggatgccggcatggaccg

SEQ ID NO: 48825 - DNA, 61 bp, Chlorella protothecoides
agatctttttagatttgtattcactggcgggggcgagacatcagatctcagggcggcctca

SEQ ID NO: 48826 - DNA, 61 bp, Chlorella protothecoides
ccctgaatcaaaccgcatggctgggcaagggaacggacgctaatgcagctccttgtcctcc

SEQ ID NO: 48827 - DNA, 61 bp, Chlorella protothecoides
gtgggctggtccctgctggaccggctgggggacgtgcccagcctgcccgccgtgctttcca

SEQ ID NO: 48828 - DNA, 61 bp, Chlorella protothecoides
agagatcgctgtggcagcttagattgcacgggggcagaccccattgccgccgataccaaat

SEQ ID NO: 48829 - DNA, 61 bp, Chlorella protothecoides
cggagagtacgacgaggcgggccccggcgccgtgcacatgcgctgcctctgacggaatggc

SEQ ID NO: 48830 - DNA, 61 bp, Chlorella protothecoides
tcgctggcctccagggccgccagcgcgtggtgcaccagcgcccccaggtgcgtgccgccgg

SEQ ID NO: 48831 - DNA, 61 bp, Chlorella protothecoides
aggagttcctggcagcaaagacgctggaggggggtgattatggcgggttgtttgaactaaa

SEQ ID NO: 48832 - DNA, 61 bp, Chlorella protothecoides
cgcggcggccgcggcgtcgccgccctcgcgcgtcagcgccagcaggggctgggccaggtcc

SEQ ID NO: 48833 - DNA, 9106 bp, Chlorella protothecoides
  modified_base (508)..(517): a, c, t, g, unknown or other
  modified_base (1111)..(1120): a, c, t, g, unknown or other
  modified_base (2421)..(2430): a, c, t, g, unknown or other
  modified_base (3047)..(3056): a, c, t, g, unknown or other
  modified_base (3293)..(3302): a, c, t, g, unknown or other
  modified_base (3783)..(3792): a, c, t, g, unknown or other
  modified_base (4505)..(4514): a, c, t, g, unknown or other
  modified_base (4574)..(4583): a, c, t, g, unknown or other
  modified_base (5156)..(5165): a, c, t, g, unknown or other
  modified_base (5622)..(5702): a, c, t, g, unknown or other
  modified_base (5811)..(5820): a, c, t, g, unknown or other
  modified_base (5893)..(5902): a, c, t, g, unknown or other
  modified_base (5975)..(6053): a, c, t, g, unknown or other
  modified_base (6473)..(6482): a, c, t, g, unknown or other
  modified_base (7645)..(7654): a, c, t, g, unknown or other
  modified_base (8309)..(8360): a, c, t, g, unknown or other
  modified_base (8637)..(8690): a, c, t, g, unknown or other
gccccgccttcgccccccgtccagccccgctggtactcgagcaccgcctggaggcgggccaggcggtcgacgcggccgcccgcgaccgacacccccaggccgcgacaccgcacctccaagtcgtcgtcgcccagcgccgccagctcggccgccagcgcggcgtcgtgcgcggcgcggagctcgctcggccccgtgggggcggtgaggaaggtggcctgcagccccgccaggaagtcgtccgagaaaacgaaccagccgcgccaggcgcgcagcacgcgcagcacgtgccgccgcagcagctcctggcccatgcgagagtcggcgccgcggtacgcctcctggtcgaggcgcggggaggggaggagatcgggaagggagtcgtgggtgatgtcttcgggtcgaggctggaggttggcgtgccaacgcggagagggcgccgggcgggtgcacgaggcgagctcgtcgcccatccatgctgcatggggttgaggcggtcacaggcgccacnnnnnnnnnnatgccaacgcggagagggtgccgggctggtgcacgggcgggctcgtcgcctgtccatgccgcatggggttgaggcggtcacaggcgccactgctccccctctcatccaccacatccaccccgcaaacaagtggaccggctcacctgcagccccaggaagatgtcggggaggaggggctgaatgcagactcggaagcgcgaggcgttgcgcacgggggccgtggagttgtgcaggatgtcggacaggaggaagaggcgggccaccttgagggggatgggggtctccggcagggtcagggcgtcgctcaggatctccgccacctccgccgctgcagggccattgtggggagtgcgtgtgcgtgtgagtgggatggggtgcagaatgggccaatcaagtgtgagagggcgcctgggtgtcacacagcctgggcagcacacgaggcatccttcgtgaagagagtgccatgccctgtggcccaagggagcaccctttgcacggaggggccccccctccccccccttccccaactaccgccgcgccgcaccggagtccgccatctccagcgcaaacatcatggcagcgcagatgtcctcnnnnnnnnnntgccgctgcagtgccattgtagggagtgcgtgtgcgtgtgcgtgtgagtgggatggggtgcagactgggccaatcaagtgtgagagggcgcgcaggtgtcacacagcctgggtagcacacgaggcatccttcgtgaagggagtgccatgccctgtggcccaaggaagcaccctttgcacggagggaccccccctccccccccgattcccaaccaccgccgcgccgcaccagagtccgccatctccaacgcaaacatcatggcagcgcagatgtcctcccgcgccatggtcagccggcgcaggcagtcctcgaagcgatcgcgctgcgcctccgacagcggccgcgcctcctcgggccggcgccgcccgcccccgccctgcgccgccgtcttggcgatccccgcggcgccgacagtcatggggggagggacccacgcgttgctctcctccaccatcaggaagggctccacccgccagctgcagatgttatgggagtgtttgggcgtgtggcgtgggattacagagggtcgaaggctcatctgtagaccccccccccggtgcagaagcaagcgaccccaggggctcctggtctggaaatctccccgcagctttaaccgacatccatttccagaaccccccccctcctcctcctcctccctgccacctgcgcaggctgtcgccagacgcaagggagaagaggcgccatcggtagtaggcgtgctccgccgacgtggtgtccagcaagaaggcgaactcggggttgcccaactcccgctccatcaccacctgctcgaaggagcagccgtcacggatgacgtagtaggccacggcgtcgatgacgaagcgcgtgcgctcgtcggcgggggggtgcaccacgatccggggtccacggcccagcggcccctgcgccgcatcgtcgcgcgcgccgtgcggcaccaccggcaccgcctcccgccaggtccagcggccgtcggggccgggggcggggggcgcagggtagagcggcgcgccctcctccaccgccaagccgccaggcgggggccaaatgggggccgtgggcaggggcatggccttgccccacccaatgttcagcggcatctcatgcaagaaagcgccgtccagcgcctcccgcgctcggtctgcgtcgtcccgcagctgtcgcggaatgagggggaggttgcagggtgggtgaggtggggatgttgggggatgtgtgggcaggggggcaagggcaaatgtttcccccacccagcaagccctccccgcccttccccttgcccaaacaaaggcgatccccacccnnnnnnnnnngggaatgagggggtggttgcagggtgggtgaggtggggacgtggggggatgtgagggcagagggccaagggcgaatgtttccccgacccaggaaggccttcccacccatcccttgcccaaacaaaggcgatccccacccaccatgaagagcacgaagccggtgtttcgtccccggcggcgctgctcctcgtcccgcggccacatgaccttgaccgagccgatggggccgaagcggccaaactcgcgcagcaggatctgctcgtccacggttggggccatgttgccaacgtacaggtttgtggaggcggggtcgttcacgtcgtgggacccacgctcggcaaagtcgtcgtcggcaggggggaggttgagctccttcctcagctcccgctgcatctgctccctgaagttgaggcaagtgggcagatgaagtacaggggtgagatgcacactactgcatggtgtgggtgtaggaactggatgctgcaaagcacttggggccaaggtgaccatctgacaggggagacccaggaaggcccgccgcagtctggacaccagtttccccacagctactcttgcaaatcatcaaacgcttgccctgccagcccctcacttcttcnnnnnnnnnnaattccccacagctactcttgcaaatcatcagacgcttgccctgccagcccctcacttcttcatgttctccaggaagagatcgattcgcttgggcttgctgccctttggcggcacgggcgccgcctcctgcatggatgagtcatcacgtgtgattacaaacgtgggcaagaccccgcctgcacttgggtgcagggtcccaaatcagcgtggtgctgagcaccatgcgaaacaaatannnnnnnnnntgcctcctgcatggatgagtcatcacatgtgaacacagacgtgggcaagaccccgcctgcatgcgggtgcaggatccccaatcaacgtggtgctgagcaccatgcgaaacaaatacttctcgccttcctccatgaagagggagcaatcaccccatctcagccagccgtcccatcctacacacccaccgcaggctcatcgtcggcctcttccttggagtcaccaaacaccccagcgatgcctggaccatgcagcgagggcatgtacagcttcttctcctgcctggacccactcgcggaggcatcgcccctgctcccaggctggatgacgccgccgcgcacaaagccagtcccgcttggccggcccccgccaaagtccttcacaaactcctcatacacgcgagccgcctcctcctcgtccctctgcataatggtgaaagatgagcgccttgcaggggggtgggggcacgaacgcatgcacctnnnnnnnnnnatccctctgcaaaatggtgaaagatgagcgccttggaggggggtgggggcacgaacgcatgcaccttgtattcggtggcactgtgcactggcactgggatgatgagatcccagaagtcgctcctacttcgatcaggacatttacattccagcagcatttcccaatcaccaagtgacacctttttcttttcctcctcctgctccttctgcctctgtaatgttgatgatccgtcagggggggtgagacgaggggaccttgtggtggtgggaggttcgagcggcccagcatgcatgcacccgagcgagccatcgaggctgagggccacgaccaaccttgaacaggtttttctttttgggcaagacaaaggaagtgctcatcttgctccttcaccggcgaacgacgcagagagggagtgagaaccccgctggcatactcagccgtctaaagcgcagcccaaacgacactcccgtcaatctggaaagtgtcgatgcgggtgtactatggcaaaaacgtgcgcatgccgtccatctcaatggtcatcgacaggacgttcacatctgctgggcgcgcaataggggagaggccccactttccagagggacgacactgcatctccctcgtcgtcatcaggagtacatgggagggcctcacccgatcaagaccagaccttactatattcgatagtcgacttcatcaaggtaaggctcatcatnnnnnnnnnnatcgatgcgggtatactatggcgataacctgcgcatgccgtccatctcaatggtcatcgnnnnnnnnnnatcgtcatcaggagtgcataggagggcctcacccgatcaagacaagaccttactatattcgacagtcgacttcatcaaggtaaggctcatcattgggcaaacactgataaacgaggtttgtgcgcccggctcgcgttgtaagcctcgcattcattgccgcaggtgatgtgtggagaagctcctcattacaatggcctggtacagcttctggagtagagccaaggaagaggccgagaagcccaagctgaagatttgctgcgcctgccccgaaacgaaggtacgtctccgtgtgcataggtcctgctggcacaggctttcttggaatgccctgtgagagaccccttattcttgctggcccacagcgcgcgagggacgagtgcgtgacgctgcacggccccgaatcagcggagtgtgctgccctcatcgaagcccacaaggcctgcctgcgtgcagaggggttcaaggtgtggcggggtggctccgggcgcggctcgagggtatgggctgggtgcaaccggcagcattcatccagtctggggctgctccagggcgcagcagcttgcaggaatctcnnnnnnnnnncatgggctgggggcaaccggcagcattcatcgggtctggggcgactccagggcgcagcagcttgcaggaatctccatgcatcacactctccccctgccctctttgcacctgcagatctgagcccaggcaagatggcgagtcgtgtgaccaagccgcagcgggagaagctggcacaggtggtgggggtgacaggcgcctcaacccgcaccgccctggagtgcctgacggccacggggtggagcctggaggccgcagtggactactactactcctctggagcctaccccgctgcgcgtgggggcaggggccccaagacagacaagtgcgtggctgggagatggtttgggttccacttgcaaggggggaaacacgaccagccagcgcactgccctgcaagtctgtccgcaaccggggcctggaacagcggtcgatgctgatcggactgtgcatgccgacnnnnnnnnnnnnnnnnnnnnnnnnnnnnnnnnnnnnnnnnnnnnnnnnnnnnnnnnnnnnnnnnnnnnnnnnnnnnnnnnncctgctgggtcccacgcgccatgcatctgccccttcccactcgccaaacccttcccctggcgcgcagggcggccatcagcgagctgtttgcccggtaccgggacgaggnnnnnnnnnnggccccagcgcctgccctccgacccagtgcatgtgaaacccggcatccattgtccctccctcgccggcgctgnnnnnnnnnncgccccagcgcctgccctccaacccagtgcttgtgaaccccagcatccattgtccctccctcgccggcgctgnnnnnnnnnnnnnnnnnnnnnnnnnnnnnnnnnnnnnnnnnnnnnnnnnnnnnnnnnnnnnnnnnnnnnnnnnnnnnnnctcgccaaacccttcccccggcgcgcagggcggccatcggcgagctgtttgcccggtaccgggacgagggtgaggaggatttgatcctggcagagggggtttccacgctgtgcgaggacctggaggtcagccccgaggacccggtcatgctggtgctcagctaccacctccaggcggccaccatgtgcgagttcagccgcgaggagttcgaggggggcctggcccgcctggcctgcgactccctgtccaagctcagggcggcgctgccggggctgcgggctcagctggacgacgcctccaggttcccagagatctacaagtacgcctacctcttctccaggtgtgtgtgcggggacagtggttgggttttcaagaggaaggggtgggcaggttgcaaagggggtgctgcctgccagaggnnnnnnnnnntgcctacctcttctccaggtgtgtgtgcaggggcagtggttggggttccaagaggacagggtgggtgggttgcaaagggggtgctgcctgccagagggaagcctgctgccccttcgacctgatcccaagctccagagctcgagactccccagacaagacccgttctgacccaatggaggtcaccctccgccccctcatttcgatgtgcaatccccttgcccccattcccccacaccctcgcaacccccaaccccatgcctcaaacaatcacaacagggagaagggccagaagtgcgtgcagcaggacgtcgccatcgccatgtggcagctgctcctgcccgcccaccgctggcgctacacgcaggactggtgcgacttcctgcaggccaagcacaaccgcgccatctcgcgcgacacctggaatcagctgctggacttcatcctcagcgtcagcccggacttcagcgactacgacgacgctggggcctggccctacctgatagacgagttcgtggagcacatgcgcgagaagcagcagcagcagtgacttgtgtgggtgcaggggttctgagcgctctgtgacgcatgtgctcgagggtcagagctgggatcacaggggtcggaggtcgcggggttcccgggaccagcgtcgagggctcccaggctcaccgtcgagggcttcccgggaccagcttcagaccacgcgcaaacctacgctgcgccccgcagggtcagcgccacggcctcccgccaacccctcacatctcctcgtccagcccgtcctcggtgacgcgcagcctctcgatggcgcccttgatgagctcgctgtcggccgcaggaggctgcaggtccagcgccgcgcagaagcagcgcatcgcctggtccacctccccgagccgcttgtgcaccttgcccatctggaagtaggtgctgacctcctgcggcgcgacgtcctgcagggggggttcaggaagggggatgtttgggtggggcgggacggggcgaggttatgaatttggtgtaccttggcaggcacagtctgccacccgaacgtgccaagaggagcggcttttgccgatcagccaaccgctgcaaccagtgtttcaagctgctgcaacaaccaggccccccactggcaatcatctctccacacaacgtggtgnnnnnnnnnntagtgtttcaagctgctgcaacaagcagcccccccaccctggcaatcatctctccacacaacgtggtgcccagatcacaacccaggcacccacgtgcagcgcctggagctcgtgcagcgcgtcccgtggcctctcgcaggccagcagcacgtttgctgcctcaaacctcgccagtgggttcttggggtccgcagcgatcgccctctgggggatttgaacgaggagaggatcacagggtgactgcctggctacccattaagtgcagcactcggaagaaactgcacaaaactgacctcgtgtgtttggccaatcacatggacccttcccagccatctttgttttggtatcatgcagccaaccactctccaaatccaaaacactcagtccccctcctcccccccccccttcaatccaggctcacgtggagctcaaggagcgcttcttccagccgttccaggcgccgcagcgccatgcccagataacagcgcaggacggaggaggtagggtggatggcagtggcccgccggaagtggtactcggccaggctccacttctcctggcgatagaagatgtggcccatgccgaacctacggggagggtgtggaggggtgggtccaaacacacagcagggacaagggcgggcgggtgggtaatnnnnnnnnnnnnnnnnnnnnnnnnnnnnnnnnnnnnnnnnnnnnnnnnnnnnctgatcggtgtgagggggaggagttcatgaatatggggcatgggtctgacgcgacccgggatctctccggagcctcgtcatcacgccgacctttcatactccggccgtcccaaagttcccgagcggattcctcagcgcctcttgcacagaacccctcgccagcctgatcagggtgccttgatctagtcatgcaacattccccccccccataagatcccacccatccacccagattccctcgtctcccgctccacacgcgcccccccccccccccccnnnnnnnnnnnnnnnnnnnnnnnnnnnnnnnnnnnnnnnnnnnnnnnnnnnnnnagtgtcgcggctcgatgcgcagcgctgcgcggtagcagcccatggccttgtcaaagtcctccagggccaggaattcgtgccccgccagcgtgtgcgcgtaggcgcgcccgccgtccagctgcagcgcgcggcggaagaagcgcagcgcggtgtcgtggtcgcgctgcaggctgaagcagttgccggccgcacaccatgcggcggggctcagacggtccagcgccagcaggtcctgcgccagcgcagacagcgcggggccggcgcgcaggtgccacagcaccgtgctgtaggcctccatgtcggccaggcgcccgggctccagcgcacgcgcgcgcgcgaaggcacgcgcggactcggcgtagcgcaccgcgccggccagcgcgcggcccgtcgtgcacagcgcccaccccgtctcg

SEQ ID NO: 48834 - DNA, 61 bp, Chlorella protothecoides
cgcttcaacacggtgtgctttgccggcagggcgccgtccgggggacagaacgtcgatagct

SEQ ID NO: 48835 - DNA, 61 bp, Chlorella protothecoides
tgtctaaactactatgcggctggcctgggggggagatagagggcatacatgtatgcacaag

SEQ ID NO: 48836 - DNA, 61 bp, Chlorella protothecoides
tgatgagccgcagcatgacgggagggggggggcggggacgcaggcaccgggccgatgagtc

SEQ ID NO: 48837 - DNA, 61 bp, Chlorella protothecoides
catctggtagacaagtgagggaatggcttgggcattcctccactgacagtggatcatcaca

SEQ ID NO: 48838 - DNA, 61 bp, Chlorella protothecoides
ccggcagattctgtttggggggggggtctgcccccgggggggccctttctccactttcagg

SEQ ID NO: 48839 - DNA, 73 bp, Chlorella protothecoides
ccagggcttctgcttcctgaacagcgcggcagtggccgcggcggcggcgcgcgccgccggcgccgcacgggtt

SEQ ID NO: 48840 - DNA, 61 bp, Chlorella protothecoides
caaggtgtggagtttttttgggggggggggggtcgcgtgggaagggctcagggtcgaggag

SEQ ID NO: 48841 - DNA, 61 bp, Chlorella protothecoides
tcttttattttttttttttttatttctttgcgtttctctttttctaaacctttttgtggtt

SEQ ID NO: 48842 - DNA, 61 bp, Chlorella protothecoides
ccttgaaggaggtgcagaggctcgaggaggggctgactaccgggcaactcccatcgcagat

SEQ ID NO: 48843 - DNA, 61 bp, Chlorella protothecoides
gaatgcgcaggagcagctggcgcggcggggggtccggagcggcaaagcgctgcacccggca

SEQ ID NO: 48844 - DNA, 61 bp, Chlorella protothecoides
gcggctgcacctgctcaagagcgtcctaggggagagactgggcggcacagatgtgggtttc

SEQ ID NO: 48845 - DNA, 76 bp, Chlorella protothecoides
cgggtcccgcctcgcctcgccgcccagcctggcctccagctcgccacggcgcctcgccagcaggccggcctcctcg

SEQ ID NO: 48846 - DNA, 61 bp, Chlorella protothecoides
ctgccaagagagtgtgtatggagggggggggctttgaggggggttgaagcagttattggcc

SEQ ID NO: 48847 - DNA, 61 bp, Chlorella protothecoides
tgttggttgggaatgcagggtgatggcgggggggagtgatgggcaccaagcaagtggcgcc

SEQ ID NO: 48848 - DNA, 61 bp, Chlorella protothecoides
acgtcgcggtccgacatcgtcggccgcgccgcgccggtggcggccgcgggggcctcggccg

SEQ ID NO: 48849 - DNA, 61 bp, Chlorella protothecoides
acctcgtgaccgaccttggcagcggccagggaaggtggtgtttgtgggggatgaagaaccc

SEQ ID NO: 48850 - DNA, 61 bp, Chlorella protothecoides
cggcggtgggcgggcgcgagggcgcggcggtggtgcgccgtctggccctggccaccgccgc

SEQ ID NO: 48851 - DNA, 61 bp, Chlorella protothecoides
cgtgatgcggaccgccacgacgtggcccgcgggcgggcggcggccggggccctcgaagtcg

SEQ ID NO: 48852 - DNA, 61 bp, Chlorella protothecoides
cggcggtgggcgggcgcgagggcgcggcggcggtgcgccgtctggccctggccaccgccgc

SEQ ID NO: 48853 - DNA, 61 bp, Chlorella protothecoides
ctaggtcgtcatggccgtgggttgcggcggggcgggggtaccccgccccgctgccggcacc

SEQ ID NO: 48854 - DNA, 90 bp, Chlorella protothecoides
tgcatcacctctttggaggggacttcccccaatgcacacacttgtgctgggccacggaggtgtcggagtgaacagtaaaacgcaccacac

SEQ ID NO: 48855 - DNA, 61 bp, Chlorella protothecoides
ccctacatgcgcgcgtacgagcggcaggaggactttgcgggggtcaaggaccctccccccg

SEQ ID NO: 48856 - DNA, 61 bp, Chlorella protothecoides
cagcccgcgcggccccacgggcgtgacgatacgcggggagagcacggcgtggcccgcggtg

SEQ ID NO: 48857 - DNA, 61 bp, Chlorella protothecoides
ccaaagggcagcagcaggcccccccccggcgctgcgcaggctgcgcccaggcacgacacct

SEQ ID NO: 48858 - DNA, 61 bp, Chlorella protothecoides
ctgcctcgcgcacgacggtggagacgcgggggaaggagcccaggcgccggccctccagccc

SEQ ID NO: 48859 - DNA, 61 bp, Chlorella protothecoides
ctcgcacggtgtccccgggatggcggcggggggccttggacctgggcgcttggggcggtgc

SEQ ID NO: 48860 - DNA, 61 bp, Chlorella protothecoides
cacgcgcgacggcagcgtcttctgctgggaagggcgcgccgactacttccccgccggcgcg

SEQ ID NO: 48861 - DNA, 61 bp, Chlorella protothecoides
ttcccagagtcgccaggttcacggcggggggatgcagccgtgtgaactcgatggtggcggt

SEQ ID NO: 48862 - DNA, 61 bp, Chlorella protothecoides
cctgtccaccatgctggccacgggcggcgccggccagctgtacccggtgaccaccaacccg

SEQ ID NO: 48863 - DNA, 61 bp, Chlorella protothecoides
cggctcagcgggcgcctctgtgtccgccatgggtgatccagccgctgccattggggacgac

SEQ ID NO: 48864 - DNA, 61 bp, Chlorella protothecoides
cggtctgcatgccgagtgtggaaggggggggggtgaggatgccgagcggagggatatgaaa

SEQ ID NO: 48865 - DNA, 61 bp, Chlorella protothecoides
ctaataaactaactaataaactaactattagagtaaataagtaaataagtaagtaactaat

SEQ ID NO: 48866 - DNA, 61 bp, Chlorella protothecoides
ccgcgctggccgacgcgctggaggctcggggcgccgacgccttcaccgccgccgtccagga

SEQ ID NO: 48867 - DNA, 61 bp, Chlorella protothecoides
cctgagtctcgggcgtgatgtcatgggagggggaaccccaccgcggcatctgccaccagag

SEQ ID NO: 48868 - DNA, 61 bp, Chlorella protothecoides
aacggagaagggcgagacgatactgtcagggggcagtgctttggcagaagcctgcaccgca

SEQ ID NO: 48869 - DNA, 61 bp, Chlorella protothecoides
ttaactggaacaacatttgtaagttcttgggatactcatggcttagctacttcttatttag

SEQ ID NO: 48870 - DNA, 61 bp, Chlorella protothecoides
cgaagctatgaggtctaccgggagcggggggggggtggaagggttccatgaagggtacagg

SEQ ID NO: 48871 - DNA, 84 bp, Chlorella protothecoides
gtttttgcaggtattgatgctgacttagacgaacaaatcgaattcggtgcatttcaaaaacttggtgataaatctacgcctcga

SEQ ID NO: 48872 - DNA, 71 bp, Chlorella protothecoides
caagttagtaagtccattcatcatgtgctaccatctacttctgtttcccgcgctctgtgagctgccgacgc

SEQ ID NO: 48873 - DNA, 67 bp, Chlorella protothecoides
aatttctaaaatgtatacacatttatataaattacaacaatcgtttcctcaaaaacttcaaaaaaaa

SEQ ID NO: 48874 - DNA, 107 bp, Chlorella protothecoides
taagagattttttaattttaaaaattaaaattatgagtaaaatttacgattggtttgaagaacgccttgaaattcaatcaattgctgatgatatttccagtaaatat

SEQ ID NO: 48875 - DNA, 87 bp, Chlorella protothecoides
ataaacctattgaaatgaagcaacccgaaagtattaaattattattacgggaaattcaagtactttgtattagtttagaaattttcg

SEQ ID NO: 48876 - DNA, 143 bp, Chlorella protothecoides
tctcgatacaaaccttgattattgctgccagtgttgttgttaccgatgttctgggcccctgtgttgccattgccaatgtttccgctagcgtcatgtagacatttctcgacgcccacggcgacgcactcaaccacagagacggc

SEQ ID NO: 48877 - DNA, 117 bp, Chlorella protothecoides
tttaataaacaatgcaaaaaacataaaaaggaccatatttatttactcaagtactataagagtgtaatccacaatccatatagtgaaataaacaggttaaaataaatgatatttatt

SEQ ID NO: 48878 - DNA, 67 bp, Chlorella protothecoides
ctagctttacaacctaatatttgattttgtctaagtttaaaactagatattgatttttttgcacaag

SEQ ID NO: 48879 - DNA, 62 bp, Chlorella protothecoides
ttttatcacccgatccgactaaaaataaatcagtatcgtatttaaaataccctatttatttt

SEQ ID NO: 48880 - DNA, 80 bp, Chlorella protothecoides
tttttttgttataattttgcataataaacttggtttatttaattattctatataatgttgggtaaaataaatgaaattta

SEQ ID NO: 48881 - DNA, 61 bp, Chlorella protothecoides
taaatataaaaaatgaaatcatttaaaaatactaatagcaaaaatttttatttacaaataa

SEQ ID NO: 48882 - DNA, 64 bp, Chlorella protothecoides
atgtatgaggaggggggtatctggcccctcgtaaggaggcccctgggccaccaggggcccatcg

SEQ ID NO: 48883 - DNA, 61 bp, Chlorella protothecoides
taacatgcgagtcgaattattctatggcggtcgtccaagagaagaagcggcgcagtatatt

SEQ ID NO: 48884 - DNA, 71 bp, Chlorella protothecoides
gtatcagatatctccctcctaatcccaatcaaagaccctcgactcaccacccctcctgcagatgtctgggt

SEQ ID NO: 48885 - DNA, 86 bp, Chlorella protothecoides
gtgcacccctgggcaatggtaagatggtcccgcgtccaaggtttgggtgccagtggacggatgcagaccctctaatgcgcagcgat

SEQ ID NO: 48886 - DNA, 89 bp, Chlorella protothecoides
gccatgggcgggggctatctccgactgtggggaccagggggcaacaccctcgcattcagcagcagtgacagggtgagttgcccagcata

SEQ ID NO: 48887 - DNA, 61 bp, Chlorella protothecoides
aaggcttcggaatttttccttaaccacgccactttttctaagtcgccggctcattcttcaa

SEQ ID NO: 48888 - DNA, 65 bp, Chlorella protothecoides
acattcatgcgacagctccaggtttcactgctccaaatgtattagatcctacaagttttacttgg

SEQ ID NO: 48889 - DNA, 61 bp, Chlorella protothecoides
ttgttgtttaataatactactaatttcatctggtttgatttttaccataataagatgaaca

SEQ ID NO: 48890 - DNA, 61 bp, Chlorella protothecoides
tagtagtaccgccgcccatcggtgcaggtcacctcctgccactcggtgccgggcacgcttt

SEQ ID NO: 48891 - DNA, 123 bp, Chlorella protothecoides
gtttatctgagacctgtagtgtacgcacgtcgcttcatacatccccatcccctcaacggaagggtcactcacataccatgtaacactggttactgcaagagttgaaagaatggaggacacata

SEQ ID NO: 48892 - DNA, 76 bp, Chlorella protothecoides
agaggcatcatgctcctttgagcagcgccagggtcatgatgcacttgtatcacccacgactcacactcgcttgttt

SEQ ID NO: 48893 - DNA, 61 bp, Chlorella protothecoides
gtccagttgcattgggtggtggcggtggggtgcccagggcaggggatggtgatgcagagat

SEQ ID NO: 48894 - DNA, 61 bp, Chlorella protothecoides
ctgatctcacagaaccctcgtattccctcgtcttgcaggtgtcatgccagaccgatagctt

SEQ ID NO: 48895 - DNA, 4625 bp, Chlorella protothecoides
  modified_base (479)..(488): a, c, t, g, unknown or other
  modified_base (741)..(750): a, c, t, g, unknown or other
  modified_base (1437)..(1446): a, c, t, g, unknown or other
  modified_base (1757)..(1766): a, c, t, g, unknown or other
  modified_base (2340)..(2349): a, c, t, g, unknown or other
  modified_base (3070)..(3079): a, c, t, g, unknown or other
  modified_base (3801)..(3810): a, c, t, g, unknown or other
  modified_base (4370)..(4379): a, c, t, g, unknown or other
ggtggggctggaaaggggggagggggggaggtcgggcgggcatggcgaggtgccgatagtggaacgagtcgcctccatgtgccaggccaccgcccagtcctccctcgccccctaaaattccactcgtgacgtgccgtgcgagccccgcttttccacatgagcgaacgagagtgtgtgatacttttgagcgtgcaagctatgaattgcctgcaggcgccgacgcaccctgccggtgtcgtgtaacagctgggtgctatgtgtgtgctgggcggcagccgatgagtgctgagccagggtgccagtgagcagagggctgaggcatgggcgaggcggtgaagcatgtccttggtatccaatgagagggaactgccaggtgacaagcgtacaaagccggtaggaagggagcagacgttatcaactcagctactcatcttgctctccagtccagaagggtcagacccagttgcatctggcagcannnnnnnnnncccttggtatcaaatgggagggaactgccaggtgacaagtgtacaaagccgggtaggaagggagcagacgttatcgattcagctactcatcttgctctccagtccataagggtcagacccagttgcatctggcagcaccagggctgccctcctgaaacatatcccttccctgcccgtgccttcattcatacagctctttgactcctggtcttttactccctactagcaagcaggaactatgacacccggctcnnnnnnnnnnccccgtgccttcattcatacagctcttgactcctggtcttttattccctgctagcaagcaggaactatgacacccggctctgccactcctccccgtcccacctcattgtcaacttgtatgaaggttgttaccatctgcacttccaccacaaagaccaagaagagggcagggcaacatcacctcccaggccataccccgacggcaatcaggtgtagctggccttgttcagcacgactccctcgaaccgggtctggaaccacttcatggcgtcgtccttggtcacgcggtgctgcacgcccacacgggccagctgcttcctgcgcttcgccacccggtagccggggcgctccagcacgacgtagaagtccatgcctgttggtgcgaagggaaggggggggaggtgagtcaggatgaccaagggcgagggagatggagcaggagaaggggattgagagcaatgggtcgagaggtactgccttggggtgtggaagggaacctgaaaggaataatgtggtaatgaaacagcagaaagggaacaaagagaaagaaaatatatatcaggtgtagccagggatgcttgccccgcgccgccctgccacccagccgcgtcttgcgacgcgcccaagtggcggggcgccttgataggcatggggcgtacacccatccggcgtcgctttgccaaccgcnnnnnnnnnnagcgacgcgcccaagtggcagggcgccttgataggcacggggcgcacacccatccggcgtcgctttgccaaccgcgctcatgctctgccgcaggcggtttttcacgcagcaggcaatcagtattttacggggcattaatggtaggggggggggggtattttttggggagggggctgaggtggggttggtgtggtggcaggtggagccgacgaggtgtgtgcggccaaaagggaggttgcatgagcagggcacgtgggtgcatatagaagggaatgtgctaagtcgctccccaagcatgacacgaggaccannnnnnnnnntggccaaaagggacgttgcatgagaagggcacttgggtgcatatagaagggaatgtgctgagtcgctccccaagcatgacacgaggaccatccagcctcgcaagcctggcgcaggtaggcccatggactcctggcacaacccctcccaccctcactctaccagcccccagccttctcaccgtagatgccggtggaggggtcgtacttgatgcccaggtcgatgtgctcggtgatgccgaagccaaagttgccggagtcggagaagttgcggcgcagcagctcgtactccttgaccttcaggccggcctccagcagctggagcgccttctcgccgcgcacggtgacgtggcaggagatcttctcgttgcggcgcacagaccactggcgcacggtgtaccgggccttgccgaacacgggctgctgcccggtcagctgctccagcacctgaggagggggaggcgcgggagtgacatggattcccagctttcttcaccttcgtaacaacatgagtgcacgggacggtgacagtgccggctcgccgctgggccaaggtttcgcctcgtcatcgggagcnnnnnnnnnntggggacagtgccggcttgccgctggggccaaggtttcgcctcgtcatcgggagctgcactgccccagccccaggccggggcccgtgtcgacagccgtccgcgacgtcacgcccactccccgctacgcgacagccgctttgcagccccacatattgtttggtaggatgtagctgcagggatatatcccgcagcacccccaccctccgcaccttggcggccttctgcagacgatcgccagactctcccacgcagcagttcagcaccagcttcgcgacgcggatttcccgcatggggttggatgccttcttgtccgcctgcaggggagggggtgggggggccaacagggctcagcacccattgtctctcgagctggccaggcaggccgccgcaggcacgcctctgtctccgtcaggcccgtgcatccccgcggctcaccaccatcgtgtcgagtaggccctctctacagcctacaggcacctgaaagagggatgcgctcgcgtggccggcccgtatacagagcgaggtcccccgccggggtcgtaagcgcggggggaccctgtcggtttcccgccaccatatcacggacctccgggcccagggcgcaagagccatgcatggacgggaaagatgagcaggctcatgcacgaacttccaaggatgaccagcaacatactcaaattgcacattcaactcatcccaggggtgccattccggcgcatnnnnnnnnnngttttccaaggatgaccagcaacatactcaatttgcacattcgactcatcccaggggtgccattccggcgcatgtgacggtactctccccttgacggcagagagggccccatacatccgatcaaaccctcccaagtacatcagccgcaggctggccccgcgcatttgtcctgcgaacatgtcaggagtatgctcaggagggcctgcttcgcgaattacatcgactcgctcgcaccttctggctgcagtggcacccaggctccttcgacagcagaggcccttttccagtctaggtgcgacaaggagggacaaggagtcgcactatgcaccgttgtatcatgagcgttcgtactccgcatcgggatttcacgaatgcaccatacgtttctccgtaggacgctcctgcacaccagcggcaaggagggatactgtagtgtcagcaagggccatccccccacagcactttgcctccatcatcgagggcgacaccaaggccactcccatcggcgatgagaggtgggatgtttggaggtcggtggttctagaggggcacgtatggctcgatggattcaggcgtggtgcatcgcctgcactccgtgctcccaacagaccccagcagacatggccaccagggcgctgtcgctcgccatctgcagagcagcatgacacaaacctttcctcaccctcagccccattcccacccttcagcgaggtgtatgcggnnnnnnnnnncgacacaagcctttccccaccctcagctcattcccacccttcagcgaggtgtatgcggagtacgttgcggcgtaccagcgcacgctgggcatccccggcgccgtggagttctcgcatggccccgacggcgtgccctgcgtccgcttgcttcaccccaccggctccagcgccactgtcagcctgtcaggcgccggggtcctgagctggacggctccccagggtcacgagatgttgcacgtgcggcgcggcgggcggcggcgcggcgcgccaccggccggtggcgtgaccctggcctggccgcagtggggcccgggcctggcgctgcccactgacggcgtgctgcgcagcctgccctggacgccaatccagacctcttgcgaggcggagaacgaggacgcggaggaggaggaggaggaggaggaggagggggaggaggaggaggaggaggaggaggaggagggagagggggaggaagaggatggcgacgaggacgacgaggacgaggaggaggaggacgaggaggaggcgggggcagtcgagccggcgccgcagccgctggnnnnnnnnnncgggggcggtcgagccggcgccgcagccgctggacagcaggcccagcgtggtgctgcatgccacctcagaccgcgcggtgcatccctccttcccccatgacttcgaggcggtctacgcggtcagcctgctggcccccgagcccgaggcgccgcccggctgggaggggcgcgaggaggaggccgcgctccgcgctgcgcacccaccctccgcacagcagcgcgcgcgcgaggcggcagcggcggccg

SEQ ID NO: 48896 - DNA, 183 bp, Chlorella protothecoides
tccagccatgattgatatcgagggctgcgcctccgactcttagtatggtggtgagcgagccacagtcctcacgcatcagcacagcaagataccactatatggatgaattctgccctgttcattagatgagcaaccccgctttcccagatccttaccaagtggtcgagcgacatgtcctccctt

SEQ ID NO: 48897 - DNA, 111 bp, Chlorella protothecoides
tatattcctctctgccttcttgctggcgctttgctcagtctccctggctgcggtgagtttccgcgacgcattgagccggaggatgtccgggtgtcgcccggagcagtggtc

SEQ ID NO: 48898 - DNA, 61 bp, Chlorella protothecoides
ggggtggatgaaggtgcgcggctgacaactcgaagagcctgctgccaggccatggtatgtc

SEQ ID NO: 48899 - DNA, 61 bp, Chlorella protothecoides
catcaaccagtacattgacacgagtggtggtgaggaggaggcaccctctgttgagggcacc

SEQ ID NO: 48900 - DNA, 156 bp, Chlorella protothecoides
gtgggagggctgtgacgttgttgtgtccttatacaagacgggcagctggcgttttttcaacagacctgactcctccctctcacataaaaacacccacaccatcactcccacgctcagttctacgaagtggatgatgtagaggcacaccaggccaag

SEQ ID NO: 48901 - DNA, 61 bp, Chlorella protothecoides
ccgcgagctcgggcagggcatgctggctggtgccctccatgccccacgccgccgagtgagc

SEQ ID NO: 48902 - DNA, 72 bp, Chlorella protothecoides
cagcagagctcccgacggagctgccgcccccgcgcggcatcgaacacaccatcgagttgaaggaggggacgc

SEQ ID NO: 48903 - DNA, 75 bp, Chlorella protothecoides
aggactggcacagctccaagggatgaggcccaccgaatcacagcctgctggagaaatcattccaccaccctgcga

SEQ ID NO: 48904 - DNA, 66 bp, Chlorella protothecoides
cacatccccaaccaagctcgttgccagaaaaaaactatcttcacggcgttcacctcgcagtcatcc

SEQ ID NO: 48905 - DNA, 71 bp, Chlorella protothecoides
ttgttggttcgaggcatccctatcgggctgtcgaaaaaaccggaaccgtaggcaaaatagaaagggtgctc

SEQ ID NO: 48906 - DNA, 61 bp, Chlorella protothecoides
ttccccatcatgtcgttcagacccttggcggggaaggtttgctgcaggaccccctcctgtg

SEQ ID NO: 48907 - DNA, 68 bp, Chlorella protothecoides
cccccgaagcaacatcttccatgtaagctttctttgcaagaggcacagtgacctggatggtgatctaa

SEQ ID NO: 48908 - DNA, 68 bp, Chlorella protothecoides
ctgcggcattattgggtggtgcggaggacgtgtgcaacaccccctgcagatgaagactccgtggagtc

SEQ ID NO: 48909 - DNA, 72 bp, Chlorella protothecoides
tgtgcaaagtcaaggacctacgtgccctccctgcgcaggtgcacccccccactgccgtccagcattgcgctg

SEQ ID NO: 48910 - DNA, 61 bp, Chlorella protothecoides
cagtgtctcgccctcatctgtgaccttcaccgccagcaactggagcacgccgcagtatgtc

SEQ ID NO: 48911 - DNA, 72 bp, Chlorella protothecoides
ggggtttcgggcagggtgagatctcgatcacgttcgtcagccgactctaccgacacattgagagtgtggagg

SEQ ID NO: 48912 - DNA, 77 bp, Chlorella protothecoides
tgtggagatggcagctcttgccttttgccaccgactgcccggccttgcaatgcagcatactccaccacactctcatc

SEQ ID NO: 48913 - DNA, 32665 bp, Chlorella protothecoides
  modified_base (437)..(446): a, c, t, g, unknown or other
  modified_base (706)..(715): a, c, t, g, unknown or other
  modified_base (1123)..(1132): a, c, t, g, unknown or other
  modified_base (1747)..(1756): a, c, t, g, unknown or other
  modified_base (2387)..(2396): a, c, t, g, unknown or other
  modified_base (3934)..(3943): a, c, t, g, unknown or other
  modified_base (4245)..(4254): a, c, t, g, unknown or other
  modified_base (4697)..(4706): a, c, t, g, unknown or other
  modified_base (4905)..(4914): a, c, t, g, unknown or other
  modified_base (6474)..(6483): a, c, t, g, unknown or other
  modified_base (6720)..(6729): a, c, t, g, unknown or other
  modified_base (7005)..(7014): a, c, t, g, unknown or other
  modified_base (7367)..(7376): a, c, t, g, unknown or other
  modified_base (7560)..(7569): a, c, t, g, unknown or other
  modified_base (7626)..(7635): a, c, t, g, unknown or other
  modified_base (7795)..(7804): a, c, t, g, unknown or other
  modified_base (8956)..(8965): a, c, t, g, unknown or other
  modified_base (9607)..(9616): a, c, t, g, unknown or other
  modified_base (9704)..(9713): a, c, t, g, unknown or other
  modified_base (9804)..(9813): a, c, t, g, unknown or other
  modified_base (9867)..(9876): a, c, t, g, unknown or other
  modified_base (10698)..(10707): a, c, t, g, unknown or other
  modified_base (12715)..(12724): a, c, t, g, unknown or other
  modified_base (13823)..(13832): a, c, t, g, unknown or other
  modified_base (17424)..(17433): a, c, t, g, unknown or other
  modified_base (17528)..(17537): a, c, t, g, unknown or other
  modified_base (18112)..(18121): a, c, t, g, unknown or other
  modified_base (21266)..(21275): a, c, t, g, unknown or other
  modified_base (22110)..(22141): a, c, t, g, unknown or other
  modified_base (22256)..(22265): a, c, t, g, unknown or other
  modified_base (22571)..(22580): a, c, t, g, unknown or other
  modified_base (22687)..(22696): a, c, t, g, unknown or other
  modified_base (22918)..(22979): a, c, t, g, unknown or other
  modified_base (23223)..(23232): a, c, t, g, unknown or other
  modified_base (23340)..(23349): a, c, t, g, unknown or other
  modified_base (23854)..(23863): a, c, t, g, unknown or other
  modified_base (24417)..(24426): a, c, t, g, unknown or other
  modified_base (26195)..(26204): a, c, t, g, unknown or other
  modified_base (26586)..(26595): a, c, t, g, unknown or other
  modified_base (27812)..(27821): a, c, t, g, unknown or other
  modified_base (28072)..(28164): a, c, t, g, unknown or other
  modified_base (28264)..(28273): a, c, t, g, unknown or other
  modified_base (28373)..(28382): a, c, t, g, unknown or other
  modified_base (28531)..(28616): a, c, t, g, unknown or other
  modified_base (28945)..(28954): a, c, t, g, unknown or other
  modified_base (29314)..(29323): a, c, t, g, unknown or other
  modified_base (29669)..(29678): a, c, t, g, unknown or other
  modified_base (29912)..(29921): a, c, t, g, unknown or other
  modified_base (30407)..(30416): a, c, t, g, unknown or other
  modified_base (30591)..(30600): a, c, t, g, unknown or other
  modified_base (30978)..(31047): a, c, t, g, unknown or other
  modified_base (31709)..(31718): a, c, t, g, unknown or other
gccagctccgcgcggaccatggccgccgtgcgctcggccggcacgcccagcgccgctgccaggcggcagacaaacggcgcgggggggaggggcagggggccgaccagtgacgccgcgccgtctcgcgccgccatggccgcctccagcgccgcctgcacgccgcgacgcagcatcgcgtcgcgtccgtttgccgtggccgggtggactaccaggtctgggccggcctcctgtggaggacagggaggagagggacgggcttggggtgtctggcaggcggggcgctcgggtttggaggaggggggccggtgcgaggcggtggggaacccagttgggacggggggcccccaacgtcaagatgccgtggccctcatctgcctcacatcggactccccacctggttgagcgcggccagcctgccgaggccctccagggagtannnnnnnnnnatggcccccaacgtcaagataccgtggccctcatctgcctcaaatccgactccccacctggttgagcgtggccagcctgccgaggccctccagggagtagtcctcgccctgcagtaccttgtcgtcctccagccggcgcaagagctgacaggcctccgtttccagctcggccctctgcgttgccgggagctgtgcgccgccggtccgaccgtcgtgctccacccaccatgagggcggggcgggcggagcagaggcggtcnnnnnnnnnngggcctccgtttccaggtcggccctctgcgttgccgggagccgtgcgccgccggtccgaccgtcgtgccccacccaccacgagggcggggcgggcggagcagaggcggtctccttagacctgccggaagggatggaacttgtgctcggcgcagcagaagaccccacaccgtcctcaaagtcccagagggggcgtttggcagcagggagcgtcgactctgggtcagggatgaacacctgtgcagaagggggcgtagggtggggggaaaggtgctctggagcgatgggtggccatgaccctggagggacacaaggtccgggcaggggcagcagactaggcaggggcccagcggatggccattgagcaattgagcccggccgaccatggcaatgccggacaagtgtgggannnnnnnnnnatagggtggggggaaaggtgctctgcagcgatgggtggccatgaccctggagggacgcaaggtctgggcaggggcagcagactaggaaggggcccagtgaatggccattgagtaattgagcccggtcgaccatggcaatgccggacaagtgtgggagattcccagccgcgacgtcctatgccaatacttctctcagcgagaccgtccccatcaccctttctccacccaaacccctgccagctcaccatcttgcccccgagggaacggtccctgacccagcgccctccgtgctgtcttcggcctcccctgccaatccaccccagcctgtcctggaacttgatccccagggctaccagggcggcggctcccagggccgtccaccctagccagttgaaagagggctgatagccggactggtacggcgatggccgaggaccagacactacatactgcttgaaaacagtggaaagggagaatggggttgggaagcctgcgccagtcaggacttgaaacagttcacatgcattgagggcagttttccactccacccgcccctgggctcacccctcttgatgcattgggcaaagccaccctatgccaggctctggacaggcnnnnnnnnnntattgagggcagtgttccactccacccgcccctgggcccacccctcttgatgcattgggcgaagccaccctatgccaggctctggacaggccctcgctcagattggctgccgagccggtccaggacgacgcctgggcctgggctgtcgtagagcgcgtcgccggctgctctgtggcaatgtcagtctgtaccgaaggattgagtgtttgcagcttcactactctgtcgatcaattgatttggttggcaggcgtacgagctgtggcatgcattgtcaggtatagaactggggcgacgtgcactttgcacaagctcagcccctgcaaaccaatcctgactcgggcgcactctggcaacggaggggtcctggaggtttacgaggtgtctgcgaggcctccagccatccgcaagcgagggacgagcttgcaagaggatggcagccgcgatggaggtgcccaaaagcgcctggcttatcggcttacttgcttggctctgcgcagagcggcattcgacatctgatgggggtgccgaggggccagcgggaggggacgcagctctagtgagaatgtaactggatctcaaacctccgctgtggaagggaagcgtgcaaaagggtgggctcgaatagccgnnnnnnnnnngggggacgcagccctggtgagaatgcaagtggatctcaaacctccgctgtggaaggggagcgtgcaaaagggtgggctcgaatagccgtgcttgtggcccaccgcgcccaacatggcgcgtggctgtgcaccgcaatgtgccgagcgactcggaagtggatttcaatacgaatttcgttctgcgagtttcatacgcgatgcagaatggattccttctcctctttatcgtgtgcattgctcagaaaatgattccgttctttctttcacatggaccacctggagggctcgaagggaggtagatattgggcgaagatcctcacgcccgctatctggcacacaaatctggttcttcggactgcgatagcctattcgagcaacacgcagagcaaacaaacccgcctcatcatgtcttttaccagtttacagtccgtcgggaatattggtggagcgcagggcaccctgcttccccggtccttctcccgggccctcccctccccccggcgcacgtcgcgcgttgaggcggccagtgcgagccaggcgagcaccgatgaggccatgggcttcagatacgatgccagtatgcaggtgagtggttgagtggtgaccccgcgccgggccgggggtcggaccccgcatctcatctgctgacgaggcccagcttcccaccccgccccccggccacacactccccgcagcgctgggtcaaggacgcgcggtacaccggggcgaagtacaacaccctaatcacccccaagagcgggaccccctacaccatctggcccgtgatgcacaccgagctggtgcggcgcaaggtgcgttgcgtggagccggaggaggcacacaatgccgtgtccagcggcaaggccgtgctcctggacgtgcggctgcccaagcagtttgagaaggggcacgcggacggggcggtgaacgtcccgctgtaccgcatcaccgcgggcaataagctgtgggacaagatcaagcgcatcgtcatgggcggcatggtaatggacgccacgggtgagtgatgtgcgggggggtgggctgtctggcacaggctccctgtggggtcattaggtcggggggaggcttgcatgcccctcagtctccagaactgtgggttgcctccttgtcggtctccggctcagagaccaaccgtccccctccctcccccccaaacagagcgcgaccccgacttctccgacaaagtggtggcggcgctggggcgcaacgcgcaccgcacgcgggtcattgtggtctgcggcgtgggcggcacgctggagacggcggtcaccgtggcgtccacggggaaggtggcgcacaacgaccccgaccgcgcgtttgggcgggagtcgcgcgcgctgaaggcctgctatgagctgctaaaggccaagttctccaaggtggagttcctcaagggcggccatggcagctggcggcacggcggcttccccatggactacgggtacgcggacgaggagtagaggcacacagccttggcacccctccttttttaataaacccatgatattgacgacttnnnnnnnnnncacgcggacgaggagtagaggcccgcagccttggtccccctcctttttaataaacccatgatattgacgactttcaggacgtccccaggaggggttttcagaacaatctccctccccccaattttctgatgatttttccaagtgtttccgagaagatcgatcgatgtcagtcatgtcatgccaatgctgtattcttatattgtaaacctttgccgaagcggatgactgaagaccctcacgaacagggcttacagcagcgccagaccaccacgggccccgggtttgggcggtgttcgtccagnnnnnnnnnntatcacgaacagggcttacagcagtgccagaccaccatgggccccgggtttgggcggtgttcgtccagcagatgtggcagagtgcatcccctccgacccctttcccggccgggcagccaccccggtcaggtcaggtctgggggatgctctgctgcgcagcatggtgcttgaggtcgcgcatgtggtaggcggtacgcgcccgcatgtactgctccgcccacgcctccacgctcatatgcccgccagagacccctgccaccagggcatccgacgccgcctctgcctccttagccgaggcggcgagccgctccaatagcacctgaagaatgaggcgaggttggtggtgtgcatgggtgtttgtggggggcagtgacacccctcgcctttgcacgcagggcagggatccagggtaaccttgctccccagcgtgtgcaccccggatnnnnnnnnnncgtttgtgggaggcagtgacacccctcgcccttgcacgcagggcagggatccagggttaccttgctccccagcgtgtgcaccccggatgagaaaatgcgggacgatgcacggcaggcccactccgcacggccgctccactcacacatctgtgcgaccccgccaccaagaaacaaaacccacccccctacaagaaaaacnnnnnnnnnncatgcgggacgatgcacggcaggcccactccacacggccgctccgctcacacatctgtgcgaccccccctacaagaaaaacaaaacccacccccctacaagaaaaacaaaacctatgccgcacccggggagccagcttgtccaggacggccttctggcgggcgtgcaggtcccggaacgcggtctccgcgggctggtactcactggactggatgatggcgatctggttggcgcagtccgccatctcgtcgccgcgggcgatgttgccctccgccagctccctcgcctgctgccaggccgcctccacgggctgcgggggatgggactttcggctgtgatgatcgcagggcaaggggcccaccaggctggcatgcgggctgggcaggaggttggcatacaccagggtaaatcacggacatggaccggggaggccggtgggaggagagacccatgtggtgtagcgaggaggctgccgggtcagccctactacaccgagctcacaccatgtgctgtaccagtgcagcaccccatcccctcctggatctttataggaagcagcatcctcccacttgcctgctccaggtggagctcggccgccacccggcgctccagctcctcaaacttgctgggctgggtcagggcctccagcaactgctcgttggacagcgagtccagcagcgggaaggagcgcgggaggtcggggagggtgggggagatggggttgggggtggcgggcacggcgtaggtggtgtgggcgctgggggaggcccgcgccttggcagccagctcggccacgacttgctgcacgacggcggccaggcgcgccccgcccctgccccaggacgcgagggaagggggctccagcttgccgtcggggttgatccaggggtgctgcaacgctggcgtggcgctcagggagggcgggtcctgggggaaggtggggggaagggaggcccgcaccgaggcaggagtcccatcctggagggtgaaggccacctccaacagcgatctgggggcatggggaatgtgtgtggaggtacaaggtcgcggatgggatgacacctggatatgcatggcgccgagggatgccccatgaacacatgacgaggcggggtgtcgtcagcgccgagtgtcacctgtcggggttcagcgctcgactgccggcctgggcgacgagagtctcattgatctgttgtgaacgactgtggtcacgggaggaaagggatcggtggacggcagggagacgagagggccagcggactgtagcaccagcacgaaaccccggcctcactcgaactgttgatcgaaggactgctgtaacagggagtactgcatgatggtttatactgttatatttgggggagaatggcaatgacacaggatcaagacggtctggtctctgatgaacacgctcggtcactgtttacagagggcggaacccagcgcccaatggtaatcactgtcgagggaaaactcctccgacccctcctcatcccaacttgtacatgatcaccacggcccacactccgtaagaacgctgtcacgaccctctttccacccnnnnnnnnnnaaaactcctccgtcccctcatcattccaacttgtacatggtcaccacggtccacactccgcaagaacgctgtcacgaccctctttccaccctgtcttgtatccagaggtcacctgtggagggcgggagtggactgaagtagcaggcactgtgtcatgttggctccgattcatcatcataaagaaaacaaagcaacatctccaacttccaaaccactcacacagccctgtcatgatgnnnnnnnnnncagtagcaggcaatgtgtcatgttggctccgatcatcatcataaggacaacatagcaacatctccaactcccaaaccactcacacagccctgtcatgatggtacatcgaagctggtcaccgctgttctttgtatcacgttctgatgttctggggtcaaaggtatgtcgtcattggctgctctcattgtgtgccaccctggcgcccaatgatcggctgttgctgccaagaaatgcgagcccgtctaggaccggtcctttgattcagtgcactccacnnnnnnnnnngggccgctctcagtgtttgccaccctgccgcccaatgatcggctgctgctgccaagaaacgcgagcccgtctgggaccggtcctttgattcagtgcactccaccgcgcctcagcatctgctttggtgtgtggtgtgtggtgtgggttgaacgacgagatgcatggcacaggcaaccatgtgtgtagtaggcaacttatgtaccaagtacagattctctcctctacaataaaagcccccacaaactcacctgcgggcttcatgccatgcctcaggacatcttcaaccacagacgcaggcagttcgaggagggggagaatttctgtctggccaggacggctgaagagctggggcnnnnnnnnnntggcaggcagttcgaggagggggagaagttcggtctggccaggacggctgaagagctggggcaggggttcgtgctccatgtcaattggacagaatggggctgccacaacagctgggtcgtcggggatctgacccagggtcgcattgtatctgcttgcagaaagggagtgggtgggaaggatcannnnnnnnnnatctctcctccacaatacaagcccctcacaaactcacctgcgggcttcatgccatgnnnnnnnnnntacgagagcagatccaagcggctgaggcgcagtcctgttgtccatgggtgctggcttcaatatctgatgtgatgtaggggtgagatgcacatatttgcgggtgcctgaacggacccatactgcactttgaccgggaagcagcaggcgcagcagcaacccnnnnnnnnnncacgagagcaggtccaagcggctgagacgcactcctgttgtccatgggtgctggcttcaatatctgatgtgatgcaggggtgagatgaacatatttgcgggtgcctaaacggacccatactgcacttcaaccgggaagcagcaggcgcagcagcaacccacccacgcacgcttcatagccgaggatgacgcagagtactgtgacgcagccccaggcagggatggctagggcccagtaggtggtgggaaagtacgtcacaccgatgcgtgcaaggagatgcgggggtgtgtaggcccacaccaggtatagcactgcagataatcgagagcgtgtggggtggataggtcgcgttcatgcggggtgggagcaggaatgcaggaggacagtcaccccaggacccaccgtaggccacgaaggaggatatccagcccacgaagccgtacacttccaccgaggagacaccccgtgtgccttcttctcctatcgacattctgttttggattgctgatcgtcggtgcgggtgcctgatcacacaggtgctcgacgtgtgcaggagtggaagtcgatttctgcatcgcgcgctgaacccattcgattgcgcccaaggttgtcgcccatacttgcgagaagcaatcaagatggaacatacaaatcgaaccgaacaatgtttcttacgcatcccaagtcggcatcgtccaccgtgatcacagagctgtggctctgagaaggacgaccgattgtcagtctcccatccctgtcagcaggcccctccatgcatcaccgagcctgagttcagcaggccttcgttccgcaggacaagggagcagatccagcgtccatgtcgcaggcacacctgcggaacgtagaggagccgatgtgagggggttggcctggtatcccagccatgacctcgccatttcctgccccccccaaaaggagcgctcaccacaatcaccgtgccccacagattcatcggctacgtccctggcgaccccacgctgccacccctggacgacgccatcccggccccgaaccccgcctttgcgcagaacaaggtggtggacctgaggacctgggatgcggtggccctgcaggtcgaggccgatcgtttcaacccctcggaccccttcgagcccttccacctgcccgccnnnnnnnnnncgtggccctgcaggtcgaggccgatcgttttaacccccccgaccccttcgagcccttccacctgcccgccatgcctggcgtgcccaccgagaaggtggccaccttcaccgggcacgacccctctgactacctgggcgcccaggccgggcccgggcggggcaggggcccctcgcgaccccgggcacggtccacgctgtcggacgagcagatcctggaggtcatgcgccggaccctgccccaccccggcaggcccatcgcctgggtggacctggggtaccgcaacggaggcctgacgctggctggaaaggaggtgcagctgcgggacctgtgggacatggttcagggcgcgggcgggtttgcggccgtgtgctccacccggaagtggacgagcgtcgccatagcgctgggcgctgacacctcaaggctcaccaacggtgggtggctgggaggagtcaggagtaggacttttcattcatatttgcagggtggtgggagacctcgtgtgggcatgcgggcgctgctgttgggcgcgccaggctgagggtggtggaacagagcatctccagcgacaggtcgtggaggctaggtggagtagtatctccacccgtgccgctcctccacccttttcacagcctcccatgnnnnnnnnnnaagcatctccagcgacaagtcatggaggctaggtggaatagtatctccacccgtgctgctcctccacccttttcacagcctcccatgnnnnnnnnnnatgagcatacttctttggaagtgaatctgttgtgccccagtgcgtcaacgcatgtgtgcaggttccagggaccagtacgcgcttcgtctcnnnnnnnnnncttcaatgtcccgaacccctccaagagatcgcgcccagaagatttccgctggtnnnnnnnnnntggtcaagggctggtacctgcgattctttgcgaattatgagaagtcactgcagagccaagaacttccatcctgagcatacttcgctggaagtgaatctgtcgtgccccagtgcgtcaacgcatgagtgctggttccagggaccagtacgcgcttcgtctcacgatccaccgagcattgaccagacgaacccttgaatctcagctatgtattgtcccaaccccgttgcaagcatgcagcaaatcagatctggacatgaattgcgcctgttcggatggtagacatgtctgttccagtttcaatgttccgaatccctcccagagatcgcgcccagaagatttccgctggtgtgtcgcacatgatcttgcgtttgtaaagggccataggcatcgggatggagtcaaagctgccctcgacaactacaacggatgcaggctagcttctattgagtctcagatcagtcgaaacgctcttgggcctcaacctcacatggccgacgaggctctgtccttggtctgcaccgactgcaatgcccagctccaatccgtgaaggaagcccaagcccacggtgagtggtgttttgcaatgtcgattctccgtccctgatcgagtatgttctgcccgtgttggttccacttccaaaggcttgcgtcagtggtcccctacaggcgaagccacagggcactcaaacttcgaggagagcaccgaagcggtgagatgaaatgaaggctgcacgagaaattaaccgatcgtgcggtaggattgtcgtggtgtgacgcctggctcccctcctgtatcccccaggtcaagcgcctggtctgcannnnnnnnnntcaagaccacggtgagtggtgttttgcgatgtcgattctccatccctgatcgagtatgctctgcccgtgttggttccacttccaaaagcttgcgtcagtggtcccctacaggcgaagccacagggcactcaaacttcgaggagagcaccgaagcggtgagatggtatggaggctgcacgagaaattaaccgatcgtgtggtagcattgtcgttgtttgacgcctggctcccctcccgtatcccccaggtcaagcgcctggtctgcactgagtgcagcaagccatgccgcaccatagttgagcaggagctgcacacaaagcgaacagggcacaccacgtttgaagatcaggtgtgtggaatccgttgggtgctgagaatggccattcctggtgttaagcgacatgggggggtgtattcttgactgccatgggtgcggctgtgtataggtgggcccttgcggaagagcatgagggcgggccctggtctcgcttgcagacccgcgctgctgccaaggccatgagcacggagatggagatggcaaaggcgagggcggtggaggcaggggaagggactgacaagaaagatgttgagcttgtaagtcaattctgggtgaatggacgggcatctgggtctcttggattacattcatcatggcgtgctgtgctttcctaccgcagtgcaactgcaggctctgattgccaggatgaatacgcccatgtcccattccaccccgccttctcattggcgtagctgtctcgttgctgatacagtgcacccggccccactgcgtttttttccaccaggtggagcctgaggtggatggccaagcactggcagaattggaggccatgggctttgccaggaacaggtgtggtgtggacgtcaggtgctgttgcgatgcatacagcaagtcgatccctggacctgaaaacagtctcagggcaggagcgttgatgcgccgcggcgccgtttatgaactcttgtccattcctggcttgggatcaagacccagaccccttgatcccgggcgcctccatcccctcttgccaggggggtacgcgcattgcatgggagtggcaataccggggtagaaagcgcggtggcctggctcgctgatcacgaggatgatgcagacctggacagtcctctcctcctgcccaaggcaagattgcctggctctccagcccccggggaagaagctgagaaagtcggccatactcggtcaaatgtgtggaggagcaagggcttatgggctaaatccatctgtatcatgcttccgcccacccctgcattacaccaagcaggagacacccaagcccagcctcacgcctgaggaggccaaagccttggcagcagagctcctcgccaaggccaggtgagggaatgggttggaggtgtgtcgccggtgtggctcagctggatttaaaggggaaaccatcgtgtggctcgagggaacaatgtctaaataccatggcgcacttgcactcctcatgcaataggagaaagcgcgaactcgaggagaaggagctccagcgactcagggagcaagaacggattaggtaatgtggaggctgggctcagtgaagagccagattctctctgcaccagcgcgttgactgcagccacggtcctagcacccacacataaacgcacacacacaggtcggggaaggagctcgctgctgcagcgcgtctggaggccgagctgaagctaaaacggtctatggaggcacggcggctggggaaggaggaggagcgcaaggcgcgggagagggtccgcgagatgctgggtgggtggtgggaagggttgtgcaggacaggcacgcagagaggctccttgtgtcggggattttggtttgaaagatcttgcagaggggcgcgggcgcccacccctctcctgctcccatgcactgcaaaggtgtgtacacatcacagttcctctgcatcactcaattccagtctctgtcaggccatcccaccccttcccctggagcagaggaggacaagcnnnnnnnnnngagggttgtgcaggacaggcacgcagggaggctccctgtgtcgaagatcttggtttgaaagatcttgcagaggggcgcccacccctctcccgcgcccatgcactgcaaaggtgtgtacatatcacagttccctctgcatcactcaattccagtccctgtcagaccatcccacccccttcccctggagcagaggaggacaagcgcgcgcgccgtgtccgcctgggcctcccccccgagcccactcccgaggagctggaggcggagcgggccaaggcggcggagaaggcggcgcaggaggccgccaagcggctgccgcccccgcctgtcatccccgatgcggaccgcctgcgggacctgctggtgggcatgaagcggggcacggccgatgcggcggcggtcacggtgtgcttccagaccctgctgcgcctgtgcggcaacgcggccaacgaccccggcaacgccaagtaccggcgcctgaacctgggcaacccggcgctggcggcgcgcctgctcccagacgcgcgcgccttcctggaggccgcggggtgggcggccgcggaaggggagggcgagggcgtgctggtgctgccgggcgccggctcgcctgcagaggtcgtgcggctgaccgcggcgggtgggcagttgcactccgccctgaacaaccccttcttcggggcgctgtgaaaaaaccggtcacacgcaacgcggtgtcacaggccgggggcgcttgcgcccggcacacaaggggggcgtcaggtgggcaagaagcaggggcaggaggacagcaccgacgatgaaatgaggtgggcccgcgacaccgcccgcggcccaggcctcgggcgtcgaagacttgggcatggtggagcccgccctgacgcaccgcgcgtcaccagaaccgggatgccctgatccagcgcgtcacgatgaacttctgtcccgcgcggacggggcagccgccgtgcagcgcgtgagggtcgggaaccgccaggcctgggtcgtcggtgggcacgtagtccctgtgggttgttggtgtggggagacaagagggaggcagtgaggagcctgggcgatacatacccgccccgagtcaccacaccgnnnnnnnnnngcaagaggggggcagtgagtagcccgggtgatacatacccgccccgagtcaccacaccgcctcccggacgccgcagctcagccgacgcgtcactgcaccgatccctggccaccccatccccgcctcaccagaagagcacggcgtcgccggcggccggcgagaggcgcagcgtgtcgctgcggaagcaggggtcgtcggcctcggcgtccacgctctccaaggcccgcgcctcgccggcggcggcgggcggggtccgcgccttggggaacactgtctcgccgccctcgtcgggggcatgcacatacatgatgaaggtggccagccggtcgccgcccgacacgccgcccgcgccggggccgtacgcagggccccctgcgcgcttcaggaatgacctgcaggaatccgtgtgaaggggtccgtgtggggagactcctggagtgtttggcggcgtgcaatgacgccctgcacggcatctcagggccgtcatggtaggctgcgagagggagatcctgagcaggggagtgcaatcccccagactcactggcaggcgggggggagctcctccccgctgggacggtgccggcagttgtcggtgtgggcgtcgtatttttggccctgcaggggaccatggaaagacaaggcgggcgggcattgaggcgggcggtgctcgttttcagtcacagggctggactggggactctaccttgatgacctgggcatggcctttccgccccatgctcaagccctcccaacatctccacaccctctgcccctccatcctcacgcccacctgctcgtatcgcagcatgtaaagcgactccccaaactcctcagggatgccgatccaggagtgcagccggtgctgcaggtccagcacggtcttgtcccggcgcgcgccgctgagccacacgccatagctggtccgccggtcgttcacgctctcatcagacacgacgccggagcgcacgaagccatctgttgggagggggtgacgagggacgttgccaaggttgaatggccgaggggtgcaggggctcgatttgtgccagccgatgggggcacaaggcagctccaggctggcacgtactgccctctcattcacgctgccaggttcctaccccaggccccatactcttctggtccccagagaggatgactggttgtgagccagcacgctgtcccaaacaacccagcacaaaataccaccttcccataccggctcaccccctgacagctccaacaggtggtcgatctcggcctggctcagaaagcccttgtactggacgatgtacggcttctccttgctcaccaccaccgcgttggggtggctcgccgccctgtggaagatctctggggtcagcttccagccgcccgccagggtcgcctggtccagcgaggggccctgcccggagatgacctcgtcaggtggggagaccaccactggcttggccttctttggggggggggagggcagggtggtgctctgcagcgcttcctggggatccttgacagaggacacgatcttgggatgaccgtcagtgggatggccggtgggggccccgccgtcgatcgcccccaaggccgccacgccatgtgccgagcccgtgaggtgctcgcccaccaggtgttgtagtgggtggcttgcaagaggaacatgcaggtctgcatcgagggtggttgggaggaggtgcggcatgagtttgggtggtggtgcatcttcattccccagtaagaatgcaggctggagattgggccttcgtggatggtcatgcagactgcccgtcagtcagtgagggattcaaatcagggcgtaatggatgcaataaatcactgaattgccatacagagtctgcttgtgtagaatccaagccacaaaagctggttcgccctggtaccccatgtcggtcccccaccttgacgctggttcagcacgcgtctctgtccgtcagattgttgcacgaagaagttggtgtccggtacaggcccaacattcaaaaggctggctaggaggaacatgcagccgacaatcgcgccagtcatgagcaggatggggagcatgggcaccttcccctgccggcctcgggccctgctgggccgctgcacctgcagggaccccagcaggctctccatgggctcgaaggtgcttgtcatgggtggtatgttttattacacatcacagatcatctgtcgaggcgtggtcgagactgctggaggcatggatcctggcagttggggagcccggcacgagagtcaggaaagggagcgcgtcaacgtgtacttttctctaagagcaatgtcggagctccctgcctcgacagatgtgcccctgctcgctgggtccagtatcaagattttatttaattatttcagagccgaggtgtgagctgtgccactgagtctggcctggtgctttcactgaagtgtacgcctcgcgcgcatacaccagtatggcgttccgaggtgtccacacctccagcctgccggccgtgtactccgattccatgggcgcgacctactccaagaccttcaagccatctcgtgactcgtcatcgggcgtctcatggcgcgtgctcacactcctgctcctgggcgtaggggccacggtgtacaccctgcgctcctccagcagcagcgaggccgctcgcgtggcgcggcaggcggcctacgacaagctctaccccggatccacccggtatggcgccaggggatccatggaggagccgagcaccgcccacgcccccgtgcgcaagtggtcccagaggggtgtgcggagggtgctggagtcggagggtgccgtccaggcggaggccgccgcggccaccgtccggccccccgcctccggcttcgacccggagcggcaccagcagtacctggacctaccccccctgcccgccttcccgccctccgagtacatgggcggctgggcgctgacccaggatgtctacgaccgcgcggcgcgccaccccgccgccacggtgctcagcttcgacagcccgcgcctagtcctctttaagtccttcctgtcccccggcgaggtggaccacttggtggacatcagcaaggaccacatggcccgcagcgaggtgctacacgccgacggcgacggctccgtcagcgacatccgcacctcatacggccactggcccacccccacgcccacgacgcacaacatcacggaccggatccaccgcctggtgggcatcccggagaagtttggcgaggacctgtacgtcctgcgctacctcctgggccagcagtatgaggcgtgagtgtactgcggtgcggttgttcggaggggggggagggatgcctgtctcggccccagtgtgggctcgtgggctgttcaaggggaggggcaggaggacaggtttcgcccacatgctctcagctggcgatagccatagcgccagtcgcatcttctggagtagcacacctgctggcatgggggcagcgcttgactgatcaaatccgtgcactccatgaccttgacccaagtccaagccatccacgcctccctccctgcaggcacaacgaccactgcatggacaacctgtcacgctccaggaaggcagaccccgcctgccgcgatttnnnnnnnnnnttacgcacacgtttgagtttttctcttagaacatgaggcctggatgaggggccgcagtctctctagggttccctgcattccgacgtcacccgacnnnnnnnnnngcggggtcccgagtgcgggcccggccacggcggcgagacctgcggggaccggatggcgaccttcatcctcgtcctcaagtgagtgtgcgtgttttgtggagccgtgatgaggatgtggggctgggtacacgtacacgtttgagtctttctctaagaacatgaggcctggatgaggggccgcaatctctccagggttccctgcattccgacgtcacccgacacgactgtccagctcaggacaggtgatccgccccttgcttaatacacaggcatccgtccaaggggggccacacagtgtttccagaggccaccatcacccaggcatctgtcaagaaccatggccatgcggcagacgactcctggtactgcaaggactctggggtcctgggtgctgcccccgaggcaggggacgccctgctcttctggtgagacactctggcagggcttggggtgagactctgggaaatggaatgtagaccatgtcgtggtttcatgcactgtagaagaggatatcgattgttattcttcattgatacctctgaaattggctgcatgatgtccggagcgatgccccnnnnnnnnnnccatggcttcatgcactgcagaagatgatatcgattgttattcttcattggcacctctgaacttggctgcatgatgtccggagcgatgcccctgagtccagtgtgcgcgtcgctcagttgcccccccccacacaccaccctgagcatgcgaacacccagctccccactcacgacctctcggcagggactaccggccgggcggcggctctgggcaggggtcgtacgaggacggcactgcagacccatccgccacgcctgtgtatgaggcgctgcacagcggctgcccggtgctggagggggagaagtggatcgtgacacggtggatacgtggcgcaggcttcgattacgtcccgcccaacacggcttgagcatgggtccaaggaacgactcctccagcaggcgggagccatgagccaggctgccgccgccggtgggtggcctccccgacaaagacccctggccccaagcgcactggctcaaggtctgacccagctcacaagacgcattcatttgattttccgctgtacccatgcggtgtaggcttctgccaaagcactgcgacctgacagtaccgtctcgcccttctccgttctcgttacgagctcgtgattcctgccggcagccgatgcccttgctggcctgcagccaaggacaatgtaagaactgaccctgcacaccagatgcgacctgaattacaaggcttctgcaggtagggggggcactgtattcttctcatccaaggaccggggcaggggatctgtggattcacagctcttcgtttagaagggcaccgggggtccagctgcgctgttcagagaagtcgtggcctgcgcagcggcggggtaaatgcatgtgagagacggtgcacgccatgtcagcggtgagttggaagcacgccttgcaacgcagctgtatgaccacaccagacgcaccagaaggtagaaagctgctgcatggccgagggcgccccaggccagcacctgatatgagaatttttggggggaggcagactcaggagctgaagggaagacgtacatcggcaggaatggccaccaagctctgcatctcaaagacatccgcaagcactgggtccccagctgctccccgccaggagcagccccagaccacacgcgctctcgagcacaccctacagcactcacatcgatgatgttgaagccagcgggatcgttcgtcttcagcaggaaggtcgcctcctccgcacctctgtcgccagcctcggcatgggtgatgccgttctgacggggcagaccctgccgtgccaggttgtcgcggtggaagggaaggaatacaaacctgtgggattcgcgtgaatcgtggtccgcatgaggaaggaagggtatgcagcctgagcttggcacgaaatccaaaaggccaccatatcttgctgacagcaaaccacaatgcaaactctagcacagacacactgccgcagtgctaccttccgagggcaagggcagcaaaggtggcgcctgtgggtatcgtgatgatgggggaggctggttggtcgcctcatgataacgaagggtcaccatgtgggacaagcatgtaccctccagccagcgcatcgatcgagcccaaagtcccccgcacgatcctgcagggccatgctgatcccatcaaccttcctacgtacccccgacgaccaggttgacctccgcgatggcacgagtgggcgtcttgatggcctggcgagccctgcaggccgtgcgcggcacgaagggacgggtagtcccccggaaagtgcaggtcgcggaaggggtcaggccgagcatcgtcatgatgtccactttcgcctgctggaagggtcgaatgtgctgggaaggattcgcaggtggggacatgagaccctcgatcgcgacctgctcggcacaggccaagcggatcggaactcaatcttgaacgttggaaagcacggcatggcatgctgtcggcagacatggtcacgttcagatgtatggaaagggtcattttcttcagccctcaagcgagtagagcattgtttacatagagagcggtcttgaaagcaacgataagctcagcagggcaagtgctgagagggatttgggtatgagcacacgggaatgtctctgcccaggtatacaacaagatgaagggatgcttgtgaagtgtggcgtcttcacaagggctgagtgagtgagaggcatgccgcgtggcaggcagaaaatagtggtgatacaaagattcaactcctgatctggggtcatttgcgattattctgcacagaatggcgtgtcaagtcaatcgggctgcatggatctcctgctgaatgctgccagctccgcctcccagccggacgcagagcggctggcgtcctgtacgagctctgccacaccctcctcgccgctgtcggggtacagggcggcagccatcatgtcactgcacagcaccatcagctgctcgtccacagcccagcgtgtcgagtcggagagcatggaggcatgcgccaaggcctccacatcctctggcgagaaggcctggaccagcgcaacgcacagcaggcgcaccttgcagtttggagaggttgaagggggaatggggtttgagggctgtgcattgcctcgcgccgatgacatgcggaggacatacggcatgcagcgcctgcagcagcaggtccaacctcttccccaattttgctctgctcatgcccatggcctccctactccctcgtccccctcaccaccccaggacacacccaccacgtaggtggcgttgaagagcatggccaggaaggtcacccccaggatggcgtcggtgctcgactcctcggcggcgcccccctgcgccagcaccgtcaggaagaggtggcgcaccaggtcctccaggttgaccaccatgtccacggcgcgctccacggccaccgtgcatttgagcacccccgccagggccaggaggcaggcctgcagctgctggcccacgtcctccagctcccccgccaccgggatcaagggggggcagctgtaggtgtcgtgcgcatccagggccgcagagaaggaccccgccacattgagcaggtggcggcacagccgctgcgcgcgcttggccgccacaaagggaaaccttttgggggtgggagggtgagggtttgggttggggggattgggannnnnnnnnncggaaaccttttgggttgggggggtgagggtttgggttggggggattgggaaggagggaatcgggggggataggaatgcattatgcacgcacgcccagctcatgtgctgaggggaccctcggcccagcaccacacaagcaggcaccacccctgggtggtgcatcagtgttttatcagtgcagtgccggcgcctgacactccacccggcctccatccctccctctcttaccccccacccccccctgccaacctcctcaccgcttgaccttgctgaaggggtagtattcgtagtgcagggccggctccagtgcccccatggccccgatcagcatggcgatggccttgagctggggcaggacggcgaggtaggcggcgcccaccaccttgcgcacccccgcctcccccacctgcaggtagatggactccaggcccgggccctgcgccatcagcaccccgcgcgcgtgcgcggggggtgggctgtaggtgatcaacaggctggggcggccgccgcgctccgcgcccacaccgggggccgtgtcgaaccgcgtgcacggtcgtgcatgttgcggcgatgggccctctggcggtgagggagacggctctggggctggggagtcggtggcgcagagatctgccgtcgcaccaggcccggcccagggtaccgaccccgcgactcgatccgccagctctgctgcgccgggctgggcgctcgcctggtcgccggacggctcgtccggtgccttctcggccgacccttcccgcgcctccgcgccaggctccacgtccaccacctggccctctccgccctcccgcccacccgccacgagggcctcgnnnnnnnnnnnnnnnnnnnnnnnnnnnnnnnnggaccgcgccctgcccaggctgtccgtcgcgcggcgcaccgccccgcgcccggccttgcgccggtgttcgcgtgggaccagacagtggcaggggcgggccctgacgtcggcccgnnnnnnnnnngccagaccctccagcgcggacagcatcagggtctggtgcaccgagcgcgcggagatggggaagcagacggccacgaggatcacgttgaccaccacgcccaccgccgtggaggccaagcgccagatggcggcctgcgggtaggtctcgtccacgtggtagttgggtagcgcaacaagggcggtgatgatggcggcaatcaggaagcagtctgggcgtacaaaggtggtgggtaggtgtgtgtgtgtgtaggggtgtgtgtgtgtgtgtgtatgggtttttttttgtgtgtgtgtgtgtgtgtgtgtnnnnnnnnnngaggatttgccgccgctgctctcagcagttgctttgtcatcaagccacccatgcaccctccccacgtcacacacaacgacccacagaagtaggaggagaagcggatnnnnnnnnnnattgggcagcgcaacaagggcggtgatgatggcggcgatcaggaagcagtctgggcgtacggaggtggtgggtaggtatgtgtgggtaggtgtgtgtgtgtgtttgtgtgtgagtgtgtgtttgtccgtggtggggacggcctccatctgtaaaggcgacagaaggggctacaaggctgcacctggcacctggcacccaggactcaacccccacactcgaannnnnnnnnnnnnnnnnnnnnnnnnnnnnnnnnnnnnnnnnnnnnnnnnnnnnnnnnnnnnnggcgcagcccccaagcacgccagtcaccagcgggagactgatggtcatcacgatgtactgcatgggtgggtaggggcggggaagctggagaggggccgacgcaggctttaaggaaatgagggcaggagggccagtgcactgaaaggtgacgtgtgcggtgaggacaaagcggagggtcggttggcgggagagctgggagcccaggggcattgcgtgagctcagtggatctccccaccaggcgcnnnnnnnnnncaggatttgccgcccctgctctcagcagttgctgtgtcagtgaggcgcccatgcaccctcccccccatcacacacagcgacccacagaagtaggaggagaagcggatnnnnnnnnnnatgggtaggggcggggaagctggagaggggtcgacgcaggctttgagagaatgacggcaggagggccagtgcactgaaaggtgatgtgtgcggtgaggaagaagcggaagttggttggcgggagaaatgggagcccaggggcattgtgtgagctcagtggatctccccaccaggcgctttgagaacaggccccccctccaatcgacggctgtctcaacctcccccccttcctgccccccacccccccccagtggcgcaccttttgcgggtgggagacgtaggtcagcccgttgcagaggtaggtgaagtagagcacgcccagacccagcacggcgcccagcaccgtgcccagaagccgctggaagcccttgatgatgaccgaccctgtgatttgatgtggggtggatcagtgcatggctgggtctagctgggggtgtggaggcacacggcacaggcgtgtgaccaagcatttgtccgtccattgtgtggggcagagtgcctgcgnnnnnnnnnncagctgggggtgtgggggcacagtgcacaggcgtgtgaccaaccatttgaccgtccattgtgtggggcagagtgcctgcgtcggtccacaggccttccagccccaacaacagccatcgaccgccgtccccaccagtcatgggctccaggatggtgatgacgatgagcatgccccacagcatgcgtccctcaaacgcatcgttcaccgccggcaccatgaccatgacgaggatgatgcagtaccccagcatgccctgcgtgggcgggaggccggcggtggttgagccgagggagggtgtggcgccccgacctgggcccgggcgacctcaccaggaccggggtcccggcgaggcacgccggcttgtcgaatgcacgaccgaatccttccccaaacccgcaaacacatcccaggtccctgctcgatgcatgcactcgccttccgcctgccatgctcctccagaatccctcccacccacccccactccacccacttgcaggccgacgatgaggtggttcggagtgaccccggtccgcccgcgcagccagtccagggcnnnnnnnnnnagtcccggcgaggcccgccggcttgtcaaatgcaaaaccaaatccttccccaaacccgagtacagacccgcaaacacatcccaggtccctgctcgatgcatccactcgccttccgcctcccatgctcctccaaaatccctcccacccgaccccactccacccacttgcaggccaacgatgaggtggttcggagtgatcccggtccgcccgcgcagccagtccagggcccgctgcgtcgcgcgcggcgtgctttcccgcacgggcagcaccttgggcgctggcgtgccctgcgcggccaggtactgcttgagggaggggcccggggggccccggggcccctcgtccccggcgcgcagcgagtcgtgcaggagcgcgagcgggggccgcggggctggctgcgcgcgccgcacgcgctgcatgagggtggggaagtgccaggtgcggctaccgccgcggtccaccgccagcaggtgggcggcaagggcggcggtggcggcggggtcgtcccgccccagcgcctctggcgcggtcatgaacagctgccggatctgcgggcaggaggtggacagggagggggaggtttgcctggtcataagggcagccaagggaccagggcagcggtaacatggcagggcctgcccccctcccctcccccccccacacacaccgggaaggaaactgcagggtgagggcaaggtgcggcatcaggccccctcaccctacccctcacgtcctgcaccaccccacgccctgcgccccaccccatcgctgacccaggtgcaaggccaaccgcgccccctaacccctcgcccccacccgcgtgcagagcgtgaagagggtggccaggatcatgttgaagtgcaccgcccgactggagggtggggcgtgggcatcctggagcgaagcccccacctcccccaccagctctgcgtaggctgcctccatggccttgagcacaggcagggcctccttcaggctgagctggccgctcaaaacgtcggccagctcgttgcagcagcccgccatgctggcggccagggcccgcagcagccgtgcatgctgcctgtaagttgtatattttgggagggaagcggagcctttgtaggtctgcagttggacgttcacaacgaacctgagcatgggcagccctggagcggggcaggagaggggtcccctacaaggcggcgcctggactctcgcgacgccgctggcacggcatatgttagccatgggggggagtgacacatgcaccatgcgctgcccgtcaccaccccgccccacctggtcaggcggcagtccatgcgccccgtctgcagcgggtagatgatcatcatgaagctggacagcatggagcgcagggtcagagtgagcacgccgtaggcgcgggaggggaagacgtgctggcggcggtacaggtcccactccagccgcgcggcggcctcccacttccacacgttgctgatggacccgcccgtggcaaacacgtcggtgtgcaggtcggagaggctcgactgccacagcccctcgtcgatccccaccatggcctcggtcctctggcgggcgggagggggggccgaggcacgaatgaactgtcgtgggagggggcgatgcgtcgacaggcgccagcaccagcagccaccctccctcgccgggtttttccaacacagccagtgactcaagccgaggcccatttcccagaacccttttccccccccacacccccccagacacacaaagactcacgccggagcaggctttcaggagcccgnnnnnnnnnncttcccagaaccctttcccccacccacactccccccagacacacacagtctcacgccggagcaggctttcaggagcccggtgtcgtcgttgatctcgtcagacatggtcccaatcccgctttccacgactttgccaaaggacagcagcccagcgcagatggacgcccgtatcgtgttccctgcatgaggtaggatgggttggtaaggggtgggaggacatgaatgtgccaggctgcggcagccggcagagaacagcgtgggggggcctcaccttccctttgaggtcctgggccgtaccacatacaagccccgcccccctgcctgcctccccctgcccgccagccccatcaacccaacaatcacagtgcacctgcgtactgcnnnnnnnnnntaacagcgtggggggggctcaccttccctttgaggtcctgggccataccacatacaagccccggccccctgcctgcctccccccgcccgccagccccatcaccccaacaatcacagtgcacctgcgtactgcggcagcaccgtggacatggtcagcaggagggaggcagcagccatgaccgcaaagtacatgaagtgcaccccgaacttccacagcgccgccctgctgtggtactcggcggcgatggtaagggccatgcccaccagcatgagcatccacagcatgttgttcttcgtgaagcggaagcgcaggaccgtgccgaagaacgccaccagacccgacaggaaaaaggtggccacaaactgcgaggcgagtgggtgggtggttgagtgcttgaaacaagggttgacaatggcgcatgactcagctctgacgtagagcgggtgcccccagagcagggcccgacacctgtcaggctgcatgcagctccggggggtctcaacaaccgagtaagccatgcagtgattaggtgctcggcttgcagctgggcccaggcttcagtgctggcatgcgcatgtggagtcagcgaccatccctcccacgcaaccagttccggcagcccctaaccttggtgggcgtattgtccctggaacccccgttgatcgccagcacggcgtaggtcagcccgatgccgatgcccgcgccggcagtggcgccagccagcagctcgcagctgacctgcagggcggccaggccggtcccgaccgagaagaggaggcacaggtagcacagcaggagagccatggcggggatggccaccacgtcatccagggacaccgccgtccacaccgggtgggcgctggtcgcggccaggatgaggaaggtggcggtgaacacctgcaggggagtgccagggcccatgggtccgccaccccagtatggaggaggaccgtcttgcaccccggcctggcctctttcctagacagaagataccatctcttgtggccagccgtacctggatgcccacgcgcacatagaccagggagaagcacctcggcagcctcagctgcggcctggaaggccaccgccacgccatgagcccctcggcacggggttgccagcaggattaggccgaccttatacacgagttctgcagtttttcgcggtcacgcaatataccttgatcagcgaaaagtgcactcctcgaagccattggnnnnnnnnnntcgagttctacaggttttcgcggtcacgcaatataccttgattagcgaaaagtgcactcctcgaagccattggcctgtttgacacatactgacgtcatccaccctgactcccagaaaccccggggcaatcatgccgtgcgttgttaactgtataaaaggtataatatttgcagtctcatatttgttttcaacaatcgtcgcaggctggccaattggagtaatagggtctgatcatgggaatgcgaataggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttatgtcgtcctccaagggggccgccaagtccgaaactggacttgggtaacaacccaaccgccatgatcacaatgcagtagtcttggcttggccgtgggnnnnnnnnnnatatgtcgtcctccaaggggaccgccaagtccgaacctggactcgggtatcaacccaacagccatgatgacaatgcagtagtcttggcttggccgtgggnnnnnnnnnncgcagtctcatatttgttttccaacaatcgtcgcaggctggccagttggagtgatagggtctgatcatgggaatgcgaatagggcgcggaaacgttatttgaaccacccccaggtgccggttcccacatgaacgcgacatggcaatcgnnnnnnnnnnnnnnnnnnnnnnnnnnnnnnnnnnnnnnnnnnnnnnnnnnnnnnnnnnnnnnnnnnnnnnnnnnnnnnnnnnnnnntcatgcatcgcttaaaagagtgcgaggcaccaaccaacatccgaggaaaaagggaaccacagtatgaaggaaatgtgagtgtgacccaagcattctgcatagtaaacttggaggattcgattccgaaaagggttgcacgtatgggcgcggtggggttcgttccagactaccaggcgaatttcgtaatgggggggtcctcttgcataagccggctggcggacgccagctcgccctcccacccagtggtggcatcgccctgcaagggggcaggttcctcgctgtcctcctcctcctcgctgctgtcggggtacagggcggcagccatcatnnnnnnnnnnggggtcctcgctgtcctcctcctcctcgccgttgtcggggtacagggcggcagccatcatgtcactgcacagcaccatcagctgctcgtccacagcccagcgtgtcgagtcggagagcatggaggcatgcgccagggcctccatgtcgtcgggtgagaaggcctggaccagggcaacgcacagcagccgtacctggcattgggaggtggggtgaggtttccttggaggagatctgacggcagcacagagtgctgtgcgatgaaaggcgaggtgtgcagggcacagtgcgcctcccacagcaaccccccctgctatgacggtgtcggtccttccaatcacacacccaccacgtaggcggcnnnnnnnnnnggcacagagtgctgtgcgaatgaaaggcgaggtgtgcagagcacagtgcgcctcccacagaacccacccctgccatgacggtgtcggtctttccaatcacacacccaccacgtaggcggcgttgaagagcatggccagaaacgtcacgcccagaatggtgtcgggcccggcccggctgtctgtggaggtcccctgggaaagcacggacaggaagaggtgctgcgtcaggtcctccagattgattaccatgtccacggctctgggaggttggaagagggtaaggggggaagagttgcagcgctctttcccacggaacaagcactcgcaaggcgcagtccacagctgnnnnnnnnnngaggggggaagagttgcagcgttcctttccacggagcaagcactcgcaaggcgcagtccacagctgggtacactgccactgcaatgcagccagtgcgctcaaccacttccaggccagtcgtgcctttgtgcctgggacaatccagtcactgaatcccagcccctgctcgacctcgtcttgcccccccaagaccacctcgcccaagccctccaaccccggacagtctgcgcccannnnnnnnnngacccagtcactgaatgccagcccctgcttgacctcgtctgcccccccaagaccacctcgccccagccctccaaccccggacagtctgcgcccaagccccaacacttgaacccgcctcggatttctcaccccccctgcacctgtctacgctgactgtttgctgcacgatgcctgccagggccgacatgcaggccttcagctgctggatgacatcctccagctccgccgccactgggatgagcatgggcgcgctgtgtgtgtcgtggctgtccagcgcggaaaggaaggaggaggacacattgagcatgtggcggcacaacttctgcgccctgcccgccgcaacaaagggaaacctgagagagaggggggagagatgattggtgaagagggagggaaggaaactgcatatgaatggctggtaggatgggccaacccggctccctttgtgttaaagtttaaccccctgcgcgtcaccacccatgcctnnnnnnnnnnaagtggctggtaggatgggcctgcccggcttcctttgtgctatggattaaccccctgcgcgtcaccacccatgcctttccaatgacccctcgatgcccgcctcatgcaccacctttccccctcttcccccctaccctccctccatttcctcccagcgcaccgcttgaccttgctnnnnnnnnnncatttccccttcttcccccctaccctccctccctttcctcccagcgcaccgcttgaccttgctgaaggggtagtactcgtagtgcagggcctggtccagcgcggccattgccccgatgttctgggccacagtcttgcccaggggcacgctgtccatgtagtcccccccaagcatcttgaaggactcccctgccgggctcaactccatgtacctcgacccggggtgggagagcatgcggtccaccggctgaaggacggcgtcgccgtctgcagcttcatcctctcgatcgggattggctggcgctgctgcctcgagcacaatgcaagcagccctggcgtcgcccggcctggcgtcgcccggcctggagtcgcccggccnnnnnnnnnnnnnnnnnnnnnnnnnnnnnnnnnnnnnnnnnnnnnnnnnnnnnnnnnnnnnnnnnnnnnnactccacctccctctgtttggtgctgctgtgcggcgctgggctccgcagcaggcctcatggaagtctcgccaccgacaccagccatgccgtcgggtgcctgtgttggcgccggcagactgtgcgcctggcccgcccggccctcttgcggcagcagggcctcctcctcccctcccccgttgatggccgtgcgcgccagtcgcccacccgccctgccccgcgccgcgtcgggcgtggccgccggccgcgaccgccgccgcggcgggcggcggtgctgacgtgggagtaggctgtggcaggcgtggtccagcacgccgcccagcccctccagcgtggccaccatgagggctgagtaggtgctgcgcccggtgacagggaacagcgctgtggcgcacagcatgttcaccgccacgcccaggacggtggtgaccaggcgccacagtgcaacctccggcatgggggtgggagtgtggtacccgggcagcgccaccaccgcgaggatgatgtcggtgatcaggaagccgtctggatggtgggaattgtatagcgatgaaatgctggaggggtggggtgaagactgggtgggtggcctttgggagctgttggatccggggatgagcggctgagtgttttgtgtcaccacccgtgctcctccgtctcatgnnnnnnnnnncggtgagaattgtatagtgatgaaatgctggaggtgtggggtgaagactgggtgggtggccttcgggagctgttggatcccggggatgagcagctgagtgtttcgtgtcaccacccgtgctcctccgtctcatgggcaccaccactccctggcccactcacagaagaatcgggggaagcatagggcacacccggcgacgatgccagatatcacggccagagacagggacatgacgatatactgcattgcagggtgggggaggggcattgagtagggtgggaagctgcgcagggatgtcccattgcagtacctcctccctgggtagcaccgcggatgttggcatcacagacgcgccttcaaacacctgccccttcctgcagacacaaagttcgccaccttctgcgggtgggaggcgtaggtcagcccgttgcagaggtaagtgaaatacagggcagccagacccagggctacgcccagcaccgtgccaagaaatcgctgcgagcccttgagccacaccccgcctgcggtgcttggcagggagcggtgagcgggagggtgtgagcgaggaatggcaggcatctgcgacacctccgccacaggggacaccttgaaacggggcctaggggagcatgtgaggttcccacctgcgggcactcccacagcatggagattgaacgctgaggcagccattcatggccttcctgccccacagcgcaagggctccttcctgcccccacctgcatcccaccacacctgtcatgggctccaggatggtgatcacgatgaagagcgcccagagcaggcggtcatcgaacttggcgttcacgtgggggaccacggtcatgaccatgatgactgtgaaagccacggtgccctgcgagcaggaggcaaggatgggatggagcgacgggtgatgtgcgtgatgactggcagcctgtgccacctag

SEQ ID NO: 48914 - DNA, 13791 bp, Chlorella protothecoides
  modified_base (142)..(243): a, c, t, g, unknown or other
  modified_base (805)..(814): a, c, t, g, unknown or other
  modified_base (1340)..(1399): a, c, t, g, unknown or other
  modified_base (1956)..(1965): a, c, t, g, unknown or other
  modified_base (2135)..(2144): a, c, t, g, unknown or other
  modified_base (2556)..(2565): a, c, t, g, unknown or other
  modified_base (3898)..(3907): a, c, t, g, unknown or other
  modified_base (5173)..(5182): a, c, t, g, unknown or other
  modified_base (6054)..(6063): a, c, t, g, unknown or other
  modified_base (6151)..(6160): a, c, t, g, unknown or other
  modified_base (6413)..(6422): a, c, t, g, unknown or other
  modified_base (7519)..(7528): a, c, t, g, unknown or other
  modified_base (7641)..(7650): a, c, t, g, unknown or other
  modified_base (7735)..(7744): a, c, t, g, unknown or other
  modified_base (7988)..(7997): a, c, t, g, unknown or other
  modified_base (8293)..(8302): a, c, t, g, unknown or other
  modified_base (9903)..(9912): a, c, t, g, unknown or other
  modified_base (10234)..(10243): a, c, t, g, unknown or other
  modified_base (10307)..(10316): a, c, t, g, unknown or other
  modified_base (11124)..(11133): a, c, t, g, unknown or other
  modified_base (11255)..(11264): a, c, t, g, unknown or other
  modified_base (11724)..(11843): a, c, t, g, unknown or other
  modified_base (11951)..(11960): a, c, t, g, unknown or other
  modified_base (12619)..(12628): a, c, t, g, unknown or other
cgcccgcgtccgccgccaggcgcggcagccaggccaggtccagcgcgaagcagccgccgccgcgtagcagcacgtggacgcgttctcgggcggcggcgtcgcccagcaggcgcacgctccgcccggcgggctccccctcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgcaccaggtccagcaccagcagccccggcccctcgccggggtccgcagtcccgggccccagctgcgaccgcaccgcgtccagacggccgccggggcccgccaggcactggggccggccctcctgccaggcggggcgcgcggggctggcgagcacgcccgccgcgaccccgccgctcgcggcggcaacgcagattgcgctgcaccccggcgcaaacctggcgagcagcaggtcctcggccacggcgccggaatcgccccagaggccggcgaacccggccggcagggggccctcccccggggtcgcgaccctcagcggccccaccaggaccggcacgtgggcgcccagggcgtggcgctgcgccattgcgaccccggaccgggtccccgcagcaaaggcacgctgcagccaggagtgcgtggcctcgtcagcctcgccgaggtcctcccccagggccgccaggctggcggagggcactcgacaacctggtgggttgccggcacgggggaatggtgaccttgcggtgatggaggctggggcaacacacccatggccgcacgnnnnnnnnnnggatggtgaccttgcggtgatgcaggctggggcaacacacccatggccgcacgtgcctgatgcagcagggacgctggtcaaccccagccccagcaaaacactcatcaaaacactcgggtgaaatcgggacacggcctgagactcgaaacccaggacaggagcggcaccgcaaccccgggtcaccacccaggcggcacctgcacccacacatcggcaccacattcagatggaacaccgcacccaccgaatggcaccacggggcagacgcggaagatgttgctgcggttggagaggaagtagagcgcaaacctgtcccaggcctctgcagggccaaacgcaaaggctgtcgggcgctccgccgaacctcccagccccagagcatgcctggcatgggaaggagggagcgaatgaatggggtggagatccagggatcggctgcaggcaggcaaagtgcgtgcactgattgatgccatgttgggagaggggtgtggctgtctgccagcgctgtggcggcagccgccacagnnnnnnnnnnnnnnnnnnnnnnnnnnnnnnnnnnnnnnnnnnnnnnnnnnnnnnnnnnnncgccagtacacaggcccttgcctgatcccctgtccactcagcgcttgaagcacacctgctgcccaggctgagctccagagtctgctccggcacgctcggctcgtccaggcagtagaggcgccaggcggcgtccgacgtgagcaccgccaggtgcccgtcgccgagcgggtgccaggcgagctgcagcacgcggaggcccgggcgcgcggcgaacagaccccggtcgacggccaccgcggaggccggcgggggcgtcgccgagccagcgcgggggacggcgggggcgtgcaggctgacggcccacagctcgctcagctccggggtctcgcgggaggtgcccgccaccgcggccagcgtcccgcaggggctgcaggagaggtgctgcacatccacgcccagggccgggtgggggtgcaggtgcacggcagcgtgggggccggcggggtcgcggtgggcctggcccgcctggaccgccagctcctccctcacgtcgcccagcaggaatcccccatcctgtgccgcggcgaccctgcagcacggggagcttggggcctgtnnnnnnnnnngaggaggagtcccccatcctgtgccgcagcaaccctgcagcacggggagcttggggcctgtgatgctgcatgctgaggaggccaggtcttcggccttctgcactgcaggggaatggttccccaggcactcaacgggatgcaatgcgtgggagacagcacatggagccacnnnnnnnnnntgaggccaggtcttcggccttctgtactgcaggggaaaggtcccccaggcactcaacgggatacaatgcgtgggagacagcacatggagccacaactcacagcttgccagtcctgctgtaggacagcaggcctcggagccacggcagggagcggccatccgagcaggcttcctgtcgcacacaggcctcgctgaacgagtcgaggatcgacattcctattggaagctgtagcaaaccgcgtgcatgctttcgagtgtcgcaggtccagacctcggcgaacgggcccgaccgatccaggccagatgctgtgacacaagttcgactttcagtttgaaattgacgtatgctatccttgatccctagaccatccctgctcctgttacagcgggtgcgagatcgatggcccggtggnnnnnnnnnnaactttcagtttgaaatcgacgcatgctatccttgatccctggaccatccttgctcctgtcacagcgggtgcgagatcgatggcccggtgggaaaggttttcgaagtcgtgctgcgagtgctttgccggcgatctgtgcatagacgaacggtcgaatactcgcaattgcattccgtaggggtcggacaccgatccagcattccagaaacacctccatgagaccataatgaagtttgcagggggtgctgccgtcgctgtgactgctgcgggctgcccccagccccaggagaagccctgggatgccatcatcatcgggtcgggcctgggagggctgggcgcggcgtcgaccctcgcccagctcgctggcatgcgttgcctgatcctggaacagcactggatacctggcggtgggtttctggctcgggatggggggccttgttgagggtggagggcattaggagtgcctgtcctccgccaggcccaccagccttcgcccccatggccgctgctttccaggcatgacccatcagtttcgacgccccggaggccactggttcacctgcggcacccactacgtgggccagatgggggagggggatgccatgcgcgaattcatggactttgtgactgggggcgtcgtctgggaccccctccccgacacctttgacatgttctgcttcaagtcggatggcgcccagttctcgcagcccactggcgccaaacgctggatggagcgcctcatcgaatccttccccgctgagcagaaggcgaggaggccggtgggcatgcagagcggcatggagtccctccttgccacaggcagggccggcagctggcaagggggtacaccagggtcaccaaaccctctgcctgccaccacacaggccattcggcgttactttcgcgacatcaagcgggtgtacagctggtaccgcttctacttcctgtcgaggagcatgggccggcccttcagcagcatcctggcgacgtgtacggctcccaggcggcgcgcctttgcccagcagacctgccagcagtacatggacggcgctttcagagacaggcggctgattggcgtgctgtgcgcgctgtggggtgactatgggatcaggcccgacttggtgaccttcatgcagcatgccctggtggcgggcaacaactttgagggtgcgcaagtcgcatcggaaggggccacacggctggttctcttggctctgcaccggcttcggcttggtcatgcctgacatgctcctgactggtcagcacagtttctccactcacccaacccctgcccatgctaagcaggcacatactacccgcgcctggggtctcnnnnnnnnnnatttctccactcactcaacccctgtccatgctgaacaggcacatactacccgcgcctggggtctcgagccctggccaagggcgcactggccctcatcagagccaagggtggggagatcctgctctccaccagggtcacacagatcgtcctggacgaggcagggagggccgtgggtgtccgggcagtgcggggaggaaaggagggcgtgtaccggggccggcacatcatctcaggtgtgcgctgccgcgtgctggacatgtgggaaggactgggtgggggttgttcgaggcgatgtactgagggcagtcgcaggtcaacacagtccttggaaacagcgcttttaatgcctctggtccatcaccttatccacacatgttcatccaaccatcctcacgagctgacagcgtctgccgccccaacattgccccactcctgtaccctccccagcggtcggggcatacaataccttcaggaccctgctgccacacccactgcacgattgcttggcagacaccaggctccagcatgccgggcatgccgtgatctcgatctggctgggtctggacgcctcaccgcgggagctgtacggcatgcacggcgaaaaccgctggatctctgcagactaccgccattcgcaggcccggctttacgatcccaaggtgtgtgcacggaaatgagtgagggagcactggctgggtgaggaagtgtttgaaaggggaagacgggactccaagccggcgtgcttgcatggcaggtatagaggagccccttgctggcgaaagtgcagaagtctggcgtgtccctgtcaaatcaactgttcttggcaccatcaactggctctgcacacttttctcccacgaaccactggctcaggttcgcgaggtcacttacgcctttctcagctgctccgcgctcaaggaaaaatatgccggccatgcgcacagcctggaggtgtgcctgttcacggatcccgcgtacttcatggggtgggaggagcggaatgatgcagatggaaggcaggattatgtgcaggtgggcagtcctgggaaagagtttcacaggtgcaggtgatggtttggaaactcgtcaatgagatcttcctgagcgctcgatatttttggatgtttgcagtgtagtttggttgatcatacacaaagtatgaatgcttcatgaatgcttgtgtggcccccagacctgggagttgaggaacgtgggagctggaatgcacatcctacacctggtcctcaccaaccacattctaccagnnnnnnnnnnatcacaggtgcaggtgatggtttgggaactcgccaatgaggtcttcctgagcgcttgataattttggatgtttgcagtgtagtttggctgatcgtacacaaagtatgaatgcttcatgaatgcttgtgcggcccctagacctgggagttgacgaacgtggtagctggaatgcacaacctttacctggtcctcaccaaccacattctaccaggtcaagaagaacatcgtggcggatgccctggactttgtggaccagttcgtccctgggcttaaggaccacgtcatcttctcggaggtgggtctagaaggggaatgggcagggtttcgtgacagtccactcacctcttaattactgccttacagggtcgatgtgctcccagtaccatgttccccagcacatcaggccagtgcagcaccagagatcagccattttacccttccaccctggcgcatacctgccaggttgggacgcccgtcacctggaactctttctgcggctggccaggcggtaccatgtacggcgtccctccgaccgggcagagattggaggccgaagcggctcttcagcctcggacgtctgtggagaacctgtggcttgccggtgtgtggtcgttgatgcgtcagtgtgtcaagtacaggggatgcgaagccgcgtgtgccttgaatcctcggccacttacagatgggttggggtccattgtgttgtgccactatgggtcagtgcccaccatctacatgtgagcccatgcatcgaccccaagagcttgcctggatccatcgccctctgcctcggacatgagaacctcagccatgcagtccatcgctctcgcccccctccatgtccatcgcatcgccaggctgcgacgccaatnnnnnnnnnncatgtcaagtacaggggatgcgaagccgtgtgtgccttgaatcctcggccacttactgatgggttggggtccattgtgttgtgccacnnnnnnnnnntagccatgcagtccatcgctttcgtcaccctccatttccatcgcatcgccaggctgcgacgccaatgtctttggtctggctggtgccatggcgggtggggtgatggccgcaggcctcatcttacacccgcgcctggggtgcctggctgccctgcccgccatgcgtcgctgcatgcgtcagcctggtgagggactgctgacgggagaagaggctgccaaagttcatgcacgcatccagagggtgtggcatgacnnnnnnnnnntccgcgcctggggtgcctggctgccctgctcgccatgcgtcgctgcatgcgtcagccaggtgagggaccgctgacgggagaagaggctgccaaaggccatgcacgcatccagagggtgtggcatgacgtgtaggcaatgccttattcttcatattgaggggccacccaactcagccccaatttcatattctcagggtggggcctgccagtttggccagcagatgcgatcccccttagactggtatcaaaagaggcggagggtcggagcgcggcgacgctgacatttgagacccctgcaggctgccccttcactactttcctaccaggccagtacatcaccctgctcatggcgatcgacaggtgcgagtagaggaggggtgctcagttgttcgaggggtcaatctcaatgtaagtcctgcaccactgctcctgaacataagcgactgccgcccaggccccatgcatggctcaaactcagacggacccgcctcccattcacaaaaagacagagtggaggtgaggaggtcctactcaatctcctccctccccctcgccctgccaaagctgtcggtcaccatcaagcgcgtcgccgggggggtggcttccccctggctcctggacaccctgcagctggggtcaaccgtgcatggcctggcgccacagggcgactttttactgaggggtgctgcagcatgcaagcccctaggtcggagttcggagcccgcggtaatgccacccagtggaacctctagagacaggtgcatggggtggcgtggtcctcgttccagtcaggggcgggaggttcatgggccacaagggaagttgcatcatgctgacgtctgagagtctgctagaagggttcttgttgccagcatgggcgccacagagtgtgcacatgccgccacacagacagctccgatctgacccgccccaaaacaccctacacggcaggatcaacgctgcatcaaaccccatgcacatattcatgggagcaggcagcgggctcgcccccctgctgcccatgctggaaacggcgctgcagctcggccaggccgttgcactgctgggttgccaccgtgacgcagaggaagaggtgnnnnnnnnnntcgccacacagacagcttcgatctgacccgcccccgaacaccctacatgtcaggatcgacgctgcatcaacccccgtgcacgtattcatgggagcaggcagcgggctcgcccnnnnnnnnnncttggatgccgcactgcggcactgcaggccaccggccggctgacttgcggcgcattcctgcacgagcacacccactactcggccnnnnnnnnnntttggatgccgcactgcggcactgcaggccgccggcgggctgactggcggcgctttcctgcacgagcacacccactactcggccaccagcgggcgattgagccccgtggacgtggctggctttctgcagaggacgagtgggcaggtcgggggcatgaaaacggggcagccttcaacgtgccaggcctggagctactacctgtgtggccccactggctggctggagctggtggagagggtcctgnnnnnnnnnncgggcaggtcaggggcatgaaaacggggcagcctttaacgtgccaggcctggagctactacttgtgtggccccaccggctggctggagctggtggagagggtcctgctggaccagggcgtccccgcgaccagcatcgccaaggaggcgttctccagccttgcagagggatccggattcgactttgccgggagaggactgcaggccgcggcgcgcagcatccgagtgcagcgagggccaggggtggagaccgccctccaggtggctgcgggacagacgatcctgggggcggccgagnnnnnnnnnngggggggtggagaccgccctccaggtgggagcgggacagacgatcctgggggcggccgaggatgccgcgctccccatcccgtctgcctgtcgcagcgggaactgcaggcgatgtgcggtccggctccagtgcggggcagtgctggacatggaggatggggtggtggcggacccaggcaacacgattctcacgtgtcggacaacaccactgaccgatgaggctctcatcgtgatggagggttgaggtgtccgcttgctcgaccaccttatgatagacatggcaggggcgagggccgacgctctggattcggaacccccggcagcccgtactccttgtgggccctatctccgcgtcagtgctcgcacgtcagctccggaccggacggaaattcgaattcatggagtgcagtttcaaatgtaaaatgaccatcgggggccaccctgttttccatgccatacagaaatcaggtgatccacctaaaccctacaaaattatccctgcaaggaagcaagcgccgccatgggtgagccagttgtacgaactcgatatccaggtttaagtggcgactcgggctcaagaagcccttccaaccacaggagggttccagcgcgcatgcagggcaccatctagcattcaattatgaattgaaagctgtcgacgacgacgtgaccccccccccggctgcgcggactgcctccgagcccgctcaaagagatgctccagacagctctgacctgatgcgatgttgaaccctccctaggtccacatggggctgcgaccaatccaataatcactgctgcatgttctgttggttcgtaaaacgtgcaacagattgcctgaggggcctcaggctcgctgcaaggccggcatgtctgcgcaagcatcatttgtgaccactcgtctcccttcctccgtacttccggaggagggggtccgaacactccgagataatctttgagttttgcgctgctcggggcgctgcccggcatcgccatgtctgccaagcttaccacacacagcacttgctcttccgagggcgcggaagacgccgtccctatggtttccatcaggtgcgcacggtctgccctcctcagccaatgctgaggcgttctggcaggtcgtaaggggttcgcatgccggcgagcggcccgccgcatgcaccagcgggctcaaatttcggcgaggggtcgaggtcgatcctggctcagccgcctggcctggtccctggaaacccctgccccacccacccgacccccctccccccgcaggacccatcggggcagcggggagcgccaggtgactctggaagacctcaagcgtgtggcacacctcagccaggagcgtgcagcagccgccctgaacgtgggtaacacccgcttcaagtcagcctgtagggagctgggcatgcggggctggccataccgcaagatcaagtcggtccggagcctgctgtacgccatccagaaggagccagactctgtgcacccggtgagtcacatgacaagctgggtagctgaggttcgtgagggcacgggattcaggctgcgccacgtcaggaagcgccacccaagggttgcgttgatgccgggtgatgtcaggannnnnnnnnngggttcgtgaggggacgggattcaggctgcgccacgccaggaagcgccacccaggggttgcgttgatgccgggtgatgtcaggaatgccaaatgaatagtcagttcgtcagggcgagatgcggggctatgaagccactcattgcgtagtactgggaggatgaacatctactggcattgctgttggacattttgcaccagaagaaagtgctctcattaagcccttgcctgctggcatgggcagcacataatgatacaagtatcttccccaacccaagcgcaggacatctggcctgcgatcctttggcgtctggaccggctggnnnnnnnnnnaagatgcggggctatgaacccactcattgcgtggtactgggaggatgaacatctactggcattnnnnnnnnnngatgatacgagtatcttccccaacccaaccgcaggacatctggcctgcgatcctctggcgtctggaccggctggtcgaccaccacttccacaaccccaccgagcccctgaccgaggagttcaaggtgctgcgccaggcggcatacaagcggaggcacggccagaagcggaggagcggcgacggcgccgccgcctgctccagctccgagcactgcctcgatgaggacctaggtgccgcgatgcctgctgggcatctgccggtaggccaggccccgtgcacggggtaccaggcgttcgaggactcggcgcagtcgccatgcaccccccccaacgccagggagagggccctgcgcaggcttggacccgccggtgaggtcatgcaggagggagtggcggagtcggggcctgggctgcgtccagagcctccctctgccgacgcttgtccgcacgccggccaaggggtggcagggacaccggtgtgtcagctgctccctgccgcccttccttccccatcagcacccgacctgtggtgctcgctgacgtggaccagcggcctggagtttgcacctgagcccaacgaggcccgtgaggatctggaggatgtgtacgctcagaccgcatcctcctgacatcctctgagagttgattcgcagcttacgaggcagggacctgtactgcccaccacctcaattgatgcacagcgcggaaccatcccacccgccctgccttgtatcacttcccccaaatagctgatcttgatgctgtgcagcaaacccacgggctactgtcttgtgcctactcttgccccnnnnnnnnnncgcgaatcttgatgctatgcagcaaccccatgggctactgtcttgtgcctactcttgccacgatgtctcgacccctgcagcattgctgtgacgccgcaggtgcccccactcacttgcaccgnnnnnnnnnngatgtctcgacccctgcagcattgctgtggcgccgcaggtgcccccactcacttgcaccgtgcaacatcaggtggaggaggttttgcacaggccaatagccacaggtacctgctctcccgaccgtgtcagcagacatggtactgcgcatatatgacctgctgcacgcggtggtactgctcggacagggggccctccaggctcagccccgcgccctccccctccgaccgcctgatgaccaggggcccctcgcagtacagcgcgccgccggagaattcggccgggatggaagctttcagcagcgccttgcgcacctctgcaaaaggggtggagcggttgcggtcaggcaagtggtatgaagggggttgttgctatgcgatctggccaggcaattcaatcgatgcaatcgcttggggtcggaatggcagccacatcgccacacctgacagctttacatcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacagcaccacacacccgaagactgcgccagcaaagaccctcccatcagggttctattctcatcagcagccctcggcaactcaccgggtcggcggcactccggcgcgnnnnnnnnnncgaagggggttgctgctgtgcaatctggccagggaattcaatcgacgtagtcgcttggggtcggaatggcacccccatcgccacacctgacagctttacatcgccgatgaatacacctccaagtgtcgcatgctgtgcctcgtcctccgcaggctccagcaacccctgctcgtgtggtgggttggcaaggagtgggggcctggcgctgccccatcagcgcctctggcctacagcaccacacccgagaagactatgccagcaaagaccctcccatcagggttatattctcatcagcagccctcgttaactcaccgggtcggcggcactccggcgcgcccgcagccatgccagcttgcacccgctaacggcgtgcgtttccagggaagccaccaggcgcccctccatctccaccctgcacgaggcgggtcactggctgtggggcggcacaaggaagggcagaaagggtatccagcgggagcatccctggccctgcacggcactcaccggacgctgggcgcacaggggatctccaggttctccccggggctcaggggcccgtggattttgccgtgtaggggcgccaagtcgtccaccagctgccgtttcagtgtctccaaggcctgcgggatcgagaaagaggggcatgggtcacaagcagnnnnnnnnnnccactcaccggacgctgggcgcacaggggatgtccaggttctccccggggctcaggggcccatgtattttgccgtgtaggggcgccaagtcgtccaccatctgccgtttcagcgtctccagggcctgcggggtcgagaaagaggggcatgggtcacaagcagccagactgccagggaaaaacagccatgcgccttgctcccctgcagtaaactgaccagccagctgtttccaagctccttccaatgcacctgcccccggaggagtatgaaaggcacacagccgcaccccacctgccgcccgctctcggtctgggcccggcccagcagggcgcagtggcggggcgccacctggccgacgatggtgcgcagggagcgcccgtccaccaggccctcgtagtcgaaggccaggaccagggccctgaggttgaaggaagcgtcctcctccacgaccttggtgggcgggggcgggccgggggcggccccctcggcgccggcgtccgcggcggcgggggcgacccccgcaccggggtcccaggttcccggccccgaggccacgtcctcctcaaagaccacggaggtgtcgatggtgccatacgcgtctcgtgcctctggctcctccggaaagggaaacatgggcgagcagcagccctgcaaggagcacacgagcgtgtgaagcaagggatgactgcttgatctgtgggcgagtggatgcagcagaggctggcggacggtggagcctgcccgggcacagggatgtgccctgccctgccctccatggctgcaacggacctgcctgatcacctgcaggccccccgagtcccgaacagctcctcatccagggagcctccacctgccaacccccttcggccccacctccggcaccgcgaatccgtccaccaggcacgcatgctgcgcggcaagggcccccgcgccctcggtccgctgctgcgccggctcgggcgcccccgccacgccgatgatccccgtgttggcccgctggggctgctgctcggccgtgaagtcagcggccaactccaacgcctgggccgcagcgtcgggcgcctcaaacccttcattggcctcaggcaacgcctcggccagcgtcgcatcttcgaccacatcctcgcccgcctccccggccgccgcggccagcgcggccgcca

SEQ ID NO: 48915 - DNA, 61 bp, Chlorella protothecoides
accggatcggcgaggtcttgcctgtagggtaccatggagccgttggagagctgcgcctgga

SEQ ID NO: 48916 - DNA, 85 bp, Chlorella protothecoides
ggcggacatcagcatcgagagcctgcgacgtgtttgactctcacatgccccccgctccctaggttgccgggcccccattcctacc

SEQ ID NO: 48917 - DNA, 62 bp, Chlorella protothecoides
cggctcggtcccaccatgtttaccctcccccactcctgtgcacagccgatccagtgaagcag

SEQ ID NO: 48918 - DNA, 61 bp, Chlorella protothecoides
ctgtcgcaaggtggggacgatccacgcgactcgcgacaggagcacctctgtgctcgctgtc

SEQ ID NO: 48919 - DNA, 61 bp, Chlorella protothecoides
gtaattgggcatgggctgcctcatggtaggtctagattcgcctcctgctgatccagcaagc

SEQ ID NO: 48920 - DNA, 67 bp, Chlorella protothecoides
atacacgcccgtttgtaagctgcattgcacgttgatagcacggcaacgcacaatttccagactcagt

SEQ ID NO: 48921 - DNA, 72 bp, Chlorella protothecoides
ggtgcggcgagcccggagggactggcccgcatgcacacgttctgtcaggagttttcggttctactgctggag

SEQ ID NO: 48922 - DNA, 68 bp, Chlorella protothecoides
gcacatgcattccaggcatgcactggacgggtgcatctccatcatggcatgggcccttccctttcccc

SEQ ID NO: 48923 - DNA, 63 bp, Chlorella protothecoides
atgttcttatctcctatgtttccggatccaaaattgtaccagccgatgtttccggcgccaatg

SEQ ID NO: 48924 - DNA, 61 bp, Chlorella protothecoides
aggtcccgaaatctcacatgccgagatcccaccatcccgccacgagcgaacttgtgccttc

SEQ ID NO: 48925 - DNA, 61 bp, Chlorella protothecoides
tggaatgccgggctattgatctagtttctgatccgccactgagggcaacaacggcttcggc

SEQ ID NO: 48926 - DNA, 14504 bp, Chlorella protothecoides
  modified_base (5061)..(5070): a, c, t, g, unknown or other
  modified_base (5305)..(5314): a, c, t, g, unknown or other
  modified_base (5564)..(5775): a, c, t, g, unknown or other
  modified_base (5870)..(6108): a, c, t, g, unknown or other
  modified_base (6653)..(6662): a, c, t, g, unknown or other
  modified_base (7452)..(7461): a, c, t, g, unknown or other
  modified_base (7525)..(7534): a, c, t, g, unknown or other
  modified_base (8423)..(8432): a, c, t, g, unknown or other
  modified_base (9071)..(9080): a, c, t, g, unknown or other
  modified_base (9315)..(9324): a, c, t, g, unknown or other
  modified_base (9469)..(9478): a, c, t, g, unknown or other
  modified_base (9893)..(9902): a, c, t, g, unknown or other
  modified_base (10265)..(10274): a, c, t, g, unknown or other
  modified_base (10577)..(10586): a, c, t, g, unknown or other
  modified_base (10666)..(10675): a, c, t, g, unknown or other
  modified_base (10786)..(10795): a, c, t, g, unknown or other
  modified_base (11204)..(11213): a, c, t, g, unknown or other
  modified_base (11491)..(11500): a, c, t, g, unknown or other
  modified_base (11824)..(11833): a, c, t, g, unknown or other
  modified_base (11908)..(11917): a, c, t, g, unknown or other
  modified_base (12105)..(12114): a, c, t, g, unknown or other
  modified_base (12505)..(12514): a, c, t, g, unknown or other
  modified_base (12742)..(12751): a, c, t, g, unknown or other
  modified_base (13102)..(13111): a, c, t, g, unknown or other
  modified_base (13785)..(13794): a, c, t, g, unknown or other
  modified_base (14397)..(14406): a, c, t, g, unknown or other
cctcccacccccctccaccaccaccccaaaaaaacataaactcgctcacctgctcgcgccttctccttggcctcctccatggcagcctcgaagccgggcttgtcgacccgcaggcctgcctcctcggccatgagctcggtgaggtccacggggaagccaaaggtgtcccagagcaggaaggcatcggggccggacaccacgccgtcctgtgcctcggccgccgccttcttgaagcgctcgatgcccttgaccagggtgcgggagaaggaggtctcctcgtcgcggatgacctcggtgatggtcccccgcgcccgctccagctcggggtaggcctcgcccatggagtcgatcacggacggcaccagcgtggagaagaagccctggggtccgcccagcacctcgcgcccgtaccgcacctggtcatgtcggtgtgtcgaaaagagagggatgaggacgcggtgcactgagcttgagctgtggagtgagaccttggggcatccatagatgcccgcggcaggtgctcgagggaaggcggtccctggaacgcagcttcctcccgcagcgatacccggcagaatcgggcatcctgcccctccctccacccaaaggacctcaccgcgcgacgcaggacgcggcgcaggacgtagtcacggccctcgttcccaggccgcgcgccgtcggcgatggcgaagcagagggtgcggatgtggtccgccaccacgcggtaggccatgtccttgttgccgacatcatcagccccgacgcggtcggtgtagggctcggcgtggcccgtggccgcctggatggcggcgaagatgggcgcaaacaggtcagtggcgtagttgctcatctgaccctggagcaccgaggtgatgcgctccagccccgcgcccgtgtcaacgtgctgcgcgggcaggctgatcaggctgctgtcgggctcgcggttgaactggatgaacaccaggttccacacctccagcacattggggtcgtctttgagagtagggggggggggggaggtgattgtgagaagtgctggtcctatagttggaattgagggaagttttgagcattgtgtcacccatgtacatgtacataaccccaaaccacccacccatgttgacgaggtcgggcacctcgcggccgccgatgcggtcaaagtggatctcggtgcagggaccacaggggccctggtcgcccatctcccagaagttgtccttggtgccgaagggcagcacgcggttggcaggcaggaactgcagcctgcaggcggggagggtggtttgaggagggagggagtgcttctggtgtgtggttgacagatcttcgtcaagacaggggcaccaggcaacaagccgatccaaagcatgaactaagaaccaaacacagacagttgaagtcatggtctgtcccaagcccaggactttgagtagcaagagctcagaaacctctcctcctcctgacatttcaaatttcatgctcaccagatgtcacgggcctcatggtcgggaggcagtccctggcgctcgtcgccgccaaagtaggtggcgtacaggcggtcagcaggcagactgtacacctgcaggacgaggggtgggagggttgagacaatgcagcgtcaggagagcgtgtcacaacaaaactcaatcgcagggcacaggctccaaggaatagcactgactgccaggacacctttgcagccatcagcatgtcctgtcctggtgatacaagctaataacccttgtccctctcccacactgaccttggttaggagctcccaggcccagccgatggcctccttcttgaagtagtcgccaaaggaccaattgcccagcatctcgaaaaaggtgtggtggtacacatccttgcccacatcgtccagatcgttgtgcttgccgccggcacggatgcactgcggaggggtacagggtggggtggtcttgcctctggtgagtctctgaacaaccaggcccttcagcaaaccccaaccagtcaagcacttaacccgtctcgcacgcctcccgccgtccatgatcctcagcatcacaagcacacaacgtaccttctgggcgtttgtggcgcgcttgagctttcccaggtccgaggcggggtccacggtgcccaagaaaatgggcttgtactggttcatgcccgcattggagaagagcagggtggggtcgttcacaggcacgacagggctggaggggttgaaagtgtggcccttggacttgaaaaagtcgatgaaggtggaccgcacgaccgatcccggccagtcggtgggggagggcatggtcgcgaggcaggtgagccgagagcgggggcggggtgcgcgctgtacgatgatcggcaggcaagagatctggcagcgactaggagccaggcccaatcgcagtgtcgccaacatgcgtgccttgatgggggaaggatggttggggccgacccaagcactctcggctcgggtgaggagggggaaggcctgcggtacccgagcaccctggcgcggtaccccccaccccccttcacgcatgagcagcagggctgcagggcgcaaagacgccgcgcaatgcccttgggactggtgaatctgtgtttctgaatagtactttcactccggatagccttatcgctctgcaaacctgtggtcaaacaccgaacaagaacggggcgggagtgcggcagctacatttatggagggcgagggggatattggggccgagaattttgaaaggtatttgagatccactttagttctgacaatgagcttgaatgaacgtagcttctcccacacagctgtgtcgttgcgacggtgctcgcaaaccattctccccacttccctgcccctcccagcctaattgaggaggaagagctgggccccattgatctagaccctttttacgtcgaccctaccgagccggacccgtgggcctcggaagatggcatggaggggaccgagggcacagcctccactccttgtgagcctcggagtgtcacactggggcttatagattgagatgtcaacagactctgtgctttgagaatccggcactcgagaccctgatgctcacttccctcctccacatagtttccatcccagaaagcttcgactcaaggttcgtggagtctccaaggacgcctgtggcctcacaggatcctcggataacaacgcagtacctcaccaagtatgagcgtgccagggtactgggcactcgggcgctgcaaatctccttgaacgcaccagtcatggtggatgtcggcacggaatcaggtgggtcgcgttggttggggatgggtgtttgagcaggtgttgcctgaatcgtggctttatcaccatttgttgtgatgtagcgggtcgtacctgatggcccttcgatctgccatcatctgcgccgtctgccgaggcttgggggaccatcagcacccaacatgcagacatgactgtgggtggcaaagatgcagaagataaacccaaccattttcaaccgccactcctcaccctaatcacagcatcaccccccccatcacagatcctttggaaattgcatacaaggagctgcgggaaaagaagattcccttcaccatcaggcgttacctgcccgacaacacctacgaagactggagtctgtcagagctcctcatacaggagcaatgactttcattgctgatcctctgcactgtgtgcctgactaggtttgtaacatactgacacgtacgatgcatgccttcgaaagggcgaggcctgagttgatgttgaataagaaagagtgacctgagcactttcctgcacgcggcacgcatagcgggctacggtgaatcagcacaggggattggtaagggaacagtgcgttcgagacgatctatagtggaaagaccaaggtgcacagggttcctggtattgacaagaggctgtgtatgcaatcaagaatgcacggggcacacagagtggccctggacgaagatgggctggcgcaaaacgaccactcgtggtgccctcgtctgcggcaagccacgaccatggtgcatcacggcaacagcacatgcgctgaaacggtagagacacaagctgagtagcagctcaaggggattgggaatctgatcatgctctgggaagaatcagcaaacgcaatgcggtggtcaatgtgcgagtcttggagagcatgacaccctgtcccattggtgtcagggtgctcggtcagatggggggttgggtgagtcatctcggcgtgggtgcttcatggacccatcaggtgacgagtcgcgcctacggcggggagcaggctgctgtggtagtgaggggaatggcaagcctgcggcatggggggccagccttgggaaggcactggagtcggcgaacgcaggggagccatctgaagcatcagcagctgctgacccaggtggcggggcctgtcaaggacagtaatttgaatcagtgggatcaggggtgcagagagatgagcttaaagcgtggtgaggattcgacaggcaacagatacagagcacgcgtaagatgccctccaaactgaaacctgaacccactcaagcctgcaagaaatataatgacaaagcactctccagctaaaaatctgaagaactagccacacgtgtcctcactgctccgcgcacatctctgagctgaggaaagaaggccagaccgaggggaggaccttctgttggcgctcgcgaagtgtgggacatgtatgcctcacggagcacagggtcctgtgcatgttcacgtgtgggatggtgcaatgttatgttgaaccatttcaatggtgaattccccaaccaggggaatgttgcatgggatttatccataacgtctggcgtacgtacccatagtgaccctcgcacggtgcgtcacaagaaaacaaagaaagtttcagctctaatcgaccatcacctgggtgaggaagcgatgcatcatggccaggtcctggacttgctctccaggcgggatttcaggggcctgtgttgggaggtgaaagaaggaatgtgtgcgtgacaagatgttgtgatatcacagacctaacgtgatatgaccagatgacttgaaactggattcannnnnnnnnnaaaggaatgtgtgcatgatcaaacgttgtgatatcacagacctgacgtaatatgaccagatgacttgaaactggattcagatggatcctcgatcatgcatggtcattgacaatgcttgcacctcagcacatgccagctctctgataattcaactaccgacctggcgagaaggaattcccctgaccccaacgttctgctcaggatgggtgctgggcggcggcggcggcggcggcgnnnnnnnnnngagcatcagcagccgctgacccaggtggcggggcctgttgaacacagtaatttgaatcggtgagatcaggggttcaaagatatgagctcaaaccgtggtgaggattcgacaggcaacagatatagagcacacgtagcatgccctccagactgaaacccgaacccacccaagcctgcaagaaatacaatgactaagcactctccagctaaaaatctgaaaaactagccacacgtgtcctcactgctccgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacatctggcgtacgtacccttagtgaccctcgcgcggtgcatcaccagaaaacgaagaaagtatcagctctaatcgaccatcacctgggtgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatttcactaccgacctggcgagaaggaactcccctgaccccgacgttctgctcaggacgggtgctgggcggcggcggcggcggcggcggggctactgctgccggagggtcaactgccggtgcaggcggggcaggtgcccgggttcgggcgcggcgcagctggtcccagatcgcacgggcctccggcgtcagctgcgccagctcctcctcggaggccccgtcggtattgccaggcgcccctggaccggtctggcgcgaggcgtgcccgacgatgatgggtgtggtgtctggctggaacttcagggtgttccagacgttcagggcctcatgcgtcagctgggacaggtctttgattttgttggggtggcccagggccggcagagatggctgtgagtggtggggagggaagggaggcatgcttggtgcgtggcacagaagcaggtggtgagactggcatcaaagtgtttgtcacactcacactgcacactgggccaaaccctttgaaccaaggcaactccaccaagcaattcacccttcctcaccnnnnnnnnnnaaagggaggcatgcttggtgtgcggcacagaaacaggtggtgagactggcattcaagtgttcgtcacactcacactgcacgctgggccaaaccctttgaaccaaggccactccaccaagcaattcacccttcctcacccccgccttctgctcctctggcatcagaccctgttgaggctgcaggcgcaggacgcgaggctgcttgactgacgatgtgttgtagtcgggatggggtgaagcatcccgtgccctggagccactcgctgcctggttggcagcagcctgggctgtcagacggggcaggtcttgcagcacgttttgcagggctgcgatggaaagggagggcagtgatgtgaggtcgactgagatttttatgcttttctgacaggttgggacccagacaggggcaaacaatctcaaaacagatcgagagccacgacacccttgcccgaggtttgaaaccattctctccacacttacactcaaaccttccaagcagggtgagcatgctatgctccatgacacgaagccgagcatctgatgcctcgacttgggccctacgttgggggagcgggtgaaaatagatgctttgcagcgatcatgtatccaaaatatcagaataaatgtatacagtatgaaagagagttgccaaccaccacacgatcacccccactaggtagccgcctacctgagtccagcattgtcctgggcagcagcagacagtgcttccagccgaccagctccttcttccctcagctgcgccacctggttctctagctctgcttgcctgnnnnnnnnnnaatcaccaatatacttgcaacaacttgatattctcttaccaaagactctgccaagatacaccannnnnnnnnntcttgccctggagccactcgctgcctgattagcagccgcctgggctgtaagacggggcaggtcttgcagcaagttttgcagggctgcgatgtgaagggagggcagtaatgtgagttcgactgagatttttatgctttctgacaggtgggactcagacaggggcaaacaatctcaaaacagatcgagagccacgatacccttgcccgagggttaaaaccatattctcaacacttacactcaaaccttccgagcaaggtgagcatgctatgctccatgacacggagccgagcatctgatgtctcgacttgggccctacacggggagtcagaaatcaaggatgattaggggtaatgaaattaccacagaacctagtgcgcttctaaggaaggccagctgtgagccatgagttgatcatcaccccgtgaatagcagcatacctgagcccagcattgtcttgggccgcggcggaaagtgcctccagtcgcccagcaccctcctccctcagctgagccacctggttctctagctctgcttgcctgcaatttgtgggatgcagtacaacacgcctgaaggaagtgagcactctgcatgcgggtgcagtgagagcagaccataaaatgtaaccgttcatttggaaacttgctcactttgtatcaatgccagaggaggtagtccattaccaacatacttgcaacagtttgagattatcttaccaaagactctgccaagatacaccagccaccgcaatatacatacctttctgcattgtcttccagcatgtccaacacccccttcaggtgttgagagaaaagctgcgtcatggacgcccgctggtcctgttcatcctgggctgcctttaaaaccctctcaaggacgctgtcggtgttgnnnnnnnnnntgaaaagctgcgtcatggatgcccgctggtcatgttcgtcctgggctgtcttcaaaaccctctcaaggacgctgtcggtgttggcaaagcgcttgctgatctcggcaaactggcgttgcatcacccctatatctgcgccaaccacccacgagcccttcccgctgtggttgccgacgctctcgccctgcacccctcttcctccgccgccgttgccgccacctccacccgcagcctgtcccgtgccttcctccagcgcgctgccgctggacacctcgtgcagcacctgggccgcctcagcgcgcacagcgtgcagagcgtggcgcacctccttgacgtcgcgcagttcgctggtcagcgcggtgacctccttgcgcagcagcgcgtcctcggccgtggcggcctcgggcgactgcagccagtactccatgtggccctcgtggttgtgccggcggcgcaggcgctgcgcccttggccccactacccggtccgcctggtgcttgagcaggtggtccagcaggcccgtgtcgccgatgacacggcgcgccgcgtctcgcagtaccgggcgcagtaccgcggccacgggggtcagcgcgcccaggcgctgcaggacgcccgtcagcgcggccagcgcggcctcgnnnnnnnnnngcgcagtaccgggcgcagcaccgcggccacgggagtcagcgcgcccaggcgctgcagcacgcccgtcagcgcggccagcgcggcctcgtagcgccgccgcgaccagcgcccggtgtcgcgctcgccggcgggggcgccggggcgggagcgcggcgtcccgctgtcgccggtgcccaggtcgctcaggaccgaagctgagggtgtgggctgctgggtgggggtgggcacgtcctcnnnnnnnnnntggcatccttcagctactctatcctcagttttgcggcagcagagcaaaggtgcacacagcaacaccctccctacaagagaagaatagaggcttggcatacaccagcagcatatgggtctcctcaccaacgctcacctcattcccnnnnnnnnnnagacgaccggtggctcgcctgttcggaggacgcggttgggctccgctcgctgccggccttggagccggcattggacacctggagaggggaggtggacatgggccgaggtttgggtcacccttggtgacagagcttgcaagtcgagtactgatggtgcatgggcatccttcagctactgtatcctcaattttgcggcagcagagcaaaggtgcgcacagcaaaaccctctctacatgagaagaattgaggcttggcatacaccagcagcatatcggtctcctcaccaacgctcacctcattcccacgcctcttcttggtggcatggaccgttgtctcaactggctgagcatcagtcagcacctgcacaggacgctggtccagcttccctgccttctcggcatccagagggatgagnnnnnnnnnnacatggaccgttgcctcaactggctgagcatcagtcgacacctgcacaggacgcgggtccagctgccctgccttctcggcatccagagggatgaggagcctgcaaggagggtgagcagtggctgtcaggacttgatcgactagggcgcagcaggattctcataatggagaagcattcaagtgtgggcatgcccttctgtatgttgaacaattagaagtctcttggtgaaaactgaagctgaccaccttgcctcccttgccaactcagtaaactcactgtctggcagacaggtactccctgcggcacacgaattcattttcgccaattggcaaattctgatcgacctcgccggtggcatcaaannnnnnnnnngagagtggacgtgcccttctgtatgttcaagaatcagaagtctcttggtgaaaatcgaagctgaccaccgtgcctcccttgccaactcagtaaactcactgtctggcaggcaggtactccctgcggcacacgaattcattctcgccaatcggcagattctgatcgacctcgccggtggcatcaaagactttgcagcgtcccttgactgcgcagcacgggccaaataggttgaaggctggacattcgagatcatgagcctgaaatcgaaatctttaacctgctaatgcaccctgaaaagtactnnnnnnnnnngtaggttaaaggctggacattcaagatcctaagcctgaaatcggaattcttaacctgctaatgcaccctgaaaagtactnnnnnnnnnnaggtgcacaccactctgtcacactgacaatttgacaaagacatcctgcttcccgaccaactatcttcctgtcataggtccgccacctgcctgaaaaagcatcgagccatgnnnnnnnnnntgcctgaatcaaaagggcacagcgcaaacttttctgagaagaaaacctcgccgcatgccagatcagggacgtgggtcccaccgctcaactcagtgggcctgcatggaaggggtgctgacccaaatggcacacgagactctgtgacagctaccctgctccccgatcaaacccctctcatcataagtcggccacctgcctgaaaaagcatcgagccatgaccttcatgggctcgccctccgcgccgccgggttggaagttgcacagctgcccaactgatggctgcacatcacgaggattgaactgcagcagcacgtagtctcctgcacgtagtatttccggacgtcttcagagcaacagcatgaatagatcaggaggtacggcctgctgtttcagtatacctgttcacttnnnnnnnnnnctgcacagctgcccaatcgatggctgcacatcacgagggttgaactgcagcagcacgtactctcctgcacgcagtatgtctgggacgacatcagagcatcagcatgaatagatcaggaggtgagggcctgctgtttcagtatacctgttcacttgctgccaagggaacaatgtaccaggtgcaaaagccatcagatgcacatccctagagccccacccttctacacagcccagacatcgtgtaacactaccttcgagatattgcgtactggccttgcnnnnnnnnnntaatggaccaggtgcaaaggccatcagatgcacatcctcaggaccccacccttctacacagcccagatatcgtgtaacagtaccttcgagatattgcgtactggccttgccgtcgtcgttgccatgctcaaactccgagcctgcctgagcgatcagcgcatctgaaggagcatcaacctcggaaatggtcgcgtgacttccgtttccagtggcggatggcatggtcgtcgagggtacttgttatgtgagtttacgcctgggtgtagtaatccgtccgaaacctgctggggatggcgggcgaggaagatgctgccgtcgtacaannnnnnnnnngctccgtacctgcctgagcgatcagcgtatctgaaggagcatcgacctcggaaatggtcgcgtgacttccgtttnnnnnnnnnnggtgcgcaaggtctgttgggctgtttcaccggagcatataatgcacataaacttccgatgaaggctcgtgaacagtcttcggataatcagactagtaccttggagagtggcgtgcttgagggcgtgccaactaccctcgccccgcttcagggcagaggctccgcctccgagatcctgaaacggtggannnnnnnnnncgtgcacaaggtctgttgggctggttcactggagcatataatgcacatacacttccgatgagcgctcgtgaacagtcatcggatgaacagattagtaccttggggagcggcgtgcgtgagggcgtaccaactaccctcgccccgcttcagggcagatgctccgcctccgagatcctgaaacggtggaaacctgactatattatgatggtgtacacgtaatccacttacaaagggagtatatggctgttgtacagccatgtcgcctctggtgagggttagatcctgggagccgcacaatctcttcctcgaggatctttgccccaagaactcctgatgcttccgaacatcacagccgatctgtgttcaggcaggaggaagctgtacgaccttnnnnnnnnnnggatcctgggagccgcacaatctttcttcctcgaggatcttggccccaagaacccctgatgcttccggaaatcacaaccgatctatgttcaggcaggaggaagctgtacgaccttgccttcggttgaagtgaccagggacgagtatgccgtaatgttttacaataaaatttgcagtcagagcagtccattgcagacgcctggacggtacagccggtgtgccctcctgnnnnnnnnnncggttgaagcgaccaggaacgagtatgccgtaatgttttacaataaagtttgcagtcagagcagtccattgcagacacctggacggtacagccggtgtgccctcctgctcacacccgctgctggtgccacatgttgaggagctggaaccgctggggccgcgcttcgaaactcactgcggagccggtgaggctgaggggagcgtgtagagcactgaccttgagttgcttttggaaggctgatggggcttccaggacaggtggcggtgccggcacctccagcatgggctccctcgcgatgccacagtcggcttgggcacacagcctgggtactctcacccagcacacgccccnnnnnnnnnngggaaggctgatggggcttccagggcaggtgccggcgccagcacctccagcatgggctccctcgcggtgccacagtcggcttgggcacacggcctgggtactctcacccagcacacgccccggggactgagcggagccggtgtggcctgcctcttccctcgaagtctgccggtgccctgcaccgcgccggattccctgctgcacatggaagcttccggggacaccaggctgtccacgctggacaccaggctgagctcggggcaggcctccccctcttgcaggcatgcggcgctgcactcggcgctgcatgagtgcagctgactgccggccggtgtttgaaggacacctggtgtcgccgacactggtgcctgtgctggcggcaccagctcctccgcagcccgtcgaggcgagaggggccatgccgcagggcttccaggtgcctcatcggcgagtgctgcgatgcctgggccagctgtgttctcagccttttcatcttcctgtggcgtgatgccagggtgggagaatcttatgcctccttcttctcccaaggatggctctgacacgactgacgtcgacccagccctcgtggagtcgggtggttgaagcccgtacgtggctgccagcgcaggccctgcgtctgcgccgtccggtgcatggtccatcagaggtacctnnnnnnnnnnaggtggttgaagcccatacgtggctgccagcgcaggccctgcgtctccgtcgtccggtgcatggtccatcagaggtacctccagctcagcaagagcaggactgcgatgactcgcgcagggctctccctccgccgacggctcgcccccggaggaacatgacaagccgggctctgcagccgccgcccattccccaccgccagaccgatgatcgccgccatccccgccccccggcaccctggcctccctctgccgcgcgcactcccgcgcgatccacgccttcagcgccgcgaccttgcgcgcctgggcggaggcgcgggcctcccgctcccgctccgccgcctggcgccgcgcctgcatcccggccaggctgcgctccagccgcccctgcgccgtgccggacaggaaggacgcggcgctggccgccagcaccgccccgtagcccgcactgcctccatcgtctggtgtgggcaggatgcgctcgaagcgcggcccgccatcctgccctgcgtgctcctgccgcgggtcccggggccgcgtggtctcgcccgccgcgctgcctcgccgccctgcaccctccccctccacccccagcagcccggcagnnnnnnnnnncgcgtgctcctgccgcgggtcccggagccgcgtggtctcggccgccgcgctccctcgccgccctgcatcctccccctccacccccagcagcccggcag

SEQ ID NO: 48927 - DNA, 61 bp, Chlorella protothecoides
tgtagacgtgggggcggcggtccagaagagagtgggagggagggcgtccgagaagtgcttt

SEQ ID NO: 48928 - DNA, 88 bp, Chlorella protothecoides
ggcatggaactcccatcatcgaagcagcatacaggcaacccccggacccatgctcatcccacccacatgcatgggcctggggtccgta

SEQ ID NO: 48929 - DNA, 460 bp, Chlorella protothecoides
  modified_base (130)..(359): a, c, t, g, unknown or other
cccactgcggtgcaggtgggaaggagggcatggagaatgaggaattaggaaattgagcgccaacaggttacagagtacgagtgggaatgagctactgacggggggaagggaccttaccaccctcaacccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcaggaaagggaggaagggtggcagggaggaaggggtcgctcaatgcagcgagtcgcctggccgtgccgtgcctggggtcagcaaggatcgcaacgggt

SEQ ID NO: 48930 - DNA, 61 bp, Chlorella protothecoides
acagtcatgctgcaaacttatcttccccttaccctgcctcaaactcaggtgctggcatcct

SEQ ID NO: 48931 - DNA, 61 bp, Chlorella protothecoides
gcttggcaataatacatcgtgtgtggcagctttagtgaattgaacctctcccatctgttgg

SEQ ID NO: 48932 - DNA, 71 bp, Chlorella protothecoides
gcccccgttgcgtcagcaaaggggcaaatgatcccggtggggtcctcgatcaggcccatgctgggaccaaa

SEQ ID NO: 48933 - DNA, 152 bp, Chlorella protothecoides
tggacctgagcagacacaggaagaggggtttccccggcacagcatgcgacggcgggacctgggcatcgcattccgaagatgcatggtgccttgtagcctccccgccagcaggcatgcaatcgccggcgcctcaccagcaggtcctgcatgct

SEQ ID NO: 48934 - DNA, 123 bp, Chlorella protothecoides
gccccaacttttacatcgtggcgcgaaaatcctcctccttgggtttccgctataaacttcatcacgttctcgtaaattgccgtgctgacaacatctcattcataattgaccaagaggaacaca

SEQ ID NO: 48935 - DNA, 70 bp, Chlorella protothecoides
acaaacaagcatttgcaacattttgacgtccttgcatgaccctcgcagtccacacggacgccgattccta

SEQ ID NO: 48936 - DNA, 61 bp, Chlorella protothecoides
cggaaaagaaaggagatactgaagggggggttggagcatcggggggtggaggcaagctgcc

SEQ ID NO: 48937 - DNA, 119 bp, Chlorella protothecoides
gctggcacggtctgaggggacaggcaggaccgatgcagttggggagaggcatgtgcatgataacttcacaataatacatgcgcttctcgcccagcctcctcaccagggcagcttcaggc

SEQ ID NO: 48938 - DNA, 62 bp, Chlorella protothecoides
taggtgggcaccccgaccttttgcgtgcctcaagcccttcaaatcatcacccccaccttctt

SEQ ID NO: 48939 - DNA, 61 bp, Chlorella protothecoides
gaaatagctcatgtcatgctgctggcagggtgtcgaaacaagcttagcagcttggtcctgc

SEQ ID NO: 48940 - DNA, 164 bp, Chlorella protothecoides
ccccggtcacgagtattgaacagagcgacccggctgctgaccggacggtatccggccttctccagtgattggatggaagtcacgatctacttggtgtctcacgaacacgctgtgccacaattggccctactggagtgcccattacattagttcaatccgaatgg

SEQ ID NO: 48941 - DNA, 7092 bp, Chlorella protothecoides
  modified_base (654)..(663): a, c, t, g, unknown or other
  modified_base (1635)..(1644): a, c, t, g, unknown or other
  modified_base (2210)..(2219): a, c, t, g, unknown or other
  modified_base (2529)..(2538): a, c, t, g, unknown or other
  modified_base (2941)..(2950): a, c, t, g, unknown or other
  modified_base (3231)..(3240): a, c, t, g, unknown or other
  modified_base (3616)..(3625): a, c, t, g, unknown or other
  modified_base (4471)..(4480): a, c, t, g, unknown or other
  modified_base (5541)..(5637): a, c, t, g, unknown or other
  modified_base (5723)..(5732): a, c, t, g, unknown or other
  modified_base (5789)..(5798): a, c, t, g, unknown or other
  modified_base (6375)..(6384): a, c, t, g, unknown or other
  modified_base (6746)..(6755): a, c, t, g, unknown or other
  modified_base (7007)..(7016): a, c, t, g, unknown or other
gccggtctggcgggccccgccgcggggtatggcgcccccgccccggggtccatgatgccgcggccccaggtgcacggcgccccgctcatgcggccgcccatgggcggcccgcccccgggcatgccgccccctggcatgcccccgccggggtacaggcccgggatgcccccgccgggcatgcccccgccggggtatcggccggggatgcccccgccaggcatgcccccgccggggtatcggccggggatgcccccgccaggcatgcccccgccggggtacaggccccctcccccaggcatgcggccacctcccccgcagtgaggggtgcggaagccgatgcgacgctgcgctctgggaggagggctggctgcatgcggccaccagcggtctgcctcatggtgtctggggccgctgactgcctgccctgtgacatctgtcatgagggtctggtgcatcgcaggacatgtgcggacatgcacttcgccaaagccatgcggcgctccaaagctgatgcttcctctgcttggaggtctctacctgacactgtaaccacagagatccagtctgcctctctctgttcataggagatccctatcgtcaacctgacgagggtgctttcgtttcatgtccagcacccggcactacagccgaggnnnnnnnnnngcctctctctattcataggagattcctatcgtcaacctgatgagggtgctttcgttccatgtccagcacccggcactacagccgagggagggcacgtaccgcctccctctcctcgacctcgatggggatgccatccagcttcttcaggcgtggcagccgacggagcacttcgaggcggtaggcagtcaggtttcctgcagctgccgcctcgctgtgcagtgggttgcctgccaggagcagctcctccagatctggcagggccgtcaggcgctcaatctccaaccagtcccgaattttattgttggaggcgtacagcactcggatgcctggggctttctctatgccgacctttgtaccagagtgagaaggagaaggggctgtttagaactggatggtgggcaaagaaataccacacatggctgttgagcccatgaacagagagatccaaccatgcctctttgaccacaagcaagcagcaatacaggagagcttttgatgtgccaactgatacccaagacccagaatcccaccagcttctcaatggagttgtagctgatccatagctggcgcagggtgggcgccacgccctccaagttctcgatccgcttcaaacagttgcgccccatggacaaggtctccaggctgagtcccgtcaagggaccaatcttgtcgatgctgttggtgctgagcgccagatggcggcttgcttttagtcccaggatggagctgtccatgcgttcgatgggtgggcaggcaccgcacaggttcaccatctccatggccgcccaggcggtgcccttctgtttcgacattacatccttacaggatcgaccggctggaggcatgactggtcgcgctcggatggatttggaagtgtgatgttgaaaacgtgctgttttgcaccatatttaatcgtcattgatcagttgcacacatcctcgaggtacttgaagctggacgaccgaggcgggnnnnnnnnnnttgttttgcaccatatttcatagtcattgatcagttgcacacatcctctaggtacttgaagctggacgaccgaggcgggtcagagcaccgccggttccggaccctgcccggcggaagaggagagctcgtgggaagggaagttgcgatgaacttatgttctcattttcgagcagaacgcgtactcccacaccctgatattcagagtggagatcatagcctatactatacctactgaccggtgatgatacggatctggttgctgtacgcttccctgtggtatgcacccatattgacctctaatcaagcccaggtttggtcacgttgattgggagcatgctggggtcttctgcccttgagcttgtcgacaaagtagtttttcggctgcagacaggcagatggatagcaatgacgagaagctgagaagcatcatacactattgggtatggacaccagtgaggtttctgtacaacattcccttcccaaagaacttaaacttcgaaacttgtacaacaaacttgtctttacagggatcctatcagcaatgcccacgaagtttcgctccgtgnnnnnnnnnnatagtttctcggctgcagacaagcagacggatagcaatgacgagaagctgagaaacatcatacactattgggcatagacaccagtgaggtttctatgtaacatttccttcccaaagaacttaaactccgaaactttgacaacaaacttgtctttacagggatcctctcagcaatgcccacgaagtttcgctccgtgattccacaaggactattaagtcacatcaacatgcatgaacacaaactccaccagaggaaccacaatgctcagtagcatgcatagtcacttcgacaaagccagctgcatcacttnnnnnnnnnngcaacatgcagaacacaaactccaccagaggaaccataatgctcagtagcatgcattgtcacttcgacaaagccagctgcatcactttgttgggctactgagtggcctgagggaactattaccgttcctgtgagcttcctccttgcatctcccattcccgcgcctcgttcaactctggccctgccgtgaaacatcacattcatgctgctcgccagcccgtgacagatgcatatgaccatgcagagcggcacctgaggcaccctcactcacccaccacccatggatggcttacgggtggtcgccggggtgctggagtctgttctgcgggatgagcagacctccaccctgttcggggagcctgtggacccggtggccctgggcctggacgactacttcgatgtgnnnnnnnnnngaccctgttcggggagcctgtggacccggtagccctgggcctggacgactacttcgatgtggtcaagcagccggcagatctgggcaccatcctggcgaacgtgagagccagcctggccgggactgggccctactcccacccccgccaggtggccgatgccgtcgccctggtctggtccaactgcaatctatacaatgatcggccagtggacaagcccatacgggatgcagcagcgagatcaaaatcactgctcgatcgagcatgggccgctgcagggctgnnnnnnnnnnagacaagcccatacgggatgcagccgcgagatcaaaatcactcctcgatcgagcatgggccgctgcagggctgggcagggagccggccacccccgctccatcggcctccaagggtgcgggtgtggggcaagagagtcacgcggcaggcaggcagcagcggctgaagctggcctgctgcatcatatgaatgtttgtacatgcctgcatggcttgcacttcgcttgtatacacggattgccagggtcctgcggttgccctgggctccaaaaccactgtgcgaggcccagtaaggcctagtgggatgtaagcccggccactggcaacccttgcacccgcctcttcctgtcacaggccctgccccaactccagccccagnnnnnnnnnnacttgcatttcgcttgtatatacgaatcccagggtcctggggttggcctgggctccaaaaccactgagcaaggcccagtaaggcctagtgggatgtaggcccggcccctggcgacccttgcacccgcctcttcctctcacaggccctgccccaactccagccccagagaacccaggtctagaggcgcccacggcgacgacgctgcccctgctccgcgtcgacaatttccggatcgtgtccgccagcgacggcgaggcgtaccgcctggagcagctccccgccgcccccggctccgacgccaggctggagggcgaggtggcgggcgagccgggttcccgcttctcctgccacgtcgccgattgggtgctggaccacatcgccgaggccggccccagcctcgcctcggaggacggggtctgggtgctctcccctgaggcctgggtcgcgctgggggagccccatccctcctacgcggacgtgtggtcggggacgcagacccttgtgcgcctgacactggccgcgcgggccgagctgggcgccggcacgcgcctggaggacatcaccgccgcggtcgaaagcgcggccgcggtgctgcaggccgggtcgggcctgcggggcaagcgcaagacgcacgtcagccacgaggcgcgcgcctttgctgccgcgcagctgcgggcgggcgtcagggccgccgcgcgtgcggccgcgagggcgcggggcggcgcaacggggcgcaagcgcagaccctcgggtgggtttgctggggcagcaggattatgagcagggggggaggggcggcgatgggcgtggaaacaaaccaccaggtgcagcgtgcgcgaacggccnnnnnnnnnnggagtaggggggggaggggcggcgatgggcgtggaaatgaaccaccaggtgcagcgtgcgcgaacggcctgcagccgtgcgagatcaaatccggcgttcctgcacgtcgtgaccgtctcgctcctacaccttgtccaacacgcgcagagggcgatcgagcggggcggaggtctgtgctggggggccgcttcaggctaggcgagggccccagcgtcgaggacgagctggcgggcatcagcgacgacgacattcccgcagactttgaggcctcgggtgagggggaaagggtggatgagaggggtgcctccatggaaggactgggtgcagcagtccatacatccggacccctgacgctcatttctgtcctcgtttcacgggtcctgtcctcctctaaaccagatgaggacgacgaggcggccagcagcggccccggcggcccctccgccgcccggcggcgggcgtggcagctggtcaagctgcgccgaaggcaggaggcggccagggtcgcggccgccgaggcagaggccgcgcaggtggagagggagcgggagcgggacgcggcgcgcggttcgcccccgccccccacctccgatttcaggctggctccccacctcgtgcctcgccttttagctgtctgggagtttgtccaggtgtgcgctgctgtgggggtggtggattcgtgagggctgcctgggtatacgcaagagggaccttccatcacccaaatgcagtccccgcaaatgctcatgtggtgcaaagagcacagcaatcctgcgcttcagagtggtggacgcccctcctggatgtgctcttgcaccgcgtgtccttaccttaccccatgccactattatgcagacgtttggcgacgtcctgggcgtccctcccttctcgctcccggccctggaggcagcgctggacccgggaccacacctgccccaccgcaccgtgaaggctgcccccgcaagtgagcgtgctgaggtgcctgccgctgcgacagacgccctgcaggccgtgaagcgggaggaggagccccaggtcggccttgcgacgcctggaggcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagcggctcccgccacagaagaaacgctcggcaccgaggcgcccgctgacggtaaggcgcattttgaaccagcgcaaccagccannnnnnnnnngtccagagccgaatggagtggctggaggcgcggatgaggagaaggccgacgtggagnnnnnnnnnnctccagagccgaatggagtggctggtggcgcggatgaggagaaggccgacgtggagatggccgaggctgtgggtgctggccaagagaatgacggagcggatgatgccatgggcgaggcagaggcgcctggcggcacagcggctcctgccgcagaagaaacgctcggcaccgaggcgcctgctgacgatgaggcgcattttgaaccagcgcaaccagccagcgaggcggccgccgacgcgccgggctccggcacggaggaggaccagtccgcaccgcagggaaaggcgtccgagggccccgtggtcaaggccaagcgccagggctgccgcaagttccccaaggttgcgccgcagaacgtcatctccaaccccacgatccgcacccggcgccagctgctggtgagagagtagggtttctactcttgcgggattgtttcacattctcggaagcccactggccgagacgacaatccaatgatgcgtcgtatcactttaaaactcaccaccccctcctcacaggggccggcggcgacgcagagcggcggcagctcgccgcgtgcccccgaggagggcctcannnnnnnnnnaagagagtagggtttctattcttgcgggattgtttcacattctcggaggcccactggccgagacgacaattgaacgatgtgtcgtatcactgttacactcaccaccccctcctcacaggggccggcagcgacgcagagcggcggcggctcgccgcgtgcccccgaggagggcctcaagatcaagctcaaggtcccaggcctggcggaggggtctgcgccgcacgatgagtcggccccccagcccccgatggagcctgtcgccacccctgtcgctacgatgggggcccctgtcaccgccccccgccaacctcaggccgcaccgttccccggccagtttgcaacgcccggcgcggcgcaggcgnnnnnnnnnncggtgcctgtcgccgcccctgtcgctacgatggggccccctgtcaccgccccccgccagcctcaggccgcaccgttccccggacagtttgcaacgcccggcgcggcgcaggcggccatcgcggcgcatgccgacctgctccagcgccgctacggcctggggctggaggcctttgctcgcctggcgcccgtggactggccctcggcgccggcagcgctgctgtcgcgcgacgtcacctgcgcgctgctgcgcnnnnnnnnnngcgcctggcgcccgtggactggtcctcggcgccggcggcgctgctatcgcgcgacgtcacctgcgcgctgctgcgc

SEQ ID NO: 48942 - DNA, 61 bp, Chlorella protothecoides
gtcagcccgcaggtgctggaactcggtaggagccccctccagcatgctgacctggcacacc

SEQ ID NO: 48943 - DNA, 62 bp, Chlorella protothecoides
tgtgtggtcttcctcatcgatggctcggggagcgtcaccgaaggtgccctggcatgagggtt

SEQ ID NO: 48944 - DNA, 65 bp, Chlorella protothecoides
ggcctgggctccacggcccaagcgccaccacagcgggatcagatggctggctgcacagccgccat

SEQ ID NO: 48945 - DNA, 93 bp, Chlorella protothecoides
tgatgggaacgatgggtggaggggtcggtagatgatgtccggaatcaaggtgcacagcttccatatgcaatacacgcccgctccagaaggcgg

SEQ ID NO: 48946 - DNA, 61 bp, Chlorella protothecoides
ccgcactttcgcgcttaaaacactggcgggtcgtgagatctctgctagtacaacaagaccc

SEQ ID NO: 48947 - DNA, 61 bp, Chlorella protothecoides
gcctcccgcgcaatacgtgccatggcctcgcgcgacccagtcagcgcatgtatggcatcaa

SEQ ID NO: 48948 - DNA, 79 bp, Chlorella protothecoides
ttttctttgcgaattggggagaggggaacccttttcccatcagaggaggtacatcaatcttcacagggtggggccagaa

SEQ ID NO: 48949 - DNA, 76 bp, Chlorella protothecoides
atccaaaaatggcagcgcgtcccatgctgcccacgacaacagggcctgtgtacatgtttacaacgtgggggtgttg

SEQ ID NO: 48950 - DNA, 79 bp, Chlorella protothecoides
aggtcgtgggaaagtgcttcctgactggatcatacctgccaatcagcacggggtaagacccaggagcccagtgtgcagc

SEQ ID NO: 48951 - DNA, 121 bp, Chlorella protothecoides
cctaacgcccaagaggcttccaagcacctactatgccatgacagtgactcgcacataccagcaatatccccgccacacctccctttccctcctcatgccaccacatacctaagggagacct

SEQ ID NO: 48952 - DNA, 6548 bp, Chlorella protothecoides
  modified_base (537)..(546): a, c, t, g, unknown or other
  modified_base (1874)..(1883): a, c, t, g, unknown or other
  modified_base (2523)..(2532): a, c, t, g, unknown or other
  modified_base (2747)..(2756): a, c, t, g, unknown or other
  modified_base (4203)..(4212): a, c, t, g, unknown or other
  modified_base (4609)..(4618): a, c, t, g, unknown or other
  modified_base (5060)..(5069): a, c, t, g, unknown or other
  modified_base (5374)..(5383): a, c, t, g, unknown or other
  modified_base (5477)..(5487): a, c, t, g, unknown or other
  modified_base (5608)..(5617): a, c, t, g, unknown or other
  modified_base (5694)..(5703): a, c, t, g, unknown or other
  modified_base (6109)..(6118): a, c, t, g, unknown or other
  modified_base (6433)..(6442): a, c, t, g, unknown or other
cccgcgtcccccggccgcccccccctctccacccttcccggcggcctgcacgagcacgcggtgctgaacgcctacttctcggccgcggtggcgcgccagcgcgcgcaacaggccgccgcggcggaggcgcaccacgccgcctggatgcacccctcggcgctgccgccctcctttctgcacgccggcggcgtggccatgcccaccgtgccccaccacggcgcgcagcggccgcccgccgacgggcaggccgcgcacaaggcgctgcccagggtcaacccctacctcgccgcgcagctgtactggcaaatgacggggggcggcggtggcggccggccctgaggcgcgcggggacgggccgcgcgtgttctgatgccggcccttggaaaacacgccgcggcggtggcggccgccgcagtctgcgccgccattcgaccagcgaggcccgccgcggcacactcctttcccagagctgagacatgcactgcgcttgaccaggaggcccggtaaccagcggcactccaccagagccctccccgnnnnnnnnnngtcgaccagcggggcccgctgcggcacacccctttcccagggctgagacatgcactgcgcttgacccggaggcccggtgaccagcggcactccaccagagccctccccgacacggtgtccggccccgcgcctgcacccaggaaccccttttttgaggagccgacactgcgggcccgacacccccggcgaaactccctgtaccagtcctgcgactgctgcctgtccaggaacccgtctgtaaatctaggtggactttgaggcgatctcacatgagcagggggaggagaatgtgtgacgggtgccagagataggcgaggggccaggggtgatggcggcaggtggtggagcaagggggctcgcgagagaggacagacgatggcagcgtacaggctgcccatccaagcttggaagatgagcagctgggtggaatgatggcaaggcgtggctcagatccatcagcattgcaggcgccaagcacatgggcagatttcaaggggtggcaagaactgacccaagtgagtctcacgtctcgtgctttgtcaaaccaatgtcgcgcttgtgtgtcacgccgcccagtcccagcccgtcgacatcggtcggggcacggggggaggctcccctctccaagtcgccattgcaggacgtcaaggacagccgggcggggccggggagggacctgggattgccgccgtcagaggtcgcgtcgccggtctcgccctcctccctctccttggcccgcttggagtagggaccataaaagtccaggtagtacttggcgctcagcaccagcagggctccacccagctccaccagctcacagatccaggctactatggcgccctcccagaagaggtacaggaacgtgaggaagaggccgatgcagtaggcgaagaggtaggggtaggccaggtcacgggcactcctggtgcgatacagccggtacagctggggaagaaggcaggcagacagaacgacaccgcccaccgccccaatgacattgatagtcgtctggtcgggcatggcgagaggggccaatggggtccagctcagtgcgtcgggagtgggaaggggttcgacgttagccgtcgggatgcatccataaggcggagtgttgggcacgcgggccccacaagtggattacaggaaagacggcgacgcgtgacgaattgtagggccttgtacctcacaggcactacggccctacaacttcagctcgcacgtggtgtcgcgccctggcaacggatctctgatcgtccaacatctcatctagagtgactcacaagcaagttccgtgagagcctgagggaggtcaagagtcttgaagggannnnnnnnnntgcgccctggcaacggatctctgatcgttcaacatctcatccagagtgactcacaagcaagttccgtgagggcctgagggaggtcaagagtcttgaagggacgcaaagaaacaggcaatgcatctggaattggtacaagtttggaatcagcttgaggacctcgtgggccaacttttggtgaacacggctcctcatactaccctattccgcatgtgaagtgctcagctccacaaggaagacctgggaccctggtatgccagcctgcgcctgccttgccaggctccgctgctcccgggcttcccttctggccttccgtgcgctggaggacagcacctccaggtataccttgcccaggaggaccaccactcccgaccctgcatggggaagtcttgtaaccaatcgatgcagcgcgcaggagtgttggcaagaaagtgattcgaaccagaaacttgacccagagccagcgcatgtccatgccctctgatatatcctccagcagcagatctacagtttctcccacaccaacagcatccacatgacctagttggatgaggatgcaaatccaggtgatgagagccctcttccagaacaggtagaggaaggtgaggaagaggcccaagatgtacgccaggaggaagannnnnnnnnncagcagcgttccccccatggccccgatgatcttcctggtgtgctcatccggaggcatgggggtcccttgtgggttggaggcagatgtatgggatttcgcgcctcccgggactagatgcaagccgcaaggaggtccgtgctcgggtgcccggcggccaagctgcagctgttctgagtcggtgaccacaccggggcagggtctgagagacggaaacnnnnnnnnnnacaaggaggtccgtgcacgggtgcccggcggccaagctgcacctattctgagtcggtgaaaacaccggggcagggtctgagagacggaaacaaacgtatttgagtggaaaatacacgcattcgtggtgccggtgcaccatttatcgttgcagaatgactcaagtggatgatccattcggcatctccagtacggcgccaggttttatgagggaggttcgagggggcttccgggagccccgcgcaagatcatggtcgtggtccagctctgtccaaaggggcacgacctctgcaaatctttctcaaatcaccccatatcgatttaccaataccctaggagtcctgcccagcttccttcccacccgcatgccagactccagccctgcccatacatccgtgcatggaccggcggatgccgtacctaccccccagcccagctccctgcccccacgcatcctgttctccgacctggatggcactttgatccactacacggacaccctgcgggacgtgggcctcttccccaccacctcccccgagggtctgtggcggaccagccccccacccctcggctcggccctgaccgcacccctggacctgctccccctgccgcccaccgcctccggctcccagggcttcatctccaccaccatcttcgagcgccttgcccgtctcagggcccggcaggacgtgcgcctggtgctgatcagcggcgcccgtgcgggcaccctgctccagcgcctgcccctgctccccgccgccgacgcgtacgtgtgcgagagcgggggccgcattttctaccccggcgcggtcggctgggccgcgcacaccgcggcgccgctgaccgaggaccatgcctggcgcggcgcgcatgagcccgccgccggccccgccgtggcggcggccatgaagccggagcgccgcggcggcccgctctggacactgttcgccgcgctcagctccacgcgccacgcgcgcctgcatttcgactgccgcggctactccaccgccttccgcgtgcggggcgacgccgccgcgctggcagagattgcggggtcgctgccggggtcactggcctgtgcccggaacctgggcgcactggacgtctaccccgccaccagcggcaaggtcagcgccgcgcgccacctggcggcgcgctggggcgccgacctctcccgcgccctcttcctctgcgacgacgataatgacctggagctggcagcggcggtgggccgcgccttcctcccctccatcacctcggagagcatgggcagcgcggcacgcaccggcggcgacgccttctacgtggcccgcatgccggtgccctggagcacggaggaggtgctggaggcggtggaggccgagctggcgcaggcagatgatcatgggtcgtcctccatgggagccgagccggggccagtggaggcagggtcggggccggtggaggcannnnnnnnnnaccggcagatgatcatgggccatcgtccatgggagccgagccggtgccggtggaggcagggtcggggctggtggaggcagggtcggggccggtggaggcaggatcggggccggcgggcgcggaggccgagccacaaggcgcgggtgtctagacacatggtcgcaggcaggagcccctcttgtgtagtacagcggcagacgggcgtatgtgtgacgcaagagcaaacagtcggccttctggcaacattttggatgtgtgatgacaccatgttccttgcgttgcatggggggccccccacatgatattcactcccctacctttgtccttgctcaacaaagctcagggggccctgcagtcccggtgcacgtccctccgcctggcagtcggcgtggggccnnnnnnnnnnccccccccccatgatattcacttgcctacctttgtccttgctcaacaaatctcaggggcccctgcagtcccggtgcatgtccctccgcctggcagtcggcgtggggccgcccagggatgcagcgccactcttcctgaaaacgattcccctttgttattctcattcttcttatgacactgtaacattggagcatggaatttgctccgtcaagatttgcaacgtcccgagcaagcagcatgccccaccgcatgccagtggatcatgccgctgcgacggcatctgccgcgacggtcgccttcatgttgtgatagtgctgcctcaccacagcctcgtcaaagggcaagcccatctccgccgtgaacctggcgggagggacgatcaagggggtgggcctgggaaggggggatggttgagtccaaggggttccggctcaatgttcagnnnnnnnnnnaggagggacgatcgagggggtgggcctgggaaggggagatggtcgagtccaaggggttccggctcaatgttcaggctcgtccgccccaaagccggccacccaggagaatggggtggcgccgcatccatggcctgacttgtggatcgcccggcaacctcctgcaataccctcttccaaaccgtcatcacccagcgcaaggcaagacccactttctgcagtgctccaggtaatcctcctcgctcatcagctgtgccgactgcacagccttaggcttctcggctgcaaccagggggaggggccagggnnnnnnnnnntgcatccatggcctgacatgttgatcgcccggcaacctcctgcaatagcctcttccaaaccgacatcacccagcgcaaggcaagacccactttnnnnnnnnnnngcccagaacggtctcgccaatgcgagggacccaggggctgctgtgccagctcctgtgcttgccctcattcaacaagcagtggatctccttgcccacacactgccgatcatgccccaccccnnnnnnnnnntggaaggatggtgtggagtgtctgggcgtatgcacgcctgagttttggagtggggagccaggtggcagatcagcacnnnnnnnnnnttccgtgccgctcgcggccttgccctccttggccttgtcttggcccttgagcgactcaaaggtctccacatactcgtcgtagctcatgtacatgatgtcggggcggtcgtcgggtgtggccctgcatggtcagaaggatagtggggggtgtctgggcgtatgcacgcctgagtttcggagtggggagccaggtggcagatcagcacccgcaccgacctgcccccagggccctcgccacgcgacgcattgttatcccacgccccgccgccgctgccgccgccgccgccgccgccgccgggcgcctggaggtgggccggcggcgggggggtgggtcggacctgccccggcctgcccatccccggccagacgccggcaagcatgggattcatggcgccggggacgagcnnnnnnnnnncggtgtgggccggacctgccccggcccgcccatccccggccagacgccggcgagcatgggattcatggcgccggggacgagcatgccgggcggcatgcctgtgttgggaagggtgggagtggcgtgtctaggacaaggaggggctgccaatgccatgcccagcagcagcacagccgccgtgtatggcctggaatgcacagcaggcgcctggaggtctgcacgctacgtgccaggacctgggggcagggaggccgcctgttccaggtcaccctcgtgcccgcgttgcatcctgcccccctcccccccttcgccccnnnnnnnnnncctgcacgcttcgtgccaggacctgggggcagggcggccgcctgttccaggtcgccctcgtgcccgcgctgcatcctgccctcctcccccccttcgcccccccccc

SEQ ID NO: 48953 - DNA, 66 bp, Chlorella protothecoides
caagaggggttccctgcatgtgccgtgccagcaacccctcgtgctctgtctctcccagcttgcaca

SEQ ID NO: 48954 - DNA, 63 bp, Chlorella protothecoides
gcttcagcaggcctggagcggcaaggggtgtgtgggagaaatgtgtcatcaaggaatgagaat

SEQ ID NO: 48955 - DNA, 152 bp, Chlorella protothecoides
tcctgcaatgggagcggggcaatggaagcacgtgtgcctgtatacatgcgatacccagggcggcccctgccctggtagatcccgcactgtcatcgagtccagaggtgccttgtgctctcctttcccacccttctcctggctcaccgtggggc

SEQ ID NO: 48956 - DNA, 61 bp, Chlorella protothecoides
ggcgttcaccttccccagcagctcatcaacgtatgcaagcttcagtgccttctggtagacg

SEQ ID NO: 48957 - DNA, 61 bp, Chlorella protothecoides
cgaacggaccccgccttgctgaagcccttgcgcctttagtttgtgaggggtggacgtgttt

SEQ ID NO: 48958 - DNA, 121 bp, Chlorella protothecoides
attcgtctgggcgcactgggatagagaggatgccaggccgtgtacacagcgttctcctgcgtttccctcgtggctcgcctttgtggtcatgaagccccatggctggccaaactccccaata

SEQ ID NO: 48959 - DNA, 77 bp, Chlorella protothecoides
tagcggggccttcggaagcatgccaagaccactgggggaactacaccatgcgaggactgtgggttctgtgccatgca

SEQ ID NO: 48960 - DNA, 75 bp, Chlorella protothecoides
aacatgctctttttcaaggtgctgagcaggaggcggtcttgtgttgtcgtcgcctgcatgtcactcgccggtgga

SEQ ID NO: 48961 - DNA, 93 bp, Chlorella protothecoides
tctcgactcccacacaccgggcgactccgaacccccgtttcacaacctctcccacagcttcaacatctccgagaaggtggaccccttctgcgc

SEQ ID NO: 48962 - DNA, 114 bp, Chlorella protothecoides
gcagggccctttgcgttgcaacagtggcttatcattcagccccactccctgccatgctggtccatgaaagttacagcctcccctttggtggcttgtctcggggtggaggatgcc

SEQ ID NO: 48963 - DNA, 61 bp, Chlorella protothecoides
ggagtaggaggcggcggtgaccatctcgtgaacgtcctgccaggacaccaccttctggtcc

SEQ ID NO: 48964 - DNA, 39449 bp, Chlorella protothecoides
  modified_base (96)..(113): a, c, t, g, unknown or other
  modified_base (197)..(206): a, c, t, g, unknown or other
  modified_base (733)..(742): a, c, t, g, unknown or other
  modified_base (1154)..(1163): a, c, t, g, unknown or other
  modified_base (1450)..(1459): a, c, t, g, unknown or other
  modified_base (1655)..(1664): a, c, t, g, unknown or other
  modified_base (1892)..(1901): a, c, t, g, unknown or other
  modified_base (2235)..(2244): a, c, t, g, unknown or other
  modified_base (2339)..(2365): a, c, t, g, unknown or other
  modified_base (3067)..(3076): a, c, t, g, unknown or other
  modified_base (4144)..(4153): a, c, t, g, unknown or other
  modified_base (4904)..(4913): a, c, t, g, unknown or other
  modified_base (5206)..(5215): a, c, t, g, unknown or other
  modified_base (6930)..(6939): a, c, t, g, unknown or other
  modified_base (7061)..(7070): a, c, t, g, unknown or other
  modified_base (8031)..(8040): a, c, t, g, unknown or other
  modified_base (8402)..(8411): a, c, t, g, unknown or other
  modified_base (9009)..(9018): a, c, t, g, unknown or other
  modified_base (9517)..(9526): a, c, t, g, unknown or other
  modified_base (9578)..(9610): a, c, t, g, unknown or other
  modified_base (10285)..(10294): a, c, t, g, unknown or other
  modified_base (10997)..(11006): a, c, t, g, unknown or other
  modified_base (11752)..(11761): a, c, t, g, unknown or other
  modified_base (13503)..(13512): a, c, t, g, unknown or other
  modified_base (14136)..(14145): a, c, t, g, unknown or other
  modified_base (14643)..(14652): a, c, t, g, unknown or other
  modified_base (15273)..(15282): a, c, t, g, unknown or other
  modified_base (15829)..(15838): a, c, t, g, unknown or other
  modified_base (15907)..(15916): a, c, t, g, unknown or other
  modified_base (16114)..(16175): a, c, t, g, unknown or other
  modified_base (16516)..(16525): a, c, t, g, unknown or other
  modified_base (16672)..(16704): a, c, t, g, unknown or other
  modified_base (17020)..(17029): a, c, t, g, unknown or other
  modified_base (17167)..(17176): a, c, t, g, unknown or other
  modified_base (17397)..(17406): a, c, t, g, unknown or other
  modified_base (17862)..(17871): a, c, t, g, unknown or other
  modified_base (18321)..(18330): a, c, t, g, unknown or other
  modified_base (18803)..(18812): a, c, t, g, unknown or other
  modified_base (19458)..(19467): a, c, t, g, unknown or other
  modified_base (19598)..(19607): a, c, t, g, unknown or other
  modified_base (20748)..(20757): a, c, t, g, unknown or other
  modified_base (21314)..(21323): a, c, t, g, unknown or other
  modified_base (22157)..(22332): a, c, t, g, unknown or other
  modified_base (22439)..(22448): a, c, t, g, unknown or other
  modified_base (26992)..(27001): a, c, t, g, unknown or other
  modified_base (27093)..(27102): a, c, t, g, unknown or other
  modified_base (27239)..(27248): a, c, t, g, unknown or other
  modified_base (27974)..(27983): a, c, t, g, unknown or other
  modified_base (37388)..(37397): a, c, t, g, unknown or other
  modified_base (37782)..(37791): a, c, t, g, unknown or other
  modified_base (38740)..(38749): a, c, t, g, unknown or other
  modified_base (39181)..(39190): a, c, t, g, unknown or other
acacgccctgcaccgccggcgcgggggacgggggtcccagctcctgcgcagggcaggcgccgggtgcggcgcgcgcgtcccagacggccacgccgnnnnnnnnnnnnnnnnnnagcggcgcgtcggcgcacgtgaagcggcgcgatggctcggggtctgaggctggcgcgaggagctgggtgccggggtggcgccgnnnnnnnnnnggcggcgcgtcggcgcacgtgaaacggcgcgatggctcggggtctgaggccgacgcgaggagctgggtgccggggtggcgccgtggcgcggcgcccaggtccaccagccgggccccgccctgccagtcgacgcagacggcctgggcgccggcgcccaggagcgccaggccggtgggctgggcgccgcgggcggtgtgcaggggtcccagccggccggcggggacgccctcgccggaggccttgggggggagggggtcaaggatgttgggtttgaggggggtggccaggtacgagtgcggccaagatgatggggtggggttgagatgcccagggcgacattgtgcggagtctttgaacatgatgggggagaccagagcaggaggggaaagtagctggtctccgggtgtcagggactccatggcacgccgtctggcacctcctcatacccagggcacgctttggtgagcacccgactccccctcccccacaattcctccctccccgtacctgcatgccatggagggacnnnnnnnnnncagggcacgctttggtgagcaccgagccccccctcccccacaactccttcctccccgtacctgcatgccatggagggactctgcccctccctcgggcagtgacaagcgcaggcagcacaggctgcccgccctcgtgagcgccacaacatgtcgctggctggcgtcggtcccgtacaccctcaggcccaccaccttgccatctactgtcagggaggccagggaggacagtgacggcccggcctggtggccgccgtgcaggctcaccaggctcacgcgatgctcctgctcaggtagtcgtggaggggcaccatcaagatccaatgccatctaccctcagtctccagataaagcgcatgatcggatctgatactaccatatattgaattcggcgcacctgggcatcggtggaccnnnnnnnnnncaaagcgcatgatcggatctgagactaccataatatcgaattcggcgcacctgggcatcggtggaccaggatcctacggcgaggaggctggtgtgcgggtactgggggacgggaatcaaggcagcagacgtgcacgattctcccaggaaatgccgtgagagtcgaggctccgtcatcctgtgtcgctctcgtgaatgctcgtcgcaggtggacttgcaacgtgagacaaagaggggtacagacacatcgactgtgtggggtgggtctgggtacaagtcagggcgcgnnnnnnnnnnatggatctgcaacgtgagaaaaagaggggtacagacacatcgactgtggggggtgggtctgggtacaagtcagggcgcgagaactccatgcacatcattctcgcaagcgagccagacacgagacaattgaattttgacgttggctttgggatttttcgtgtatgcattggcagatcatattgtcagtccctcactnnnnnnnnnnatgaattctgacgttggctttgggatttttggtgtatggattggcagatcatattgtcagtccctcactgccaccattttccatgagcaacctcgagcaagtgatccgggaggccacgagcaagcgacaccctgctgttcctgcaagcgagctccgcgagatcaaacaggtttgtagattctcaccggaaaatgtgcccttggcgttccagctcctgcttacgaggtnnnnnnnnnnggcgagcttcgcgagatcaaacaggcttgtagactttcaccggagaatgtgtccttggcgttccagctcctgcttacgaggttgcgggagccaaacctccaggtgtggtgctaattgttatgcgaggctacgacacacgcctgcaagcctcatgcacagaggacaactgcctgaagccgtgaaccccatgtcacacaaaggttcgtctgaatgttctgaatatctgtgcggagctcatggagcggtccgggaccttcaggaccattatggcagacggggttcaagaggtgagtggtgacccattctcgtgccttgtatggggagcagtgaagannnnnnnnnncatgcgcgactacgacacacgcctgcaagcgtcatgcacagaggacaactgcctaaagccgtgcaccccatgtcacacaaaggttcgtctgaatnnnnnnnnnnnnnnnnnnnnnnnnnnnccacatgccacatgcacctgtgccgtgcaggtcttggaactgtgcatcgggtattcggctggcaagcctcccagccctgcacccgccggagtggcgagcgagctcgtctccagggctctggagctcttgttccaatggaccaccaagtatgccacaaaacatgtgcaggtgaggcctcaagttgcgtgggtcctggtgatagccggagcgcccttgctgtcaagcttgcaggctggggtggtgctcctacatcctaccattgggtggcatgcctgcagatcgatcccacccgtccggccctactcacacttcgtgctgcccacacacctacacgatgcacagttgctgctcagctacatgtacctcaagaacaagctcaagcttcctctgcaagacctgccggtgcagccagcagcctctgcctccccaccctctcagctcagccctgcagccctgcgacatcagagcgagaactgggatgagatcgtgtactcggccaagtccactgtccatgagttggtacgtgtggatgcagcagggcgtttgatggactttgggactttcagacagcgcacaggtatctcatgttgctgcaaagctggcaggctgcgcccaatgcatggtccgatcctcaggcgagcattgtgtgctcaaatgcccatgcacactggtttgcccggcagacgagccatctggcggccnnnnnnnnnngtctcatattgctgcaaagctggcaggctgcgcccaaagcatggtccgatcctcaggcgaggattgtgtgctcaaatgcccatgcacactgttttgcccggcagacgagccatctggcggccctgagcgcggcgtgcgggctggacgctcctggcgaggatgatgctgggcaggattgggaggatgtggaggaggcgggcccatcctctgccgtggcaacggaggggactagtaccttcaagacggcttggcccagattcgaccccggacgggtggacctcgccattgctggccccctcctggaccaggcggcagctgcgcggcagctggtcgtacaggagctggtgcccgtgctccgcgccgagcttgcaaggggcggtgcgcatggcgccgaggccggccccctcctgtgcggtctggaggaggcctcgcgacagctggacctcccgggcatcgccgcgctggccgagcgctggcgggcgctgaagggcgctgcggccgaggcggggaccgagcgggcagagggatcgccgccgacaggatccagggctgcactgggcgccgcaccgggcgacaaggaggcggctggccgcgggcaggctcccaccacaaaagggctcggcgggcggatgccccgcgtgcctccttcccaactccctgatgcagacccctatgctgggatcgtcgatccagctgccccccggcccgggccacactcaatcgcgaaagccgtggtggagccggcggccgtcgcagccagggcacccagcgctaagcagtcgtcgctgccggaggaggtgcgccgacggttggccgagcaggcgccgaccctccccaccggcctgcacacccagttctgggacagctcgcaggcggtgtcactgacgagcggcacggctgaggtgtacaatcactggggggccgtggacgtcgccaagggtgcgggagggaaaggcagtgggagatgggatgcattgttgaggaacacccatctcttcacccaggaaagaactgcgaggcttctgaacgcctgcggcaagaggtcctgagcaccggaccacttccctnnnnnnnnnngggagatgggatgcgctgttgaggaacacccctctcttctcccaggaaagacctgcgaggcttctgaacgcctgcgtgaagaggtcctgagcaccggaccacttccctgccctgttttcgagcgcagagctgcccaccgagcggctggacgcggtcttcatgctccctgcggagctgttggagaggcaggccaagagggaggtgaaggaggctgtcagccccgtcctcccagcaaggagtgccgcaggggtacatggggaacgccgagcggcgaagagcacggtgtcgacactctggtcaccctctgacatgactcgcaaggaggaacaggcttacaatgctgcggtactgggtaggctgggttgggctgtgggttgtggggtttctctggtgccatcccagcatcttgtggcccgacgggatcctgagccatgacgcccttgtgaaggcaattgcctacggtacagcatctcggtttcctcttacttacctcggcatcacggcacccatgcaccttccctgtcatccaatcaggctccagcgatgagctcctggccaggcagctggaggggacggagtctggttcaggccttcggaagcgaggctcggcagcagctggactacaagcgtcgcacctgcgacccaaagcaaagtcaagtgcccacagacccccgaaatgatggagtgatgcgaaaagaggatgtactggtgaattaatattcaccttgtgacttgagagatgggagtgttnnnnnnnnnncaaatgatggagtgatgcgaaaagaggatatactggtgaatgattagtcaccttgtgacttgagagatgggagtgttgtcaggagaccctgaccgtgcactatgattacctacacttgagctgttcagatatgggctgctgaaaatcgtactcgagctcaacacacctctgaggccctgtggtagcttctccaggagcgacaggagcccacctgagtactattttacacaaaggttatcatgatgaggccggagtttgagagtattcttgactccttcaagtggtatgcaaannnnnnnnnnattgagctgttcagatatggacttctgaaaatcgtattcgagctcaacacacctctgagcccctgtggcagctactccaggagcgacaggagcccacctgagttctgttttacacaaaggtcatcatgacgaggccggagtttgagactattcttgactccttcaagtggtatgcaaatgatggagtatatcttgagcatgagtggcagaatgaaggggtgttgcgtgatgtacacaaagaatggcaccttgcaagcatgtaggctactgagagaaacagagggctatgagcgagtccagcttcttgcatgggaaagcgcaaaagtgatgagggtgtcaaagggaatgtcagatcagttgccgccctccacgccgagatgtttggcgagctgcggcaaagatgaatagggaggacatgggttgcgtgatgcaatgcattcatgtcgatggcctcctcacatccccttcatccttccccctccactcaccttgatgaagacctcttccagggtggcattggcgatgccccagtccaggatggtgaggtgggcagcggctgtggtcatagcctcaaaaactcccgccagggtcacgtcagacattgggagctcatactttcgcgtgccagccagggagtaggtctgccgggcattcgggctcatggagaggaccagtctgtgggcagactctccctcctccgctggcgtcatgattgtgaagacctgtgtcggtttgaggagagagacaggtgatggccatgcgggctcctgccaagctgagaatgcgggtggcctccataggacccctggatcaccgctcccatccccacatgcgcccacgaccccataccagctcacatagtatcccccaaatcgagtggtcaggtccttgggggtgccgaggcaaacgagctgcccatccacaaatatgcccagcctgtcacagaggatgtttgcctcctccatgctgcgggcatgggaaggggcggccaagagggggtggaggtatcaaacagctatgcggtgacacagggccatggtcaagtggaaaagagtacgacccttgagacctaaactgtacctgtgggtggtgagcacgatgccccttccttcctttccttccttgaccacgtcccacagattgtgccgggatgcagggtccaggccctgtgggccgtgatgtggcaggaaagtgtgactagaaactcagagaccaatactatgttgatgcagtgggagaccgtcatgtaggaacgctcaagaactgtttaccgttgagggttcatcgaggtagacgacagcgggcgaaccgatgaaggagatggcgacagacaggcggcgcttcatgccgccagagtacgacagcacctgtgggtggtagggttggtgggtgttgaagccaagctccccgggagaagctggatatgtgtttgcatgcccggccactctcgcccctgatcagaaaaattgagacatgcagctgaacactcaaggcgacagcccgcagtgcagatccatacctgcttctctcccactcggccgtgtaacaggttcacagaagccaaggacttgatgatggcagtctccaggtcctctccctgtaatgtggaggcacgggtagattagagcaggacacttcctggggacctcgcagctcagctactcccttggtgacccccaagctccagcacttgttcatcctatgtcactcacctnnnnnnnnnnattggtgggtgtggaagccaagctccccgggagaagctggttatgtgtttgcatgcccggccactctcacccctgattagaaaaattgaagcatgcagctgaacactcaaggcgacagcccnnnnnnnnnnacaggtactcccttggtcaccccaaagcttcagcacttgttcatcctatgtcactcaccttcaggcccttgaggcgaccgtagaatgacaggtgctgcctggctgtcagctgctcccacaacaaattatcctggaaggggccggcaggatcatgatgaaccaatgtccaaaccagaaacatgctgggcttgagtgactgctttccaaggaattttacaccctccttgcctgtggacacactcccatgatggagtgaatgggcctcatgccgttccgggtgtcgtggccttccacgatcacagagcctgcaatgttggggcatgtgtgaggagcattggcgggcgacagggacctgggatgagctctccaagcttacttactgcagcatgctgaaacatgacagccagcgcccgcgtgattaccgtgtgtggctgtgaggaatccggtgaggatgttgatggttgtgctcttcccggccccgtttgggcctagcagaccaaagcactcgccgcgttccacagccatggtcagccccttgactgcggccaaacgcctttgcgtgggaaggaggtgtgtgtgtgtgtgtgttgaaggagggctgacctgtgcttgcaagcctccaagcaactcagcccctcgtttgcaaatatatgcaccacaagtctccaccccagcacctacttgttgccaccaacagctgggaaaatcttgacgagggacttgatctggatgcaggcttcatcggctccaccattctccactcttgcacgctcggcctgcacatcctcaggctcaacgatgacctggggggagggtgattgggaccttttcaaggttggacgactcaagggccgagcccagactggcagagtgagtgagatttattgaacagaaatgacaaacaaccaatgctggcggtacagcgacttatcagctggaccaccggaatccctgcatcacnnnnnnnnnngtttatcaaacagaaatgacaaacaaccactgctggcggtacggcgacttctcagctggaccaccggaatccctgcatcacctcgactgcatctggccctgcttttgagggctgcgggccggcacgcttggaaaaccttcctcccaagaaaaacaacggatgcttggtcaccccaatgcccgagggaatgacctgttccaggtacctgcaaggtggcaatgacaaagacaactgagccaaagggcaagagcagcggccgcatgagggaggctctcaggtgcctaatgtcaagagattgctgctacacggcgaacacttgttactcccaaatttgtctcgccttgccatgcatttatccaggnnnnnnnnnncgagggaggctctcaggtgcctagtgtcaagagattgctgctacacggcaaacacttgttactcccaaacttgtctcgccttgccatgcatttatccaggtacattccctgtcaaacccaccaagcccccaaaaatcctcacactcaccatgcaagcaggaggaagaccacccactccactgcaaagatgatgagcacagcgatagagccgttgcctgggtcgctcagggtcgaccactggaggcccctggtgctctgcaaaggaggcaggagtgaggaagcgggcgtgttggtgctgcagtctggtaacaatgttgccaggttgtgtttcttttctacataacagaagcaatcggcccatctctatcaaacagcaaacgctctgccccaagcaacttacacccgggctgaaggttgctctgaaggcgtacgcccccatctcatagaaccctcggtacaaagcaaagccgggaatcagctccaggaagatgaccctgcacagagcacacagagacattgattgagtggtggaagcctcatagtcccattgtgagagcggcaatgatccaagcagcttgccttcacttcaaaggacgannnnnnnnnnctccttgtcccattgtgagagcggcaatgatacaagcagcttgccttcacttcaaaggacgacgatgttggggttgcctctgtaagtcagacatatggcatcctcgaacagtgtacgcaggcactcgtcacaccatggcaacccagcccgcaccatgtatcacaactcaccaccagtgtccgttatcgatgaagcgggagaggagcaggaagcctatgagccccgttccaaagattaacaggaaggcagtgaccacagccgtgcgagaggaggtgaagagggtggagagcaggaatgcgaagccgatgagacagttgcaccagaggaaatagaaaaccttgcattagatgggaggaaagagggaggtagtgagttgaaatgctgtctgctaacacagcactttatcaaagacagcattgacatgtcctggatggtcacagtgctgtcccaggctattctagttctgaatcctggacatcagtgcccaacaaaccttgcnnnnnnnnnngacatagcactttctcaaaggcagcattgacatgtcctggatggtcacagtnnnnnnnnnnnnnnnnnnnnnnnnnnnnnnnnntatgatgtgagcctgaagatgggaaggtccacggcccagcccatgcccacgaggatcatggagaagaggaagttcatgataaagaaccatgtgtactggatcagcctgcggcgttttgggagagggggggatggttgacaaggttgtgattccctttctgtttaaaaggtctaagagaggaagcttgggtgcacgggcataacagggatagataacactacatgcggcaagacatcccaaactccttgcacagccgtcttgaagcacagaagccagagctcggcccaggccacccaccagtaagcaccatccccgagtccatgcatcttcatcatggtcctcagcctgttgaagagaggaggcagtgctcgtatgtgggggattgacaagaaaaaggatgggcagctgcacacaggctaggacactacaatctccaggggcagtgccatcctcatcacgggcactcgctcacctcttctccttctcatagacgagggtcagcagcattgtgggcaggagcagctggctcagccagacaaagaagagtggacccaggagggtggaaatgctaacagtgaggcgcgtcacatcctgagcacatggcaatggatggtgagtaaaaagggggggcaccagaatgtgccgcaagtggccttgacccgccctgctgggagnnnnnnnnnnggtgaggcgcgtcacatcctgagcacatggtaatggatggtgagtgaaaagggggggcaccagcatgtcctgcaagtggccttgacccgccctgctgggagtgttgcctgccatccagtgacggcttgaaagcaccaaccatatccaatcatattgcttcaaagcttgtgatcccagcaccaccctcacacaccttgggcatctcctggaaccctaggaggcgggattggtaccctggtcccagtgctctttgcaggaaggagtttgcagccaagttgatgccctgcagggagttgtggactgattggcccctggtcagtcaccttctcaaggttcagccaaatgagtggcaatcacgtctccccaagcggcgcccccaacccaactttacccacctgattgactcgtaggaggcttggaaaggagttgtacacatccacacgcccggttccattgaaccacatcctcacattgtactgccccgtctccaccgacgtgttttgaaagtcccaggcctgggacacctcatagtcctcctgcacccgcccgccacaccggatctgggcgggatggagagtgtgcgaggctgatgagagattaggcttcccgtacgaccagcctaggtcgttgaaactatactttctaaacagaggaccggggggagcagaatatattgtatggggcaggctgctgaccagtctgnnnnnnnnnngttaggctccccgtacgaccagcccaggtcgttgaaactagactttctaaagagaggaccgggggagcagaatgcattgtatggggcaggctgctgaccagtctgatgcagcgtgcttcctgaccaggaagcagcggcgctctgacttccagaatgccagccccactcacctgagggtagccgcagtacaggaacctgttgatggcggacgcattggcctgccacgccggctcgcccgtgacgggggagattgagggcactgccagtcccagtcccactgcgttgctcagcgcatcgagtgaggtgccgagctggtctaggaagagggaaacgctgggggagctggcattcctcaccacggccgtcaggctggcgttgtactgggattggtgttgaaggatggaacaggtcaagggaggatcggcaagcagtttgactcggaaccaaaagaggatgacggcgcagcaaccaccctgaccagcttcccctggacggcacccagaaacagactcacatatctggtggagatgagggatggctccacatagtaggtgggaaagaatctgttccgatctgaccccaggatgagccccagttgggataggccagacgcataaatagctccctgttgggggcggaaggcaggcaaggcatgtttgagaccttatcccttcatacctggctttcttaaaaggtccagaagccatggcactgatgtttgagagtatcacctgggctgatctggnnnnnnnnnnggctccctgttgggggcggaaggcaggcgaggcatgcttgagaccttatctcttcatacctggctttcataaaaggtccagaagccatggcactggtgtttgagagtatcacctgggctgatctggcttggaagaccagcaggagtgcgcggccagggccgcctcaccccaccctccgacttcccctcttttccaccaaaagggctgacttaccacggccaggccttcctggaaggtggctgctgcagcaccctcctctgcaggactcggcgcaggatcgataaagagctcgttggcgagctgctctgaggcgccccgctcatcacctgtgtacagcattgcagctgcgggccgccagggctccgcacgccgcgctgtcctggggatctgcatcagcgccggccatgtgctcggctgcggtacggggcagtacatggcctgcgccgcagtactgtaccccaagccgcaacgagactcgtcgtattcctcgcagtcctcgtagaaccggcaggccgctccctctgtgttattccggcatgtgtactgtcttgatccatttgtactgcagcatcgcaggcagtagcagccacactgcaggtgagaaagttttgggaggtccatgcggggaggagaggaactcgtcagctgctgatggggataaacatgtgccaggaaggccctgtgggcctcaatgttaatagtgcctgcacccgatcccacaaatagcacttgaatatccggcagtatgtcgtcatgcaatcttccaggcaaccccaagcagcatgaagtgggtatcgaaagggtaaaaagggcaaacccaccttgtacgttggtgtgtcgagcgcattattgatgagagtttccaagacaaacaggatcacaaaaaagagcacaggagatatgatgagcaaggcattgctgcgcctctgtcttcgctgctgggctacgttcttcaggaacaaggcagtggcttgggttcggaatgtcgtctgcgcgggggtagtgggtggcgcatgtcaagcttgggcaggcgatctggcgcccgaattcagtcatgaagcttcaaaaaggacatccgggtcctcaaagtgaattctgacagaaggatgaccaaacgaagggggagcgatagccgctccaatacaaaccgacctggcgtcctgtggcacgaatcgcatccgccatcgtgaaaccggggccgcacgagaggcgagggtttcgcgggggaccaccggctgcgctcacctccctttgcaacgagcctgtacgaatgccggggcgcgatacttgtgggcatgttgcggactcgaccggcccctactgtgcgatgtcagtgtcccttaccttcatgctgcttctgtatattccatgaggatgtcgaagcacgggggagctcctggctgatcagagtccttgaatactcattacaacaattgggtggaggttacatgctcgttaaacacttttcgcgcagctccgtttaccatggcgatcgtgcgaccattgccagcagcgcgagctgcgcatggcgggaaatccatgaacctgcaaggtctcttctgcatgctgacgttgcgaataagctttcaaaagcgaggtctacaaaaaaataagtcatgaagggagtagtgcagtggctttagtgaagtggcgggtgggtggggatgaaagagatgtctatgacacaagcaagcacatgggcaagacgtgagaggagccagtgccaagggtctagtttcctnnnnnnnnnnaagaggtctatgacacaagcaagcacatgggcaaggtgtgaggagccagtgccaagggtctagtttcctcccttgacgccgaggtccttggcgaactgcagtggagaaggagggcgaggtcaggtacttgatgtaatgcccagcaatctaattgtaatgcgtcaatgtcccagtagccaagctagggcaagccccttcgtaccttgatgaagacctcttccagtgtggcattggcaatgccccagtccagtattgtgaggtgattggaggcagcagtcatctcgttgaagacctctgctagcgtcacatctgcgacgggcagctcatactttcttgtccctgccaacgcatatgtctgacgagcattgggactcatggacagcacaagcttgtgggctgcctctccttgctcgggaggggtcatgatcgtgtacacctgccggagtcaaggtgggtcgacgggtggggaaggtacttgttggcacaggaggcatgcagagctcgcatccgatgcagatgacaggggttttgatggagcccctgccgtgcagaacctcagattcagaatgaaagggccagccatctcagaggcgaccccaatctcacataaaagtcagcatatcnnnnnnnnnnagggttttgatggaacccctgccgtgctgaacctcagattctgaatgaaagggccagccatctcagaggcaaccccaatctcacataaaagtcagcatatctggaagtcagctcctgcgggctgccgaggcacaccagctgcccgtccacgaaaatgccaagcctgtcacacaggaccgtggcctcctccatactgtgttgggaggtggaggaaagggcggaatgagcaggaacagcaacattgtacatgcctgtgacaaggcactacctgaagccagaagcatggtcagatgagggtcagaccaaagcgcctcgtacctgtgggtggtgagcacgatgccccttcccttctttccttccttgaccacatcccagaggttctggcgcgaggccgggtccagtccctgtgcataggtgtcgtggcgggcgaaggggcgtcgcgggggttgcagaggagcaaaaagaaaacctcaagacacatgagcatgcccttcaatnnnnnnnnnncgaaggggcgtcgagggggttgcagaggagtaaaatgaacacctcaagacacatgagcatgcccttcaatgagggacaacaaacccaccgtcgagggttcgtccaggtagacgacagcaggtgagcccataaaggaaatcgcaacagataggcgccgcttcatgccgcccgaatatgcttgaacctgcagtaagttgggtgggcgggcccagcagtcaggtcttgagcactctctgctggatgcctggagattcattccacacagtacagcggatccctgcacctcacgccacaggatcaccgcagctacttttcgtgaacccgcgaccatccctcacctgcttgtccccgaccccggagttgtacaggttgacgcttttcagcgcagcatccacggcctccttgagctccgtgccctgtgttgggtacaggggatgatggagctgctggtacccagagctgagtgtaccaaggcagcaaccccttgcatccctttgactgacagcgcgacaggaccgcaagcgcacagagggtgcatcgcccacacacggggccccaccttcaggcccttcaggcggccatagaagtcgaggtgctggcgggctgtgagctgctcccacnnnnnnnnnntagcgcgacaggaccgcgagcgcacagagggtgcattgaccacacacgggcccccaccttcaggcccttcaggcggccataaaagtcaaggtgctggcgggctgtgagctgctcccacaagaggttgtcctagaaagatgagaggggctcaggggcgtcagaggtgctttcaagatccagtgcaggtccaaacatggtccgggtgggcttaggcactgccgctgtccctgaatacacttgctcacctgggggcagacgcccatgagggcgtggatgggcttcattccatcccgtaggtcgttgccctccaccacgacgctgcctgccacagaaggaagggcacattccaggagaatctccggtgaggaattggtccagatgcatatcattgccaccaaggaggaatttaatggtgccagcatggcgcagagcattcatgaccccccaggccggcagccatagcattggtctcggcaagctcgtgcgagcatcgcagcccacacccctgagcccatgtcatacaacacccacctccattggctgtgannnnnnnnnnagcatcaggggtactttcaagatccagtgcaggtccacacatggtccgggtgggcttaggcactgccgnnnnnnnnnngggagagtctccggtgaggagttggtccagatgcacaccattgcaaccaaggagtaatttaacggtgccggcatggcgcggagcattcatgctccccaggccggcaaccatagcgttggtctcggcaggctcatgcaagcatcgcagcccacccccctgagcccatctcatacaacacccacctccattggctgtgannnnnnnnnnnnnnnnnnnnnnnnnnnnnnnnnnnnnnnnnnnnnnnnnnnnnnnnnnnnnnatgtttatggtggtgctctttcccgccccattcggacctagcagtccgaaacattcaccgcgctccacagccagggtcagccccttgactgcggccaaacgcctgtgcaggggtccagggcgtgcggctgagcaagccatgccttgcaatgtacagggggatgagcaagagcccaccccgacctcctgtgtcggacctgccaggcatcagttactccctctcccgaccatgtaggcacaagcaggccccattccttccgagtccaccccagatcatgcccaaccaccctcctactcacgggtttccaccggtgggcgggaagatcttgaccaaatccttgnnnnnnnnnntcctgccaggcattagtcactccctcccccgaccatgtaggtacgagcaggccccattccttccgagtccaccccaggtcatgcccaatcgccctcctactcacgggtttccaccagtgggcgggaagatcttgaccaaatccttgnnnnnnnnnnnnnnnnnnnnnnnnnnnnnnnnnaaaaaggtgttgggtactggcaatgtgaggtagcattgagcgacgcttctacctgcaatctcctgcaatgcatataaactccccagccctgtctccctgagtcgctgcgatgcagctcctcacccgccagcacccctggcggcaccgtgcgctacaaaatgccagcgtgccatgcccacctggacgacgtccgtaggggtgctctgtgcggccagggacctcttgcggaacttccctcccaggaagaagagcgggtgtttcgtgatgccgaccccagatgggatcacctgctcaaagtacctacatagggtgtcannnnnnnnnnattgccagtaccccgacaccttttcaggtgccgctggaacctgaggacgtgcgtgcggagcgccagcgtgtcagcgacggcgacacggccggctcgtctatcgtgatcaaggatttggtcaagatcttcccgcccacnnnnnnnnnngcggatcaggacattgggcaatgaggtctgcagtctgtctgctggcagaggtggcagcatgcacggcacaaacaggcctgatgggcatgccctgcccgtggctggtcatttgacgctacaaggacactgccacgagcaggccacatccctcaagatgtcaagagcactggtggtgggtaaggacacaagggcacaccctctccacccaagaccgctcaccnnnnnnnnnntggcatgccctgaccgtggctggtcatttgatgctacaaggacactgccatgagcaggccacatccctcaagatgtcaggagcactggtggtgggcaaggacacaagtgcacaccctctccacccaagaccgctcaccaggccaggacgagaaacaccacccactccacagcaaagatgatgaggacagctgtggatccattgcccggatcgctcaggcttgaccaagtcatcccgccagagttctgcagcagagaagacagcgaggtgggtggtgggtgtgtcattgcatgcaaggaacagagcgagaggcgggacccccatctgacctgctgtgcacatgctacctgacctaaacacagaccacggcagccccaccccggccctcccagtcaaacaagcaccaccgcccataccaccagccaccagccgggaaactccaatcccaccttgtatnnnnnnnnnntccccatctgacctactatgcacatgctacctgacgttaccacagaccacggaagccccggcccggccctcctagccacataagcaccaccgcccataccaccagccatcagccgggaaactccaatcccaccttgtatgctcccctgaaggcatacgttcccatctcccagagtcctctgaacagcgcccagccgggaacgagttccaagaagatcaccctggtggtgagtacgttggtaaggatcggaggtcagacgcatcgagctcaaaacaggctgggctgccggccagccggaatcaagtggaggcccctgggctcgccctgcccgtcctccggccttgcgcggtacctcttgcatgtgcatacgtccctcagtcaattgcggattctatgaaccatcctcccactcagcagtgcagtctcccaaccctcaccaaccaacaaaannnnnnnnnnataggtaaggatcggaggtcagacgcattgagctcaaaacaatctgggctgccggccagccggaatcaagtggagacccctgggctcgccatgcccgccctccggccttgcgcggtaccccttgcatgtgcatacgtcactcagtcaattgcggatcctatgaaccatcctcacactcagcagtacagtctcccaaccctcaccaaccaacaaaagagcccagcgcaccaccaatgacccgactggatgaactgggtgaggagcaggtagccaatcagccccgtcgcaaaggtgtagaggaaggccaccaccacggctgtccgtgacgagcggaagaaggtggaaagcaagaacgcaaaggatatcaggcagttgacccacaggaagtaaaacacctgtgcgacatcggtgtggtgtagtggagggggtttgtatgatgcgtgcattagatgccacccctcgggctcatgatnnnnnnnnnngagtggagtgggttcgtgaggagtgtgatgcgcgcattagatgccacccctcgggctcatgatgagcttgtgtaaggatccataatagacatgcacacatgtccaccgaccccaaccttgctcaccacaaggtagctgtagctggtgaggcggaagatggctaggtcaaccgctgtcccaatcccgatgagcaccatggagtacaggaagttgaggatgaagaaccaaacatactggatgatcctgggggagggaggttgagtgcgcggcataggtcaagctgagatgaagagggggtgctccggtgtgtcagttcagacagctcaagtctgaggcagaggcacgagagaggtggtgccagctcccaaaatgcacaccttctgtcaacagactctgtctgtggccacccctcgcgccaccagcctcacatcatgcacccgtcctcaccagtatgcgccgtcccccagcccatgcatcttcatcatggtcctcagcctgggtggaaagggagcgcacaagcgtgcggtcatgcacatggctgacacatccagatgggttcagccagcggcatccgctcccccattccagcaacaaggcacgtgcacggcaatcaagacctaacctctccttccacgccaaagatggnnnnnnnnnncagagggggttatccggtctgtcggttcagacagctcaagtctgaggcacagaggcatgagagaggtggtgccagctccaaaaatgcacaccatctgtcgacagactctgtctgtggccacccctcgcgcnnnnnnnnnntcgtcatccatccccccattccagcaacgaggcacgtgcacggcaactaaaacctaacctctccttccacgccaaagatggccccacctccttacctcatctccttttcatacaccagactagcaagcatagtggggaggagcagctgagccagccagacgaagaagagtgggcccaggagggcagagaagttcagactcaggatggtggcgccctgcagagagtggtggcaggcccggggtgggagagggcgctgacagggctgttttggatctcaacacagtcctgaggtacacaacacgcagaggggccaggcatctggtcaggtgctcaccttgggcatctccatcaggcccaggagctgggcctgatagtctggacccagggcggcttgcaggaaggcgttggtcgccaggttgatgccctggatgaagggcaaggaggaaagggagagcttctttgttgtactcgcggcaggcctcgtaccaacggcactgagatggcagacatgaaacagtgtttgagaggagctgcggtgcggcgagccaaggcaccgcgctctccccccgattgtctgatgagcagagccagaggggtgatgtcccagggacactcgcccgccatgcaaggcagggtcaccaagtgccttccctgtcatctgggccccaccccatccagaccgcaccaccactccctggctcaaaaggaaatctctaggccccgcacctggttcacgcggaccagggtgggcggtgtctggtacactccataccgacccgtcgcattgtaccacatgcgagtgttgaaggtgcccgaggtggtggaggtgtcctggaagtcccaggcctgggaaatctcgttgaaggcaaaggtgtcgttgcaccaggcctgggaatggaatggtgagaggttggggtgtcgcaggagattgtccattcgtgacacttgttcggagacccacaaggcacaccaagcgtcccagtccaggttgctcctgtgtgagccaccaaggccgcctgcaggtcactccaacgccaacacacgtccatgagggtcccagtcaagcccaacagcgcgcataccacccagagcgccggtgctcaaacacctcatctccacagagcccatccccagccacccnnnnnnnnnntggtcccagtcaagcccaccggcgcgcataccacccagagggccggtactcaaaaaccccatctccacagagcccatccccagccacccacccgcgcgtatccgcagtacagcatgctgttgatggtgctgtcgttggcctcccacaccggctcccccgtggtcggggtgaaggtgggcgccaccaggccgccgccccccagcgagttggctgcgccggcgatcgctgtgccgagcaggtctgcggtgacgacagccgccggggctgcggcgtcggccaccatcatgtacatgctggcgttgtactgtggagatcaggagggggtggggggcgagggagatgagtgggcgcgtgcctccatgcaagggctgcggcgagcagtgatggcggcgtggccgagctcagccatgcaagtggatctgcggccatgacagggctggcccccaagcactcttgccaccacccacaccctctcctcggagtgtgtcgatctttgcttaggcacatccctgcctagaccctgcccccccccccctcatcatctccactccaacctnnnnnnnnnntgatctttgcttaggcacgtccctgcctagaccctgccccccccctcatcatctccactccaacctccgctaggtcccatcaccccatctctccccccccaaccccctatgtcctccgcgtccacccacatcctcagcgttctctccctgcaggaagcccggctcgaggtagtaagtcatgaagtcggtcaccgggcgccaggttcccagcgtcagccccagctgggacaggcccgaggcatagatggtgcccgccgcctcccccgccgccagcgtggcctgcgccgcggcgcgctccgcggcgctaggcgccccgtcgccgaacagcccgccggccagctgcgcggcggccgccgcgtcctgccccgtgtacagcatggcggccgcggggcgccagggctcggcgcggcgccgcgtcagcggcacctgcatcagcgccggccaggtgggcgggtacggcaccgcgcaataccctgcctgcccgttgaccgagtactccacgccgcagcgagagtcgtcgtacgcctggcagtcgtcggactgctggcatgggtcggcggcggagttggtgcggcaagtggtcgtgcccgcgacgtccgtccggcagcaggacaggcagtagcagccgcactgcgtggttgaaatttgggaggttgggggtgtgacaggaggctcagtgcgctgtgtgtccagaacagagtacacaccggcaccagcgagcgagggagagatcgacgcatcctcctcaccctgcttgccgctgcgctcccctgtgacccacagggcagggagtaccacccaagcacacaccctgcaccccacctggttatcgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggtctgcaagtggtggggatggtggtcgtttggggcatcagtgctcgtgtcaacatccgcagtgtgagctcctacgacttgcccactgagcttcaagacgccacnnnnnnnnnnccacccagcttgccgctgcactcccctgtgacccacagggcaaggaggaccacccacacacacaccctgcaccccacctggttatcgcgggatgagagtgcattgttgattacccgctgcagcacgtagagcaggatgcagaagatgaccgggtacaggatgaggatgatgttggtgcggcgctgccggcgctgctgcgccgcattctttatgaagagcgcgcgcgcctgggtgccaaacctggtctgcaagtggtcggggtggtggttgttcagggcatcagtgctcgtgtcgacattcgcagcgtgagctcctgcgacttgcccactgagcttcaagacgccacaaggatccccaaatggaacactggaatacattacatcagtgtacaagaggagcagaggcggggacacccctcccctgcaggactgtgctggctgcagtggcatccctcacgaaccccatctgagaccggtgggcgcatggggacagtcccgaacccggctcaggcagattaccaccggaaccgcgcctccaaagaaacctgctcggtgtcctgaatgaacacactcacatgtttggggggtgccgcggtggacatggggaccgcacgcctccacaccctggagtgcggtgtctcagaatgatccgtggttgagcgcggaaggttaacgaacctcctctattctctaccgtgccccgatcggtaccgtgctggcgcccaatcagatcgcagcccacgatatatcagttgggcgttgaaaagagagcccctgctcctgagtgggtgccgcctgaataactccttgggaaagcgaaggcaggcggagggtgcgagcctcgccgcagagcagtaccgtctccgcacccacaagtctggtccttagcgattttgtagtcggcaatgacgaaaggtggaaggtaactatccagcggaagctttgcccgtctgaagcgccttgccgcgtagggttctgctggaaaggatgggggtcccagtctctccgcagctgaaagatcctcaggagctacgctagtatcgcgtcaggaccgcttgtcgtcagacagcaggggccatctgacaggagcgagtgcttcgcatggatgcgatgaacggcaagggagagggcgtcaagcccagcattgactcggaggatgccaccctcagaccagcagctgcgcccatgaccggatcgcccttcatgggcgcccgcatacttgatcggcactggcatgttcgtttctgggagcagttcacgtgagatctggttcgcaaggagttgcgcaggggtcggagacctgcgctgaggagaggtgtccctaggcagcgcccctccccacttcatgcagctccctcccctctccctgccccaggtcactttcctataagaacatgatagtggcttataggaacctgcgcgccacgctgctgcgtatcatagccccactggtgaggcgcgcacgggacccgggacttagttcagggctcccggcccgcatcctgtggcttgggagccttggggtggggcattccttgcccttcccccagcccgatcgaaggcacctccttcactactatactacatttcctacaattccacagttcttcatgttcctgctctggctgatcaacatcgcggtgcgcaacgacaacccataccttgagtactttgtcgacaaccctgacccagccgtggtcacggtgggggccatccccgcgtgtgccaccgacatgtacattgaaagcccttgctgggacttcctgtaccagcccaacaacaacagcgctgttgaggtgggtcgaatgttgggtggatgggaagtgcagtagggaaggacacatttcaagctctggggctccatccttggagttgatacattatgtatgggaaagctggcccggcccagtaggaagctgggaatgacagttgaagtagttggcatgggtgtcttgtcaggcactgtgccaagtcacaggctgttaccgattggtgccttcctgggttggctctgtctggggttttggagccacacgtactctacacagcaagcctggttctccctcgaggccgctgcctctgtatcttgtcctcccatcccccaactgagctatccatgcctatcaactctgcaggccatcgtcacgggcatccgagagaacaacccggggcgtccaatcccagccagtgccgtgctaggttttcccagcatggacgacgtcaactcctggctgcagaacaacaaggagcagaccctgggggcgtatcacttcacccccaatggctcaaccggcatggacttcctgctccagatcaactccaccgtgggttgctaggggcgaagaggaggagtgaatggatgtgttggggaatctacagccacccttgggttgcagcatgcggtcaagtggttaattggttgtgttatggagacctgcattgacctgagatccagggcagcctgccacaccgggcccctggctcccaccccagcaacataccccacaccctgccccggacccctccctcttcgccaggtcaagctcttccgtgggctgtaccaggacccgacctttttctcccaggtgccgctgcaagtggccgcggagcgcgagatcgcgcggtacctgtggcagctggcgggcagggacgccgccaacttctcctggaccacctcgctgtcggagtttgcgcaccccaccgtggacagcatcaacatcgtgggccaggccatagggccctttgtctttgccgccaacctctttggcttcgtgctgctggtgggtgggccagatctcgagggggctcggcatgatctgggctggcgccggcctgggttggcggggtccgcagcagagggtgtgctcgtccatgtgcctgaggcgtgcaggttgccatgcaggtgctggtcggaaacctgcgtgggtcgagctcagccaggattcccacgcccccacacagctgtcgtccgtggtgatggagcgggagcaagggctgcgccaggcactcaagaacatgggcatgctagactccgcgttctggctctcctgggggttcacggagctcctggccggcattctcttctccctgctcatcatcggctttggcgccgccttccagttcgacttcttcctgaacaacagcttcggggtggtgaggcaatgggagggagggggttgggtggggtgctgatggctgactgtcctgctggctaggagcaacatgccttcctcatgatcatggaccccctccctgcgcatcccattcccttgtccccaaatccttgcagctcttcctcgtattcttcctgttccaatgggccatgaccagtaccgccttcctcttctccaccttcatctccaagtgagatttgcatggaagagggagagggggttgtagtgggcagaggcctcctggcatgcggttcccttggtgctggctcatgtgcagtgggccagggaggtaccaaggtgaggtgtgcgccatcaagcacttggtcagagcagcaaacttgccaccatggcgatgcagcatcaagcctcctcagtcctttctccccttccaactccacttctgaacactcccaaacgcacattatcgcccccacagggccacctccgccgtctactttggcttcgtcatcttcatcatcggctggatctgccaggtggtcatcgcctttggcttcccctatacccccgacaacatcgactccgtgccggccctgaacgtcatctttgccctgctcccctggtcgctcctggccaaggcctcctgggacctgggcgctgcttccgtggcctctgggccgcagggcatccagtggtcgacgcgcggatcctactgccagaacatccaggacccagaggcgcaggccagggcttttgtccccggggtgtaccagaattttgactgcgtgctcagcatcgagaccatcatgatcttcctcaccctggaggccctcgcctactttgtcctggcggtctacctggacaatatcctgcccaacgagcagggtgcgcgccggggtgtcagctgtgcggggttagtaagagtatggagtgcatggccgcgtcttgttgaaagctggggtcaaaggaccaccataacagcgcttgtgcaccgtcaagctcaacctcccgcccacacctcccctgcattgcaggcgtgcgtcagaagccctggtacttcctgctgccttcgtactggcgccggaacaggtcgtctgccattccccctcccaaagccaagcgcaggttctggtgagtgtagtagacaaggattgggccaaaattgcatgctgggcattttgtgattgtggggtactggaccacggccagagcaaggcaggaaagcatggtagagatcgattgggttttgcctgagacagggggcacagcattacttcagacgcaaagaagtatgttggctgactcctgggcacctttcttccacgacaccacaccctcaactgagcacacccatcccctcctcgctcaggccttggaagcgggctgctgcagtgcagcccagcggacccagcgnnnnnnnnnngtgagacatggggcacagcattacttcagacgcaaagcagtatgttggctgactcctgggtacctttcttccacgacaccacaccctcaacnnnnnnnnnngtggccgcagaggagcagcgcatgaggaacctgctcgagcttcgcacaggtgggcggtaaccctcaaagggttgtgacgtcgtctcactgtacaaactgttgatggatgacatacaccggtgtctcttgtagctcannnnnnnnnntggtaaccctcaaaagggtgtgacgtcgtctcgctgtacaaactgttgatgtatgacatacaccggtgtctcttgtagctcacgtatgccccttccctgctctgaccccaccaggacatgaccttgccacgtcgcctgtgcctccggcagccgtggaggtgtttggcctgaagcaggtcttcacacccggcatcctgaccagatttgggcacagcctgaaccggtgagcctgggcgcgggaaggcttcatcggtcgtgagaccatgggcaggctgcatgaaagaggggcagacgccatgttgcctggggcgacagcgctctgtcagtgtcagcacatcttccccccactcctgcacagattcttctgcggctgggtgccgaagctgaggcggaagaagaacaggcgccccgccaagccggtctcccagcgcctgaagcccttctgggcgatcaagggctcctggttctccatcgagcaggacaagctgttctgcctcctgggccccaatggcgcggggaagaccaccaccatcaactgcctcacaggtgcggcaggacccacagggtctgggtgttgggaaggggccctttgtttctcactggccaatcattggaaggcagggtaaccaccacacgggggattcttagctcccccctcaccatgcaaaggccactcctcccgcctgcaccaagccctcccactgttcaaccccccccacccgcctnnnnnnnnnngaccaccccatgggggactcttagcttcccccctgaccatgcaaagggccactcctccagcctgcaccaagctctcccactgttcaaccccccccacccgcctgcaggcgtgctgccccccaccggcggcgaggtgctggtgtacggcgagcgcctgggctcctccggcggcgcggaccgcatccgctccatcatgggcgtgtgccagcagtttgacgtgctgtggccggagctgtccggtgcagagcacatgcacatctacggccgcgtcaagggcctgccccggtccgcgctgcgcgagcaggccgccgcgctgctggagtcggtgcggctgcagggcgcggcgcgcgtgcgcacgggcgcctactccggcggcatgcggcgccggctgtcggtggccatcgcgctgctgggcgacccgctgatcgtgtacctggacgagccgacgacggggatggaccccatctcgcggcgccacgtgtgggacgtgatcgaggcagccaaggcggggcgcgccatcgtgctgaccacccactccatggaggaggccgacatcctgggggacaccgtcggcatcatggcgcgcggccagctgcgcgctctgggcacgccgctgcggctgaagcagcgcttcggctccggctaccagctcagcgtcagcgtcgtgccgcgcgtgacgggggccgacggggccgccgccgcccgcgcgcaggccgcgcgggcagacgaggtcagggcctacttcagtgccgcgctgggcgtggcacccgccgaggagaaccgggcctacatgcacttcctggtgcccaaggcacgcgaggcggagctgccgggcgtgctgggcacgctgcgcgagcgcggctcggagctgggcatcaccgacgtccagatcgcgctgaccagcctggaggaggtcttcctcaccatcgcgcgcaaggtgcgggtggtggggggcgggggagtcccgtggtctgggggtgagggatgggggtggggcaggctgcgggtcgcagcgaccgggggcctgccccaccctggccgcacagctaccacctgccgacacgtcggcgtgccacccttccttctccacccctcaacctgcaccgaccccaggccgagatggaggccgccgaggcagagggacgcgggtcggtggaggtgcacctggacgacggcaccatcggccacgtgcccctgggcgacgagttcgtggaaagcgagaacggcaaccgctacgcggtcaagtgggcgcaggacgaggcggggaacctgcaggtgctgcgctgcgtgccgctgagcgccagcgagggcgccccgtcggacgaccggccgaccgggaccccctcctccaccggctcagacgcgccgccgggcgtgtcgttcaagccgcgccagagcgtgctgctttgagcgtccctggctgggcagctgctggccttgggacacccccttcagggggggactggccgggagctggagaagaaaaggacccgccccaggggcatacctgcttccattgaccaccactcaccctgactgaccatgacctcgagttcgtcatgccactaggttgctccctcaggtctgtgtacagtagtttcagacgcccacgtgcagagacagaggcgtgacagacggtggtggagcatgcactgcatgaccattgacacacgaggagctgtgtgtcctcccggcccatgatatgctggagggggaccagattggcatgcctgccaccagcggccagctgccatcctctcacagcgacaggccggacgcgagcgaggtgatcttccgccccgcagcattcattccggctttccagcgaggggctggcatagtgaccatctggccctgggcatccacctcggcagggatggcagacgccgtgttggtgatcacctgggcgggggatccgaacggggtattatgttgagcagacatgatgcaacgtgcccacgaggtgataataacagacattttgccagatatgagcatcccttgagcaaatcatccttgcatcactgcgatgccaccctgccccatcttgatgcgccactcatccccgcctggacctcacatcaagcgcgacaaaggccaggatgggcgacaggtccagcgtgcctcccagtggaggaatgatgccccgaaacaggttcaggtaagggtcgcacactgtggccagtggccgagagatggcctctggggcctgggggaaccaggtgagcaggatccgcccaatgagagcagcattatacaggctcctgcaggattgaaaggcgtttcagggtctttcagagagtactatcgcacgaggtcagttcaaaagcgtccgtctcagaagaaattagctcttagcaagccacacatgggcttccacacatgacgatcctgtcacagagggctcatgctgccatgggttccggggtgagcatttcccaatcccaacgcaatagggggagctcagagatcgccaacagccatctgaaatactcacaggaattgactgacgcccgtgctgagcacagtgcccgccacgccgcctgcagggagggcagctgcgaatggcacggccctgagggagcgtggaccccacatctggcgaccgcatgcatccgagatgctcagctcatacccgccatcctccctgttggcaacaaagtgcattgattcgtcgagtgcataggaatgtgagggagggagcgtgggaagattgaccgatgcaggcagccatgcggacaccgtgcctgggagtgtatgtgacgatgtcctggccgccccgggctcgttgggtgccccgtcgcatcaaggatgtaatagtgaacgaccgagctgacaattaggcagtcgtcacagaagtcatgcggcatctgaagcgtctcggcacacgaatcgccaccgccatgcacatggtatgatcctcgatcgctttccggctttccagggtggcaactcctgtgcactggctaaggcacattacattccacagaacaatttcaccatgcacctagacatacaggactatgccatggagttggaagcagatttcaagtattccttgatcgcaggtttcgtgcacaggtccatgcagccccttccctctggatcctgcgcgggtggcaggcatgcaaggatgttacgtgtttggtgttgtcctgattgctgagcctgctttcaccatgttcatgaccacctgcgaatactccgctcccttggtcaccttgacgctcagatctgcccccgccgccaccagctcctccagcttgggcaggtcgttctcggtgctggcaaggagaaccaggagatccacaggttccacgccacctgcacccacaagatcatgcattgtcgatccctggttcttagcatgtacttgaatacacaaggattatgctgtcatgcatcgatgccagcgttgcacaaagcataagccagccctgttcgatccagcccagctcactgtcgaacagctcttccagtttgtcatagttgccctgcgcattgaagcgagagcgccgtcatgagcagaagtcccgtgatcactgtgtgaagcacacacactggacctttcccgctcacctctgcggccagcatccccatgtagttgtagtagtcttccacctcactcctggtatagtccccccgttgcagtgtcggcactggaagtggatcccagagggaggagggctgccattaccatctcagtatgactgacctcataatcagggacatgggtgggttgtggtgcaattcgaggagcatgtatcccaaccagcaatccacctcctcacatgtgtcattctgcttcccaaacccgaagaatgcgttgcacgatagcctgcgggataccgttacagtttgagccttgctcatagaccctacgtatgtctggaccgcggggggaaagcgtaggttcctttggtggcaaccaatcgaccgctgtgctgtgcatgtaatgagagtgcatgagccgatgggcatgccccgagcagccgcgtggaccagcgacatcctgagtctttgattcaattcatcaagcgctctgagaacagcatgtaacaatgagtggttcaacgcgaatgaatgctgctcccgaaatcgcaatttcacggcgcctcagcgaggtatcgtgcatgctgcggtccaatctcgggagataagggaggaagaaatgccgatggcacgtagctggtgcggtgtccccctacagcacagtagacgatcctaccggatgagcggatccatgcaaatatttagagcttactgagtacgttttgctctgtcctcgagatttttcggtgctcaaccccacagtgctttagtgtgtgcgcaagtgctgtagatcgtgggacacatgggtgctaccgcaatggtgcagcctcttggctgcactctgggccgcgtacagcacggctcaaagcacattcctgcagtgcccaggcagaagttgaatcttcattccttccaggtctgcaccccggctccacgacgacagagacggacggtgcccatggctgtttcggtacgatggtggagttcccctcctctgggaagccagggggacgtcttgatgcccgcgcagcaggccatgactgtctatcaaccgaataaatgcctaccaaaatcctgcagtccatccccaaggagaactacatcgacacaactccgggctccctgcttcggccgggagttgattcggcggacaggtgtggtcatgagtcgccctcttactcaaaaaccacatgtgttggagcctcgatatgctgggtggtgtcgctggtgggaatcccgccgtccactgtgaaagacagagggggtcccatgatgtgttctcaccaaaggctgctcagcatggtcgccagcattccactgtctaccttcccccacttgacacccccgcagcatccgagggcgcttcgaaaaggccatcagagccgcccaggactccatctgcgaggccatctcggccgcagatggcacccccttcaggcaagacgcatggacgcgggagggcggcggcggcggcatcacgcgtgtcctgcaaaacgggaacgtgtgggagaaggcgggggtcaacgtgagtgtcgtctacggcagcatgcccgtcgaggcctaccgagcggctgtgggccacgacatcagcggcatcgagaaggtgtgtctgtgtgtgtccaaggggagtacaggttgcgtggcgagatccatgcagcccacctgggcctcagttgcagcctggtcactggggcacacgaaggcggtgcaaacgtcgaggtgctttgcaaatccagtgcgccagggaagcgccaccctcccaattccatccctcatacagggttcgcgcatacctttcttcgcggcgggcatcagctcggtgatgcacccccacaacccccatgcccccaccatgcacttcaactaccggtgggtctcctaggttgatctctgcaagttttgatgtagatttgcatccagggttggtctgcgttcctgaggccagggcgaggcccggctctggatgacattccaaggccccctattcttcagtagatgtacaggcatgctcgccccacgggagtgttggtggcttgctgggcagccaggcatggctgcatgtccatcctgctagtccctctcacatccccccccccttccctccccctcccacggccaccagttactttgagacggaggagtggaatggcatccccgcccagtggtggtttgggggcggcaccgacatcacccctaactacgtcgtccccgaggacatggcccacttccacggcacgctcaagggcgtgtgcgaccggcacgaccccgagtactacccgcgcttcaagaagtggtgcgacgagtacttcctgatcaagcaccgcggcgagacgcgcggcctgggcggcatcttcttcgacgacctgaacgaccgcccggcggaggacatcctggccttcagcaccgacgccatgaacgccgtggtggaggcctacgtgcccatcgtcacggcgcacaaggacgacgccttcgacccgaagcagcgcgagtggcagcaggtgcggcggggacggtatgtggagttcaacctcgtgtacgatcgtggcaccacctttggcctcaagaccgggggacgcatcgagtccatcctcatgtccctgcccgtcacaggtgtgtgtgtggttttgatacaatgcaatgtggtggggggcacactgtgcgtgtctcggggggagggggtgttcgggggctgatggcgatgcaggatgctccaagcaacgtgggctctggagttgtctgctgcaggatcgcagacacacctgtgaggcctctcgacagggtccggcacccgtccctgacccctctgcacgtgcattgcatcctgtttgccccctgtggtcagccgagcccgcacatgctggtacagaatcacgctgctgaaccctgccacccccgccccccacagcttcctggctgtacgactacgtcccggcagagggctcccccgaggccgatttcctggatgcgaccaagaaggcccgggagtgggtgtgagcatgaccccatgccgtcccgtctgctgtgttagtctcgtcactgcgtcgctgctgtggcaccctgtcggcgaaggctatgctgtcaggtctgctggtccctttaaatagcatactgctcagtgctggtcagaaagactggagctggtcaagggaggggcttgcccctcatgcaagtcggagaacagcaatgccttgtacaggctcgcgagcagatccaccacttccacgtccgcgccgtcgtgttggggcttgctgccaaagtgtttctcgacaccctgcggcccgcacgcatgctgtctctcgattgtgtttgagctcgggactggggccgctcgcctcacggcccagtctgagtgccccgcgcgctcctgggtggtggcacgagggcatcacgggcccgagggctggagggcggtgcccccctcctggggcgcgaggaatgcatcacccttgagcgctgcaaagagagggtcctggagcgcccggcgggtgatggccgcgtcctcgtggatccggtccaccagtgcctgcccgtgggtgcacgcgtcatgggtgagtcatcgcagagagcgcctcgcaaacagcagcgcggcgggagcatgcacctgtgcgtttccagcccactgctccaggctgcccccagccccacgacgaatgcaccccacctgcaccgacacaaaatctgcctcggggcgtaggtaggcgcagaccaggagccggatctcctcgccgtaaaagtcctggtcgaactcgtgcagcagccagggctcgcaaaccctctgcttgtttttgaacacggggttgaagcctgccgagagggtgcagctgggtcagctggagcaggtgcagcatggacgacggcccagcccctccgtcagcacctggccaggagcgccgagcgtcgcccaccccccctctcgtcacacccaccgacgctcatgcacatggggtacacttcgggggaccggccgaccgacgcccagccggcgtagatgccggtcaccgcctcccccaggctcccacgcagggactcggcatccaggttggcagtggggatgcccagctccttggaccctggaggcggcatgaagggcagggtgtgtcatgctgtggcaaggaaatcctccaggggaggatggggtggacacaggaagctcagtgtcccaccgatgcccacttgcaagggacaagggccggaacttcaggcacctgtgcactccatgccgccacgcacctcgcccatagcctctcacgacagtgccacgtatgctccaggccgggtcgacggggacggtgccctgcacaccatccttgaaggggggcaggccgaatgcctctggcctgaagtcgagcagggaggcaagcgtggttatgccctggcgtccgaaggtccgcgcattccgagcggcgctccccgtgtcaacctgccgtgaggtcgggtgagtgttggggtgggagggaggtcagggcaatgccctcctagcaaagctgaggcggtcatcatcgactctgcgctgtcagcaaagcaggtgcgcatgtggagcctgcaagttgcagcacagcgacagctcatctcctcgtgcaccttcgcacaccatggaggggacgtggacgacatgcatccccgccgctgccgccgcgtccactccagcgggagagtcctcgatcaccaggcagcgggagggggggaaacccaggctcttggctgccaccaggaagctgtcgggggctggcttgccctgctccacctgccgagagagggcggtggtggtgggttggcgcaggctgaaggggccgagacagacaggcgagggggctcgggctgatgaaaacagactggggactagggcagtgtcccctccactttccttccccccaaacactctgcagcaccgccgtggcacctcgtcaccgcagcaggtgatctggaaggtggtgcgcaggtggccgtgcacggcaagcttgagcggcagcgtggcgcggagggtggaggtcgccagggccatgggcatgccgcactccttcaggtgggtgagcaggcgcagggcccccggcagcatcttggcctcctgccagcgctcgctgagcagggcctcggactcctccagcagctgctgagctggcacgggcaggtcgagggcagcggccaccgccgcccaggcctccagaggtctcttgcccaggctggccgcgcgggcggcgtccgtgagctcgcctccgtggcgggcgatgacctcgcgggcgacctctgcgaccagggactccgtgtccaggagtgtgccgtcgaggtcccagatcacgcaggcggagggttccgggggaaacatgaggggaacggcgtgaaagccgcgacgcaggactcgctggcgttttttgctgatgagaatgtttcacttctggctgaaggaatctcggttctgggttcagcagtgcagggtgtataagagcagcacgggtgggccaaagctggtgttcgagcctctctgccctagacgctttcgcaacccggagtgtggccccaccctgctcagtcaatattcagccgactgggatgattaggtctgggttgactgacagagaatagggtacaagtacatgcacctagccaggctgaaagattcctcagtccaccggccacgggtccgctcgccaatgccgggggaatgacggccgtccgcagctggtcctgaagccggagcctgagaaggccacgacggccgaggctgtgcgtgcgggtctagaaaatcgatcctgggagcaggtgctgtgcatgacgcgccggttccagttagggttggatgaccacggcacacccagcatgcagtcagacctggacgctcgcccgtgttgcactgannnnnnnnnnaaggtgctgtgcatgacgcgcaggtgccagttagggttgcatggccacggcacacccagcatgcagtaagacctggacgctcgcccgtgttgcactgatcgcaacagcacatcggtcgactgccgatcgctgatcataacctgtactggagcaggcctggccagtgcagcccggtgtgtgatgcgggagagccatctgtccttccgtcttccaatgactcacgtaatctgagaggccgagagggaatgaaacagctccccctgtcaacatgctacgcctctgattttcatgctaatttcacattcctgagagttattgccaaaccttggacgagctcaatgaggttcacgaacccccctctgacattctcctgaggttgccggtnnnnnnnnnngatttcacattcctgggagttattgccaaaccttggacgagctcgatgaggttcacgaacgcccctctgacattctcctgaggttgccggtgctcacgtcgattccatggcaagtcattgccactcctcggtcgtgccacaactagcttttcttctatcaatctgccattgtgtgacatgttacgtgattgttgggcacgccatgccctggatgaccagccaccagctacaagtcggtgtcatggggaaggagctcgttgcccggggccataccttcatcatgctgctctccagctgcgatgccgcgacgttggcgcgagtgggcggagtgcccgagggcatccaggtcatggagtaccccagccccatgcccagccacagcagctgtgctgcagccaagcaggcgaccctccttgagttcagcactaagctgccaggcttggtgggtggggcgtgagcagagggcgggttcgagggggtggtacttgtgatcaggccttggcagggtagtttacgatcgtctgcggtaggacagtgccccgtccgctgtcctcttgctcttcggaatgtcatcactggtatgctccctcctgctgtgcacccaaattcccaggacatctggtacctcactgagcacagcatggtgccgcattgcgccgccctcctgcgtaatttgaccatcatccctgcccttcgagctctccatccggaccttgtcctcggggacttcagcgacgtctgcactcccatcctcggggatggtctgggcgtccccaggtcagggctgcccctgggtgtctgtatatgctgagattgcgagcgcttcgcggccgccactgcctgtccctaaatagcagtcgagcatgctgcacggaagcagcaagtgagccctttgcacgtcaccttcttcccttcccataacacaccaaaacagggtggacttttcgcnnnnnnnnnnagcagcagcaagtgagctctttgcacgtcaccttcttcccttcccctaacacaccaaaacagggtggacttttcgccggcaggcttctttgacaacatcctggccactgcttacaacttcagtgcccctccctccctcgtacccatgtacggcactggctttgttcctggacagctgaggctgccttggaactatcttttgaatgctgcctcctttgcagtcagcccctgggtggtcaggtgacgcgctgatggaggggtaaagggacctgcatggtgggagtcgcgcggggcgctgcattgggtgattcatcgtcacatactcggcatgctctttgtgatagtggaggaggagtgggttgctgttttttgccatcacctgctcattcgtgctctactgctacacctcatgcccctgcatgctgacgctcannnnnnnnnnaagtcgcgcggggcgctgcattgggttgattcatcgtcacatacacggcatgctctttttgatagtggaggaggagtggattgctgttttttgccatcacctgctctttcgtgctctacggccacacctcatgcccctgcatgctgacgctcaattcataaaactgttggcttgcctgtgagggtgtcgctgatgcactcgctccaagtcaccccttcttgatgccccccctcccctttcaccccccaccccaccccac

SEQ ID NO: 48965 - DNA, 242 bp, Chlorella protothecoides
tccccacaggtgtcgcggacggcatctgcttggaacttgctgcatgtgggcctgttgcaacggtgaggaccatgccttctgctctgcggccagcagtaaaagcgcacagatgccaaggctgcattgaccagcggactgctgcatgccaggtcgactccaagcgcgtggttttcgtgccagcgaggtagaggtgggaggcccttgcaacctgcatgggctcacttgcaaatgaacaaaggaat

SEQ ID NO: 48966 - DNA, 72 bp, Chlorella protothecoides
tgtgcctggtgctgccccctcatccctcttctccccggggggatgggagcagcacggccaggggaacaccac

SEQ ID NO: 48967 - DNA, 64 bp, Chlorella protothecoides
agatgccggggatggggaggatgcggggcttgctgccggcgagggagaggccgcagggctggcc

SEQ ID NO: 48968 - DNA, 75 bp, Chlorella protothecoides
tcgatctctggaccccaagcggttgcctgtctggccgccgcgcgacggatccatttttatgcttgaatctacccc

SEQ ID NO: 48969 - DNA, 78 bp, Chlorella protothecoides
ttggagtgagagattgttttacaattagcactgcatccacaaggagatcccttgagatcgatcatcacacgctctagt

SEQ ID NO: 48970 - DNA, 72 bp, Chlorella protothecoides
tcaaacacatgagtaatgatgacatgttatcgggatgaagtacctaaccaagattcgactcgagtacaaggt

SEQ ID NO: 48971 - DNA, 76 bp, Chlorella protothecoides
ccagcgggactggacgtacccgacctgcgcaagggggggggtggaaagagaggagggaatgagtgatgagcagggg

SEQ ID NO: 48972 - DNA, 75 bp, Chlorella protothecoides
aagatacacacccttgtgctctgtagcttgacacatgggacacttgcgataccaaggacatcacaagctatgcgg

SEQ ID NO: 48973 - DNA, 52221 bp, Chlorella protothecoides
  modified_base (398)..(407): a, c, t, g, unknown or other
  modified_base (471)..(480): a, c, t, g, unknown or other
  modified_base (945)..(954): a, c, t, g, unknown or other
  modified_base (1088)..(1181): a, c, t, g, unknown or other
  modified_base (1261)..(1270): a, c, t, g, unknown or other
  modified_base (1364)..(1448): a, c, t, g, unknown or other
  modified_base (1528)..(1537): a, c, t, g, unknown or other
  modified_base (1774)..(1783): a, c, t, g, unknown or other
  modified_base (5217)..(5226): a, c, t, g, unknown or other
  modified_base (5941)..(5950): a, c, t, g, unknown or other
  modified_base (7689)..(7698): a, c, t, g, unknown or other
  modified_base (7929)..(7938): a, c, t, g, unknown or other
  modified_base (8167)..(8176): a, c, t, g, unknown or other
  modified_base (9160)..(9169): a, c, t, g, unknown or other
  modified_base (9873)..(9882): a, c, t, g, unknown or other
  modified_base (10255)..(10264): a, c, t, g, unknown or other
  modified_base (10889)..(10898): a, c, t, g, unknown or other
  modified_base (11750)..(11759): a, c, t, g, unknown or other
  modified_base (13337)..(13346): a, c, t, g, unknown or other
  modified_base (15626)..(15645): a, c, t, g, unknown or other
  modified_base (15817)..(15826): a, c, t, g, unknown or other
  modified_base (17851)..(17860): a, c, t, g, unknown or other
  modified_base (18571)..(18580): a, c, t, g, unknown or other
  modified_base (18779)..(18788): a, c, t, g, unknown or other
  modified_base (19561)..(19570): a, c, t, g, unknown or other
  modified_base (19821)..(19830): a, c, t, g, unknown or other
  modified_base (20801)..(20810): a, c, t, g, unknown or other
  modified_base (22394)..(22403): a, c, t, g, unknown or other
  modified_base (22509)..(22518): a, c, t, g, unknown or other
  modified_base (23019)..(23028): a, c, t, g, unknown or other
  modified_base (23723)..(23732): a, c, t, g, unknown or other
  modified_base (24336)..(24345): a, c, t, g, unknown or other
  modified_base (24564)..(24573): a, c, t, g, unknown or other
  modified_base (25373)..(25382): a, c, t, g, unknown or other
  modified_base (25441)..(25450): a, c, t, g, unknown or other
  modified_base (25513)..(25522): a, c, t, g, unknown or other
  modified_base (25695)..(25756): a, c, t, g, unknown or other
  modified_base (25891)..(25900): a, c, t, g, unknown or other
  modified_base (30318)..(30383): a, c, t, g, unknown or other
  modified_base (31856)..(31865): a, c, t, g, unknown or other
  modified_base (32331)..(32340): a, c, t, g, unknown or other
  modified_base (33608)..(33617): a, c, t, g, unknown or other
  modified_base (33718)..(33727): a, c, t, g, unknown or other
  modified_base (34363)..(34372): a, c, t, g, unknown or other
  modified_base (35845)..(35854): a, c, t, g, unknown or other
  modified_base (36397)..(36406): a, c, t, g, unknown or other
  modified_base (36688)..(36697): a, c, t, g, unknown or other
  modified_base (37038)..(37047): a, c, t, g, unknown or other
  modified_base (37602)..(37611): a, c, t, g, unknown or other
  modified_base (38246)..(38255): a, c, t, g, unknown or other
  modified_base (38819)..(38828): a, c, t, g, unknown or other
  modified_base (39050)..(39059): a, c, t, g, unknown or other
  modified_base (39149)..(39158): a, c, t, g, unknown or other
  modified_base (39468)..(39488): a, c, t, g, unknown or other
  modified_base (39726)..(39735): a, c, t, g, unknown or other
  modified_base (39825)..(39834): a, c, t, g, unknown or other
  modified_base (40323)..(40332): a, c, t, g, unknown or other
  modified_base (40991)..(41000): a, c, t, g, unknown or other
  modified_base (41433)..(41442): a, c, t, g, unknown or other
  modified_base (42016)..(42127): a, c, t, g, unknown or other
  modified_base (42184)..(42193): a, c, t, g, unknown or other
  modified_base (42250)..(42259): a, c, t, g, unknown or other
  modified_base (42451)..(42466): a, c, t, g, unknown or other
  modified_base (42811)..(42820): a, c, t, g, unknown or other
  modified_base (42884)..(42893): a, c, t, g, unknown or other
  modified_base (42967)..(42976): a, c, t, g, unknown or other
  modified_base (43510)..(43519): a, c, t, g, unknown or other
  modified_base (43903)..(43912): a, c, t, g, unknown or other
  modified_base (44752)..(44761): a, c, t, g, unknown or other
  modified_base (45372)..(45381): a, c, t, g, unknown or other
  modified_base (45684)..(45693): a, c, t, g, unknown or other
  modified_base (46025)..(46034): a, c, t, g, unknown or other
  modified_base (46111)..(46120): a, c, t, g, unknown or other
  modified_base (46201)..(46210): a, c, t, g, unknown or other
  modified_base (46624)..(46633): a, c, t, g, unknown or other
  modified_base (47411)..(47420): a, c, t, g, unknown or other
  modified_base (49002)..(49011): a, c, t, g, unknown or other
  modified_base (49407)..(49416): a, c, t, g, unknown or other
  modified_base (50196)..(50205): a, c, t, g, unknown or other
ggggggggtgggttgatggatggggtgttgggggggtattatctgacataacgcactcagactgcggtgagagtgatgcagttcaagtccacaattattcacatgtgcgcatgcctcttgcctgcgcttgtcttcttcactggagagatctctgcaatctctcggtagctcgagcaccaccagtcttcccactcagaaactgattgtgcctcacccaatcccccaacactcaggcctgctcgggctggtgtcctctgacgatgagctggccgccgtgctggcgcatgagtgcgcgcacgtcctggctcggcacgccgctgagcgcatgacgcaggtggggctaagggggccacagtactgtgggtgatattgtcaagctgttgctgcaggaatcttgnnnnnnnnnntgtctgccccaagagccaatccttcagcagttcattggacggctgaggccatccccacaccttnnnnnnnnnncaaggggggcatagtactgtgggtggtattgtcaagctgttgctgcaggaatcttgctgcacaaggctgtgtaccgcccgattgtgaggctgtagggctacttgtgcatgccaagtgaatgcgtgtctgcccaaagagccaatccttcagcagtttattggacggctgaggccatcaccacaccttgcccccatgattcacagggtggtgtggtcagcgtgatccagatgatagcttactggggcttcggcatccctcttccatcagaccttctcgtccctgctttcttccttcccaattcaaggcacggcaagggcctggtgggccattgggatctgcgttcatcttcttgggagcgcatgttgtaaaggttgcagatcaaccgcctctggttcctggctccgtccgtcttgtgcgaggatcccctgtatacgattaccactgagtaatgaattgtgttggctnnnnnnnnnncccatcagaccttctcgttcctgctttcttccttcccaattcaaggcatggcaagggcctggtgggccattgggttctgcgttcatcttcttgggagcgcattttgtaaaggttgcagatcaaccgcctctggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcgaccaggttgagcagcgaggtgattgctgccatagacccatggtccttgtatccctgcatcaaccgcaacctcggnnnnnnnnnngattcatgccaacttgcaagcagatcttattcgacgacccaatgctgtctatctctccgtgtatgcgcaggaaagcagagacggaggcagacgnnnnnnnnnnnnnnnnnnnnnnnnnnnnnnnnnnnnnnnnnnnnnnnnnnnnnnnnnnnnnnnnnnnnnnnnnnnnnnnnnnnnncagcgaccgggttgagcagcgaggtgattgccgccatagacccatggttcttgtatccctgcatcaaccgcaacctcggnnnnnnnnnnaattcatggcaacttgcgagcagatcttattcgacgagctaatgctgcctatctctccgtgtttgcgcaggaaagcagagacggaggcagacatcattggcatccaggttggtgggcttgtaggaaggtgatggcaggctgcgtgcggtcttcaaggacccggcttatttgagtgctgcttccacttggttctggaaaagacaagacttgtctttctgagagagagcacatgccacnnnnnnnnnnccatctttacctcccacctgctttgtggatcccatcttccaccgtgcctcctctgaccctcaccagctggcagcacaggcatgctacgatcccgccgctgcggcatctgtgttccagaaactgggcgctgctgagaagaagatgggagggactgccatgcccaagtttctccgtacccaccccctgtcagacgagcgggtggctcgcatcaaagaggtgtgctctggcgtcttcagcacatggtgttcaggctgcggagttgccttgtttctacatggaacatggtcaagtgctgccaattccggtcaccagtgtctccgccttccatgtcacaggagctgcccaaggccctcggcatgtatgagctggcgggatgcggctccctccgaggccgggcagggggcctcttctcaggccttggcgatggaggctggcgatgacaagggaggagatcgtgccgtgcgagcccatggtgccaggagtcgatgctgcctgggtggatgcacaccctcccaggcaaaggaggctggccccttgtagttggatctccaggcaggtctttgccctgtgcagtgcacaccctccctgcaacccacagtccctttgtcatcattgcaccttggctgactccacaacaatcacagccgtgacacgcgtcgcagactgtgccaggaggcacagtgcagcagagttcaagaattggtgggtttgggaatgcagtgccatgggctgctgagagtgttgggaggcatggtgggggggcgaggtgcatggcctgctcatatcgctgcagcggtggccaggaggccacaccgcgagccgcgtgggctcacccaaaccaccccgccttggccccgctcttcttgcccgactccttggagctgagctccgccagctgctccaccagccgctgctcctcgccgctcagggtcttggggatgctgacctggacgtgcaccaggtggtctcctcgcacgccggccttgcccagcttgggcacgccgcgcttggccatgaccagggtggtccccggctgcgtccccgccggcaccttcaggtccacgtccccgtccaccgtggtcacgctgaccgacgcccccaggatggcgtcggtgtaaggcacgcgcacgtcggagtggatggtctggccctcccgccgcagcgtggggtgctccttgacggtcagcatgacgtacaggtccccgggctcgccacccctggcggtttgtggaggggtcgagaggggatcgaggtgggtgattggggcctggagggtgagctagtgggccaggaagtctgcacacaaaacgcaatcatgttgagagggtggtgtggcgcatgaaaatgggtgccatgcgggaatggacatggtgctgccgagaactgcactatgcagtcaaggtccatcaaggatggccatgacctcattcttgaggtctcaagcaccagcaatcactctgaaaatgacacagcgggcaacttctagcacttgccagtggctatacaatctcatgcttacatctccattcgcaccccaccccccccaaaaaacaaaaagctctctccacccccctcccccccccgcgcacctcttccctgcatctccctcgccccgcacgcgcagccggctgcccgagtcaattcctggcggcacccgcaggctgatcctcttcttggcgcgcacgcggccgtcgccgccgcaggtgccgcagggcgtcgactcctgccccgacccgccgcaggtcgggcagctggccacctgctggaacatgcccagcggcgtgcgcactgcctgcaccacctggccctgcccgccgcaggtcttgcaggtggtgggggtggtgccggccttgaccccggagccagagcaggtgccgcacgactccaggtggctgatgtccagctccttgttgcagccgaagacggcctccatgaagtccagctgcagcccaaacctgggccatcgtgggcggaaggtgggaggggatgaggatgcgggcaaaagatggaattggtggctgagcaggccatggcagcgagatagttgaagggccaaggaaccttgcgccattcaggcacaactcttggacaacaggtaggtaagccggcctgagccagagcaccttccttgcccagtcacagacaggcttgctatacaatgcgactcccttgccgcagattgctcaccctctgtcgtcccctggcaccctcgggtcccgagcctggccccgtccaccgccacccccaaacgcgtcagagaaggggttgccgccgcccatgccgccaaagaacgactcaaagatgtcgaaggggttgctgcaaggaggagaaggggggggcggggggggatgggggatagcgcataaactggcttgtgagaccaacagatggcaatttggagaagccagttgaccaggactgcagcataccaaagcatatggctcaagtatcgttacttgtcctttcttcccccaccccaccccaccacacacgcagcaatgccggcctgattcatgcctgacactgagatacacaagactggctctcacacgaggcatcccttcatcagcagcacttcctgtccagccttcccgtccctcacctctcaaatccggcaccaccaggcctgccgccgcccccctggagaccggcctccccgaatcgatcatacacgctcttcttattgtcgtctgacagcacctcgtaggccgcggagatgtccttgaacttgtcctctgcccctgcctccttgttcacatccgggtgccacttcctcgccagctggcggtatgcgctctttatggtcttcttgtccgcatcgcggctgacgcccaggatgccgtaaaagtcgcgctctgcgtgcacgaccaagctgctgccgcggcgctggctggcgccgcgcttgtatcccaggagccctcttacgtgccgccgggcagagccaagccccgcagctttggtcggttggaatgggtgaggggtgccgcaggttctggttgcagggtggtagggggagggtcggcgcaggagctcattcaatggcagggccggccagtcaggaatcgcagcacaaaagatatggcattgaaggcgcatgtagcaagcgccatgcatgagccatcgcccacactgatttatgccatggcctcgctagacttcgcagcaatcagactgaaaggaaatgcaagaagataaggaccactggaccctcatttgaaccaaccctctcctttcgcaacgacctcaccgatgactggcaggcgacagcaacgagcttctagaccctgctgtctggaaagcggccacgcttcgcggcccacatccatgtacttggtgccccagggagagcatgcctgccatgcaagctagcgaaggaaggggtggggggcctgtggcgtccttagatcgagttgctgggatgccgagtctgggcnnnnnnnnnntatgcctgccatgcaagctagcgaaggaaggagtgaggggcctgtggcgtccttggatcgagttgctgggatgccgagtctgggctatcagagcgctgcgccacaagaaatggccaggaggagcaccaaggttgttgtccttgccttgcccacgagattttacaggttttattcgtgcaatggtggtggacaacgtgcagtggtgagattatttgggggttccctagagaccggattgtggggaatgcatgtgggaagtgggatggaagtaagaaagcacgcctacagaatttcggggtccaggcggccgccccaccccctccccgacaagatgtgggaggcccggagtactcgccctcttccaggcagcaggtgagaccctgctcaggggctgggggagcccaggatacggactcgctgctgccgcgcgcggctcacccccccacttcacgccatccccgcaggcagggcaggactgatttgccgagcctttcaatatggctaccaccaaggaggtcgagaaggtccgggaggccaccaatgtcaagctctttggcaagtggtctttcaatgagctcgaggtgagaacctacggagggtccccagcctgggaggcgtgcagcgagccggggaagacatggaccggcacgctgatgatgcactgtgattgctgggactggtgtgggaatatgctcttcccttgtgactacgacgnnnnnnnnnntcggcctgggaggcgcgcatcgagccggggagacgtggaccggcacgctgatgctgcactgtgattgctgggactggggtaggaatatgctcttcccttgtgactacgacgagcgtgggcggttcctccgtccgtcctggcgctcgggacggaatgtttctgaacagcagcctcccgcgctttccctggccgcaggtcaccgacctgtctctcatcgactacatcgcggtgaaggccaagcatgaccgatacacgccccactctgccggccgcttccagaagcgccgcttccgcaaggcccagtgccccgtggtggagaggtgggtgatgggcatgattgagtcgtcggagctgctgcctcgtgtagcgcccctgtgcaaaccagctggttgcgactttaacaatcttctttctgccggtgtgagacattagtaggtgcaccttcaaaccttgtacacaaccaccctcctcccccacacccaccgataggctgaccaactccctgatgatgcacggccgtaacaacggaaagaagcagatggcggtgcgcatcgtgcagcatgcctttgaaatcgtgcacctgctgaccgaccagaaccccatccaggtgctggtgcaggccatcatcaacggcggcccccgcgaggatgccacccgcatcgggtccgctggtgtggtgcgccgccaggcggtggatgtgtcccccctgcgccgcgtgaaccaggccatctggctgatcaccactggcgcgcgcgagtccgcgttcaggaacatcaagaccatcgccgagtgcctggccgacgagctgatcaatgccgccaaggggtcctccaactcctacgccatcaagaagaaggacgagatcgagcgtgtggccaaggccaaccgctgatcgaccgctccgtctggcggcgtaggggaaagggcgtggagcctgccctgctgtgccctgcgcagggcagttgaggtgggaacccaccctttcccatgccgtggtgttgctgatgtaagggtaacgatgcagcatatgctttacggcgaacgaagtgagagtagagaactcgattgagggagagaatcaatgatcgggggattgaggaaaaggttcgcgccctgggggagtgtgcgacgagcagacgtccacctgcctctgtccaacgccaccaaccacgcgaggacaaggttcgcatggagattgatttaagaatcacagtggagtatttcagcaagaagtttgcatcgcattccagccattttccctttcctcgaagggtcgtgcgatgactactcgggttggggcaaaggtcctggcccaggcatgccgacccttctggcgcagcttggtgcccagctctgctgtgggcagggtggaaggcatgcagaatcccggcgcagaccttgggttgcattctgcggagcacggtgtgtggggtcgtcacgccctgtttcacaccgcgccacagtcgctggcctccctgccggtcaccattccggccctgggggagtccatcagcgatggcaccgtggcatcattgctaaagaaagcgggggataccgtggaggaggacgagcccattgtatccattgagactgacaaggtcacggtggatgtgagggccccccaggcgggtgtcatcctggctgtgctggtaagattgcaaggaagggctgaggagtctttctcggaggtctgggggggttgagattccgagtgcctggaagcagaggttcccccatcnnnnnnnnnngtggcaagaaagggctgaggcgtctttctcggaggtcggggggtttgaaattacgagtgcctggaagcagaggttcccccatccctcgacagtacagcatgagcagccacagggcatcgaccatggcacccatgggagagtcttgctgaaacccacggcaagtgttttgcctactcttttcgtaggtggaggagggcgccactgtagaagtcggccatgtggtggcaacgnnnnnnnnnnatggcaagtgttttgcctactctttatgtaggtggaggagggcgcaactgtagaagtcggccatgtggtggcaacgatcgacactgacaaggctggtacgttgtatggttggctttggggccttgtgcaatagatcccaccatgggcatgccttcaccgctgtgcaaggccactctcaccctcatcagcctgtgcccagcgcaaaaccatttggtgcgtcctcacatgnnnnnnnnnntggggccttatgcaatggatgccaccatgggcatgccttcactgctgtgcaagaccacactcaccctcatgagcctgagccctgcgcaaaaccatttggtgcgtcctcacatgtgcggtacaatactcatgcctccacgcatacatcctgtccacacagctgccggagcgcccgccaaaaaatccaccagccaagaccagcccgagactacgcccaaggcacccgccgagccatctgcgtcgcatgcagccagcgcgggggagtctggctggtcacgtaccccttcgatacacttccctgcgcgacgcactgatgacggcacagtcatcagttcccttcccgcaaacgaggcgcaggcagcacttcaaagtgaggagatggggtggtgtttggacattcgggcctcaattttcgcctggtttggtctgtcacgatattcgggaagggggccccctctcctgggaatggtgtaccagttgcgggcttctccatggccatccaggcaggctcgttgtctgatgagaaaccccagtcacgcagctccaaaccctgaggtatgtgatgctcctcccctcacactccacagaactggagggaggaagcagcagtggcgggacagaaggcagtcatcccccaacagtccttgcgtcagccagccccccacccaagcagggcccgtggctgcaactgaaccgtgaggtcgtgacttctgcggatgatgggcagggtgtccctaggacctccatgtcagagcgggagatggagctcatcatgctgggaggcgctgatccgtgactgcttggtgtcgtgaaccaaaacgagacctgtggccacttgagtggtccagcccgccggggaccggctctcacgggacaggtcgggatcttcctagaccttcatccctgcagcctttgggcgtggtgcatgcccgtacaccatacatcaccagtgcaaccatctcggtgtgctgacaattgtagtgtnnnnnnnnnncgtggccacttgagtgggccagcccgcggggggaccagctgtcaggggacaggtcaggatcttcctagaccttcatccctgcagcctttgggtgtggtgcatgcccatacagcatacatccccagtgctaccatctcggtgtgctgacaattgtagtgtcattgcaggcaataccttgttgcccttctgtcgagggcgcaggtgtccagcaggagagatggagcgaggggattggggaccagagcctttttgtcgctgcatggctacagtttcaccagcaacctgccccggcttgccagcttgacagggtacacctccaggtcgatcggatcctgcttgtctttgagactgccaatggctttccgaaacaggttgttcttcgggcaccaactcagcacctgagcagtgccatgacgatggtgaggggtgggtggggtgggataggagggtgtgggaatttgggcaccagacgtccctctgtggcacgattgcattgatagcatgggcacaaccccccaatctagaagactgatatatgcatcagcgcaccttgccagaagccaggtcatacacggtaccatccagccgtacctcaacagcaggcttgcctttcacctagaactcagtgaggggtgcacaatgatctccaccgtcaaggagtggcaaagcagtgcagaggaaagagcaggccaatacaagtccannnnnnnnnnaaacgcagagaggggtgcacaatgatccccaccatcaaggagtggcagagcagtacagaggaaagagcaggccaatacaagtccaggttgaagatctggggaaggaacaggacaaggtgccacaagataaacagtcctctttgcatacctggattatgcttgcatctgccagagggtacttgaaggctgtggagttggctgcggaacagaagaaggtctcaccaacctgggtgcggggaagacgaggtaggtgaagcccccaggtatctctgggtgagacttcacccctgcccagcgcaaacacctgcttgcccaaccttccctccacatcgggctaactttgcgtgccttataaaacatgagaactctgccnnnnnnnnnngccctgcccagcgcaaacacctgcttgcccacccttccctccacatcgggctgacttcgcgtgccttataaaacatgagaactctgcctcccggcaaggaagctgccttgatgggcttggagaggaatgcagaccgaacatccaggtcagggacctccatccagtcctgtgtggtcgcctcctgagctgatgaggccgtgtcctcatcgtcattctgacccagattctgctggagtctggacacctgggccggtggacgaccatggacacaacgttgaaggggagtaatcagctgaacggagggctctcgattattgcaagaatgcaaattgcagttcatgcccagacatacctttttgttgcttttctgaggagagggatttcccgctgtctggccaaatccctggcctgcatacactgcctgatgattcggccgtcccgaccgagcgcgagatggggtccctagtcccgttaaacatatgctacctaggcattcgcgaaatgaaaaggggctgagaacgtattgccgcatggatgtgtatgaatgcgccgtgcattgagtactcttgttcggacctgatcggtgcgtcctgccatgaaggttgccggcgcctacaccggcccnnnnnnnnnnaatggatgtgtatgaatgcgccgtgcattcagtatacttgttcggacctgatcggtgcgtcctggcatgaaggttgccggcgcctacaccggccctcaccaagcaagacgaggtaatgagtaccatggacttttgaaatgagtttcacgattcgtacaagtgttctgtgcaacagcatgacctgtgcgcgcatgcttgaggtcatcatgtttcgaaggccatgtacatgtgcacgagaaacggagaattttgtagtgacgtttggccgttaaggatggctctcgagacatggatgcgactccagatgcacattcagcaatcacccaatccacaaataagctataagtagatgtattgatagcctcatgctgtgataggcaaattgaggatggaagatctcgatgacccggcccccggatccggcgggatgtcggaatgcatcggtctgtgccaaacgaaagtctgcggcttgctgggcatcactggagacgtatgggatcgattctcgagatccgagaattggtgggtcatcgggcagcgtatcgatccttgggatgctgtgggagggcacatcaagagggtctccatgtcaatcatattcacaatggcttgcttcaccccacaggtcggccctgcaggcgttcctgtctcaacccagcactcaatccgtcatcctgacactggacggcagggagttgagcgcggtatggtataggatgggtcaaggagaaggagcagggacccctgcaaaattttggaccgcatgttcaactattagaccaattcatgcctctcgttgacagcccaaccatcaccaatttgataccagaccttcaagactccagatcaggnnnnnnnnnncgttttggaccgcatgttcaactatcagaccagttcatgcctcttgttgacagcccacccatcaccaattcgataccagaccttcaagactccagatcagggcaagggttctgcgcgtcacctctgcctactcaaagttcatgcgcagcccctgagcaaagcaaccttctcctcaaatgtgagtgggtgcatcgtcatgttatctgcaccatcagcactggatcaacatgcttcaacccacggacttcatgtggaagacccaacatgccttggtggtcactgccctaaaggccttttgagcagtccagatgtcagcagaccatggccattggcaccgcaggtggttgccatggagttgtcccgcggcatccaggagcagctggccgtcctctcctcccgcgtcttcatccccatgctgcaagcccaagccaggcaggcgctcatgggagcaaagccatgcggcggcacctgcatccccccgtcagctgccaggaccgcagcccaggcgctgcagcagtatgtcctgaaaggtgtgctgggtgatggaacggcctgactcactgcagtgcatccacaggacaggccgagcatgtgcccggcactagaagcacaccttgttaacccccctttgatcgcatgcagtgaatgcggcaaagcccgccctgcagccggggtccttcctcgtcatcccggatctgggcagcgcagagctctacgacggcggcccagacgcccccacccccgcatctcgcgacctgctggcggccctggatcaggcggcgggcgcctggatcggccagctccgagaggccctggctgcaatacctgtggtacccagcgcacagcgctggcccagggcacccgcgttcctggccgcctgggccgcgcgcgcggagtccctgcagggcctccatgatcaggcggccggccccggtatgcagcgggcgctggcgctcctccgcgccaacgccagccctcggctgccggccctggaacggctgctggcggagttgagggaggcctgcccaaaggcagcctccgtggcaaggcacggcgccgcgcttggtccgaggctggcagccctcgccggcgcaggggtgcagcacctcccacaaaccttccgcccggtcatgctcacggccatcctgatgtggcagcactgccccgacctgcgcgccgccccgggcctcatgctgagcctgctgcggcacgtcacaaacgacatcgctgagagcgtgaggcaggggacagaggggacctccatcctggtcctggaaggccccgaagcggtgcgcaggctggagctgtgcctgcacgtcctgggcacctggaagagcatgtacctggaaatggcaggtgaatgagggaggctgggaggagggccaatgttaaggggctgtgtatctggcaagtggctcctgcttggcatcccgtgagggttgtgatggtggagaaacacttcaagtacagacaattgggcagctttgctcaaactctttcacctgccaagcacaaaaacaagctgtgcacagccctttcacctccatatctcaccaccccttgcagctcaacacagtnnnnnnnnnngaacactttaagtacagacaattgggcagctttgctcgaactctttcacctgccaagcacaagaacaagctgtgcacagccctttcacctgcacatctcaccaccccttgcagctcaacacagtcgaacccccacaaagggcgcgagtatgtggcgcttccctcctgccaccatcttctctggcatggacgagctgctggagagggcccatgatgtccttggtctggttaacatggcggcccggtttgcacgcctggaaaccctggagctgggagggagcaaggtgcaggactggtggacttgttaggggttgattgggggcttgtggatgtctgttgcagggccaggggaagagctcggatcccaacacttgatctcgaatctatactcctgcatctaccctgctccagggccgcgaattgacggccagtctgcatgccatccagaccgagttcaagtctgtgctcaccactatgcaagaggtgagtggcagatgctccagccttctttctggcagcctgggatcccactgactgtcctgctcactgcttcagctgactatccacaccagtggccagagcagatgccgccgacgcacctggatgcaggtggacggcgaccccctggaccctgactgccccgggtacggggaggcatggacctcttgcagctgggtcattcaggacctggaacggcgactggcctgtgtgatcagcctggtcagtctcaaggggatgcacgtggacttgctgaggggtctcactgggcaggggagtgggagcattgtttgccagcgtcgctggttgtaaacatgtacccttcaaacgaagctcgacgctggcatccacatgccgccttcttcctgcccaggcgctggatgggtgtggcaccgtggccgcctccttccatgtccttggctgcttcagtgcgtggctgcacagggagccggtggcgcaggagctccagcatcgctacgtggagctggtgggaggccttgggcggtgtatcagctagggatggatatcattggcaggacgccgcaccgccatggtcagcgtgaaacactggcatgggagtcctggtggaacgctggtcaacactcaccgagcccgctccacaaacctggcatgcaggtgtccatgtttgggaaggaagtggaagcggccgccgtggtattccgggagcagcgctcctgcccccttgtgggccctggaatggctcccttctccggtgccgtggcgtggtcgcgtggcatccaggagcggattcgtggcggacaccagggcatggccagcctgcctccggccatcctgaacagcaagggggggcgagaggtccagcgggcgtacggcgagctgcttgcggagctaaaggcatttgaggcggagcagatggagctgtgggaggcggaggtggatgtgacctctgcctcctccctcatgcagcccctgatccggtaggctgtcacagggagggcagactgggtcctggggctactgggcctttctggcaatgttgggcccccctcacgcatctggcagctgcctctgacaggcatgaccaagcccattatagtaaagactgacagcggtgttgtgccgtctctccccccccccccacatgcacaggatgcatcgcaatgagggcctcactcaggtggcagttaactttgatccgaggatctcagaactgctgcaggaggtcgccacctttctgggtcaacctgacctaccccgctccataccagggactgcccttcaggtgtgaggccttggaagtatatgtactgacgatgaactgggtccactggcgcttccccccatcttcccgcgacctgaatgcgcctgccagcatgcgatggtgtaccgcaacccactgccgccatgcgttcctccaatgtccccattaccttctttccacctataccaccaggtgcatgctcaggccagcgtgctgcagctgcatgtaagccagctggagtcggtcgtgaatgcctggaaccacatgcaggacaccatgatccctgaggagcgggcgattgtggatgccctgataatcagggccaggctcagcctcgagcaatgctcccaggtactgctgggaagtgggtgctgtagctggccctcctttgtcttgagtgtctgatgaagagcagcatggacttgccaagtgcggccttaggatttgtcaagcaaatcgtgctgcaccaagtaacaacttgcagacaacatggtcctccaaggaaacaagtgggtgtgtgacagcgtgtgtagaagcggnnnnnnnnnnnnnnnnnnnncaaggtaacatgtggggttgagaccttgtgcgcgcacctttctggttgtgtggacaaggctgctgacttcacttgctcaactgcatatgagaacatcgtccccaaactaactgcatacatccgccacactgatcctggaataggcaacaagtgggcgcatccaggagatctnnnnnnnnnnctgctcaactgcatatgagaacatcgtcccaaaactaaatgcacacctccgccacactgaacctggaacaggcaacaagtgggcgcatccaggagatcttggatggctggttggagcggcccctgttcgagaggaaggacggcaaggtgaataatagagtactggagccagctgcaccaacattctcgcatttaaggaagagaaaaaggatccatgcacaagctgaagcatgctcttcccccccaaccatcccaaccaagtacctcccaggtattctcaaaccttgagttggatgcaagcatgaaggggctgatgaccatgcggctggaaagcactgcattccacagctctgcggtggtcagcatcctctcggaagccgttgattcgctgagcataataaggtgatgtgtgtgcatgtttgcttcagtttgagtgttacgagcgtgcacatagggcggaataggtacaagaagcgacctgtttgacagcaattagacaccttctcccttctcaccccccctcctccacacacacattcctctacaagggagagccagccttggagggactatctcgcgcatgtggcaggacgaatgctggaggggctggctgctgtcgttctggccagcgcccgacgccttttgggggtcatctgcatccatgatgcaggccagcagtgcgagggtgggcctctgctggaagtgactctccagtgccaggcaggccagctgttctggaaacctgacatgcatgctgccaggtcagacgagtggacactcatggcagaggctcggcggtgcaccagagcttctcagggcaggcaatttatgtgtttattatctgttgcactccccaaactcactcgtcctgcttgcaacatagctttacatccctgtattgcagcgagaagtcgatgcaagccctggtggcatcctggctcgagggctttctagaggttggacgggcgatggctcgccccggcctggaggatggtgaggatggtgggagaggctgcacaaggagtggaaacttgtatagacttcagacatataagccgttccacagtaattaatcccgcacgctgccccatcttctcctccgccaacctgcaacagggagggatttccatgccgcactgcaagctcatccagctgtgcagagactgtacgcggatgtcactctggccgccacagccagcgcagaggcatgcactgcctgggaggctgtatggacgccattcgagcacctctggaagcagacccccaagagcgtgctgcaggtaagcatcggcttcaggcaccgcagccatggtctgcaggacagcaggtcgcacaacagggaccggtgtattaccatgatgtagagttgcggtgtgtggatggatgcaatgagtcagacatgcaacattccatcccaatcataacttgcaggagtatttggcagccgatgaagtgctggatcaagcagggttcttgtcacgctttgagatgaaggttcagcaactgcatgccctatctgagcagatccaggtgggctggtctttgagaattcagggatgagcatgcggtttgtgcgggtgaccaagggatgggtggcctcctcttacaaatagctgtctgttggtgttatagaaagcccacacggaaggcttaacactctggaggaagtgaatgggttgaacagggcaccaccctgatgtgtgcctcaccctccaccaatcatgctccttaccctgtcttctccacctcccctcaggccctcccggccacatcgaccctgggctggttgagggtggatgcgcgcttgttcaagcagagcctgctgacttgtgctggcaagctgagccatgcattcaccagtcacttgcagactcaggtgaagttttttgtagaagcgtgatgggggcgcacgtgatactcagttgtctcctggcctagcgccttgcctgccaggaaagtctctgcaaacatgcaagcagccgtcaacccccttctccttcccaccgagtgcagctgggcaggtgcnnnnnnnnnngaattttgtgtagaagcgtgatgggggcgcacgtgttattcagttgtctcctggcctggcgccttgcctgccaggaaagtatctgcaaacatgcaagcagccgtcaccccccttccccttcccaccgagtgcagctgggcaggtgcgtcgccgacgtgagcgccttcatcacatccgctgccaccgtgctgaacgatgccatcgctgcgcctggcgccggctcggcgcagccctcccccgccccgtccccgtccatcaagcccacgtcgcgacgcggcaccgccagccactcgcccagcgcaggcctggctgccagcctgggggcctccagtccacgctccacccgctccagcctcgccggcaacctgctggggcaggccaggccgaagcggcagagcgtcaagttggccgccgggatgggggtcaggggcgaggcgtccctcgactccgccagcctgtgcaccccccgaccaccagtgtccggggagagcaggaaagaacggtacctggccgcactgcactgcggccaagaggtcagggccgggaccaaggaaattgcagctcagctggtgtttgccgacgagtcaggtgggggcctcaagggggacgggggttgcttgattgggtactgttactgctgtgggcatggtggagcacacaggtacttattgaggtccatacatcccttcccccagcggccctgctggcgannnnnnnnnnatgggcatggtggagcacacagatatttattgaggtccatgcatcccttcccccagcggccctgctggcgaggagtggcgcggcgctgagtgcgggtgtgcagaaccaagtggaagcggtggcgcgagagtggaggtcactgcagaagaagctgctgcacatgtgggtcagcggcggggtgatcatcaggcttgagatnnnnnnnnnntgtcagaaggagaccactggcatcctgagccccccgcactgccctttgcaggaaggaggcactcgcacacttcataagtgcagagacgcaggaactgcacagggctgtcattgcctaccgtgctgatgtggaggcacacaggatgcgattcaccgcgacagctccttatgccgtcacagcagagctcacactcgcctgtgtgagtgacaagaggcaaggggcttcgggtaggagcagtgcaagtatctcactgccatcatgaggtttggtgtgcacatcaagcaatgtgcacaaggcatccccggctgtacttgctcgcaggtttcgccggcgctggaggttctgcaggggctcgagcatgatggtggacctgaggtacggcctgtgagtggatgggtggtcctcgtctgtcagatcatcatgccatgtgcacatgcgccctacaagcccacctcccacccgattccagggtctcatgggtgtcggccactccctcaaagcccggcatgacctgttggaccttccatacgaacctttggcctccttgtcagcttgcaaggtgggtggtgggtgccatgcaagcaggagactgcaaggggctgaagtctcctgttcattcgttctgtgggatgccagacacaaagaagcagtgctccatcaagccctcgccctcatcctacagagtgaggcaaccgctttgagaggcatgtgggacatgattgcccgtttcctgagctcccacgaggagtggagggcccagtcttggactggannnnnnnnnnatgctccatcaagcccttgccctcatccttcagagtgaggcaacggctttgagaggcatgtgggacatgatcgcccgtttcctgagctcccatgaggagtggagggcccagtcttggactggagtggacgctgagagtctggtgtgtgagagttctggttgagttggtggccttacaacgcgcgatggtgtgtcatgaggaatcctgttcaacatccagcggctcccggactgcatcccagaccctgcatnnnnnnnnnncctggttgagttggtggcctcaaaacgcgtgatggtgtgtcatgaggaatcttgttcaacatccagaggctcccggactgcatcccagaccctgcatccaatgaactgcagagtgagatgtgcaaggcccagagcaaagaactgaagagcctcagcaagacggtatgctgtttggagccctcatctgtctgcacccgtcctgcctggaccctgctgatggctgtgacaaaggcgttgcaggacctcgcccgaccaccccgttgcccccaaactcctgccgagtgtataggtcagggcataccctgcctgtctgcagctggaggagatcttgaaaacgctgctgagcatgctgcccctcctgcaaaacctgcacaaccctgccatgcggcccaagcactggctccaactcaccaaggcaagggcgtgagtcgctggacatttgggatcaggagccgtcagctgccaaggacccctgacctacatgtgctttattctcattgcaggaaggctggtgtccaattgcgtgtcagtcctcaaaattgggtttgagcttgttcatacagaatgcgttccatcccacatgcaggccattggtgctcgctttgagctacagaccggcaccctgctgggtgaagtgctagatctgaaactccaccgacatgctgcgaagtgcgaggaggtcctggagcaagtgcagagggaggtggtggtcgaaacggtgagtgggagctggatgtgctgggagagtttacacatgtgctgcagtcggggcctgtgggcactggtcgtgcatacaaaccgtgcagcaaaaaatgcagtacacctgacacccctcttcacactgaactcccacaggcactcgccaaggtggcctccaattgggccgagcagcgcgccacatttgttgacaagccgggacagggggttgccctgctgaccgttgcagatgcggtggttgagctgcttgagannnnnnnnnntcaggcactcgccaaggtggcctccaactgggctgagcagcgcgccacatttgtcgacaagccgggacaaggggttgccctgctgaccattgcagatgcggtggttgagctgcttgagaacgacaccctcacgctgcagggtcttgcgtccagcaagtttgttctggtgaggggctgaggggttcaatgtggaggagtctggagagctgagcttggggggtcagggtggcaggggggcatgaacatacagccttggcccacacttccctcccaagactgttacaagtccatgcacgcacggcgcagggtgatgtcacattccagggcgctgtgcaagcgtggcagcagcgcctcatgaccacagatgcggtgctctcctcctggacggatgtgcagcgcctctggcaggtgcatgcatggggtgctccatgctgtggcgtatgttgtgtaggtagagtgcccttgagttgcagacgagcaagttttgagcaggctctgtccctgtgaatgacaaccagcaatttcagccaagcctgccatccctcccacattccatccccagtcgctggagaatatattcagagggagtgaggacatcagatcccgcatgcctcaggacactgcacgattcctggctgtccatgaatcctttgcagtgagtttctggaggtagagttgggggtgggatctggcatactttgatattcactgatcatgccgagggctgttgcttgttctgggggtgtgcactgaatatgtcgtgctctggtccttgatcattttctggggtcttcaacacctttgagcatgcgcggacaggggctcatggcagcggcaacccagaacgatcttgttctggagctgtgctgcgttccagggaggcaggaggctctggatgaaatgctggtgcagctagaactgtgcagcaaagcgctgcaggcgggtcttggggtgttatacatgaaacgatccagtcctagctgtgcactgcctggtagactgtgtgcttgggtcaaggctttggctctgcatctgccgcaggaaatgtcatcctgcagcaacactctcaaggacctttgttccctcccccgctcattcaaacactgcttcaggattatctggaaaccaaacgtctggcgttcccccggttctactttgttgccccggccgatctcctggacattctggccaatgcctctcagccgcaagccatcgtcaggttgagttctggacatgcctctcccagatctgtctgactggtttttatttgacctctaggcccttcattagagatgccagcagctcaactcttgcatgctgccgcaggcaccttcccaagatattcgacaacattcatgggctggagtttgcgagggatgccgctggggttccctctagccttgcaacggccatggtgtccggagaaggggagattgtcaccttctccaagccgtgtgcctgttctgggccggttgaggtgagcatacttggagagggggccgaatgacctccagtgcagtgtcatcggcatcctactgcgctttgcatccaagtctagacatggcccggctgcaggtctggctnnnnnnnnnntcatgcctttcccagatctgtctgactggttttgatttgacctctaggcccttcataagagacgcgagcaactcgactcttgcatgctgccgcaggcaccttcccnnnnnnnnnnagcatcctactgtgctttgcatcaactctagacatggcccggctgcaggtctggctgcagcgcctggtcgatagcatgaagcaagcaatgagctccgagtacaaactcggcatacagagtgcgtagtgcatagtttgtggtgagggtcagctgttaccatctcatgtcctgctcactcgtggaaagtgtggctgcgtcggatccctgccaggcatttcaccgcgagtcgcatcccttccgatgctggcttcatccgcagtccctttgccctcctgctgacagcctatgacgagcttgcaagggacagatggatctttgagcactcggcacagaccaccatcacagtctctcggacgtactatacacacgaggtcggtcgagatcattgcagatcatgcctgggatgcgcaagagcttagtggcttctcgcatgggaaacggtgccttacgtacggtcacacggttacgacgcctgctcttaccccatgtgccatgcaggtnnnnnnnnnnggtggcttctcgcatgggaaacggtgcctcacgtacgatcacacgattacgatgcctgctcttaccccatgtgccatgcaggtggacgcagcatttgatgctcgcgaggatggcaatgagaatgccctcaaggtgaggaaggagataccagtggcatgccctgagctcatgcaggactcaccgctcagccagggctcgtgcccgtaggcaaatggggatcttgcaggacatgatgtgctcatcctggtggacatgtgggctcctcatgagccccagcacagacatttcacgcaattcgccattggaccccccccgcaggaactccatgccaagctgcaggcacaggtgtcggagctcatcgccaggatcaatggcaagctgacccccagcgagcgccagaagctgatcaccctctgcacggtggatgtccatgcaagggatgttgtgcagcgtttgatcgaggagaaggtcgactctgtgaatgccttccagtggcagagccagctgcgatactaccagtctccccagtccaaggagtgcatggtgggtcccggcgcagtgactgtgtatggagtgaccttgggtgtgcagcaggacatgccacggaaaggccagctggagggtatatgtttatacacatatgtacatgtatatatggtctgtatgcccatgtccctggcacgctctgctgatcnnnnnnnnnnaggatggagcgaccttgggcatgcagcaggacaagccacggaaaggccagctggagggtttatgtctatacacacatgtacatgtatatatggtctgtgtgcccatgtccctggcacgctctgctgatccagtcgcatctcaccccaggtctccatctgtgatgctgacatcgagtacggctatgaatacattggcaactgtgggtgcctgtgcatcaccccattgaccgaccgctgctacatcaccctgacccaggcccagcggctgcacctaggtaagcatgcagctggaggcctggggcagctgcctggcagccatgacctaggaacccaccatggcccgcaccactcccgtcccgcaggcggagccccggcgggaccagcagggacggggaagacggagaccaccaaggatctggcccgtgcgcttggggtgcagtgctatgtgttcaactgctcagatcagatggattacctggccatggggcagatctacaagggcctggcgcaaacaggtatggcttctgcgaggagctctgcctcgctcttgggcagatttgggatggtcacggatggcagccactcctccgcttgcacagtctgnnnnnnnnnnttacaagggcctggcgcaaacaggtgtggcttctgtggggagctctgcctcgctcttgggcaggtttaggatggtcacggttggcagccactcctccgcttgcacagtctgcaagagcatccagctcaaggggggtggtatcacccactatttttggaagcttaggactcctgcgctgcgatgtgtcgcaatgctcaacactctccttttctcaaacannnnnnnnnngggggggtggtatcacccactaactttggaagcttgggactcctgcgttgcgatgtgtcacaatgctcaacactctccttttctcaaacaggcgcctggggctgctttgacgagttcaatcggattccagtctctgtcctgtcagtctgctctacccagtacaaggtgaggagaagaagggagtgggcatgctgggagccaatcagcactatgcagcctgctcatgtctgttccaggttgtcttgaggaccagatggtggcagctgctctccacacacaccaaatgcttcaccacaccgcagactcttctggatgccttgagggcgaagaaagacagattcgtttttgagggcacagagatcccccttcgccactctgccatggccttcatcacaatgaacccaggatacataggccgtgctgagcttcccgaatccttgaaagtgcgcccagccagcattggagaatggggtcaatgacttgctcgcttgccccgctcaagccggctctctcgcgttccacccaccttcctatcacaatgcccatgcaggccctcttccgccccgtctccatggcggcgccagatctgaccctcatctgcgagataatgttgatggctgaggggttccaggaggccaagaccctggctcggaagttcatcacgctgtacaagtaatatgggcaggggtttgtctttatgactgcaccgggcatgagctgggaacatcagtctaaggtttgctggccaggtgggcacagacgttgatgaactgcactctccctgtgctgtgcagactgtnnnnnnnnnngtgaggaaaaggtgtggcgaaggtttttggggaatggggtgtggaagggtgtgggatgnnnnnnnnnnatgaggaaaaggtgtggtgaaggattttggggggggaatggggtgtggaagggtgtgggatgnnnnnnnnnncaaggtttgctggccaggttagcacagacgtcgatgtactgcactctccctgtgctgtgcagactgtgcgaggacctcctcagcaagtccaagcattacgactggaagctgcgtgccatcaagacgaccctgtatgtcgctgggggcatgaagcgggctgcaccagagctgannnnnnnnnnnnnnnnnnnnnnnnnnnnnnnnnnnnnnnnnnnnnnnnnnnnnnnnnnnnnnacctacactccgttcactcgcagttccgttgcttatggtgggccgtgaccttagagcctggtcagggaatactctaatctggcgtgtctgtgccaaccccctttggtgtgacaggtcctgctgcgggctctacgnnnnnnnnnncaatctggcatgtctgtgccacccccccttcggtgtgacaggtcctgctgcgggctctacgggacttcaacctcggcaaactcacggctgatgatgtggtcgtgttcaacggactgctgggggacctcttcccatccctgccatccacagttccacgaagcgtggaccaggaatttgagagcatggtgaggggggtgaagggaaagggtgtggtctgacacagggctggggaaggggttgaggatactccgccccaactccatagtgaccatcccctgatgccgacagtacacaagacggcgccaaccaggtgcaacagggcacttcacactcctgctctgttgacatactccttcctcatatcatgtaggtcaaggtgtgcgctcgtgagctgggctaccaaccagagcccaacttctgcctgaaagtctcgcaactcaaggagatattctctgtgagtactggcctgcaagtttccgctgcatgtcttgagtgggatgggaatgtccattgattcgtcattatggccccacctgacaaccctcctccctacacatgtaatcatcccaacaggttcgctggagtgtgttcttgctgggtaacgctggctgtgggaaaagtgctgtctggaggacacttgcgcggacgctcaatgcaatgggccagaaaaccgtgagtcttctgctcggctgacattgcagggtctttcaattgtcatgttctgcagtctcacctccacaggcgccttgattgtgctcgccccatggaccacgcccaccgtggacaagtctgccccatgccataggtgtggaagcctatcaaccccaaatctgtgacacggaacgaactgtatggcttcatccatccccagacgcgcgaatggaaggagggcttggtgagttgctggggatatgtgttgcatgctcagagctgacccattcatcgccggctcgatgtcagagatgaggccaaccagcggttgtgtagaatagcgttgctcagacctttgacatgccccggtgcaatttcccacagatatcaagcacctttcgagaaatggccagcaacaagacgtgccggcaccaatggattgtgctggacggcgacattgatgcggagtggatagaaagcatgaacactgtcatggcaagtctggtggggggtgtagctcccgaagcattgaagggctggatcatcccaagatgtaggacgcgctgtcaccactgtctcctggccactctccaagcaaccctctgcatggatttgtcacagagcatgatgcatgtccaccatcttcacaactcttgcaggatgataacaagatgctgtcgctggcctccaatgagcgcattccattgacagacaccatgcggctcttgctggagattaaccacatgaactactgctcccctgctaccgtctcccgtggcggggtcatctacatgaatggtatgtagcaccaggtgctggacggagggaatgcaacttctggccatgctcccaaccatctcaattcctggctcaatacacatcccgttctgtagacactgatgttgggtggagtcctctgcttgtctcctggctggacagtacacagcaccaggcgctcaagccgcaactggttcctctcatcaggcgagccaggggaatgggatgagagcatgttgaggattctcgtgctcctgtctgtctgcatgaagccgtccagccggcagcaacgtattatccgcacgagctcactcggtttcgtctaacctccctacctcagcaagtatgtggagaagacgattgagttctgtgccaagaatcttcgttatgtcactcccatgtctcctgcaaaccaggttcaaactctctgcaaggtgagagtgtctggaactccagagtgcacttgagacctatcttgacccaagaactcttgccatgcacatagcgtctgcatgatggcacacttgcctcccaacagctgctggatgccagtctaccctccagcgaggaagacccgagtcgcttcagggtggaggctcactttgtgatggcctgcatctgggcgttcgggggagccctctcctgtgatggggtgaggcagcgtggacaggggtgtgcttagccggacagacaccgtgcacttgggtgacttgggaggtttggtacaatgtgcatcgtgcagaccccatggcaggaccaaccagcacccctgaacaaacattgagcttcgctcctgtcaagactctcacaaataccattcaaagtgctggctcatgcccccatcccctctcaggctgtcgacagccaggctgcattctccaagtggtggcgcggggagttcaagagcgtcgccctgcccgccgaggtgtgtctcatgacaggaggagccctcctgacccccctcatgatgcctctggagtccaaacctctcccacgattggcccctctggcctcctgacaccatggcggaatcgcacattaactgccttggtccctcacacctgcccagggcactgtcttcgactactatatggacaatgtcagcgggcaaatggtgccctggacgcagcgcatccctgccagcatgccaggcccccctctgaccgcgagggacgcaattcaggtcgtgcagacccccgagtttgtggaaacggtggatactgtgcggctgcgctggttgactgagaccctggtgaaggccgggcatgccgtcctgctcgttggtcctgcaggtggggaacgatgctggggctaggactgcccagacatgtttgcatggcagtggtgatgtcttggaggtttgcccatgagcagcagcgagtaggacgagcctcgggaaagcatttctcgcctgaccaaggggcagcaatcagccatcttccctcgctaagttgttctacttttgaccccaggatgatcttagggcacatttccaagcgcgccctcctccatcacctcgtcctcctctcacccctcctcaactttcaggcacggggaaatcagcggtgatggcacgtgcgctggagagtatggacggccagggtgttatggtgaaccgactgccgctcaactcctgtcacgacggcccatccctgcaaaccatcctggagcggcctctggagaagaaggcgggtatgcgctatgggcctcgagggtcaaagcgactcatctactggctggacaatgtcaacatgccgattgttgacaagtatgaaacccagtcggccctggagctcatccgtcaaagcatagactacggtggctggtaagttgctgatggggggctctctgtgccatgctgcagaatcatgaatgagcagcagtgtgcttgccaggagtggtccatgtcagagagcacatggagcctgtaaggcttgccccctcatccctctattgcacgtgcaactgttccaagaggttcagcacatacctgctcgtccctggccttgccaggtatgacaaagcacgaatcgcagccaaggagatcatgcacaccggttatgtggcgtgcatggacccggcagccggctcaggcagcatcacgccccggctacagcgtcactttgcaacctttgctgtgacctgccctgcgccagccagtgcacagtgagcggggtgttggatgagcatgtgtgggctcgcaagggggcgagggcgccgtttttctgtagcccggctgcccaaatatggtgtgcagcacagaaaatgcaccatcaaagtgcatcatgtgtgaggaaaactgaagtgcattgtagtgaaacatcccaccacacccttgcagatctattttcatccagctgaccaaaccacatttctctggagggttcaagaagcctgtgcttgaggcagtgtcgggtcccctggcaactgccatggtggatctgcatgctgctgttcagtcctccctgctccccaagtgggtgcttgggaggcttaagtgaggtttcttggcatggggttgtctacattgaaggcgtttgtcagtgctactactgctcttgaggtgtacgcctccaacttcccgaggctgcacgttgtaaagcccgaccccatcgcccctgttgcagctctgtcaaattccactacaacttcaacctgagggagctggtgggagttgctcgcggaatgcgattggccagtccaaacctccagaccaacgtccttgaggtgatctgacagcaagaggatagtctgtgcgctttgtctggcatggaacggggaggcaaacaggctattgtgcagcaagaacacagtcattggttgtcagtatccctgctctgattttgtcttgcagttgctgcaactctggcgacacgaatgcgaacgagtgtacgcggacaggctggtgagcatgggagggcaagcatctgctgacctggggtggcgtcctgctggcatgttctccattataaaaaagcattgggacggtnnnnnnnnnnnnnnnnnnnnnnnnnnnnnnnnnnnnnnnnnnnnnnnnnnnnnnnnnnnnnnnnnntgacagatcacgagcggggatgagatgatgttcaaagacctgtgtcagaaggtcctccgccgtcacttcctgccctttgcagaggtgaggcgtaagtcctatctttttgttccgaggcgcaacagtgccccgattgcagctgcggagggtgcaaggacagggcatttccccgcccagatccgtctctgctcgatgtcagtgcccatctcgtcgccacaggtcccaccagtgccggtgtactgcctctctgcgccagagagcgggtcggcggttgaagaggggatggcatactctccctgccccgacatgaccaggctttgtgccacgatggagcgtggcctagcagaatataacgaagcacacccagccatgaacctggtaggatgggcccagggacaaacttgtgctgaagggggccttggaagtgctgagaacaccacaaatgtgccacagtgcaatccctggagcagcggaggggaggtatcgtgggcaatgcttccgactggcaagccagttcaccggcactcctcccccatgcttggtcccaaccacaggtaatgtttgaggatgcagtccagcatatagctcgcatttgcagagccctgcaccggcctgggggccacatcatgctagtcggggtgggtggatcaggtgcgaggggagtgcgcagaaggccgctggctggtgttgcttagccctgcgatctgcatggattccctgaagacgcgcatgcaacatcggttgcactctcctgcaggggtttaacatcaccactcacaccatccctctgtgccgctcctggcaccctgcagggaagcaaagcttggctcgtctggctgcccacatgcaaggtctggaggcgatgcagctgtccctcacctcctcctacggtgacccagagttcaaaatggtgagaatggaagcaagggctgagataacgactctccaggttgcagacattggagtcaagtctgttgcaggctcaaaagtctcactccctcacccccctccgcgaaaggacattttggctatgtgtcgaaaggcgggtgtcaagaacaagggagtggcattcctcctgaacgatgggcacgtgacaaaggaggacttcctggcgcacatatctgatctcatgacgtctgggagccctgcttcactctgcagccaagaagacaaggagggattttgcgatggggtgaggaggttgggaggctgctgagattcaggacttcaattgccggggctccagatcccttcccaagagtgtctgggggaaaactttctagggttagggatcacggatggtatatccatacaccccctgcctgcaggtgcgggctgaggtcaaggcatcaggactgctcgacacagccgataactgctgggacttcttcaccaagcgggtggggctgtgttgagtgcatgatcctgctgcagaggggcaacagaacacttggatgactgtcatgtagccannnnnnnnnnagcgggtggggctgtgttgagcgcatgatcctgccgcagaggggcatcagaacacttggatgactgtcatgtagccatacagggtggtgcctcgtcatggtggctgactgatgtgcagcgccatcatctggcccccatgctgcacccacttccatttccttggcaggttcaagacaacctgcatcttgtgctctgtttcagcccagtcaatccacagttccggggctgggcacagcgcttcccagccttgatttccatccccattctcaactggttcaggccttggccagaatcagcattgctcacaggtggggactgggaaagataaggatagcgccttaagtgcttgaccctctggcgtgcgaatatgctgcacacattctcctcccactcagcagatcatgtgaatgactgccgggagattaaacctcatgaccctacaccctgcagttgctgagcactcacnnnnnnnnnntcactcaacagatcatgcgaatgactgccgggatagtaaacctcatggccctacaccctgcagttgctgagcactcactgaacgatgtgcctgcgctggaagcagaggcattgcgacactcggttgcgcagtgcatggcagctgcacacgctgccgtcatcgcctgcaacgacaggtaggctgggccggtgtgtggctggtgtgtgcagacattccactgacctgatgacaagttccagagctgcaggactgccagctcagaatgccgatgcaaacatcctcctcaaccccctcgagctttggcagatacctgtcacagtatggcaagcacaaccacaccacctccaagtccttcctcgagtttgtgaagctgttcaagtcactgctggcaaagaaacatgctgagctgcaggcatccaagacaagacttcagaatggtgtgactttgtgggctgttgcagctttgactgggtggagagccaccccaggcttctggccggatgtagattccaaacctttcaatcatccatgccccacccccatggtcaggtttgaacaagatccggcaggctgcagaggccgtgctggtgctgcagggagaactggccaaggagacggttgtagtggaggagaagaaggcggcgacccaggagctcatcgagtccatcaggcgggagagggaggtggtggacgaggcggtgggcgcgtcgcaggcagatgaggaggaggcagcggccctgcagcgggaggtcaccgccttccagacagagtgtgctgccgatctggccaccgctgagcccatcatcaaggtgccaggagtgtctcaatcaggaattatagggtgtctagagcactgaagagagttcttgcctctcacgatgcctccttctatatctcagccggctcttttcagcacagtgcttgctcacagtgtttccctgagcatcgcaggaggcggaggcagccctcaactccctggacaaggcatccctgggcgagctcaaatcctttggcagccctgccaaggaggtggtggatgtcctggccgctgtcatgatcctggcctcgagcggaggaaacattcccaaggtatgcttggcgcaggcaggcactccacggagctcagggcagggcggtggtggggacccttgcgcttcacatgctttgctgaagtaggcaacctattctgagggtctccaatgcagcatcaggcatgggcgggacgggaccaatccaccatcatctcttcatttcattttggaaaagcnnnnnnnnnnggtgtctcaatcaggaattatagggtgtctacagcactgaagagatttcttgcccttcacgatggctccctctatatctcagccggctcttttcagcacannnnnnnnnntgcgattgactgcctattcatgtaaaactcacccccccacccctcctttccccccgcgccctccccgcatcttaggacctgagctgggctgcggggaagaagtttatgggcaacgtggatgccttcctgcgcgccctcctcaccttcaataaggatggtctgcacgtgcccaatgtggaacgcgtggagaaggaatacctgtcgcagccgggtttcaggcctgagtccatcaagtccaaatccagtgccgccgctgggctgtgcgcctgggtgctcaacatctgcaagtacttcagggtctaccaagtggttgcccccaagcgggcagccctggctgaggccaaccagaggctggctgtggcaagccaaaagctgaccgccatccgcgcggtcgtggcggacctgaacgccaaggtggcggcgctggagagcaacctcctgcgcgccacagaggagaagaacactgccatcgcacaggtgggcgggctttggatcttttggggggatgtttagcgctgaggagaacaagtgtctactgatcatgtgcaatatgcccatgggtcgtttgtggcaacgtgcccagctcacccctggcccattgtccccttgtgcattatccattgcaggccgatcggnnnnnnnnnngcatgcccagctcacccctggcccattgtccacttgtgcattatccattgcaggccgagcggacggcgagcaaggaagacatctcaaggcggctgattgcgggactggcaggcgagaatgagcgttgggcagccaccgtggccgagatggaggatgaagagggtgaggcggagggtgctgggcaaatgtgtgagtgctttgctcttgtgggacagggtgcctggtagagccccctgccagcttttacagcgtgaccaggcaatttgtatgtgatgcaactcggcaattaagaccaccagtatttgttgcatgccaaagttcatcgcccctgttgcgcgagtttgtccacctgccagtgatgcccccctcccacaggaactctgctgggccgagtgctgctcaccagcgcctttatcacatatgcgggagccttcaatgctcagctgcgtggatcactggtggagggcacctggagaccccacattctggcggctggtattcctctggagccagagttcagtcccttggacctcctcatcaccagcgttctgagggtactgcatggggagaggaagtgttggagggaagtgaatgtattgcccctgcccagtcctccttcactttcttgcaagggcagccttttgcggagtggaaggatccagtggacatgatcttccctctgcatgtcctgtgtcatcaggcaatgtgatatctccatacctctcttccttgccacgatttgcatgcagacatcctggtcccagaacgggctgccaagtgatgctctgtccgtggagaacgcagccatcctcaccaatgcatctcagtggccgctgctgattgaccctcacaagcaggtgtgactaggtaggggcccctggacgcaggggggctgcattgggctgatccaggggcctttccaaatgcttggagcgcccttccttgtccggcctgttgtctatcaacaatgcagatagggcggcccatcctcctcaaccggctgcatgcacaacccgcctttctaacacatctgcagggtctcaagtggctcttggctcaggaagagtccacgggaattagggtgctgcagcaggatagtgagaacttcatggcaacggtgagctgacacacggaggatcgggatggcttctgtgcaccattgcccagcttggctatgtcagatattgatcaaggcagttactattgccttggaccacccaccccacctttccctgctgccccatttccccaggtgcggcagtgcatacaggaagggatccctcttgtcattgaaaatttgccagagaagcttgatccggcgctggacccggtcttgcagaagacggtaggacgtgtcaatttccgatctggactgtgtaccacctccacttccagattatagcattgacacatccattcccacatccaatgtgtttccctaaatcccctgtcccgggaacacagatcgtcaannnnnnnnnnagacgtgtcaacttccaatctggcctgtgtaccacctccacttccactttatagcatttacacctccattcccacatccaatgtgtttcgctatatcccctgtcccgggaacacagatcgtcaagaagggtggctcacatgtttgggttcttggagacatggaggtcgactacaaccccgccttcaggctctacctccagaccgagatctccagcccacactttgggccagaggtgagatgcggggttggggctagaggtcctcctgcttgatagggactcatgtcaccgcttgatggctttgcctggggcgccagagtcgtgcaagtgcaaaatgggcatggacctgtcatgtgctacatcatctcactcaccctccttcctcactgacgctaccagatcgcggcgcagtgtaccatagtgaacttctccgtcactccagagggtctcgaggagcagctcttgaccacggtaaggaagggttcctctcaatgcaagttggtctgacatcaccaagcaactccatggtcaagtttgttccctnnnnnnnnnntggtaaggaagggttcctgtcaatgcaagttgggtctgacatcgtcaagcaactccatggtcaagtttgttccctgctcctggcctcctgagcctctgcacaatagcctccttgtcaaggatggcctcctaaacacactcaccactttcaggttgcggggcacgagcgcccagatctgcaggccagcgcagcagagatcgtgcggtccctgggcgcactctctgcccagctccagagtctggaggacgacctgctggcgaggtgagggcctgtcaggggcgnnnnnnnnnnttccctgggcgccctctctgcccagctccagagtctggaagacgacttgctggcgaggtgagggcctgtcaggggcgcaggcagggtgcttgccggaatgcccggacctgtgttcccgggggtgtgggcaatgagctcaggcttggtcatccctgcaggctggaggcagcggatgggaacattctagaggacatgggcctcgtggagggcctggaggccacaaaggcgacggccgcaaacgtggaggacagggttgcggaagcgagggtgaggagcagcgcgctagagggagctttgtttgataggaagcttctcaattggcaccaggccacacaacgttnnnnnnnnnnagaagcgagggtgaggagcagcgcgctggagggagctttctttgataggaaggttctcaattggcaccaggccacacaacgtttgacttagtactgcaaggatgggactgatactttctctgcagccatgaggaccgaaccctctcgtcaactgcatgcaggagaatgaggccattatcctccagtccttggaaacatacagacccgtggccatccgcgctgcaatcatcttcttcatcatggattcgctgccggccctggaccgcgtctacctcttctccatggccgcctttgtgatggtgagcgtgattggtgtttggatgtggttggaccatggtagatgagcagctcttaatcaagatcacctcgctcaccctggatacgcaacagatactggagcagggaatagctgcagcctcaagatctggcgatgacgacggcatggtgggcaagggtgttgtcttgatgcctgtgcctctgcatccacaaggaagacgattttaaatcctacaaccccccccaattgtctagcctcgctctgccatggcatcgcannnnnnnnnnttgtgcctctgcatcatcaaagaaggcggttttaaatcctacaaccccccaagtgtctagcctcgctctgccatggcatcgcaagccccctcgttccaatctctttgcagtctgtctccagcgctggaggcatgggtagcctggatgcaactgacaccagcgcgcgggtgcagcagctcgtagtggacataacaactgccctcttcaggttggtggaggatgattgagtacaacctgattatattagtgtgggctataggtggtccggcgagtcggtagctgggagcctcgtttgttgcacattttaacacattctgtgcgatcttcctcctgtcccaggtacatgtgccaggcactgtttgagcggcacaagctcgtggcagccacgcagctgtgcatgcgagtgctgctgcggggaggcagcgtctctgctgcagcggcagcctgcctgacgaacggctccgaggtaaagacgagggactactacaggaagcgcacgctgcagcggatgccgtgcatcattgtcatcttgcgtccacgcaagtgactggagggctctgtgcccctcatattcccccccccactttcctcctttccacagggtctggaagccccacctccaaaccccctggcgnnnnnnnnnncgcccctcatattccccccacactttcctcctttccacagggactggaagccccacctccaaaccccctggcggactggatgagcgactccagctggcgagcggtggccaaccttgcgcgagtatcaggctttgaaacgctgctgcacgagcttgtcggcctgccgaagcgatggagggagtgggctgagctggcccgcccagaggaagtcctgctgcccggagagtggaaacgggctggctcgctggagaggctgctggtgctgagggccctccggccagacagactgacgcaggccaccgagctgttcgttgcttccacgcttgggcccaaatttgcagccagccagccatggagcctggacgacgcttacaaggtaagcctgggtgtgtgtcgggttcctcttggcaatgggccatggggtgactggggttcacctttccacaacaagagactgatcagatgggtgttggtgcagtgtgcatctgtgcagagatgatgtggctgtgacacggacgaccatggttgggctagtcaaggtcctgcctcccatggatacttcannnnnnnnnntttggtgcagtgtgcatctgtgtagagacgatgtggctgtgacacggacgaccatgcttgggcaggtcaaggtcctgcctcccatggatacttcatgtcctcaagccgcaagcatggcgcaacagctccctgtgcgcttctcaccagtccttccttcctatggtcatgcacaggattccgggccagccatgcccatcctgatattcttgtctgctggcgtgnnnnnnnnnncatgcccttagactctcacgacaatgttctcactcacccttcctctggcaggaacccgttgccatgcggcagctggagaaggctttccgnnnnnnnnnntagctccctgtgcgcttctcgccagtccttcattcctatggtcttgcacaggattccgagccagccatacccatcctgatattcttgtctgctggcgtggatgttgctggcgctgtggaggcttttgggaggcacatggggtgcacgcttcagaatgggagatattccactgtctcgctcggtcaaggacaggtgaacatcgtggttggaggccaggagcgacaatgctggacctggctgggcaccttccttgggacatacacagcgccatggcaccatgccataggggtagctgcaactttgcactatnnnnnnnnnnnnnnnnnnnnntgagggcgcttgggtcctcctccagaacatacacctcactctggactggaccaggggcgccctctccacctttgtgagccagctgcccaaaagaggagctcatgccaacttcaggtgcggtgtccttccctgcaggcgtgcagcagatgtgttcatgtgcatgcatcgaaggtctgtacccctgcagagtttactatgcctccagtgtatgtttcaggctcttcctgtctgcggagcnnnnnnnnnntatgcccttggactctcacgacaatgttctcactcacccctactctggcaggaacccgctgccatgcggcagctggagaaggctttccgnnnnnnnnnnctgtgcagcagatgtgttcatgtgcatgcatcaaaggtctgtacccctgcagatttcaatatgcctccagtatatgtttcaggctcttcctgtctgcggagccaccgccagcacttgagcagcccctgccagcccctctcttgctggtaagttcatcgtgcgggtggagtctatccaagatcactttgccgtttcaccagcaagcagagcaatctcagtgcagaacacctgactacgtgtcgatccccctctcctcaggcatgctgcaagcttacaactgagcctccagggggcctgaaggcgaacctcattcgtgcgtacaacaacttttcagatgacacttttgaggcatgctccaaacagtctgagctcaggtacactcggtctgcttgcgggggggaggcttcaatgggaggatacttgcaagatccctcacatggcccgtctccccaccccatgtccatgcaggacaatcgtgtttggcttgtnnnnnnnnnntgggggaggcttcaatgggagcatacttgcaagatccctcacagggcccgtctccccaccccacgtccatgcaggacaatcgtgtttggcttgtgctactatcatgctgtcatcattgagcgaaagcgattcggagtgggtaacctccttggagccacttccggcatgggctggaacatgaattacccgtgagtagtggaatggcgttgggccgctgcaaccgttgatgactttgaacatttgaatgcccgaggggtgctgacccagcgttaagtaccgaggtggaaggcggccactccgtgatttctctgccttaaagatggactgcctggccagcatgtccattgtgtggcaaacgggtgcatcctgaactactgctacaggttcagtacaggagaccttgtgtgctgtgcagagcttgctggcaagtatcttgacaactttacaaaggtcggtctgagtcttaagtcaggctgtacgtattaactgcgttttgacgcatctggttgggatgcagccgagtcctccatggcaggctgcaagtcttgagtgcattcctaagtcagtccagacattgctgcaacacccctcctgatcagtgtaccctgtcggctactcgagtcgattcacaggttccctgggaagatctgcaatacctnnnnnnnnnnaaagtcatgctgtacgtattgactgcgtttcaacgcatctggttgggatgcagccgagtcctccatggcagagtgcaagtcttgagtgcattcctaaatcagtcctgacattgctgcaacaccccttctgatcagtgtaccctgtcggctgctcgagtcgatttacaggttccctgggaagatctgcaatacctctttggcgagatcatctatggtggacatattgtggagggctgggataggtgagagggaagggtgtgcatcttccaggaatgcagcagtgccctgagcaaaacatctcatgcagagtgcagcagacacagaaagggaggaagcggcttgcagcactgtcccaaaccatgaaaaatcccctcaaactcatccctacatctttggccgtgcctcccgcaggaggctctctcgtgcctacatnnnnnnnnnnggcggcctgcagcactgtcccaaaccatgaaaaaaatcccctcaaactcatccttacatctttggccgtgtctcccgcaggaggctctctcgtgcctacatcacgtctctgttccaggaggcactgctcgatggcgctgagatcttccctggcatgtcccccccgctgtcctccttgaaccatgcacaggcaagcctgctgcctgtcacaggctgggttggctggtcttggttccctgacggagtgcgcatcgctgggtgccccagggtcacagtttgccatgtgccagccgcatgcacttcccttgcgcaccatctgtgcaggtgctggaatggctgtctgaggccctgcctcccgaagcccccgctgcatacggcttgcacgccaatgccgctttggggtcgagccagctggagacccgggccttcagtgaggcactttgctccctccaggtgatggacaggctggagactggtatgaaggaggtttggactcgggtccgttgtgctgaactcctctgccgctctgcctgagtgaacaggttgaggaggatgacaggggcaaggaggaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggagcaaggggctgccgagacattccatctccacaccactacacagctcctggannnnnnnnnnaaggagcaaggggctgccgggacatcccatctccacaccactacacagttcctggannnnnnnnnngtgaaggagggttggactcgggtccgctgtgctgaactcccctgccgctctgcctgagtgaacaggctgaggaggatgacaggggcaaggaggaggtcgttgcagaggctgaagtcgactctgatttcatggtgaggcagctggtggggcagaccctgctgacagtgaggtgcatgccacatccaaagccgnnnnnnnnnnnnnnnngaaagttgtcggctcactgcctgacaatctggatatggagacgatccgtggccaggtggaagcctctgatccatttgcaatggtggcgctccaggtaccttgtcgcttgggacaggggtgaccctcggattgcctgtgggcaaagggagccccagagggtctgacactcgagtcttgacacatattgctcagagaatgtgcctctcccatgcttggcctatgcatgctgctccaccttgtcctttgccactgcctgctggctgttgccaagtctgaatcttgcaaatagctgatcaccgctcccaactccaccactgtcccaggagagtgagcggctgaatgccnnnnnnnnnnacgaatagctgctccccgcccccaactccaccgctgtcccaggagagtgagcggctgaatgccnnnnnnnnnncgacctggcgatgtcggtaagcgagatcggttgaacgggcagcaagttggggccacagagggacctccagcccnnnnnnnnnnctcctccacattctgcgatcggatctcggggagctggagctcggcctgcgtggggacctggcgatgtcggtgagcgagatcggttgagcgggcaggaagttggggccacagagggacctccagcccttccactaccttttgacataatgcatccacgtcagcttgtacccttgcacacacacttctccaccttcccttcctcactcttcaggcgacgatggagcagatccgctcggcactgaccagcagtcgggtgccaccgtcttggatcgccgcatcctaccccaccatgaggaaccttgcatcctggctggaggacctgagccaggtaggctgtaaagaaggggtgggtgggtgcttccgaggcgaagctttggggccgggcccgccagggcgccagcgtcaccgcctcagacctgagagtgggcatgcaaggggccggcggccctgtgctgcgcagtgagcggaacgagggaccccccatccaaccccctcaccatcttctgcaccgagcacagcgtgcccagcagctgnnnnnnnnnnggggaccccccatccactttcctcaccatctcctgcaccgagcacagcgtgcccagcagctggaggactggacccgcgcaatggagcctccacccgtggtgtggctccctgggctcttcaatcccatggccttcctgaccgccgtcttacagaccaccgctcgtcagcagggctgggcgctggacaggacgctgcttgtgacggaggtgagcatgccatcatgcgctgatgcgcttcaaataccttttccggtgaccattggcagcaggggcatgcctacagccacagggccagcaagacggccagaatggtgcctggtccctctttgcccaggcctgctggagcagagcctggattcccccatgacacgcgctggggtccctnnnnnnnnnngtggtgcatggcccctctttgcccaggcctgctcgagcagagcctcgattcccccatgacacgcgctggggtccctcctcccatccgttcagcacgatttcacgcaggtcacacgtcgtgcgtatgaggctgtctcagagcccgcacgcgagggggcatacatccatgggctgacactggagggggcacactgggacgagaaggcagggtgtctggaggatgctcggcacaaggtcctctcctgccgcatgcccgtgatgcacatcagggtgagactgatgggcatggcatccgtgtttgaggcagcaagggtttcgcgaggtgcatgagaccaccaccttccaacggtcatgccctcgggcaaaactctcagaccgtgcccttgcagaactcttcctcagcctcaggcctccacccccgacaggccctccctgtgggaagctttgagaccagggatgtctacgaatgcccagtctatgccacccagacccgtttcaggcaggaggtgttctccgtgtccctgcgatctaagcagccgtggacaaagtgggccaaggcaggtgtctgcctcatgctcgaagctccccagctctgagttgcattgtcgtgcacacaataaccccttaggaacttggagggtgaggtgtaatgggtgctggaatggcatcctccaggaagatgtggggtcaacacggagtccaccatgcctgtcgttgcaaggtacaattatcttaggccccaagcagccagacttgaaggccccatccctcaagtccacatcactgtcataggctcgactctgatcaccgattggcagtgtgtgtgtgtgtgtgtgtgtgnnnnnnnnnncaggccccaagcagccagacttgaaggtcccatccctcaagtccacttcactgtcataggcttgactctgatcaccaattggcagtgtgtgtgtgtgtgtgtgtgtgtgttgagaagagcacctgatccacagcggcaaaatgcagccagcatcttcagtgatcacaaggaccttctccaaaacccgctggaagttcagtcaatgacctccccagtcttcttcaggaaccgaaccttcttcccgtcatcattcaacctgcgtgtaggcaagagttacgcattaggtactttatagacctgctgtgggtcatgcatgccaagtctactccatgtcaccatctccacgagactcacttgtgcccgatgcgggatgcaaccttctgcgcctccgagtagtgggcgacattagagtggtggatggggtactcctgctgcatgacctgccctgcctcctcttttgactggggcttcacatgcttggtctacaaatggggaattgccagctctctgagtacacagccgggcgcaggaggcggctgcgcgggtaaccttgccatatatatcaaccacaatactacgtaactcccattcctacacagctcccacagtgnnnnnnnnnnacggcggctgcgtgggtaaccttgccatatacatcgaccacaatactacgcaactcccattcctacacagctcccacagtgctaccaacatagaggtgtctgctcaccttgacgttgacgccctcaatgagcaccttcccaatcttggtgtgtaccttcacaatcttgccaaccttgccccggtcatctccagcaataacctgcatgggcaaggttttcggtcagtctcattgcctgtactatgccacctccctgaataccatctggcaatccctcatcgcaataaagacaccccaccctacnnnnnnnnnnagggcaaggtttttggtcaatctcattgcctgtactctgccacctccctgaataccatcttgcgattcctcatcgcaataaagacaccccaccctactgcgtgacacccaccctgaatggtcttgcaccatgcgacctggcccaagaagcggtccaccaggccgtagccaatgtgacatacctggacaacatccccagtcttgacatgcatgggaatccgtagcggtttcccattgtcattcagctcgtagtgctcccactttttaccgggaccctggtggtcaataaaggaagaagacgtcagcagaagcgggtgggtcacacagcccgcnnnnnnnnnncgacacccaccctgaacggtcttgcaccatgcaatctggcccaagtagcggtccaccaggccgtagccaatgtgacnnnnnnnnnntaaacagccctggtaaagccggtgaacaggtgcctttatgtcggtatataagagttccccactcacgatcttcgccgcctnnnnnnnnnngaaacagccctgctaaagccggtgaataggtgcctttatgtcggtatatgagagttccccactcacgatcttcgccgcctcaacgcgtaggggcgcggatggccttggaggggagcacctctaaatggtagcggataaggtggtgtgcgatgagtcgcgacgagcatccccacgcgccgtagcaggtaaaaatgcagctcgccaccacctaccgtatgaattccttgcacggtaagggcagggcactttgtgccgaagaaggccgggcgagcgcacccagccatggcaccctgcatgttggccggtagcgtctctctctacaaggtgtgccagccgatagaagatcacaatggatgcgccacgagcttctgcacggtgccaatggacgaagcactgggcggcttgcgctggttnnnnnnnnnncgccagacgacagaaaatcgcaatgaatgcgccacgagcttctgcacggtgccaacggacgaagcactgggcggcttgcgctggttgatctgtagggaaatcaccgtgtccccctctctcgaccagcgctttctcgcgcccaatcggggtctggcctgtcccttcgacacattgcttgctcagctgcaccgatcaggtgtgggtcagattaaagttctgttgcacagacaaacaggtgtgacatgccatccatcaacccagtctgccctgggccagcaggcgtcgctccccctcggaaattcccgtctccagtttgccgcccagccgcgagaacacgtctggcgcagcgctgcccggcagcgccaccttgggtgcttgcggcggcggagggtagggagcgccgcctgggatgtagaacgggtgcgatggctgtgggtacccaccacgctggccgctgcccggggccctgcccggcggcccgaccttgccgaccttcttgaaaccatccagcatgagctgagctctcgaggccgcagcggggcccttggggggcagcttcatgccgtcctggaagcggagcagggcccgaccgtctgaaacagaccagtcgccaatgtcccagcgtccagagggggcagttaccctcatattgagcggggccagcgcgtcgtttaacgaccggaagacatgcagctgttgaggaggcgatatggacaaggggcatggttgatatgagtctcgtcgacaagccgaccaggaacatggtgccttctggagnnnnnnnnnnagggcatggtggatatgagtcacgtcggcgagccgaccaggaacatggtgccttctggagtggacacgagtcctgctcccgcccgctgcgtctcagtacaagcagttttgctgcgctggccatctctcccaacccatgcaggtgactcacatctgcagcgtcctgggagtccagggtgacttcgccagccggggtgatgaccaccaggtcgacagtgtcataccgaaacaccacattccctgtttcctcgtcgcgaaagcatgtttgcttctgcaaaacatgtgggagggagacaatgtgagtgcaaatttcggtgcgaccgcacgtcttgcacacaatgatggatgtgtcaaagcagtgcatacgacgcaagggcatagccaacaagcttgatcaaccttcaccagttcccccaaccacagagaattccccactcctccccctgccaacagggggcccggtctcctcacttttcggtaggcgtatggatccacagagggtcgagcaggctcctggctgcgattcctcggaccccgaggtctgtggggcccttccaggccctggtgcacgatggcgtgagggaaggcttgagggatcaggaactgcggctgcagctgcgcaaagtggggtatcgccatggctatctgcgatgggcagggggaactgcgcatgtttgcctgaggtccttggacccctgagtagctgctcactcagcaattcatcctcgaccgacctgaggtccgccgctaacttgatgtcggagcctctgatcgttattaccccgtctttggtacggcttgtgggctccacccctcctgtcctttcgctggttgcggggtgctcgtcctcccccgctctcctcgatgagcgagtctagggaacagttgagtccctttggctcctcatccatgatggcttcgctcacggatgtgtgcaaatgtgactaaaaaggatgcgtaaatccgaagggcgccctgtcacacagcgagtacgccggtcttcgagtcgctcgtagcacaggagaagccctcttcaccctgaggcgcgtgctgcgctcatccatggtgtggccatgaagagtatggtatatgatgcgaatgtcgatgctgagcccaagaacgggaatagtgtcagcccgaatcgtttcatgatgagcacaatgagtctgcatgccgcgtttcccggtccgagcctcgcgactgcgcctacacgatgcgggctacggctatgctcagctccacgcaggggtcatgctggctactacaagctgagtttgccgtccagcatccttcgtgcggagcctgaagatacgtcaggtttggataaaacccaaggaagagcctccactagctgcaacgaagccagaacctcaggctgccaaggatccagctgttcagaggggtcaggtggttgccatcatcactggaggcatatcgctcgctattgccgtgagtggatgatcgagggttagatcgctggcctgcgatgagtgtggtcttgaaccgtcacgtccccattgggagaatgaaatgtatgattcgcctgtgcagggcccccatcctctccctgacttccacttctnnnnnnnnnntgtccccattgggagaatgaaatgtatgatccgccagtgcaatgcccccatcctctccctgacttccacttcttctgtgcaggtattctatcttgccctcgtgcaaattttggacgtccggggaggagaaatgctcccacctcctccagaggcactcaacatcgattgtattgactgctccctcttactgcgtcagtgaagcgtgggcttgcgttattaagtaggaatgtgaagaggtagtccaagcgcgtatgtaccttttcttgacaagggccctgcactagatcatccagctcaattgcatcgtgttgtgaaattcgagtggtgctgcatgccctttcgggagactcgtttccataccagtgtatgccatgcgtgccatgtgtaaagcaacannnnnnnnnnggtgaagcgtgggcttgcattataaagtaggaatgtgaagaggtagtcaaagcgcgtatgtaccttatcttgacaagggccctgcagtagatcatccagctcaattgcatcgtgttgtgaaattcgtgtggtgctgcatgccgcatcacctttcgggagactcgttcccataccagtctatgccatgcgtgccatgtgtaaagcaacacaacagacaaggagcacaatattgcagatggaggggggtatcgtacacatttgtgacatctgtagttagttaaattgatgatcggctgatgtagctctgcccatgttcaatgacaaatctgaaagtggtgggttgacgagagacagattctcacattcctccgggctcccagcaccctgcatataacgctgctgccaggtgccgcgaccatcctcggcacatacagtgtctgaaattcaatcggctggatctcattagagtggcgctggacgcttcaagaggatgcaaatcaccagcaagctgaggttgaccctcaggtccgcagccctccctcggagtgttgaggacctgttggatgtggctcgtcgggggctgtccagtgctccttcgctgaaggaggccctggcagagaagattcccgcggagcaggtgtgatgcacatgagatcttggctggggtttcggcgttggggttgttggcgtcggaccgcctgctcgaacactcccccggcccacaacgcttgccgcaaggagcacagtgccagtggtctacggcacattccgcgttgctgnnnnnnnnnnattggcgtcggaccgcctgctcgaacacttccccggcccaaaacgcttgccgcaaggagcacagtgacagtggtctacggcacattccgcgttgctgcgtgatgcccccttgccgtatggctttgggttgccgcacaccggatccttgactcgcccagctgtagcctcgacactggcgcccatgccaaccctggcgcccatgccaaccctggctttcacaccaatcccaggagcgtgtcaaggccctgaagaaggagcatggcagcaagatcctgggtcaagtcaccgtggagcaggccatcggcggcatgcgcggcattccggtgagtgtgaaccgttgtgtattccaggagactggaggggaggcagggcaggtatctcgctatgtatcactcgtcgtgtgggtacagctgtggggctcgtagtgccacaaggtattggtgttctggcgagaccctacagatccgaccaagtcggaccgtggatggaccagagcttgccaagcgcaccgcgtgacacacctgttccggtgtccgcctggcccaccatgtgacttgtgctccctcgcctctccaccccgactgcccattccgtcccctcagggcccccctccccccccgcccctcttccacccacagtgcatgttgtgggagacctccctcctggatgcggacgagggcatccgcttccgcggctacaccatccccgagctgcaggagaagcttcccggcgccgcccccggcggcgagcccctgcccgagggcctgctctggctgctgctcaccggcgaggtgcccaccccggcccaggtgtcctcagtgacagaggagctgcgctcccgctccgccctgcccgaccacgtcaaggcgctgctgggctcgctgccggcgggcacgcaccccatgacgcagctggcgcaggcggtgctgggcctgcagtccggcagcaagtttgcggcggcctacgacgcgggcctgcacaagagccggtactgggagccggtgctggaggacagcctggacctgatcgccaagctgccggagatcgcggccatcatctaccgcaacacgtatgcggggggcgagctgatcgcccccgatccggccctggactgggccgccaacctgagcgccatgatggggttccgggagcacggcgcgctggagctgatgcgcctgtaccagacaatccacacagaccacgagggcggcaacgtgtcggcccacgccacgcacctggtcggctccgcgctctccgacccctacctggccttcgccgcgggcatgacggggctggcgggcccgctgcacggcctggccaaccaggaggtgctgcgctggatccagcacgtgacgcgcgagatcggggagagccccagcaaggagcagctcagggagtttgtctgggccacgctcaagggcggcaaggtggtgcccggcttcggccacgccgtgctgcgccgcaccgacccgcgctacacctgccagcgagtgtttgcgcagaagcacctgcccgactaccccatgttcaagctggtcagcgacctgtacgaggtggtgcccgacatcctcaccgccacgggcaaggtgaagaacccctggcccaacgtggacgcgcactcaggcgtcctgctccagtactacggcatcacccaggagagcttctacaccgtgctctttggcgtgtcgcgcgccatgggggtgctggcgcagggcgtctggtcccgcgcgctgggcctgcccatcgagcggcccaagagcctcaccgtggatgccatgctggaccgcgtcaaggggcagtgaggcaggagctcgaaggtgccgaggccgcggcgggtgccgaggccgggtggccaagtggagtcgatccccagcaggacggcatgcgcgcgcgatggctgtcgcgccagtcgagagaggcgcgagccggaccactccgactcctggggcccaggcgcacgtctcccctgccaccctctccttgtggtggacgcctcaggtgcccctccctcccccc

SEQ ID NO: 48974 - DNA, 76 bp, Chlorella protothecoides
gggctccccggctcctcggccaggtccatgtctggggtgagggttgggagggcaaacctctcgtatgccgggattg

SEQ ID NO: 48975 - DNA, 66 bp, Chlorella protothecoides
ttcccgctctgcaccgagtccacgccgctttgtgaagcctatgaaacccgaccatcacactgcatt

SEQ ID NO: 48976 - DNA, 61 bp, Chlorella protothecoides
ggcaggctcgggcttgcaaagtgagagatcaaagccagcagccctctgggaaggggggtgg

SEQ ID NO: 48977 - DNA, 70 bp, Chlorella protothecoides
atggtgcaaaggggttgggggggtaaagggtccatgcacctgccatgcgccttgcatggatgcccaccga

SEQ ID NO: 48978 - DNA, 68 bp, Chlorella protothecoides
ccatcttggagcgttgccagggtcccgtaataaagtaccgccctctcgccctgctcagcatgcatgat

SEQ ID NO: 48979 - DNA, 61 bp, Chlorella protothecoides
tccaagcgatacgaggatcttttctccaaatccagcgagccgtacatttgggaggggtgat

SEQ ID NO: 48980 - DNA, 61 bp, Chlorella protothecoides
cccatccccgccaccgtcgtccgcataaagaccgcctctgtcctgccgggccgaccagtcg

SEQ ID NO: 48981 - DNA, 61 bp, Chlorella protothecoides
ctgcagccaccactttccagttgccttcctacccccccctccccctcgagcaccttgagta

SEQ ID NO: 48982 - DNA, 164 bp, Chlorella protothecoides
gccgccttggagttgggtatgggcttgagaacatcaaggatgtatcagacacattgcctgctccaagccgagatcagcacgcctagggtggcgccgacgtgaatgggcccacccacacagcccacagcaagcatagtgcacaacgcccctcaccgtttcttggc

SEQ ID NO: 48983 - DNA, 80 bp, Chlorella protothecoides
tcgccgcacgcatctacgcttgactggcggtgtgggcgctggggacccgccgcgaccccgagagcaccgactggatccct

SEQ ID NO: 48984 - DNA, 86 bp, Chlorella protothecoides
ctcctcattgtgttcccaaacctgcagatcggcatcttcccaacataccacaccattgtcttacgtgatgggactggctgcgggcg

SEQ ID NO: 48985 - DNA, 61 bp, Chlorella protothecoides
gcttccggcgagctgtttgccgtcaagcgctcccggcgccgcttcaggtccaagatgcagc

SEQ ID NO: 48986 - DNA, 206 bp, Chlorella protothecoides
gaaggggaagcaggggcggggccccaccaaaagctgtgggacgtcatagagctgggatccgtccaaaataccaaggtcaatcaggagacatgaagtaagagaagtgatccagtgcgacgtgatacgacactgctatgcgattcattctcataccttgctagtatttcacagtattgcaacgcctcttgtaatgcaaaaatataaca

SEQ ID NO: 48987 - DNA, 68 bp, Chlorella protothecoides
cggcgatctgtcgtcgggattttactaatttagatcccgcgcgatctgggactcctggagcgtaactc

SEQ ID NO: 48988 - DNA, 257 bp, Chlorella protothecoides
attgtccagaagacttcgtaggatcccagtagagaagtcaagtcgtgtttcacaggccaagcaagagcatcaggataaattccaggcgcacataaacattcaactattaattcctgtagttcctatgtcatgcaatgtaaatgcgttgctcctccccacctgactcatgaggcaaccacattgcgcacagctctccctcaaagcctgtaatagtgttgcagccccttctgatcttaaggtgatgggcatcgatgcga

SEQ ID NO: 48989 - DNA, 118 bp, Chlorella protothecoides
gctcacactgcacagctcgactcgtggcgtcatgcaaatgggagggactccgcgatttctcgcctctgtgctacgtcgtggcagggtctcatcacagcgtctctgtttggccgagcct

SEQ ID NO: 48990 - DNA, 36783 bp, Chlorella protothecoides
  modified_base (444)..(453): a, c, t, g, unknown or other
  modified_base (1290)..(1299): a, c, t, g, unknown or other
  modified_base (1368)..(1460): a, c, t, g, unknown or other
  modified_base (1633)..(1642): a, c, t, g, unknown or other
  modified_base (2880)..(2889): a, c, t, g, unknown or other
  modified_base (3580)..(3589): a, c, t, g, unknown or other
  modified_base (5053)..(5062): a, c, t, g, unknown or other
  modified_base (6262)..(6271): a, c, t, g, unknown or other
  modified_base (6660)..(6669): a, c, t, g, unknown or other
  modified_base (8949)..(8958): a, c, t, g, unknown or other
  modified_base (9615)..(9624): a, c, t, g, unknown or other
  modified_base (9938)..(9947): a, c, t, g, unknown or other
  modified_base (10778)..(10787): a, c, t, g, unknown or other
  modified_base (11023)..(11032): a, c, t, g, unknown or other
  modified_base (11266)..(11275): a, c, t, g, unknown or other
  modified_base (11346)..(11355): a, c, t, g, unknown or other
  modified_base (11734)..(11743): a, c, t, g, unknown or other
  modified_base (12279)..(12288): a, c, t, g, unknown or other
  modified_base (12904)..(12913): a, c, t, g, unknown or other
  modified_base (13831)..(13840): a, c, t, g, unknown or other
  modified_base (14180)..(14189): a, c, t, g, unknown or other
  modified_base (14536)..(14545): a, c, t, g, unknown or other
  modified_base (16248)..(16257): a, c, t, g, unknown or other
  modified_base (17448)..(17457): a, c, t, g, unknown or other
  modified_base (18421)..(18430): a, c, t, g, unknown or other
  modified_base (19433)..(19442): a, c, t, g, unknown or other
  modified_base (20036)..(20045): a, c, t, g, unknown or other
  modified_base (21262)..(21271): a, c, t, g, unknown or other
  modified_base (21525)..(21534): a, c, t, g, unknown or other
  modified_base (21609)..(21618): a, c, t, g, unknown or other
  modified_base (21725)..(21734): a, c, t, g, unknown or other
  modified_base (22264)..(22273): a, c, t, g, unknown or other
  modified_base (22874)..(22883): a, c, t, g, unknown or other
  modified_base (23256)..(23265): a, c, t, g, unknown or other
  modified_base (24204)..(24213): a, c, t, g, unknown or other
  modified_base (26854)..(26864): a, c, t, g, unknown or other
  modified_base (27082)..(27091): a, c, t, g, unknown or other
  modified_base (27172)..(27181): a, c, t, g, unknown or other
  modified_base (27268)..(27432): a, c, t, g, unknown or other
  modified_base (27782)..(27791): a, c, t, g, unknown or other
  modified_base (28221)..(28230): a, c, t, g, unknown or other
  modified_base (28613)..(28622): a, c, t, g, unknown or other
  modified_base (29792)..(29801): a, c, t, g, unknown or other
  modified_base (30287)..(30296): a, c, t, g, unknown or other
  modified_base (30757)..(30766): a, c, t, g, unknown or other
  modified_base (31145)..(31154): a, c, t, g, unknown or other
  modified_base (31633)..(31642): a, c, t, g, unknown or other
  modified_base (31987)..(31996): a, c, t, g, unknown or other
  modified_base (32585)..(32594): a, c, t, g, unknown or other
  modified_base (32751)..(32760): a, c, t, g, unknown or other
  modified_base (33223)..(33232): a, c, t, g, unknown or other
  modified_base (34093)..(34102): a, c, t, g, unknown or other
  modified_base (34617)..(34626): a, c, t, g, unknown or other
  modified_base (35590)..(35599): a, c, t, g, unknown or other
  modified_base (36295)..(36304): a, c, t, g, unknown or other
  modified_base (36443)..(36452): a, c, t, g, unknown or other
cgcgggcgcggggctgagccccggcacggccggcagccgctccgcagacaggagcagcgccgcgctttccaggccgcgcaggcaggacacgcgcgcggcatcggtggacgccgagcgcgcgccggcggccaggccggcgggcatggcgcgcgccgcctcccagacctgcgcctgcagtgcgggctcggcgtcaaggggggtgagcgccacacgcaccagcgctgcgcggaacagcgggtgggccgactgcgcggcgcggcgcaccacggcggccaccgggtcagccagcaggcccgtcaggcacatcaggcactgcagcaggctgtccagggtgggcagaacctgtgcgggggtggtggggcgagggatgagggagttggaatcaccagggtggtgctggaagcagggtgtggagccgaatgctcaacggctgcggctgggagnnnnnnnnnntgatgagggagttgaaatcagcagggtggtgctggaagcagggtgtgcagccgaatgctcaacggctgcggctgggaggatcgtgcagggtgctggttgctgtcggtcccttcttccactgacaggaggtgcagcacgtgtttgctggccggttgcttcatgtgcatcccagaaagcatgtcgcccagcctgctcgcacacaactccatgcctggagcacgccatcgatgacgtcgggcaggatgcggcgcagtgccgactcaggctgcagcctgagctccaggatctccggcaggagggcgggcatgagctcctgggggtgagcgtgcaccaccagctctcgcagagactggagtgcgctcgcctagggtgggagtgccaggggtggccggaaggggtgggtgtcagatgatcagggagcctcaacaaggaacgatggcctcaccatctcgtggatatgcgacagcctacctttgaagcggcatcggcgcccagccgcgcatcttccagcaactggactgcctggttgtatgcgtgggacatcccaggttagcgggctgcagtcacatcctggttctctccgcgcaatgtaccgatgctggtatggcctgcattttttacccacagaaatccaaatgcattgtctccgatcggcttctcaagcgagggtgctcactccgcacagagacaggtcctgtcggtgcctgcatgcgcgcgcgcaaggtttggcagggttgtcgccaagcttaagatcaagcgcgtatagcattggcgacgcctggctttcgcttaaatatgagaccggattattttgctagcttcgcagggcaattttgnnnnnnnnnnatatggcctgcattctttacccacagaaatccatatgcactgtctccgatcggctcctcaagcgagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtcaagcgcgtatagcataggcgacgcgtggctctcgcttgaatatgagaccgggttattttgctagcttcgcagggcaattttgctagcttccttccgtcagtacagttcgatgacacaactgcctcagtggcagtatcacgcccttcgcaatcgatgcggaccctgcatnnnnnnnnnnatacagttcgatgacacaactacctcagtggcagtattgcgcccttcgcaatcgatgcggaccctgcatcgggattgatgaaagctagggcatatgtctactgccgaagaggtaagcagtgcgagggtgagtgtcgcgaatcagcttgtcaccccctccatggcgctcacagatcacttccacctcgcaggccaatgacgcccgccgcgcggcgatcgcggatgtccagcgcctcctgcagcaccccgatgacctcaagaagctcccggcactccgacaggagtatctcatgcgccagcaggtgctggtgatcggggtccccggtgtcacaccccctctgctgatggcaagacaagcccaacagcatgccagtcaccatccgcatcgtgcaactggccccatgcactgaatacagaagcacctctttctacaaacctgcacacaggggaacaaggccgccctgagctccgccgtggccgcccagatcgaggccacgcgtggcggggtggagatgctgaacaccgccctggccgccatccaggccctgcgctccgactttgcgacgatcgaggcgctgtgcacggagagcgcctccctcatccagagccacgacaagatccagctgctcagtgcggtgcatggcaatctgcacagcacactcaaggtgcacggtggcgtggtgtggttgtgagggtgtaaggggtagggcatgccagggtggtgaagggtggagtggaccacgggaggtctgcgcgaggggtccagcatgctggttcccaggcaccggccaggagaccacggatgtcccagcacgctcaccgcaccaccgcacccgcgacaggacgtggagaacatcgtggcgctgcccagggaggcggcagctgcccagcagctcctggacggcgaggcgccgctgctccaggtgtaccagcggctgctggtgctggagggcaccagcatcaaggcgcaggccgcactggagagcgggacgcaggtcaacctgaaggaggccaagaacctgaactcttacttccagcgggtagacgagtgctgttggggcggggccgcttccatttcgatcgggggcggggcatggcacgaaagggtactcagcacaagtgtgggcagatgcgtatgcacagtcgtgccaggcttacataaccctccagcgccccatgcgcccacgcctgtgccctcttccccccttaaggtccgtgccgcgctggtcaagtttgagnnnnnnnnnnccgtgccaggcttccagaacccctccagcgccccatgcgcccatgcctgtgtccccttcccctttcaaggtccgtgccgcgctggtcaagtttgaggagcggctgtggtctgtggtccgcgccttcctccccctcagccggggcaatccggggcagctgatcgacgcgctgcaggtcatagagctgcaggacgccgtcgactccgcgctcgttgctgctgggcaaggtgcgagggtcggggtcgtggggagggaagtgggtggggggtgggtctggtgcagtgcgggccacatcatgcgcaaggcgggtgagtgcacctgcgcactcgccgcacccacaggccacacaccgcgccgactcaccgatccccggcttcccactggccgatgtgcacagtggggcaccccctgaggaaagcatggcggcggcgctgcatcggccagctgggcatgtcggtgcaggagaggtttgcgccgctcctggcacgctgctcccggctggtcatggcgggggagaacaccgacgcccaggtctccgccatcctcgcagacgccgacgctttcctcgcgcaggtgcgccggggaggctctgagtgcagcgagcggtccagggtcaggggcgggtggggctgtggcctactgacatcgcttgttgctgggaatttggcggcgggattgattggtgagagccnnnnnnnnnngggggcctgtggccctctgacatcgcttgttgtcggggatttggcggcgggattgattggtgagagccgaacagcaccttcccaggtgcagggccgccctcgtcgtccccctcagcactccgccccccctccctctgcgcagctccccgacgtgtacgagtatgtgcaggtgtgctttcccccctcctactccgtgttcgaggtggtgagcgccgagtactgcacccacctggcctccatgctggacttcatcggcctctgcgccgagcagctggcaaacgaggacatcctgcgggtggtgggctgggtgggcggcgcgggcgacgcgctgtgcgcgctgggcctgcccccggatcgcgcctccttcccgggtgagggaatctgaggggtgttggttttggtcgcgggggtggggggtggggggggattcgccgcatcccatggctgctgagccggccggccagtgccccggcagcaaattgccgcagggcagcccctggcgacctgcgacgagggtcagcccctcttaaagcacccctcgccctcgtctcgaacccttcagacgcgcccggatcagggctgggcctgctggtggaaaagtatgtgggccgtgtggccgccatgctgtccacctggctgaccaacatcgtccaggtgggggaggggggggaggagagaaaagggaaaaaggggtaggcgagtgatgaacgcatgcttgtgcctacgttgacccaacctgatggtgagaagaagccgcggcccccagccgactatgggcatttgccacggccgctcttgcaccaagttactgcgcctccacccatggtcgttgaacccccccccacccaaccattcctaccccagacggactacagcgagccgcccaaggtgacggcggagggtcgggtttggacccccggccccgtcgacttcttccgtatcctgaacgagcagctgggcgtggctgccggcgtagacgacggcccgctgctggcggccaccgcccgcgccgcgatggaggcaatggcctcctaccaggcctcccagcgcgccgcggtggcctccgggcggctgggtctggacctgctctgcgcggcggtgaacaacaacatgcgctgctacgacgagagcctgcagtttgcggagcggctgcagaagtcgctggagcggcggcgcaggggtgggtggttttgggaggaaggggaccttcctgggtgatgcgttctggtttggagaaggaggggagggcgttgttgtccttcggatttgaagagtccgaatgtgtgttgtcagatctctccgacatcgtgaaaatggaggcggggtgatccgtctacactgcaccggcatggagggtggccatctagtcaacccactggtccgggctcgatgtcagccgcaggtcccgtcgagcggcgcgcagtgcacagattcaaagcctggtcatgttctctctgtgccatnnnnnnnnnngctggtccgggttcgatatcggccgcaggtcccgtcgagcggtgcgcggtgcacagatccaaagcctggtcatgttctctctgtgccatcactctccaacaaaaaactccccttgtgtcccttccatcatctctacaccccccctcctttcctctcctcgtcctcccacaggccagctggacatcgagtcggcgtgccgcggtttcctgggcctggcccaggaggccgtgggcgtgctgatgggcctggtcttctctgaccccgggttcgtgggcctgctgctgcagctgggctgcagcagcgcctggctggcaggcacctgcaccggcagcatgttggccacgctggaggactacctggtcgacttctccgccatgatccagcctgccctgctgccgcgcgtggcggagggcatgctggaggagaccgtggcgcactactcgggcgccgtgctcgccggtttgaccctggcgggggatgacgaggtggcggccctgcgtcgcgaccacggccgcatcctggagttctttggtcgccacgtcaagccagccaaggtgcgggctggtgtggggagaactgtttgggggagggcaggtgtgagcggaggcatggatcaagggtatggaggaaggtgcagtagggcccatgcacagctgcagagtctttgattatactcctgcaatgacttgctacagccccctgcaaccaacccctctgcattcaccaacacacacgcacacacaccaaagcactctcccctttgccaggcggctgcggcgtgccagctgatagaggagctgaccgagttcctgggtgccgactccctggacggcttcgtgctttcctacggctccattgtgtccctggccccgggcatcaccccaaccctgctcggggggttgctggccgcgcgtgttgctgcggggaccgagttcagcaaggccgacgccaaggaggtgaggagatgatggtggaaccttgggtggatgggtgggtggatgggtgggtgggtgggaggtcagcagatctcagcccagtgtagtgtggtctgggcaccagcagcagcgactcctcgcagccaccagtatgcagcaatatgatgatgatgctctacatcgatctagagcccaaagaggtgctctccttgaccaccacacccgcccccctttggtaccacaaggtgttggaggagtgcagggnnnnnnnnnntcggcagacctcagcccagtgtggtgcggtctgggcaccagcagcaccgactcctcgcggccaccagtatgcagcaacatgatgatgatcctctgcactgacctcgagcccaaggaggtgctcccctcgacgccacacccgcccccctccggtaccacaaggtgttggaggagtgcagggaggtgtatgcctctaggcagccccagaggcctggggctgggcccacgggctcgagcacgactctgcgtgggagccccgtgaaggccgcaggcgcaagggaggctgctctgcatgcggcggtggcggctgtgcgcaggagggcggccgaccaggcggactgatccggtgggggtgggacagtacaccggccgcatgccatcgcgaatgcnnnnnnnnnntcaggcagactgatcccgtggggtccggaaagtacaccggccgcatgccatcgcgaatgccacccgacccctccatgtttctgtgaggaggtcgagcttcatagcaacagatttcactcgtgaggcggcatggtaagagcgagacaggtctcaatctgtcggcatcgtacccataacccgtggctggtgcggaagcatggcagccagatgtggacgggagcctcgggccaccgcgaccatccatggcgtcgtagatacgaacgagttgcaattccgccttttactgaatcgcaccgcgtatcttcgacacaaagccatcttcttactttttagcagacgctttgcgtccttcaacaccccatcctccaccagcaacccccatctccaccaacaaaagctgaacttacctaccctactcgtcataccggcatgtgtgttctcctcgaggattgccctttggagactatcaacatcgcatgcttgtcgagttggttttatatacagtatgtacaacgtgcgtcttgagaaccctggtgacaagagcatggacatcaggcctgaggaacttgcgagtccacggcccagtcgatcaggatggatggagcgaaccgcctggcaggaggctcacgtgttgccgcggcactgtaacatcctccagggccgctccgtgcaagaccttggccgcccatgagcacggatccctcgtcacaggatgtcctgcaggcgaacgtgggagaagccgtagaacccgatgtcgcccttctccaccaccgcaaacttgacggggatgtcgcccgccgccgcctccagcacgaccatctcctggagactcggggccgcgcccgcggggtggacggagacgtggaagagcgggtccccggccccgcggcggctgaatttcgcgtccgctccccacacatccaggtgctggcgggggagtaatgagcgggcgtgaagaaaggtggtgaaggaatgtatgggtacgaggccggcgtcttgatccggtgacacatcaaccaccttctggccccaaagacatggtctggcacacaaaacacgacatgcccatgcaccatcggcacggcgcagccaccccattggaaagtgctgtgcaggcccagcccagtatccctgcctcttcacccggttgccgccggcccactcagctcaccaagcgaggggaagccgcgccgccctcgtacgccgcctgcgccacctcgccgcgggaggtctgggcgagcggctgcaggcaggggtactgcgcccgcctgcctgccgcggtgccctgcaggacctccgcccgcggctgggccgcccagaagccctcgcggggaccgacccccgcccacccatccagcgcccaccagccccggctctggccccgggccgtggcgggccgggcaggcactggcctgtcgcgcggggcacgcgccgtgggatggatgggcgggcgggccccgctgtcgcggtccggggtcgcggccgccgtgcccctgccctccccggccaggcacgcgtcggtccccgccccgccccgccagcgggcccaaacggcgcccaggtcctcgcccggccccgcgatccagcgggcggggtggcgctgcgcgatgtagcctgcgcgcgtgagcttgcagaacaccaggtacaggtctatgcccacgcccgcgcccagcatcaggtcctgggcctcctgcagcgacagcagccgctgggctcgtccagggccctccgtgaacagcagcaggttggcccggtccaccaggtacctgagagtgagggggggtgatgtggtgtgggtatgatgccagagctgagctcatggagtactcccagagaaggcctcacagacacttgggcatctcaggatctcaaccgtctcttcggtctgctcgaatatcgcagcgatggccgcgacggcatgcccacccatccccatactacgcacgtggcctcctcggggtggaggtacaggcggctgcgctgctgcacgcccaggtgggccaccgccttgcccctctgcagcaccacctccgccaggcccagcgagggcctccatatggcagccgagagctccttcctgccgttgttcccagtgaagttgaccgcgatgagcttggggacagaacctggcccgctccaccacgatcgcgcaggagggagcagggccagtgaccctgaggcccttgccttgagctcggcggccccatcaaaaccatctcctgccctgggcctcggcatgcagcggccttacccgatgcggtcggcggcccacagggttgnnnnnnnnnngtcttcccctgggcctcggcatgcagcgccctcacccgatgcggtcggcggcccacagggttgcgaggtctcccagcttggaggccagctccgtctctgcactgacctcctcctcctctgcatcctcgaagagctcccgcttctggccccgtcggaaaatgttggcgctgaagtcagcctgtcgaggcaattgcaacgccatactgaaacgtattgcaagtggttgtacttcgtggaaaggctcattgtcgactcgactcggcaggaggaggacatcgacagtgcatgcggatctgcagtcgaccgtgctgcgggtgcggcgccatggaagaatgtctgcgtgccagcgacaggtggtaaaacgcatcaactagccgtgttatggatcacgacatggtcatgcgctctgaatgaaaatctaggcattgatatgccgcgctccgagtgtgcatgagccagcctggccaccatggagggtgccgtgccatccggagagcccgtctgtatcgagtacagccatctgatagatcaggcacatgacctgtcgaccgaccttctgagggtatgataccgacatccattgcatagtatgctgtctcgtgaggtacatactgcctgtaccagaaggcccctgaagcatttcctcccgacaggccnnnnnnnnnntatgttctgctgtcccgtgaggtacatcctgcctgtaccagatggcccctgaagcatttcctcccgacaggcctttggcagagatggcttgggcctgatcctgatacgaggagttcccggcttccgcgcagcgagacagcgcctgctccccttggctcgacgcttgtcggtgtgttgcagcacagggcatgcagagatgatctggtggggccatgtgggcctgtgcgattcggcatattcatgctgcctgtccataacctcaagaagcccactgctcggtctgcaggagctcccacccgctgagctggccaggnnnnnnnnnnacgattcgacatattcgtgctgcctgtccatatcctcaagaagcccactgctcggtctacaggagctcccacccgctgagctggccaggctcgaagatgctgcctctcgctataacatcggctggagtcacgggcgagaggcgctgcgggatggcaagcccgacacccacaagggcagcttctatgcgaatccaatgctggattcagtgactgaggacacccagcttcaggcagagttccccgcctatgccaggtgcgtctcgcgcgggggatcagtttgagggatgatgtgcccttagctttgccactgcggtgggtgatgccatggaagttgctgcggcgggtattgccatggaagatgcttggcggcctattcatcaagggaaacctgagcacagactgagtgcagccctgcggcccctgctgacctcagctcatactacgactcctggcacaccaggcccaacatctggccgacccaggcgctgcccgagctggagcctgccttcaaggagtgtgggcgcatcatcgtggcggccgggctccaccttgcatgtcgctgcgacacactgctcgcggctcggcagcgggaagctggcggggaggcggggaccggcaccgtctgcccctccctccacgacactctccagacctccccctgccacaaggtgatggcgttgggcggattgctggtgtggcctctggtgcctgcaggtggccttgggccccatgcccagccatgaatgctccttctcatggtgattgtgaaacagcccctggagtgtggagtgaccggctgacgcatgatccctgggccaccctctgtggctnnnnnnnnnnttccttctcatggggattgtgaaacggcccctggagtgtggagtgaccggctggcgcatgatccctgggccaccctctgtggctcacgcccggcttaactgtctgtacctgggtggaaccccaagggcacgctccgggcacagcctggtgccggggggggggcggcctttgtccataccccccccacacagccgacccaccacccgttgtaaccccccgcaggcccgcctgctacnnnnnnnnnncggggggcggcctttatccatacccccccacacacagccgacccaccacgtgttgtaaccccccgcaggcccgcctgctacactactatgcggctccaggcggcgccgcctcggatagctggtgtgcatggcataccgaccacggcagcctcactggcctctgcgctgcgcagtacctggacgccggcggcgcggctgtggcaggcggcggcggcggcgtgggcctgcacatcnnnnnnnnnntgcactgcgtggtggggccggagccgggatcgggaggctcccagctcacgcgcgagacctttgcagtgttnnnnnnnnnnatacctggacgccggcggcgcggccgtggcaggcggcggcggcggcggcgtgggcctgcacatccgcaccctccatgggcaggtggtgcgggtgggcatcccaccggagtgcctggccttccagctgggcgaggcggcccaggtgctcagtgggggcctgttcaccgccactccgcactgcgtggtggggccagagccgggatcgggaggcgaccagctcacgcgcgagacctttgcagtgttcatgcagccacggtgaggtggcggcgtggactgttgggccgatgcatgggcactttctggtgggccatgggcgtgctggtccctgcattgcacagcctcttggcgctgtgctatcctggtataccgagcaatggcnnnnnnnnnnggtgctggtccctaaattacacagcctcttggcactgtgctatcctggtataccgagcaatggccccgggctttgcttgcctgggcgtcgcttgaatgcttgagcgactgtcagtatgccaatgcccgcaggtgggatgagccgctggagtgtgccgaggggtgcgagggcgaggccagcgtcggccagtggcgccgagggatgacgtttggggagtttgcagaggccacctttgcccggtattatgggtgaggtgagtccatgggcccgagcgacgtgaggctccctcagcacgtggtgccggtggttgcagggggttgcgaggacaaacctcgcacccgtccctcctcgtaccaatggcatcgcattcctgttccgccatgacccctgcgccggaggccatgcggacccctcgaatatcaataaaatcgcgacgcgaaccccgattctgggaacattgattttggaggtgggtttccttgcatcagtcaagccagtgagtaacgagtcggctccgggcagcgttgtgccgcccnnnnnnnnnncaaaatcccgacgcaaaccccgattctgggcacattgattttggaagtgggtttccttgcattagtcaagccagtgagtaatgagtcggctccgggcagcgttgtgccgccctgccgtgcgaccagccttccgcgcatcgtttgggacgcacgatgcctcagcccatactcggctggaccgctgaagtgtcacgccctttccgggcccgactcgtcccagatagctgacgtgtttttatgaggtacgggcacgggttacaacggcgcacgggaaacgtgatcagcaggtcgtttgcaatggatgtgtcgataaggttgtcgcccaccaatcacttccggatttcccgtctgtcgagtgggcggtcgtgcggaaaacggtccccccgatggccagctggaacagctcaatcgaagtcggcggaagctggtgcgatccagcacgcgcagcatgcagagcttccgacgatacacgagtccggaagcatctcgcaaaataagcttccgtggctctccgaagcacagatgcctctgaatacctttcgagtagggcaagatttttactgcaggggttctgctgtgtcgcagccttgtttcaccggcaacgcgcccttccacnnnnnnnnnntttccgtggatctccggagcacagatgcctctgaatacctttggagtagggcaaggttttcactgcagggattctgctgtgtcgcacccttgtttcaccggcaacgcgcccttccacctcggtcggaccgcgggagtgttcgtgcgaggggttcgtgactcctcccaggaagactgaggaagggtagtaccctcaccggatcttgcaggtgtgcccccaatcagctacatgtgatttcctgcctgactcgaccggctcaatttcgcattgctcctcgttgtgcacatcccttggattgccgcgctttcacgtgacccgactgcgagtgtgacgccccaccccattccccacccagcgtgccgcagtccatgtcgatatgcacgtgaagggctcgccgacgtcggacgtctcccccccgcgcaccccgcatacctgcgaggccttaaccgccgttgtgcgcgtcaggttcctcaagtccggcgccggtgggtcgcccacctcggtgctgcccggcgcctggcccgaccaacaaaagtacgtctccatcgcgaaggttccagcggtctgcatcactctggtggagtgctcgctgcagcaggcgcgccagcactccaccattctgctggcggatgacccgcaggccttcctcttcaccacccaccgtgggcaggagccaaacttgcagcgcctggccgccgacctgcgtgagaggcttgatcaggtccgtcctcctggagtggcgtttcttcgtggatattctggcatgagccgagatggtggattctagaaggtgggcagcatgcaccaagtatgagctgtgggtcgagccctttacccccctcacccaccccaccccccaggcatactcgctggggtgtggcattgcggccgaggtggagctcctggggtccacccatnnnnnnnnnnattacccccctcacccaacccacccctcaggcatactcgctggggtgcggcattgcagccgaggtggagctcctggggtccacccatgaaagcacctgggccattgagtccagcgggcagaactggtgatgggcggggacacgatgggagccgacggcggaactgccgcctgcatcccacccccaccccacctcggacgccccgcgcagagattgcgcagacatatgccatgcatctttgttgaccccacctgcagccacacgtatggccctctgcccaccagttatttcgtcccgttgcatgaatctttttcttgatacacgagcgtccgtgcacacgnnnnnnnnnnagcacctttgttgaccccacctgcagccacacgcacggccctctgcccctctgttatttcgtcccgttgcatgaatctctttcttgatacacgagcgtccgtgcacacgagcgttcacttccccacccccttgggactctttctttccccccttctgctcctgtgacctgcgcaatgccccgctgcggcaacacaccccggtcctctaagccccccacccaggcgcgctcttttacgctcccttctgcatgtggattgccgccaccttctgcctgtaccccttgctgctccttaatgaccttccttcaaccccatacatgccgctaccctgtcgtcggaaagaaccnnnnnnnnnncgtggattgccgccaccttttgcctgtaccccttgctgctccttaattaccttccttcaaccccattcatgccgctaccctgtcgtcggaaagaacccgagttgtcagcccatgcgccggctggagttgcttttaaccacctgtatgcaccacaccatcctgtggaagagtgcttcctttgtaaagtccttcacatgcagtgagggatggacagggtcggaacaggctgcaagggaggcggtcatgtagcatgtgttccttgtagggtgggggttgtgctcggatctgcacacgttgccgccccagtgcgcccctcgcagcgcagcctggcatgacgggcttggatcagccgggtgctgggccagcactgggcggctcaccaacagggggcaagggaggtacacagcagccggcaccctgcgccccaccaagggtccaacagccagttcaaacacctcgctcccccccctcagcgcctcacgctcttgacccgccgcctgagcctccccgcctcaaccccccgccgccgtggcgcgtgcgaagaagttgggcaccagctggggcagccagttgatgtcgatggcggtcacgtcgcgggcgtaggtccgcgtggtgcgcaccagctccccgaagaccactgcgtcgacggcggggacgccgctgcgcgcgccaccggcccgcgccagcgcgctgctggggtgcagcgccacgtcctgccccgtcgccagcacgcggtaggtgcctgaaagagggggggggagaaggaagagtatatgaccctgccatctgcgcgggtgcatgtgtgtgtggggtgatgttcagacgcatgggtcggtgggtggctcagtgttccaggcagaggttgtttgatcactgttagacaactgcgagccatgcagtagagcccattcccccgcccaacaccagtcccccacccaccgcccggctgccggcgcgcggcgtgggaaaacaggcccatgaccagggcctggcgcagcggcgtggcgtcgtcgccgcaggaggccagcctcaggcccagggcctgaaagtggccgcgaagctgggcgtggatgtcgcgcgccttggccagcgaccgcgcgttcaggaagccctcccggcaccaggcggccgcctgcttgcgcggctgggccacgaagcgctggaagaccgccagggcggtgagatggtcgccctccctggaggcgaagcgggcgtgggcggccgccgcctcctcccgcttttccctggaaggggggttgtgggagtgctgtgggggggagtggatgagtgcagccggcagagtccagtgtcttggagaggagcagagggcgaacaggacaactctggacccaaaccccggcgcccttcacctccctcccagaacgggagatgcaacacacccaaacccacctggggaactggaagacggggtcggtggaggccatggcgatgacagccagcgcctcttcgctgcaccccagctccgccgaggccatcagcacccggccaaacatggggtccaccggcaggcgggccagggaggtgcctacaggtagggagagaaagggtgaaaggatctgggtggatgagtcaccgctggtgatcaccggcaggtaccttaattccaccccctccctctcaccgctctctcctcctccccaaccttccccccatccctcagccccccacggcgccacgctcannnnnnnnnnagggtggatgagtcaccgctggtcatcaacggcgggtgccttgattccaccccctccccctcaccgctctctcctcccccccaaccttccccctatccctcagccccccacggcgccacgctcaccgatggggtgcgccaggtccccctcccgcgtcagcgcccccagcgccagcaggagctccagggagcgcacgagcgcgggcgcaggcggcgggtccaggaagtcgaagcccagcacgtcccgcacgccaagtgccttgagctgcagcacgacgctggacaggttggtgcgcaggatctccggcgccgtgctgggcgccaacttggcgaaggcggcctcggtgtaaagtcggaaggccttgcccgggccctcgcggcctgggggtgagtgggggaaagaggagtcgggtgggggggagtcgacgaggggagagggagtgtgtcgtcggggccagaggacagggtgatccatctgctggtggagagacaatgcacggacaggcagcggcgcagggtgccaggcagccgcctgcagcgtcgtacgctctgtcgctccagcccctcgatccatcgcgcccatttggacgcacccgggtccattccccctgacacacacacgcacacacccacgcccagccagtcccacctgcacggccgctgcgctggcgcgcctgcgcctggctgacgggcacgacctggaggcagtcggcgccgagacggggcgagtaagcccgcgccttgaccatgccgctatccaccacgaagcgcacgcccggcaccgtcacgctcgtctcggcgatgttggtggccagcacgacgcggcgcgaccccggcgcggcgcgctcgaagacgcgaagctgggcctcggggggcagcgccgcgtacagcggcagcacgcagagggacaggcgggcgggatcaggggggaggctggcggcgcggtcggtaagcagccgctcgcacgcctcgatctcatcctttggagaaggaagggggggaggggatggggacttgtcactggggttggaggggcaataagggtgacggaccaggacatcggaatgggaatttggcaggaacaagaggacactcgatgcgccacgctgaaggaaaaggcacagtgcgcggcaccatgcagccagggtggcgatactgaaccccaccctcgccccacctggccggtgaggannnnnnnnnncaaggcacagtgcgcggcggcatgcagccggggtggcgatacagaatcccaccctcgccccacctggccggtgaggaagaccaggacgtcgccggggccctcctcgcaatggatctgcagggcggtggtgatggcggcgtccacgtagctctcctccggcgcgggggtgtacatgacctgcactgggtactgcctcccctgcgctggggtgcagcggtagcgaggatgtggtgatgggtgctgtgctggcgtgagcctccaggccagcctcacccacagcaccctccctccctcagacgtaacatcctagcaaaggggccacgcactgcgatgtatgccgcctgggagccctggaagtaggccgtcagcttctgggtgtccagggtggccgacatgaccaccaggcgcaggtcgccctcgggcctgcccgccgccgcggccttcagcaggcccagcagcacgtctgtggccacggtgcgctcgtgcgcctcgtccaggatgacaacctggtaagtgagaatgggtcatgggtaggggtggggggaggttgggtgctggctgaggggtgcaggggctcttcaatatgagcccatgctgggtatgggagactgatctgtcatgccgacgtcaagttttgcggcatccctgtccctcgtggaaccccctttggccaagctcccaccttgtatcgctgcagcagggggtccaacaaggcttcacgcagcagcatgccgtccgtcatgtatttgatcctggtatcagggcctgtgcggtcgtcgaagcggacgcagtaccccacctgcagggacgcacgggtgaacaagtagcccagactggatactgggttctcacaaagcttctcctcagctggcagaaaggtccaggagcacagggagatgcgcaggaagactgaccccggccaggcagcccattgcaccacacctcagaaaactcctctgacccnnnnnnnnnnactcagctggcagaaagatccaggaacacagggagatgcacaggaagactgacccggccaggcagcccatcgcaccacacctcagaaaactcctctgaccccgccacacctggctgccgagcttgcagcccatctcattggccactcgctgggccaccgtcacggccgctattcggcgcggctgcgtgcatgctatcgcgccgccggccgccaggccggcctcgagcaggagcctggggacctgggtggtcttcccactccccgtctcccccaccaggaccaggcagggattggtcttcaccacctccaccagtcgatggcgggctgagtagacggggagagccttgcgggcctcctgcaagcgatccctgtggtgtgagggaggtggctgcccacccgtcacgcatgcgccggttgtgtcgtggtgcaggcgtgcctcggcccgtctctttgcaaactaagatcaatgcatatataaatcggagagcttgagcccagttttgccctttttcgcgtgcctcaggtccttcgcgccctgcccgtcctcctccgttctctggcgtttggcgaccgcggtcccattcgcagtcaccattcccagagcttcaatgcatgctgatacacatcgggtatgtgtgtatggaatcgacatccttccagacacattcccattgcctttcggccatcagcggtccgcatcctgtgcgcgcgcgcgccaggagtgagacatggtgattctgcttacgcccgagtactaaatagatcaattttgtagcccatcatgcttgtgggtagatcggtttacagatcatagatcaccatgtaatcgcttcaatcgggagccttgatgccttgatcacatccggttgccgcctctgtcgggagcagaaggcgcctcccaggggccatggacggtacgcgatggagagcgagatgccttggtcaaggcaaaatgagtgcacctgatggcacccattgtgccattccacacaccgcatgccgnnnnnnnnnnacgatggagagcgagatgctttggtcaatgcaaaatgagtgcacctgatggcatccattgtgccattccacacaccgcatgccgccccaccgcgcagaacggtcggcattcaccgtggctgtacaagctggcgctgcccagatcaagccgcgggcgtaccaggtggagctcctggaaatggccaagaccaataatgtgagccgcagtccgaggagggacaagggatcccttcagggtcaccgcatgctcgtttctgggacagcgcatgtgctccccagcaaccctcggacccctctgccccctgacacgtcgccaggtcatcgccttcctggacactggggcggggaagaccttcatcgcggtcatgctcctccagcaccgcctcactgcctccctcagcacacaccaggcgactgcccgggcagtgttcctggtcccccgcgtgcctctggtcttccaggtgatgtctgggctgcggacgattgttaatttcaagtcgtggagaggtccatccatgatcctgtgatccaccctccgcgtggccctgctggcgcatgtgccccggccctgcccccagccccggcaccaaccgtnnnnnnnnnnggtgttcctggtcccccgcgtacctctggtcttccaggtgatgtctgggctgtggatgattgtttattttaagtcatggagagatccatccatgatcctgtgatccaccctctgcgtggcctggctggcgcatgtgccctggccctgcccccagccccggcaccaaccgtggcctgcaatccctggcatcatccgcctccctcgccccaccccaatcacgatcccacagcaagccgaggtcctggcggcgcacctgccctgcgccgtggggcgctacgtgggggagatgggggtggacctgtgggactccaggcgctggggccgggagtgggagcggcatggggtgctggtcatgacgccccagatcctgctcaacctactgactcacgccatcatcccggtgagtgatggttgggtgtggttgggcgcgaggtggaaggggtgatgggctcaggcctgtgttcaggccccaggcgtggtgggcaccctctgggcactgcacatcccactcagcatccgctcagatgccaaatgtccccgacggcacccctccctgccggctgaccctcctggcacccccaacctcatccaactccagccaaattgcacacatacccctccccccgccagatatcgcgagtgcacaccatcgtgtttgacgagtgccaccacacccagaagaaacacccctacaacctcatcatgaaggagttctatcaccgaggtgagtgtggctgggtggaccagggttgcccactggagatggggaaggaatgagcccgagtgtgggagggagctgatgagccatgcaagcccactcagtgcgtgcagcccacatgctctttggaaagactcccttctcagctacacgccccttgattccctgcagtgacggggtcgacgccccggcctcacatcctggggctcacagccgcccccgccaacgtgaggagggaacaggcctcctggcggctgtccaaaaacatcgtgacgcttgaaggaaacctggatgcgcatgtgagtctttctgggatggacccacatggcggaatgtggatgctcactcgcagaggggcgggaactggtcggggaacatgatgcctgtggcatggaacccactggcatctgcatagcttgttagagtagttgctgggacggctgggtcatgtattccccctctcgccaacccccaggtggtcacagtcctcgatcgcgannnnnnnnnnactgcatagtttgttagagtagttgctgggacggccgggtcacgtattccccctctcgccatcccccaggtggtcacagtcctcgatcgcgaggacgtggaggctgccgccccgccacccactctgcgcatatgttactactcgtgcggccagggccacccaccagagctgcgagccctcctgcgggccatcagccacgccaggctgcgccttgccgccgccggagacctggtcaggtgagactgggcggggcnnnnnnnnnngggatggatgcaggtacctcgcatcaatctagcccagattccccacacaatcatcccgacacactgcagccaagnnnnnnnnnngacgaggagtgcagccatggcctggaacaccaaggggatgcagtgcaaatgcttcaagatccagcacgatgtgtcgagctggacatccttttccacatctgcagatnnnnnnnnnntattggcttcctgggttgggccgggtctgtgggtgtgagctggattccattctcattgggccaggatggatgcaggtacctcgcattaatctagcccagaccccccgacacaatcatcccgacacactgcagccaagtctggacgcacgagctcgaacagaagatgggcagtgccaagaagtcgtcaggccgagtgtactttgaccctgtggtgcggagatgcaacgaggagtgcagccatggcctggaacaccgaggggatgcagtgcaaacgcttcaagatccagcacgatgtgtcaagctggacatccttttccacatctgcagatctctggattttcaacctccaggttcaaccagatgctgtctggcgtgcagcatgtcaccgaggtggggtgcgaagcggaccaaactgttgtgttcctttgttcctgccaccttgcgccggcctccttcacccgagcaacccctgggagcaggaggtgatcgacgtgattacgaacatgcccacccctctctcccccagacannnnnnnnnnggaagcggaccaaactgttgtgttcctttattcctgccaccttgcgccagcctcctttttcttgagcaacccctgggagcatgaggtgatcaacgtgatcatgaacatgcccacccctctctcccccagacactgggtatgtggtgtggggcccaggcagcgcgctccatcttcaaaaccctgatcaccgaggtggtccccacctacatggctggcatgggggccaacaagaagggagagggctttgagtaccagaccttcaacccctctgcagcccggctggcggcaatgtcagtccaccatgtgcgcgggtggtcaaggccggaggggggagtgagaggggtggctttgcaggctcgatgcaaggttagaggttgggcccctcctggatcgcgtgctggtgcacatagggagccctgtctctcttcccagcaagtgcatcagagaacttacccgagtgcctggggaacattgcgaaatagagggctgaccccgatgctcctcctcagcagacgcagcatcgcaggatgggtcgcgacaccgttgacatgggtgaaaccatggctgacaaggaggggtccgactccgacatgtctgatgnnnnnnnnnncagggagtcctgtctctcttcccagcaagtgcatcacagaatttacccaagtgcctggggaacattgtgaattagagggctgagcgcgatgctcctcctcagcagatgcagcctcgcaggatgggtcgcgacaccgtcgtcatgggtgaaaccatggctgacgaggaggggtccgactccgacatgtctgatgaagaggtgcccaccttccccagacaaggtgcttgggaaggggggggtgcgcgcaatcattcaatgccactatgcaaaaggctcatgctgggacctgctgtgcactcatgggcatccagttgaccccatcaatgtccatgattcctcatgctgttctctgagcttggccacccttcacctnnnnnnnnnncgtgcgcgcaatccttcaatgccactatgcaaaaagctcatgctggaacctgctgtgcactcatgggcatccagtcgaccccatctatgtccatgattcctcattctgttctctgagcttggccacccttcacctccgcagagatcgagcaggagcagacagccaccaatctctctgccctggaggtggtggttgcctttgcacaagccctgctcccaactggcgcgccgcaggccgcaaagtgccaggacatgatttgcatgctcaggcggagggtggagggtggccagctgatcaaggtgcgtgaactgggcacctgcttgggtgctgcctgggagcgggtgcatggaagcgggaggctcaaagaggcggatgacgatgtggttttactccagacctccaaaccccggcaaccatccgcctccccatcaccacgcttccctgccctcttggccacaggacctgcctgtgaagacgatggaggagttgctgggtgccgttgccccttccgagctgcaggctgaggtcgatgccatgggcgtcgtggaggaggcggcgggcccgccggcgagcgccgtccccggcgccgacctgcgtgtgacggccgtgctggcgggcggcgcggcgcacgtggtgcccatgacccaggagcccagacggctgggtctggtgacgcagaaggtggcagtcctggtcgagcagctgctgcagtaccgggggacggccacccagaatgagactgatggtgtggcgtggcgggcatccgtccttggttggtttagggtcgggctgggggatggcccaggcattgttgggagcccagtttgggctttgggatggcgcggagcatgcctgttgatggtggggttcccatccactgcgcagcattgtcgcctccatcctcccacccccccattcctcttgaacaccaaaggctcnnnnnnnnnncgcatccgtccttggttggttaagggccgggctgggggatggcccaggcaatgttgggagcccagttggggctttgggatggcgcggagcatgcctgctgatggtggggttcccatccactgcgcagccttgtcgcctccatcctcccaaccccccattcctcttgaacaccaaaggctcgtgctggagcggcatcgtctttgtgacacggcggctggcctgctgggccgtgcacatgctgctgagcacgctgccctgcacgcgcgctttcctcagaacggccgctgtcacggcgtaccagcagcgcactggcgaggccgtgggcgtcagggtgagtgaacctgggacggaggggtggggatgtgggaccggaaatgggacccctgcagtgcctggggctgctgccccaaggggagcgcagcatacacattagcaaccacgaaggctttgcctcattgccaaaccccttcctccatacgctctcaaactccccagcaccaagaggagaccctgcgcgggttcagacagggcaccttgaacctgctggtggccacggcggtcgtggaggagggcatcgatgtccgtcgttgccagctggtggtgcgattcgacctcccgcccaccgcgcagagctacatccaggtgttggttgggacgttgaggacgcggagccgcagctgaatggaaagggcatgccctagtggccgcaggggaatcctggcgagctggtctggcacgcacgcctgggcatgcatggttgagtgaggtgcctctcaattctggtccgtctaacatatattccacaccatgcaacaatcccccccccccccctgcagtcacgtggacgggcgcgcatgcagaacagcatactgatcctcatggtgcagacagagcttcccgaggagctggaggtagggggctgaggggtggcagaggaggtggaatgcgtgggagcagggggaatctgtgaggatttgcatggagacgtcgccattgcattgccctgccactcatgttcatgccccgcctgatgcacagatgatcaatcacatgatcaagtttgaggcggatttgaggcaggaggtgctgtccaatattcacaagatgaaggcgaggcggagggatggggtgcgcattggactgcctgatgtgcaaggcgtggagggggagatgcacgcttcatgccatcggcagccaaaccttagggaataaggggctgccgttctcgtggctgatagcctccaccttggcagcaagcctttgagtgaggatgagtgtgttgttcttctttcgtcgtgcaggaaaagggcctggtggaagacgcctccgagtcctcagagagcgaagaagacgatggcatcaacgtgagccatgggcgctgatggggatggaattcttgttggaggaggtgtagacatgaggagccggccacaaccaacatcacatgaaacagaccccaaccctgcagtggaggggcatgtcggattcatctggtcctctgtaccgccatccaacctgctgcatcaccacacgcctctcagtctctggccctgctcccattctccacccttcaggacgaggagctgcggtacatggtggccagcaccggcgcacgagtgagcgcaggtaacgtcctccgactcctccacgcctacatctccaagctgcccactgacaggcaagcgtggctgccatgtgagcatgaatttagggatgctgcttttggcttgagggaagggcgagctcgaccccgcttgcccccggcccgctgacttgttgctgagcccccgaccctgaaacctgcacgctgccagcattctcaccacccagtctctcatctgcatggagcaggtactccatcctgcggccaacctaccgcacagaggcactgctcgacggcatgtacttgacccatgccttcctgcccagcaactgccccctgcgggagacggtgggcatgccgcaatccacccgccgaaagtccatcgcctcagcagccctcaacgccatccggctcctgcacgaggtgcgggaggggtgcccggttgaggaggggtttgcaggtggcgtggagtcgcacatggcatcatgagcgcagtcttcagaccctccctgtggtgtcatcggccaccctcccttccacacccacctcatcctccccccagtctgggagcctgaacgacaacctcctgccggcagcattcgaactggcagccgagcggcgacaggcttccggcgtgcagtcgggaggtgggtgacctgctcttttgtaatcagaggtttcatgggcagcaactggggtgccatgtgaaggtcaagtcatgtgctcatgtctaccatagtggtgaaatgactcattgttaatcacgaatgcctctcctttctccaaccaggtggtagtgattggccggttgccgaggtcatccctgcggtagtaatcgacccccccaagcgccacctcatccaaggtctgcctgaatttagagtggctggatgttagggcggtgctactttgagggaatcatgcacagcattctaaccaatggcaagtgaggataagcatggaaagcatgtcgcaagggtgcagggtcgttttgctttggtctgccatgaagcaccggcttgagtctgcgaggcccannnnnnnnnnnccctcctgcacccagcggggagcatggggaggtgctgctgcacccatacaggtggctggtggtggacgacaggagcaggactctggccgccagttcctctggtccggccaaggccatgcaggacctggtatgcctgctgctggagcccctgcccgagggcctacccccttgccggctgccaggcaacgacggcgcctccaaccagctcgccttcctcnnnnnnnnnncaacctctcagtctacctacaagcattgcccatgagagttcacgattgcaccccccgacaccccacggtgcaggcttccannnnnnnnnnaaacctctcaagttcccctacaagcattgtccatgagagttcacgattgcccccccccccccgacaccccacggtgcaggcttccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttccccttgccgcctgccaggcaatgacggcgcctccaaccagctcgccttcctccccggcccggccctgcgcgtctccgtcgaccagcttcgacagctcaaggcctgccacgtggcgctggcggagctcatgctggcgcgggggcccccgcgccacgctgctgggcagccgcggaaggccgaggttgcggtcgcagtggcagcagaggcagccgatggagagggtgggatggtgccggagccgggtgagatcgtggccggggcgacgggaggcacgacgccggcgcctccccacgccgacattgggcgtgcaggggttgcacatgaggcagcaccgacgccccacgatnnnnnnnnnngcgccagcgcctccccacaccgccattgggcgtgcaggggacgcacatgaggcagcaccgacgccccacgatgaccgacctgaggacaaaggaaccggtctgttcgtgcgagccctggtgcgccgggtaatcgaccgcgtgatcatcctacaggacggccacctgcccaagagccggcggggcaaggcgtccagggctgcgggggtgtccccggaggcgctcagcttcctgctggctcccgcaggttggcaggcgtatttgtgtacagcatttttgctgagacccaaggttcctgctccgaactccatcgcggcgacaccatgctttcctattgcctgaccagtcatactgaggacctccccccgccccttcatccagccccaagcggcgacggcagcgtagactggaggctggtggccgaggtatgtgnnnnnnnnnnaatatcatttctgctgagacccaaggttcctgctccaaactccattgaggcgacaccatgctgtcccattgcctgaccagccatactaaggacctccccccgcccctttgtccagccccaagcggcgacagcagcatagactggaggctggtggccgaggtatgtggggacgcgggatccacatccgtgctggcgctgctgcgcaggggggtggacctgcgggaccgcatcatctggacgacctacaaccataaggtccacgccttcaggtgggggcggaggagggggggtgggtgaaggggggcctgggcgaatgggggtgtatggcagacaatgggagaggctcccaccgtcaagggcgtgggcctctccaggcggggtgnnnnnnnnnnagggtggatgaagggggggcctgggggaatgggggtgtatggaagacattgggaggggcttccaccatcaagggcgtgggcctctccaggcggggtgttcggggcttgcgccccaagaaaccagtgccactctcattccgcggcatgcatgccaccgtctcaggggcgtgcggcacgacttgaacctgcagtccacgttcgagaccagcgaggaccgcggctcagccccacgcggcaagcgtcgggctgcaggggcggcgcccgctgccgtctccggggccgggagccccgccgacgaggccccgcccacgacgacccgcacctcctacgccgcctactacgccgagcgatggggcctgccgaacctggaccccggccagccgctcatcgaagccagcgcctggaagcagggcgcgggcgggcgcctggatgctgccgcggagccggaggagggcgaggcctccgtgaccctggtgccggagctgtgcgaagccagccccatccccgccgctctctgggtgcccctgctccagctcccccgcctcatgcacaggctggaggcggggctcgcggcggcgcgcctgctggaccagctggtgggcccagacaccgccaggtgggtagaaagggagacgggtgcatgggtggggattggggaaggcaggatcccatccaagtcccacacaccgtttcttcctgtctttccgccgagtcacgcgtgcgcaccatgcatgagcaggacgctgcgcaggcccagcctggcgctgctgcgcacggcgctgacgctgcgctcggcgggcgagggcagcgactacgagacgctggagacgctgggggacaccttcatgaagtacgcggtgtgcgccgagctcttcttcgagaaccgcacctaccacgagggccagctgacgcggtgcaaggacgacgtggtgtccaacctgagcctggcacagcgggcgcaggcactgggcctgcacagcgccctccaggtgctgcccttctccatgggcaactggacggcgccgcccatcgtcaaggtgcggcgtggtgcggcttggtggggttgagtcgggggaggacagtcgggaggcaggcgaggggagcattgaggagggcagggcgatggaggaccacaaggtctccgcggctcgccgggtcggaggaggtgcnnnnnnnnnntggcgtggtgcggtttggtggggttgagtctggggaggacagtcgggagccaggcgaggggagcattgaggagggcaggacgatggaggaccacgaggcctccgcggctcgccgggtcggaggaggtgcatgcggactgaaaggggagtgtctggtgtgatggcgaaattcacatagccggtggagttcctgatattcacaccagtgcacacctttccctcaacacccacaccaagacaggtgggcggcaaggtgctggcagacggcatggaggccctggtgggggcttttgtggtgggcagcggagaagaggccacccgcgtcttcatgagggtgcgaccctgggggggaagggtgctgcctcctcttgtgtaatcgagctgagcacgacatgatgatgatgatgatgatggtaatgctgcatggtaaggaatgcagggagccaactggattttccagccctgcctcagccaatcgcccccttcnnnnnnnnnntggaagggtcctgcctcctcttgtgtaatcgggctgagcatgacatgatgatgatgatgatggtagtgctgcatggtaaggaatgcagggagccgactggatttcccagccctgcctcagccaatcgcccccttccctcttctcccacgcaacctcacaggtcctgggcctgctcaaggccctccagcccagctcaaagctggagccggcgccgggcggggatgccaacgtggcgcaccgggaggtcgacgtcgacgccatccagagggtgctcgggtgcgtgcgctgttggcgtgggaaccttgaagcagcaagagggctggtggcacgtattctgccgctacccacggcaatggggtgtggaggttgggctgggtcgccgtctgcatccattcagaaccccccgttcctcacgcgacgccccccccacccgagcacctgcacaggtacacctttgcccnnnnnnnnnngtgggtcgccgtctgcatccattcagaacctcccgttcctcacgtgacgcccccccctaccgagcacctgcacaggtacacctttgcccgccccggcctggtgtgcgaggcgctgacgcactgctcctggagcgggcgcaacggcagctgctaccagcgcctggagttcctgggggatgccctgctggacctggtggtggtccagcactgcttcgactccttcacgtgggtttgcttgattcgggtagaagccggggcccacgagacgctgcgatggtgcttgagatcctgcctcatttttcccggcctgtgtgcctctggcagctgttcgtttatcacccagagggccgctctcacccacttccccccaccccctcannnnnnnnnngttttcccggcctgtgtgcctctgacagctgttcgtttattacccagaggggcgctctcacccacttccccccaccccctcacccacccaacacgcgcccttctctcctcccaaaccgcagggacgtggagccgtcagacctgcacgacatgcggtctgtggcggtgaacgccgagcgcctggcctttgtggctgtccaccatggcctgcagcgccacatccggcatgcctcgcccaagctcctctcccacctcaccgactttgtcagcatgtggcgtgatgaggtgaggggaggtgggggagggcttttggttggggacatggggaacggggccacctctaggggcactcagggaacgtgttcgggccacaggatcgaagcaccgctcgcagccggcccaggacctcagcaccgcactgcaggacctgaggaaccagatcctggcatgcccctgcccccacccctccctccctcccannnnnnnnnnctggtcggggacatggggaacggggccacctcgacgggcactcaggggacgtgggcggcccacaggatcgaagccccgctcgcagccggcccacgacctcagcaccgcactgcaggacctgagaaaccagatcctggcaggcccctgcccccacccctccctccctcccacccatcccccccaccacacagatgacgcgggagacggcggcggaggagcggcgcaggcgccaggcccagagcgtgagcccggcgggcccccgcgcagtcgcgcacagcaccacagccggggcgtcggactgtggggatgcgtcggtgcacgagaccgcgcgcatcgcgctgatgnnnnnnnnnncagcaccacagccggggcttcggactgtggggatgcgtctgtgcacgagaccgcgcgcatcgcgctgatgaaccgccacgcctttggcttccccaccatggaggcgcccaaggtgctgtgcgacgtggtggaggcgctggtgggcgcggtgtacgtggacagcggcggcaggctggacgtcgtgcgccgcgtggccttccgcctgctgcaccccatggtcaacccgcgctccaccagcatccaccccgtccggcgactcatggtgggcacgtggggggccgcgggcggcggggagcctgcatgccgcagacgccatggaacggggtgcccgtgtccgagcacgaccccgcaccctctgagaacacccgacccaccaccaccgccccgtccccactgtggcaggagacgctgcagaccttcagtggcgccctgccagagtacaagctggtggcctgggtgcaggaaagggcccacgtccaagtcagctgcatggacgtgcttcttggtgagcagcaaaggactaggtggattgcatgatggatgagcgggggatgcgccgctgagtattcgtattctggaggacctggcnnnnnnnnnnaatggatgagcgggggatgtgttgctgagtattcgtattctggaggacctggcgaggccctctggtgcggggaggcgggaagcctgcccgacagcctgcgtcctcggccttgcgcctctgacccctgctcctcgcaggggagagcaagggcgggagnnnnnnnnnnactgcgtcctcggccttgcgcccctgacccccccgctcctcgcaggggagagcaagggcgggaggaacgcacggtcctctggccggctggcggcgcaggatgcgctggacaggtggcgggagctagagccgaagctgcgagaggcgctggtgctacgggcggccgctaagaaggatgggcttgcctcaatgaaaactccaaagctggtccgtgcttgagctgtaacagactcttgcataacgagccatcacgcagaccccgcgtcaggctgtgactggccctccagatttggtgctcttgacataccatcaaggagctgatcacggagttggcaagcgtgagaacgtgtgagtcagtacaaaacgcttgcacaaacttgcctgtaagacagtgtcacgagtgggaggatcgtgccagggtcacagggtggccggactcttctcagagctcatcggggtgagtnnnnnnnnnngatgaaaactccacagccggtccgtgcttgagctgcaacagactcttgcataacgagccaccacgcagacccagcgtcaggctgtgactggccctccagatttggtgctcttgacataccatcaaggagctgatcacgcagttggcgagcatgagaatgtgtgagtcagtacaaaacgcttgcacaagcttgcctttaaggaagtgtcacgagtgggaggatcatgccagggtcacagggtggctggactcttctcagagctcatcggggtgagtgagtctggggtgagggtcgtcatgatcgccatcgtcaaaagctggcagctcctgaaaagtgaggaggggcggggaatctcatggagctcctactgcagcctgcttctcaccaccgtctcagcagcgggtccgagcaagaccatacgccagggaatcaagggagctcaagatcccagcctgtgcatcgccctcacctcgatgccctcctccacggccttgccggccaggaagtcgtccacacagtccaggaccgcccccgtcgtccagtcccagggcacaaccgtggcacggcgccgccgctggaggtccagcacgatcaacgcgggcgccgcgtcctcaccttgccgcccagaaaggagggaagcagcaaggcgggggtggcgcccggcgtccagccaggcgtagcgtgcagagcgggtggcgcggcccagctcctgcgccgccgcctgccgcatcgcgcgcagcgcgcgcactgactcagcgtatgcgggcccgcctggaagcacggcaagcgcgcacgggcccggagcacaggcatcctcccagtcctgctttcctccaagcctcggcgccagggtggcgtacnnnnnnnnnngctgactcagcgtgcgcgggcccgcctgggagcacggcaagcgcgcacgggcccgaagcacaggcatcctcccagtcctgcttccctccaagcctcggcgccagggtggcgtacatgccgtgcgcccacaagtcgtccggcacggtggagaagcgggccgtcaggctgacgacccaggtggtgagggccaggtacgagaaggggccccggtactgctcgcggatgggggccgcagagggcgccctcgggtctgggtaggcagcgaatatcaccggaccctgtattggaaggatcagatggatgtgctaatggtaatgggtgcatgcagactgggtgtgcttggggaggatctgagcagggattggcaaagcttcacctacaagacgagaatctgctgcgcagagcgatggtgggcctactattgttgcatttcttggtccttgaaacccacgtacattgctcatccaagcaaggaagaggtgtgccaccctatcctcaccaaaatcccctctttnnnnnnnnnngttgttgcatttcttggtccatgaaacccacgtacattgctcttccaagcaaggaagaggtgttccaccctatcctcaccaaaatcccctctttcgctcacctctgtgacgttaaagtactgtgctatcagcgcatcgccaggaggggccaccccaaagtcgacaccgtggtcatggagggtgccggcggctgccagcagcatgggcgccactctgtcctgcacagagaagagcaccaccttgaccctgggtgcccccttctccagccaggcactgaactcaggccctgtcagatggacagccagcgactctgggaagagccgtgcggcggcggcctgcagggacctggcgtttggtgcacctgcagagagtaccagacattgtctgagcttctagtggcgagtgaccaaaccaggaaaaacgtactccatgcagggcagggaatgagccgctgggcaggagcaatggcattcaactcaccggccctgacttgcatccagctagagaatgaccctcgagagcgagactcaaatggagtcagccacacaaccatgcggcaggctgatgtgaggctctgacccaggaactggtcggcctgccctccccatgctcttgccgctcgctccctgactgctgcatcggtgaggttgagcgcaaacggagtgcaaatgcctcctgcacgtaaagcagcttgtgcaaaggaccgtaggtggtccttacagcctactgagtcgtacacggcaatgcagaatattcctggcgtgctgctggccagcgtggcctgcaagtcttggacagagacggtttgtgggtcaggaaggctggcgccaggtggagaggacggtgttgatgtaaggtcgcgctcgtgtgtatccgatgatgaaacggggtggccgacgtgcgcccttggtgctgcagccgagaccttgtcgtgcccagggagcgtctcacagcttgccaccannnnnnnnnnagtaaggtcgcgctcgcgtgtatccgatgatgaaacggggtggccgaagtgcgtccttggtgctgcagccgaggccttttcgagcccagggagcgtctcacagcttgccaccacaccaagcaggagcatccacaccagcctgcgactggcacgctgcgtcctctccatgcctaggtgcacctgggaagaatatagtcacggtcacataataacatccttattcattggcgcaatcgcgtcgggtctctgccatctaagacatgaaatcaccagtcccaccccggcgatccggggtgggactggtgatccacctccgacaaccccggtacggcatcgggcgctataggctcacacaagggctcctgatggcgcattacatagtacaaagtgtgatgctgaaagtgcaaaagcgcatgcgttctgaaccaagtctcacccgcgacaggacggcctgcgccacgacgatagcaatgcttccatgcccttgccctgcgctggtggctggcattcatgggagtaaacccgccttctgatgcgataagtttctcctagcagagcgcccaggaaccctgctgggcccacgccctcctccccagcatggattcctcgccgtgctactccctgatggtggaggtggagggccccgaccccaaagcagtgcgggcgggcgtggccactcccagccacactgccagnnnnnnnnnngccgcttcatgctcaggtgtggggaaaccagtacaccaaggagcggtgcgaatgtgggctccaagcccagattgccaacctccttcccttactccatgcctcaggaaccgtggtggacggtggggggattggtcccgtnnnnnnnnnnaattgccgacctccttcccttactccctgcctcaggaatcgtggtggacggtggggggattggtcccgtcatcgtgtgtcccctcaccctcctgcttcccttcctgcgacccgccagccgcgagcacccgatgcgcgtctccccggcagacctgtcggcccatgccaggtggcggaagggtgtcgggctgaggaccagcctgggcgggtcaaggatgtgagtccagggaggaacccgatggcacgctggccgtgattctccccaaacacatcacacccaggatccgcgccagactcgcggccccgcacctccccgccgccggcggccagcc

SEQ ID NO: 48991 - DNA, 92 bp, Chlorella protothecoides
tgcaacactgatcggaatgatgccaactttctggaccgtgcgtcggttcctctggtgttcaaaacttcccatgtcaccaccctgcaaaactc

SEQ ID NO: 48992 - DNA, 70 bp, Chlorella protothecoides
atctccttttcgagcctggccctgccgtcactggcaccgcaagatgccttgttctttggtgcgcgatggt

SEQ ID NO: 48993 - DNA, 31260 bp, Chlorella protothecoides
  modified_base (1916)..(1925): a, c, t, g, unknown or other
  modified_base (3213)..(3222): a, c, t, g, unknown or other
  modified_base (3371)..(3450): a, c, t, g, unknown or other
  modified_base (3569)..(3578): a, c, t, g, unknown or other
  modified_base (4384)..(4393): a, c, t, g, unknown or other
  modified_base (5063)..(5072): a, c, t, g, unknown or other
  modified_base (6824)..(6833): a, c, t, g, unknown or other
  modified_base (7214)..(7223): a, c, t, g, unknown or other
  modified_base (7549)..(7558): a, c, t, g, unknown or other
  modified_base (7752)..(7761): a, c, t, g, unknown or other
  modified_base (7970)..(7979): a, c, t, g, unknown or other
  modified_base (8649)..(8658): a, c, t, g, unknown or other
  modified_base (8885)..(8894): a, c, t, g, unknown or other
  modified_base (8979)..(9226): a, c, t, g, unknown or other
  modified_base (9311)..(9522): a, c, t, g, unknown or other
  modified_base (10514)..(10523): a, c, t, g, unknown or other
  modified_base (11023)..(11033): a, c, t, g, unknown or other
  modified_base (11167)..(11176): a, c, t, g, unknown or other
  modified_base (11385)..(11394): a, c, t, g, unknown or other
  modified_base (12144)..(12153): a, c, t, g, unknown or other
  modified_base (12655)..(12664): a, c, t, g, unknown or other
  modified_base (12763)..(12772): a, c, t, g, unknown or other
  modified_base (13169)..(13178): a, c, t, g, unknown or other
  modified_base (13551)..(13560): a, c, t, g, unknown or other
  modified_base (13625)..(13634): a, c, t, g, unknown or other
  modified_base (13761)..(13800): a, c, t, g, unknown or other
  modified_base (13864)..(13873): a, c, t, g, unknown or other
  modified_base (14320)..(14329): a, c, t, g, unknown or other
  modified_base (14591)..(14644): a, c, t, g, unknown or other
  modified_base (14864)..(14873): a, c, t, g, unknown or other
  modified_base (15101)..(15157): a, c, t, g, unknown or other
  modified_base (15406)..(15489): a, c, t, g, unknown or other
  modified_base (15927)..(15936): a, c, t, g, unknown or other
  modified_base (16116)..(16125): a, c, t, g, unknown or other
  modified_base (16373)..(16382): a, c, t, g, unknown or other
  modified_base (16670)..(16679): a, c, t, g, unknown or other
  modified_base (17285)..(17294): a, c, t, g, unknown or other
  modified_base (18168)..(18220): a, c, t, g, unknown or other
  modified_base (18734)..(18743): a, c, t, g, unknown or other
  modified_base (18917)..(18926): a, c, t, g, unknown or other
  modified_base (19979)..(19988): a, c, t, g, unknown or other
  modified_base (21635)..(21644): a, c, t, g, unknown or other
  modified_base (22426)..(22435): a, c, t, g, unknown or other
  modified_base (23813)..(23822): a, c, t, g, unknown or other
  modified_base (26768)..(26777): a, c, t, g, unknown or other
  modified_base (27022)..(27031): a, c, t, g, unknown or other
  modified_base (27462)..(27471): a, c, t, g, unknown or other
  modified_base (27571)..(27580): a, c, t, g, unknown or other
  modified_base (27767)..(27823): a, c, t, g, unknown or other
  modified_base (28620)..(28629): a, c, t, g, unknown or other
  modified_base (28724)..(28733): a, c, t, g, unknown or other
  modified_base (30368)..(30377): a, c, t, g, unknown or other
ccaccacccccacccgcccgcctcacgtgtggttggtgtaggccagggacttggtggtgatggcccaggcctcgtcccaggccaggccgtgcacgtcggtgagcaggcgctggagctccgccacggcgatggtggggtgggtgtcgttcatctggaacacggccttgtccggcagccccgccaggtcagagtgggtggccaggtagcgggccagggtgtcctgcagcgaggcggagacgaagaagaactgctggcgcaggcgcagctccttgccgtactcggtggcgtcgttggggtacaacacggcggtgatgtcgtcggcgcggcgcttggcccccgtggcgccgtcatagtcgccgacgttgaaagcgtccaggtcgaactcggcgacgggcttggcattccacaggcgcagcgaccccaccgtcgtggtcttgtagccggggatgggcacgtcgtaggcctcggcgatgacctcgtcgccgggcgtccaggacgcgccgtcggaggtgccggcaaagccgacgcggtaggtggtgtcggggcggcgcacctcccatgggttgccctcgtctaaccagtagtcggggacctcgatctgatacccctcccggatgacctgcttgaacatgccgtagcggtagcggatgccgtacccccacccgggcaggtccagggtggccatggagtccaggaagcaggccgccaggcggcccagcccgccgttgcccagcgccgcatcgcgctcctcggacgccaccgtctccagcgccgcgccgtagtccttcaggatcgcaccataggcgccgcccaggcccaggttgtgcacggcggaggtcagggtgcggcccatgaggaattcggcggaaaggtagtacacctgcttcacatcctgttcgcgccagtggtcgttggtggcatccagcccctctaccagccggttgtgcacgctccaggccaccgactcgtacagcttggcctcgttgatgctctgtggggccactcggtagcgcagctcgtgcaggacgtcggcgcgtagagcctccacctccttgtcggggctggtgccgttggtgatggtgggcttgggcaggtcgagcacggcccggatcctcaggcccgaccgggcaggggcccggatggacttcctggaacccaaacgggagcaggaatcggggcggaggcggggggccccgaggtgtgtggcgaggaccggcattgcggtcgcgggctcccgggttgttaagtgggggagggcaggcgagggccaagggcaatgtgccgtgcacgtcgagagaatgatccgatgctgtcagacgcctgatcaatatatgatttgagtggttttgcggctggtgccagtttgtgcgcagggagtggctgctgatcgaatgtgccagcacccatgcgcatcgacgggcgcagaggcactccgacgaaggagggcattcattacgtaaggtattttacagcgcgcccacagggaccagcatggagggggtggcgatagcgcgcccatttgcgacagtcagtggaggctgcgggccaagctcagatgccaaggcgggtatcaggagtctgcataaaggtaacgcagcggcggctgggattgcctgcacccaccgcgcccgctccgggaggtgacgcttgtcttgggacccaatgacggccacgacggagcccctgacggagctgaaatgttttaagtgccagaagcccgccaagctacaatgtccaaagtgcctggagctggatctagagagggaccatgctgccttctgctcccagcagtgcttcgcggtacggtgcatgctaggggaggggtgtctctcctcaccaagcttgccaataaggcggtagctcagcctctggaccacaacatcagtttccatgatctcgacctccaccacttgcannnnnnnnnngaggcggtaactcagcccctggaccacaacatcattttccatgatctcgacctccaccacttgcatcgcacacaggcgtcatgggtggaccacaagcggctgcaccgcccaggcccagatggctggcattatgcaacccgccgaggggccgggcgctccctgaccatgccagacttcaactggaccggtcccctgcggccctggcggataggcccgatgcgttcggtgaggtgtgggctggattcacatgttctggggctcatgttgctgatacccaccttccatttcgaacgagctccgcaaaccgacccagccaatgccacgcagatcccggactccattcccaagccggagtggtacctcaccggtcgagcagatgtggaggtgtccagccgtcagcagcacactcgtgagaggaggtgttgtggctggtctcatgggataggagttggggctggaaggcaggggtggtgtgttgaggtgttccatctacgattcgaatgtcaagggatgccctgcggcttaccagcagggggtgctttcttgagaacccaaacatgcatgatgcagtgccgtgtggagaatcacagttgctgattctggctcctttgctgcaatgagagcacgcatttctacccaagcatttccaccatggcctcgcctcggtgccccacagccatcccacgcttcggcaaggcggccgagggcatccgcgcagcgtgcaccttggggaggaaggtgctggacctggcacacgccgccgtcgccccaggcgtcaccacggacgagatcgatcgcgtggtgcgtacggggcggagggaggagggaaggcagcgtggtgcgtatggggcggagggaggagggaaggcagcgtgggcatgggcggcggcaggaaaggcttcccttgtagctggccgtttgacaacagcgcttccaggaggcacatgccaaacgcgcggcggggtggctgggctcacgctctggcgccattgcctcaagggcgccctgtgagtgatgaccccgaagcacctgcagtgtgcaccgggcaggggatgaccaaaactcgcgtgcctcaactccctgatgccagatgtccccctttcctccaggtccacgaggccaccatcgcggcgggtgcgtaccccagcccctacaactatttcaacttcccgaaatccgtctgcacctccgtcaacgaggtaagggggccggtcattactgcaaggacgtgcaccctgcagagctcagatgtgcatatgccccacagctgtcacagcaagcatggctnnnnnnnnnntacagcgcttccagcaggcacatgccagacgcgtggcgaggtggctgggctcacgctctggcgctactgcctcgagggcgccctgtgtgtcatgaccccgaagcacctgcagtgtgctccgggcaggggatgaccaaaactcgcgtgcnnnnnnnnnnnnnnnnnnnnnnnnnnnnnnnnnnnnnnnnnnnnnnnnnnnnnnnnnnnnnnnnnnnnnnnnnnnnnnnntttggagccctggttttgttcgtggttttctgtcttgtggtcagaactgggtcggctggtcgccccaggacgtcctaccctcttcattcatgccctccccaacaaactcagccccctcnnnnnnnnnngtccgacatgccctcgggcacgcacccagtccacacatcccacacatcctgctgccgcagatcatctgccacggcatccccgaccggcggccgctggagaatggcgacattgtgaatgtggatgtctcggtctacctcaacggctggcacggggatctgaacgagactttcgtggtgggggaggtagatgacgtgtctaagaagctcctcaagaccacgcacgaggtgggttgatcttggagccctggttttgtttgtggtttccggtcttgtggtcagaactggtttggctggtcgccccaggacgttctaccctcctcatccatgccctccccaacaaactcagccccctccacccaaccccaacccccaccccatgtctccgcagtgcctggagctggccatcgcggcgtgccggcccggcatgcggtaccgcgacgtgggcgacatcatcacccgccacgccagcgccgccggcctcagcgtggtcaaggcctactgcgggcacggcatcggcgacctcttccactgcgcgcccaatgtgcaccactacgcgcacaacaaggcgcggggtgtgatgaaggagggcgaggtgttcaccatcgagcccatgatctgcgtgggctcgcaccgcgacaagacctggcccgatggctggtgggcgatggcctggggtgtactcattgtgttggtgtttatggttttgcttttggggggcgggtgtcttatggtgtcgtttgggatacagtactgttggcaatagtgctgaggaactgtctgacagaaaaggggatggggtctctgannnnnnnnnngcggcctggggtttactttttttgttggtgtttatggttttgtttttggggggcgggtgtcttatggggtcgtttgggatacaatactgttggcgatcgtgctgaggagccgtctgacagaaaaggggatggggtctctgacatccaggggccgcggtgccttgctgcagtgcgcctggggttcctcggatgcgagcgtgtggccgcagcagtgagccaacattatgtttgagacggcgccgcacgagtctccgcttcccctcccccccaccccaacacacatatcccccccctgcctccccaggaccgctgccacggaggacggcctgcgctccgcccagttcgagcaccagctgctcatcacgcctcagggttgcgaggtcctgacagcccggctgcccacctccccgcccctttggtgggaggtggaggatgcaagcctggcagccaagacagggcaggtcctgtccgtttgagactgggactgacgcaacagtgtcagacaggcaccggctgggggcctggcgctgcccaccaggttccctgatacctgctccttttgcaccagtgagactctgctccaatagtgccccccctctccctttccccctcacccccccaccctgtccccttctgcccgacagcagtagtatctgtacttgatttacannnnnnnnnncagtgccccccctatccctttccccctcaccccccaccctgtccccttctgcctgacagcagtagtatctgtacttgatttacaggagacgtggctcacccaaaccgcccaaggttcaaactctaagcaggcgaggcaagagaaccgcagcaatgttgagcattcttctcgtaccagagtattccgcagctgtcgccatatgggaaaggggagaggagggtcaagtgggcgaacagatgctggacctgggatcaccatcctcttgggcgtgcggtagaacgacaccatccatccaggcacccaggatattgggactggcagcctcaagtcattccaaggactgctggactccgggaaccagcccaggaccttgcatgcaacaacatgcaccacaccggtgacccaaggatgttggattgcagtgccgccccacccgccccctcaccccacacctcccccgagccaggctcacccttccagttttctacaggaggcgtcgtcccgtgcgctctacttgacctcctccacctcgtccagggagtagttgttggtcgtcacccccgcgtagttcacgcgctcgaagcggaccaccaccgggtaccggatgccgctctggtccactgacacaaccttgccgacctccctgaaccagtaggactcgggtcgcttgatgcgtacctgcccagtggggggaggggagatggaggggtggtgagcgacccggggtggtgagctatgtgctccccattgtctcaggtgctgagagccagctgaacacgcacagtcagatgtggatgcttggagcacaggaccccaaccctccccagggcacacctgggagccgcgcttgggcccaatctcgggcttcttctccgccttctcgctcttcgtgtccggcttgtcagagggctgccccttggcgggagtctgcttctcctgtgcccgaacgaccagcctcacatgcctcccggctttaggtcctgcgggtggtcagaaggcggagtgaacacattgcttgggcagctgcactgcgacaggcgcccatggtgccgggcgtccctgccacccggggctgcacctgcgggacaggcgagcttgccggtccggccagcaaaggatcgcgcgctgatcgactggcacgactgcatcgtacttgaagcagggtatcgaatcgatcgggatgaatgtgggcacgattttcggtcgaatcaccctctatcggggcatgggaccggaatgtcatccgcatgacctgattcgggatactggtggcccccaacaagaccctcagggtcaaatgacccgctcgattgaagacccacgtttgcaagatggacaatcctcacccgcgatgcggggcaccctgatcgggagccagcggcagcattgatcacaaatgacaagcatctggcacaaagtcgccgcagtgggcggcgcgaccgcggttgcagctggcgcttatggctcgcacggcctagcccacctggcgcccacgtatcggacggtattcgagacggccaacaagtatcacatgatccatggcggaattttgatggcccttgcacccatagctcggtaggaagggtcgatggtgcgcttgatcacgcgtgcagtcggtggggtgggaaatatcttggcaatggcgccatggacagagacatctaaatggttcacgcaggaggccaaacctggtcgggggattttctctggcaggcacccttctcttctctggaaggtaatgagtgggtggcnnnnnnnnnngtatcttggcaatggcgccaccccccagagacatccaaatggttcgcaggaggccgaacctggtcgggggggggattttctctggcaggcaccctcctcttctctggaaggtaatgagtgggtggcaggttgtcactcgacttgttcacttggctgcacagcagatgcgagctgaaactatcacgccacaagccgtgcagctgctatgtcgtggcgctgacggaggacaggagctttggcaagctggcgcccattgggtgcgccggtgaagggttgccatgcgtatccctgggatgcatgtgttccacagctcagccaagagtgtgccacacagaggcaccattccctccatcccttaccacagaggcttcctcctcatgnnnnnnnnnnatcagccaagagtgtgccacacagaagcaccattctctctatcccttaccacagaggcttcctcctcatgggcgcatggatatccctggcactttgatggaccaggctcccacccccagcaacattgccatcaccctcatgtaacaatgacgctcaacttcttgagtcctggctctgggcatagctcggcccttcgcttaaaattggcaagcaagatgtgtgcagtactaaacccggacatgaatgtatacacatgtataatgtacagggaggaagggtcgcagtgctgcaatgcgtggccgtgtgcaacaatatggtgtgtgctnnnnnnnnnnacaagatgtgtgcagtactgaacccggacatgaatgtatacacacgtataatgtacagggaagaagggtcgcagtgctgcaatgagtggccgtgtgcaacaatatggtgtgtgcttggcgaggccatgctttcttcctcccaagcagcagtctgcagggggaacgggaccccgagccgggccctgcggcgccannnnnnnnnnctttcctcccaagtggcagtctgcagggggagcgggaccccgagccgggccctgcggcgccagcccactgcacttgcagggggagccagcactcgcagcggtgggggaatgctaggcaccccctccccatctgccatgcccatcaggggtctgcccggcccccctgttgccagccgcggccgacgaggaggaggggctcctcggcctcnnnnnnnnnngggcaccccctccccctctgccatgcccatcagggatctgcccggcccccctgttgccagccgctgccgacgaggaggaggggctcctcggcttccacccgctccgccatcaggcgctgcaccccgtacatggccacgtaggccagggccaggacgaggaggaggaccgcggccacgcgccaggagggccggtcgccctgctcacccccgtcatcgccgtcgccgccgccgccgccgccgtcgcgtgcgccatcccctcccttgcgtgcgccggggagcgctgctccccagggcggggagaaagggcggcagcggggcggcacctcggcgccgcgcggcagccgcacgtctgcgccgcattttgggcccggccgcaccgcgggcgggcactccatgacacgtagctccaggtccaggcacatccacacctccaccagcgtgccggcggtgcaggagagcagcggcgcggcgccgtaggcggcccgcaccgcgtcctgcaggtcctccgcggcgtagttgccactgctggagggcagcacccccgcgttccccagcgccacctggcggaggttttgggggggggaggggggagtgtgtgagagcgagggagaaggggtgatgggaggctgagatgtgacaggcagcgagctggtggaacgctggggtccannnnnnnnnngaaaggtgtgatgggaggctgagatgtgaagggcagcgagctggtggaacgctggggtccaggaagtgggtgggaagttggcactgcgccgtggattaggcttgccacagggccgtgccagctgcctcaaacgatacaactccccctgatgtcccgaggcacgagcaacaagaacaatcttcctgagagcagctcgacccctcctctgcccgccccgctcacgtccnnnnnnnnnngcccccgtcgccgccgtcgccgccgtcgccgtcgcgtgcgccatcccctccctcgcgtgcgccggggagcgctgctccccagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagtcgccactgctggagggcagcacccctgcgttccccagcgccacctggcggagtttggggggggggggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgcaaaaagaacaatattcctgagagcagcgcaacccctcctctgcccgccccgctcacgtccaggttgtacttttcgtgcagctccagcaccgtcgccacaaaggcggtgcggttgcccagcagcggagccgcgcaggtgccgtgcttggcccactcgtgctcccagaacccggggctggggccgatcaggctgggccacaggcagttctgggcgggggtgggcggcccggcggcctggtgggtcgtgtgtgccccgcagaactggggccagcccccggtcttgtactcgggccacaggccatggatggtgaacgaggagctgcgcgaggggagattggggccaggggaagattcgaatctagggctctcgcccaatgagacagacaaggtgggggcctgcacgtccaggaagcagcggcagatacctggcgggggtgtggcagtgctgatgcgaacagaagccgggggggtacgacctgaccaggaggaggaggtcaaaccctgggctgggcagggcctccccagacgcgcccgtgaggaggcagagggcgcacacaagcaatgccaacatcatccgtctgtagaaacatgaagaatggcgagcagctttgtcgactaaatttgctggcatattttttagcttcggaggaacgcagcgccccgattgccgacgatggcccacgtgccggatttcgaaacgccctcactccgccctcgatacccccatcctatatccctacccccccagccaagccgtcttccggccccgcccatgcattgagcaccaggttgataatgacaagatcatgagtgggcccggggtctcaccggggaagaaggcaccgtcacctgagatcacaacccgtgcaccccttgccaccatgtcgggcagcaccgagccatcttcctgggcagaggagaggaaggcgctcgagcttgaggtatgattggggcggttcaactgattcatcgatgcgtctccgaggcnnnnnnnnnnggaggagaggaaggcgctcgagcttgaggtacaattggggcggctcaactgattcatcgatgcgtctccgaggcggaatcgggttgcacgggccacacccctgcttaccttgtcgtcccaccccgcggtgcagcttgcggcggagcgacgacgctgcgcgtcgttgcaggaggagctgaagaaggagaagcagctggctatcgcgcgccagctgcaggcggaggctgaggaggagaggctgaccaacaagctcatgcagaggttggacgagctcaagacggtgagcgggggaggggctgagtagatgggcaggggcaggggcaggtccatgggactggttgttgaaataatgagcaggcaatgaacggtgctgctgacccattatcaggtggtatggctgcgctgcatcctcaaatcgccccgctccacactgcctcgcccaggccaagctcaccttgacacccgaggtggaagccgaggaggggctggttgccagcctnnnnnnnnnnnaaggccaagctcgaggccaagctggcgtccgatcaaggtgcgctggagggtcctttcatacagaagtatggggtttccgacggggaataccacgtcgtgaggtgaaggccatgtgatcaggagggcagctgggnnnnnnnnnngagaagtgtggggtttccgacgtggagtaccacgtcgtgatgagaaggccatgtgatcaggagggcagctgggccaggatggccgtccctgagtggtgtccggcgtcccttgttcttgtcgaggcccctccctgtttttgaggggtaagccattgccctactcccgcaccaggcatcccttccttcccaaccaccgacacctgataccnnnnnnnnnngtatccggcgtcccttgtgcttgtcgaggcccctccctgttttaaggggtaagccgttgccctactcccgcaccaggcacctcttccttcccaaccaccgacacctgatacctaacagtgaccctctcccctccttccccactgttgtgtcgcggcacagactatgtggccaacaccctcctgcgcaagatccgggaggtggaggccgagaagctcaagctccagcgggacaaggcaaacctggagaacacgctcgaggccgagcaggagtacatcagcaaccgcctgtccaagcaggtatgtgaagcatggttgctcaatcgccgggtgccctgggcatgtgggagtccggtgcggtcgttgtgcagcctgcctgccgtctgcatgcctgcccgtcactggttctccactctgcccatcctctggccccccccatcgcgctctcctccagctggagcagctggcgatggagaagaacaccatgatgacggagaagctggagctgcgccggcaggtgaacgagctggccgcctcggtggacaagctgaacagagagaaggtggctctggaggcccaggtgcgatggctgggaggggtccacgggtcccggggaagcagggccaggaggtggagggtgggctggtagcacccattgggtgcctgggcgtccagaagccttcctccatgcccccccccccatgtcactcgtgcagtttgagcgggaggaggagcatgtggtgaacaagttgnnnnnnnnnngtgggaggggcccacggttcccggggaagtagggccaggaggtggagggtgggctggtaacacccattggttgcctgggcgtccacaaacctacctccatgcacccccccatgtcactcgtgtagtttgaacgggaggaggagcatgtggtgaacaagttgcagcgccagctgcaggctgtcaccatcgcctactgcaacctggagtccaagctggagagcgcaggcatctcgccgcgggagtccggcggcccaggcttggaccacaccatagagtgcgtttggggtgggggggacttgccaatgattgccacaggcaggcgacgaggggtgttcagagtgtgtgaggggcagcgccaggaggccggcagatccagggcggccggcgagatgtcctgcccccgaggcaggtctttgcaagagacagtgcgactctgcctctgcctccccagtttcagagatgcccgcccgcccccagcgtccaacccgaccccagcgtccannnnnnnnnntcccgaggcagatctttacaggagacagtgcgactccgtctctgcccccccagtttcagagacgcccgcccgcccccagcgtccaacccggccccccgnnnnnnnnnngggtttacgggcgcagcccctcccggcacagcacgcgcctgacgaccgacgggcgggaccggtcgcgctcctccagccgcacgagctccttcaggggcggcgcggcgctcgcggcggccatcggcacgccctccgccccgggggccaccccgcacggagcgcaggagctggcctccccccgggtctccctggcgcggcgctcctcctcctcggtcacctcccgctcgcaggaggtgccgacgccgggcgagggcgcccgggtcgccggcccacgcgccaccgcccccgtggggtgagcgcgctgacggggatgtggagtgcccggccggtcccgcggcctgccctgccctaccgctccatgctcctccattgccgcggcagtgttgcacccaagcannnnnnnnnncccctgccctaccgctccctgctcccccattgccgcggcagtgttgcacccaagcaccctatgtgccccccgcttccaagcccctttgcgctgtcctgtgccccccgcttcccgcccccggcaccctttccacgtgtcacattcacccgctcaaggcatcaaagcgtgagcagatgcacggctgcacatcatccctcagtcgccgaggaagagggccaggctggcgcccacgtccagcaggccggcctccagcagggtcgtcacgcgcttgatcctggagaagtcggacgcgcgctccgccagcgcgcccggccccgccagccccgcgttcaccaggtccagcacgcggagcagctgtggggggggggggaannnnnnnnnnagctgcagggctcatctctgccgtcgcgccggcggccgcccctccctctgccacgccaccccaannnnnnnnnncggcgggtgagcggattgtgtgcggctctgggtctggcaccgggacgggttgccgggggcaccgctgcagggctcctctctgccgtcgcgcctgcagccgcccctccctctgccacgccaccccaannnnnnnnnnnnnnnnnnnnnnnnnnnnnnnnnnnnnnnnaccgacacgcagagtccttccggtccgcacgcaagcatgcaaacacatgctcacgcacctcggnnnnnnnnnngccgacacgcagagtcttcccgatccgcacgccagcatgcaaacacatgctcacgcacctcggcacgctgactcagctcgtgtgccaggcgggcgtgcaggttgcccgccgccaggaacagctcgatcgtgaaggccgcgcaggcggcgcgcacgtcggcgcgccacaggtagaaagtgcgagagggcgcgcggtccgcggtgcgtggcacgtcctgcagcgcgatgtacctgggaagggaggaaaggagggaaatgggaaggtgggtgctcgagggtgggggagtgatgaagggggaggggtttggcgcagggctggaaagggatgtggagcgccccgaggagtcccaggagcacgtcaccacgcagggcccgggaggcggggggcccgagagaggcacaggcaggcaagaggatcagggtaccatcccgcgcccacacccccaannnnnnnnnnagagtcccaggagcacgtcacgacgcaggggccgggaggtggggggccgagtgaggcacaggcaggcaagaggaccagggtaccatcccgcgcccacacccccaaggacgcagaacagaccagccccccctctgcgcacccggccttgagcatggcgtgcagcttgactttggcgtccttggcgtccatcatgcagaagtccgccacctgcttctgctccagctggcggcaggcgcggagcaggcgccagatgcgcaggccnnnnnnnnnnnnnnnnnnnnnnnnnnnnnnnnnnnnnnnnnnnnnnnnnnnnnntccaggtgcccctggcgcagcgcgcccagcgcgccggcgatgtccaggctgtactgccgcgcgccggcgggggggtcccccgccgcgaccacgggggaggcccactctgccgccaggctggaaagcgtgccggggacgtcgggggccggccccgcgcccgccgcgtcgggctcctgaaccgccaccgcccgcgcgacctcggcctcgctcaggagcacgnnnnnnnnnnatgtcgggctcgtggaccgccaccgcgcgcgcgacctcggcctcgctcaggagcacggtgcgctcgccgtcggcggcaggggcgccggcctcccgcagccgggcggcgtgcgcggccagcatgccggccaccacggcccccgcggcggggccgtgcctggagcccatgtggtcggcgatggcctcgttgcgcaacctgcgctcgtgggacatggtggagagggggggnnnnnnnnnnnnnnnnnnnnnnnnnnnnnnnnnnnnnnnnnnnnnnnnnnnnnnnnnggaaggattgggagggtggacgacggggcagggtgagggtggacaacggggcggggtgagggtggacaacggggcggggggaagacagacgggtgaggggatgcagaggccgaccagagtgtcggaaggacgcctaggatatggtgggaaaggagcgcgtaggctggaggtgcagcgaatgcaatcagattcgccgatctgagttggtgctccctcctcctctcctgatatccttcctctggccccccnnnnnnnnnnnnnnnnnnnnnnnnnnnnnnnnnnnnnnnnnnnnnnnnnnnnnnnnnnnnnnnnnnnnnnnnnnnnnnnnnnnnactcctcgaggctgacacgccagaggatgtttgccgcaggcaggtcggcggcctcctccaccccggggactggctggggggtgctgtggcctgctggaggggctgcggcgctggatgcggggagcgacgccgctggcgtggcgctgggcgcactctggcccgagtccgccttgacgcgtcggcgcccccgtttggggggaggcgggcaggccggaggcatggaatctgggaagggtcgcagggcaaggaggggttgaggctgtacaggtgcacagggtggcaacaaagaggctgcagatggcgacgcccgcagcctgacgccacgcacagcccaggatcgtgatgccccactggggaacaacctccagcgcaccaggacagccagacctcctcgagcacccctgtcggacctcacctgccgtccgcttcccacccacnnnnnnnnnntaacaacattcggcgcaccaggacagccagacctcctcgaccacccctgtccgacctcacctgccgtccgcttcccacccacagacccattcgcctgcgcgccagacgtgctgagacctccgttcgccggctcactggcgagggaggcgccatcaggggcccgagccggcaccgccgtcnnnnnnnnnncggcctgtgcgccagacgtgccgagacctcccctcgccggctcgtgggcgagggaggcaccatcaggggcccgagccggcaccgccgtctccaccaggtccgtggggatcttgaatcgcactgtgtagtccaggggtgtgtctcaggggtgcgaggatacagggggacagccgcggagtgcagggtcggcagcggaaggctctgatgcaggcccgatgagcacagagggtcagagcgaggcctcgccnnnnnnnnnngcagagggacagccggggagtgcagggtcggcagcggtaggctctgatgcaggcccaacgagcacagagggtcagagcgaggcctcgccccacctcacccactcaccagcatggtaggcggcgtgcgcttgatcctgggccctcgcacgcagctgttcggcctcctcctcgctcccgggcttggtagcgggcttcttcttccgcgcatttgggtgtacctgggaggttgcaggcggcagcagtgagagatgtgcactccggctgtgcaaataatcctgatcactgcgnnnnnnnnnnggcgggcttcttcttccgtgcatttgggtgtacctgggaggtcgcaggcggcagcagtgagagatttgcaccccggctgtgcaaataatcctgatcactgcgcctcccgcctcgtcaggaccaggtggttgagcaaacaccagcatcccctcgacagcacactccctcctccgctcacctcgcgcctgggtggcggcaggtggcacaccggcgcccgctccaccagcctgctgcgcacaaggcgcaaaagcgccgcctgaatctccaaggcaggccgctgcggggttgtctgggcctcctccccttgcccctgggacgcggcagctgcatcctcgctctgcagggcagccacgacttggtccagcctgccaagcatgagtgtgggacggggtgtacacaacggcagagaggctgggtggggcgttccctcccagccatacacaggagcatgccgggtgtgggggtatgcacaggcttggcagcccaaggcgctccgtccctggattcgattcctgcaatcactgcacatggccgccacgccatgccctttgccgccggtgccttgcagatcgcagcgccacagtgcacctttgtcccccatcaccnnnnnnnnnnactctgccgccgctgccttgcagatcgcatcgccacagtgcacctttgtcccccatcaccgcatgatgaagcaagtcaagacaccccccgttacccccctcccgcacctgagacgcccatgctgcaggagcttgagcgccactgcctccgcagtggcgcccaggctgtccttgacgtggatgaggtagcgcggggcatgcaggccatgcagcatggcccggggtagcgcctcatacagctgctccacgcgcgactcgcccctcaggttggggggctcggcgtgcagccaggaggccacgcagttgtgctgcatgagcactagcagcgccgccttcaggtggggcagcggcaggccggcggagcgtcgcaggtcgcccaggctctgtgtgccatggtacagcagggcccttgccacggtctgatgaaggcgtggaaccgagggggaacggggaatgaggggaggtgggaggtgcacagcggcgaaggactcggggagtggactctggacaaggtacaggctgggaggcctagccaggggaccccatgttcatgaggcggagcgccctcgcatattcatgccaacacttggatctcacaactcactctacacgtctcgccaaactgctcctccaccagtttgagggccaggcgggtggcagcggggtgggagcaggggtcgtgtaggcccgccatccccctctcacgcccgcccgatggttggcctggagggcggactggcgagggcgctacagcatgtgtgcatgcatggctgagccatgcacagatcaggacgcagcagcacggcagcattggggggtatggtggccccccagcacgccggaacacgcacgtgctcgcgcgctcggattctctnnnnnnnnnnnnnnnnnnnnnnnnnnnnnnnnnnnnnnnnnnnnnnnnnnnnncacatggagtgataccataacaataaagcgttcaaaggtgactgggggagcaaggaggaggaggaggggtcggcattcgcgagcgtcaggggtggcacaagggcagcaggacggtggaaataagtgcaaggcgacaggggggggtggagacaccacacgactgcatggatacacgtcacacaaggaagggtcgtacacatactgagaatacataggggagccggcgggtctgacacaaggtcgctggcggactgggagcaaggtgactgggtctagggctggacgagcctgccccgaaagtctctgacacgggcagggagtagtatttgtcgaagggggcccaatcaggccgtcccccgtgccagatctgggctgcagggcacaggtgctacaggaacgcttgccccaggcgggtgtgcgcctggggtcgcctgtgactggggatgcccatgcacgacacgctcatcggtgcggctgcggcgacgccgcggcccttgccggcggggcaggtccnnnnnnnnnnagtgggcccctggggttttgacggggcgaggctcggggcaatttttgatgccaggccctccctcagccttcaccaaaaacaaacagggcggtgcagctgcaggcaatcctgccctcctcctgcacaaccaaacctttcccagccttcacctccctcccctccgacccagccccnnnnnnnnnncgcccaacacgctcatcggtgcggctgcggcggcgccgcggcccttgccggcggggcaggtccgacactctcttgtaccggctgggcaggcccgacggcctcgggcttggccagcatgagcagtgagccctcgctgctcacgaccacggtgggcccctgaggttttgacggggcgaggctcggagaaattttgatgccaggccctcgctcggctttcaccaaaaacaaacagggcggggcagctgcaggcagacctgccctcctcctgcacaaccaaacccttcccagcttttacctccctcccctccgacccagcacatccccccacccccctcacctggtgacctgggggcacgccgactgcccccccctcccttcccagctccagctggtacatgggcacgggcttgggcgcggcctcccccggctcggccgccaagcccgacagccgcgcgcgcaggcgcgtcgtgcgccgcgccgcgcgcacgtaggccagcacggccagcgcgatggccaccacgaagacggcgccggtggagagcatgatgatcatgatggtggggtgcacgccgccgcgccggtcctcggcccccagaccgtcggcgtcggcgtcgccgccggcgccggcgtcgccctcacagttgacgcactgcagcacgtactcccccgcccgagcgtcctggcaagcccacatggtggagctgagctgcaggaactggtagtgcatgaaccagcaggagcccacgccccagccgatgagggtctgcgcggcgccagccacggggatcagggtcacgtggcaggccaccccctccaggcaggagagccgggcggcggggctaaagagggtgaaccgcgcggagtgggaggtcaggcggtcggcgtcctccatgcccagggtgatggggtagaaaacccggcctggggggtggggggaggggaggggacggcccggattggaggcgcgcagagggactccgggggggcgcgtgagggggtgtgaggggggggacgggcaaggtaacaatgacgacacccccggccgcccgcgannnnnnnnnncgaaaacccggcctggtgggtggggggagaggaggggacggcccgggattggagacgcgcagaggggactccggggggcgcgtgaggggttgtgaggggggggaccggcaaggcaacaatgacgacacccccggccgcccgcgagggaccccacaccgcgcggcaccgccctgcgaccagttccagatgcaattacccgacttccatcccaattctcacccgaggaggtgtggcatgccacgagcacggtggttccgggctgacccacgagggggctcctgacctcgacacgccgcagctccagctccagctcagtgcaggtcccattcccaccgggggccgctggtacatctgctgcgtctgatcaagggacaggaccggggtgggagctcctgagatgcagtcctgggaacgcagaggccagccccgttcccaagggcaccaactccccgtaatgacgtcgatgagggtgatccaactgaccgatggtctcaaggatgcgcggtgtgggcccttgctcagtggagcgaaacgttaggagatctcgggagccatgacatgtgtttctcaggcttagaagggccagcagggtcacccacgaccgtgcgagcaccgccatgccccactggtcaagcgaagccaggtggcgcagtcgttctaccaagttctcattctgacaatgcaatgcctattgacgaagcatcgcacgagtacggctcatgagtcggacaccttgcgtgcctggaagccatgcacgaagctcacgcaccctctcatcacgatccaaactttcacgcgggagtcctcctccagacccactagccaggtacccacagccctggggcgacatcgtcggcaggattcgagagatgcatcggtttattgtgagtactagagtcctattgagctgttaattcggagcgcccacctgtgagacctcccagcacaagccatcgaggggtgggagtgcgtcctgactcgcagcctggccccaaccagcgtcgtcgcaggatggctaccaccctgcttgagaatacacggcagcagcatgaggacatggagcgcttggagcgtctcatcgtgaaagactttcgcaccgagacaaaggcatataaggacaagctgctccaaagccatcgcgtgcgtggcctgctggatgccctacagtcccgcgcagcagcactggtacgtactctgaggctggtggggagcgattgcatggggactgcgtgttgcggatgtaagcaagagccatgggctggtggattggccgtcggacaaccagttcctgcacttgacaccggcccctcctcataggtggacatctacaaggatgaagacgagtctcgcaaacaggacattgcagctttgcggggcgccgaccccatcaggtgccgagggcagaggggcatgggtgtttggaggctctggcatgctctttcctgctggggaccccctggacctgccttcccagccgtccattgatgttcgcaccctgtttcccaaggggaccgactccatgccaagctcgagggtcggtggccctggatcctggaaaacccctaaaaagtgcccagcgccctcacatgacacgcatctacacctggggccaagcgccccctcctggcccccccccccacccttacnnnnnnnnnntcatgccaagctcgagggtctttcgccctggatcctggaaaacccttaaaggtgcccagcgccctcacatgaaatgcagctacacctggggccctgcgccccctcctgccccccccacacaccctaccccccacacacacccatcaccacccaatacacgcagcaccttctacgaccggctgaaggaggtgcttgcctaccaccgccgcttcccgtccgaggacatcaccgagggcgacggctccgaggcgctgctggcggcggctgagccggcggtggccttcagcggcgaggaggccctggggcggtacctggacctgcacgagctgcacgccgcgcacagcaacggcgcctttgccggccagcccctggactaccacacctacgtcctggcgctggcggactggagccgcgtggcgcgccccgcccgcacctcgcgcgcctaccgcgagtacctggagcgcctggcggcctacctggagtccttccacgctcgcacgcagcccctggccgacctggacgcgcagatgcggggcgcggtggccgagttcgaggaggcctgggccaggggcgccgtccccggctgggaggaccggggggcggggggcgccgctgctgcgggcggtcgtggagaggcccccgagggggccctggacctggatgcctttgactccgtggacgaactggagctcctgggtgggcaggggctgggagtgggggatgcgggaaagggcggcacccgatccagtgtgatggaccatctcgcaccgaccagtcgacgnnnnnnnnnncatgcgggaaaggggggcgcccgatccggtgcgatggaccatctcgcaccgaccagtcgacggccggaggagcctgccctgcccaccaacccctgccatccgcctgcagcccacctgccacccatctcggccccggcgcccactcggacaccgcacacatgcacccaaagcctcacccccccgccccgcagacccggagcgcatcaagcaggccctgcgcgcgctgcacctgaagtgcggcggcacgccccgccagcgcgcggcgcgcctcttctccacgcggggcaagacccccgatcagctggacccggccctgttcgccaagggcgccgcgcccgccgcggcgctgagccaggcccagcgcgagcgggccgaggcagccgcgcgcggcgcggccctgctggaggcccgcgtctcccgcctgctgcgcctgctgggcacggtgcaggccgacaccgcgggtcgggtggagaagcgccaggcgcagacctacgaggagctgctggcggagcaggccgaggccgaggaggtgagtgcttggagggggtgagggggccgtggggatccacgcggctgtgcacggcgcgtgagacggggattggggaggagaggtgggaggatgaggagccggctcaaggggacgagtacgtgctggtcatgggaggctggctgtagcgctgcctttccacgcaagggtgcacggcggcatcagcactcaagggcaatcatcgccccctccgtcacccgcccaccacccatcaaccccaccaaaccccctctccccttccaccctccccccccaacaggagggcgacctggtcgaggaggactcggacgaggaggcgcccatctacaacccgctgaagctgccgctgggctgggacggcaagcccatccccttctggctctaccgcctgcacggcctgaacatcgagttcaagtgcgagatctgcggcggcgcctcctactggggccgccgagcctttgagcgccacttcaaggaaccgcagcaccagcgcgggcttaagacgctgggcgtgccgtggtcacgcgagttctacgagatcacctccatcgccgacgcgctggcgctgtggaagagcatgcgcgagcgccagcgctcgggcgcggccccggggacggaggaggagtttgaggacgacgcggggaacgtctacaacaagaagacctgggaagacctgcgccggcaaggcctggtgtgatgcgaggggctggcagcactgtgacaaacagggggggaatgtggtgttgtgtgacacccagggtcggcccaatctgcgaggctggcgaggaattgctgtacactatccttctccaatggggacttgacacctgggcggcatcgatgctgcgcgannnnnnnnnngcggcaaggcctggtgtgatgcgaggggctgtcagcattgtgacaaacaggggggaaatgtatagttgtatggcaccaagggtaggcccaatgtgcgaggctggcgaggaatcgctgtacgctatccttctccaatggggacatgacacctgggcggcatcgatgctgcgcgacagcgatgacgaggtcctacaggttactttaaacagtagagagcagtgctggtgcaacaaaactgatgccggtcgcatcccgagctttataggagggcaggtcggccatgtcaatctcagtctcgccaggcgccggccgactctgtgcttgtggccaccgtgcgaggcctcagcccccgctcggtggatcaggctcgctgggtctgcctggccggcgtggggtgcgcccccgccgcctcgccgcccagcacagccgccagcgcgcccgacgcggccaggccggcccggaaggccacgtactcctccatggtcgcgccggggatgccccccacaaactgcgcgtcggcgcacttgagcgtgttcatgggcaggggggacacccaccgcccccgcgtcagcaggaactggtggcgcgggatgatcctgtgtggggtcggtggtttggggaggaggagggtggttgaatggggagccaggagtacgcatcatgtggcatgggggatgggtgtgccgagcacacactcacccaccttttgaggagcccatgtgaaaggctgtgcaggcagagtccctggagctcgcccccatcccctgagcacgccccaattccctgagcacccccccccccctaaaccccatcacaataccaaatcacccaacacctacccaccgtcctgccaggctgaggctgaggtagcctgggtgggtgaccaccgaccccgcgtccccccctagctcggcgcgcaggtagcgccacttgggctccaggttggcggcgaccgagagggacaggagctggggcaggcgcgccaccacgcccgcggcctgggcccggtccaggcccacagtgcgccgcaggaaggcgatgcgggcggccatgctgtccacgcggtagtgcaggagctgggggtgtgcgcgcacggtgcgcgccagcgcgccctcgcccagccccacgtcgtcgcgcaggaaggcgaggcgcgcggccatgcccgcctccacgcaggtcagcagctgcgggtggcgcgtgatcagcgcgcccagggcggggccgtccccgcccaggcccaactcgcgggagaggaaagcggcgcggggggccagcgtgcccgccgcggacagctccagcagcatgggcgagcggcggacgacgcgggccaggtcggcgcggcgcacgccggaggccagcaggaaggcgaggcgcgggcgcagcgtggcctccgggtcatactccagcaggcgggggaagcgcgggatgacggcgcacaggtcctcgtcgctgggaggaagggggagcggggtgggggaaggtgtgggtgttggggcgggacagggtgggcggacgccccaccagggatccagcaggggggtgaggcatgcactccggaatgggaacgcaggagcagggtaggtgggaaaggatggcagagctctttgagctgagcgtcacattccagcatgccgaagaatcggtgcccagccgtggccggccacgcaaagggaggcgcggttgacacgcagcacgacaccatgccaggccagcagggcgtcattccggctgcctcctcaccacaacaggcaggcagctgcatgcacctgtgtacttgcttaaaaccaccgtacccgcatgacaatgcaatccacacacacatgctcacctcagcccgacctcgtccctgaggaaggccagcttgcgtttcagcgtcgccacgcgcagcttgaaggtggcgggccggccctgcacgatgcggcgcaggcccgccgcccggatgcccaggccgtacaggaggcccacctgcgggcgccaggtctccggcatgccgcaggcgcccaccagctgcatgaaggtgtcctcatccaggtcgccgatctccgcctcggccaggtccagctgccgcctcacctgaagatgattggggagggcaggctatgcgatcggtctagggagcttgacgcagcagaaagtcccggcatgggtcttctttcagttaaggcccccacgtttcccactccccccgcctcacctcgtcgggccccaggaggcccggcacaggagggagctggggcccggaggacgattgctggacctgctgcaccacctgcttcaatcgattccttcccttcttgctccatggcgagacgctggccggagtgggggccggctccctctgctgcgctgcctggcgttcctgttgccgcaggtgctccacgtccttgacggtgatggggcgcagggtggtggaggaccggaacgggagtccagcgggtcgcggggcgctttttcgttccggagaaggtttggagcagcatgtcgtcgtactgggccgcacaggccgacggcaggcgtgcaggaaggggtgggccatcggcaccctccctcgccccctacaccctcatggccgggacatggcggaacacacgctgctcgcatgcattctatatgttacaaaattcatgaaattgtatcacaatgtctgcctaagtgtgcatggcgcttcatcatgccgtgggtacgatcgtggagggtgcgcgctgggcatgctgtggcacggtcgccgtcgccgggctggatcagggcgagaggcagcctccaccccgtggtgcatcgggcctgcaccgcgagcagaggatcttgaggctgtgcagcgcgcccctgcgaggctcctgcccctctctgagagggatctcgggcgctcctctcactcccatggagcggcctggggcttctgccctcgggggactgtgcacacccctgcagcgctggccgccgcggtgnnnnnnnnnnaagggatctcacgcgctcctctcactcccatggagcggccgggggcttctgccctcgggggactgtacacacccctgcagcgctggccgccgcggtggctgctgctgcggccgcggtcgtcgcctgggccactgcgctggccagccgtgcctccgccttgctcctgtcatgcccggcatcctgtgagccggtaggtgtgagtggttgtagctttaaggctgtcacccgagcttcgtcattggcannnnnnnnnngcgataggtgtgagtgattgtagcttgaaggctgtcacccgagcttcgtcattggcactgcgagcctgtctccgcggtcaggccggctccagcctgaatcagaaggaaagagagggctccatcccaagtggccaccttgccttgcttccttcaccccacctcaagcttcagcaggtgctcgcgaagttcctgattcttctcgagcagcacagcccgctgatgctcccactctcgtgcctgcgaccggccatgcaccttgcagctgagcttgcagatttggcatgagcctgactgatgcccatgcatcgtgggacgttgcaacaggaagtgcaccagccgcaccactccaacaacgcagcacaaacttctcgacacctcatcccccatgtgcccctccgcacctgcatataggtgtctcttcggtgcagtgnnnnnnnnnntcgcaggacgtccacctgtgctgggggattgggggatggaggcctacatggagcggtagagagcgtgcgtgtgtttttcactgtcgcaccttgcagtggnnnnnnnnnnaacctctcgacacctcatcccccgtgtgcccctccgcgcctgcatataggtgtctcttcggtgcagtgccttccaaattatcgtcgtcccaagggccactcccaggtagggagctgcttgctgggcgggaggggggagccgcacccagaccgctgtcgtggtgtcctgaactgctgaggcaaggggnnnnnnnnnnnnnnnnnnnnnnnnnnnnnnnnnnnnnnnnnnnnnnnnnnnnnnnnnagcagcgttgccaggggcgcatttccccagatcctctgatcatgctccccgcaccttcacgtccaccggcatggaccacttgatgctcttcgcccgagcctgcagcctggtggccagtccgcgcaccccgtctgacgcagatttgccgcgtgtgtttgtgacctggcgccaccaggcagagaggcccgtgagagggttgtgattcgcccctgacccgttggtcgcggcagcagcccttgccagcatgacgcgcagctgcctgcgccctggctgcagcatgctggcgaatgcagcgggcagtggatctggcagactcattgcgaatctccgaaaccagtaaacatgctctggattgagtgcggttattacactgcgaggcctgtgttttgaggtatcggaccattttccggagggcgcgcaatgttaaaagttgacaaacctgttgttccgccgggagggcactttgaaatctgcctgctattatcagcgttgtgcaacgtcctttacatagggacacactcaggggtcatcgcatctctcaaagacgtaaggtcatgggtttagaaaagtaggtttgtgctcttgcgtccatggcgaacggatattagtaagctgcgcgggatgagcgctggacagcttgcaatacttacacagtcgcaacggggttgctcgtcatggaggggcctgcgggacagaatttggaacgaggatgaggaagtgtactgtgactgctctgccacatgcacagctcatccctcccgcaaatatgcacaatgccgttgatgtctgattgcccnnnnnnnnnnaggcttagtgcggagtatgcgccagggattcctgtacaaccttacctccaaaccagacacggcattgaaacatgcatctccctggaccactgtcnnnnnnnnnngagtgtaccttgattgctctgccacatgcacagcctatccctcccgcaaacatgcacaatgccgttgatgtctgattgccccccccgcatactgtactcactggtggcggccttgctctgctgtggtgcacggtggctggtgttggagacggccgcatcctcagggtctgccgcgatggccaggatctgtgtgatttgtccgagattatttagaagcattgcaaatggaagctcagatggcttagtgcggagtatgcgccagggatttctgtacaaccttacctccaaaccatacacggctttgaaacatgcatctccctggaccactgtcaagaatataaacccctctgctcaccaggacgatgttaaagatgatgaggaggatggtgcccgcaagtgaggcctgggctgcctggcgacggctgccagacagggcagagaccaggttacgtgactggtcagctgtcaccatgagcaccacggtcacctacagggttgacatggggatggaccatgctttggaccatattgtcttgctgttgcatttcccaattcccatcagcacggggatggtcatgcagccgatgtggggatgcagcctgagtaggcccccaggtgcaaccatgcgcgcgcgcgcaaacaccgcaatgctggctcaccatgcctaagaatgtgtagttggtgttggccagggacttgtagctcgtgaaggtagcagcgaggatgagcaccagcacaaagaactggaaccactgtgattgaatgtatcgaggtggcgggggaaagatgtgtggatgtgcagagttcctcccgcaagacttttgctcaattcaggtacgaaaaggatgcttggatcatggttattcccaaatgagagtcccaacatctctctgcactcaccactccccaccagatgaagcccagggtggctccacccagtccatcatgctgcaacgcagcctgcacatccggatgcggaatgtgatgagagggggacgctgccggggcaccgggcccagcatcacggcatgaacgctcgactcaccacaccagcgagggccacgatccaggacagcacgctgaggacgagggcgcccgtgacgatgccgcccagcgatgcctgtggtcccatggtggccgggtgaggtcagtggcacggagtacatccgttggaaatcgacaggagctcattcgccgcacacgatagacgctgacgcgtcttcaggttccatttcttccctcgcaagcccccgaacaagaaaacttccgcctcaaggaagcccctggaaaacgggggtggcgcgacaggcaagaccggagctcaccttgatgtttgccatgtctgcgggtgtaaatggtagtgcaggagcaaatggtgtatatgaggaggtttgatggcccaattcaggagttgctgaacttgatggggtgccttcctcgccgtccccacctcgcctgtgtaacttccgacacccctcaatcccctggtcggcgaaggcggtacctgtacggaagctggcaggaggcggtcaatataactacaccgcctcggtcccgaagactgggttcccccggagccaatctcgcagcaatctgatgcgtttcgataagaatcaggctgaaaggtgactttgnnnnnnnnnntaggaggcggtcataacatctacaccgcctcggtcccgaagactgagttcccccggaggcaatctcgcagcaatctgatgcgttacgataagaatcaggctgaaaggtgactttgtgagggtcaagatggcgtcgcgtgagcaatcgacccctggcttcccttgccgccagctgggcagggttccggatccggttgagaagggaaagatggacggatcttgatgcacaacggccctgcgcccttggcaaaacggtcgatattgtacaccacgatgcaatacacaatactcagacggaccatcccgggaagtcggccatgaggccggggtgcagcagcttggtgggcggctcccggtaaaaggcggtgggcaccgccttgagcttcttcttcagctcggcgtcgaggagggaggcgtaggacgcctgcgccgcctccgcaaagtcctcctcgctggtcttggacctcagggtcaggtcgcgctccaacacaccaacatacgtggacacctgcgggttggcatgtcggcgcagcgcggtgatctcccacagcgagctctccagcgcgcggctggccgccgggtcggcgcactccgcgtcgtaggggtccgccgcagccgccgccccctgggccgcctgaaccgccggacggtgcacgagctggttgcaggcggggtgccggcgcagaaggttgtggatgaaggcgatgcacaccagagcggcggggggcccgcagcgcagggccagccgcccgaagcgcttaatgaaggcggccaccgtgtacgcggggaccagggtggaggccaggaaggcatccgcgaggctgaagaagcgcacgcggtgcctcgactgtagtgtgtgtgtgtgggggggggtgcgattgggg

SEQ ID NO: 48994 - DNA, 91 bp, Chlorella protothecoides
ccctcatccagaacgtgaggagtgggaggacggcgggtccagcgcaggagcatgcgtgcggcgtgctgcaggctgcatccttgggacacgt

SEQ ID NO: 48995 - DNA, 77506 bp, Chlorella protothecoides
  modified_base (116)..(272): a, c, t, g, unknown or other
  modified_base (524)..(533): a, c, t, g, unknown or other
  modified_base (1549)..(1558): a, c, t, g, unknown or other
  modified_base (3651)..(3660): a, c, t, g, unknown or other
  modified_base (4383)..(4392): a, c, t, g, unknown or other
  modified_base (4574)..(4583): a, c, t, g, unknown or other
  modified_base (7628)..(7664): a, c, t, g, unknown or other
  modified_base (7719)..(7728): a, c, t, g, unknown or other
  modified_base (7979)..(7988): a, c, t, g, unknown or other
  modified_base (9200)..(9209): a, c, t, g, unknown or other
  modified_base (12733)..(12742): a, c, t, g, unknown or other
  modified_base (13203)..(13212): a, c, t, g, unknown or other
  modified_base (13966)..(13975): a, c, t, g, unknown or other
  modified_base (14054)..(14063): a, c, t, g, unknown or other
  modified_base (15809)..(15818): a, c, t, g, unknown or other
  modified_base (17504)..(17513): a, c, t, g, unknown or other
  modified_base (17577)..(17795): a, c, t, g, unknown or other
  modified_base (18779)..(18788): a, c, t, g, unknown or other
  modified_base (19102)..(19111): a, c, t, g, unknown or other
  modified_base (19916)..(19925): a, c, t, g, unknown or other
  modified_base (19997)..(20006): a, c, t, g, unknown or other
  modified_base (20088)..(20097): a, c, t, g, unknown or other
  modified_base (20501)..(20510): a, c, t, g, unknown or other
  modified_base (20726)..(20735): a, c, t, g, unknown or other
  modified_base (20946)..(20955): a, c, t, g, unknown or other
  modified_base (21174)..(21183): a, c, t, g, unknown or other
  modified_base (21587)..(21596): a, c, t, g, unknown or other
  modified_base (21667)..(21676): a, c, t, g, unknown or other
  modified_base (21871)..(21880): a, c, t, g, unknown or other
  modified_base (22717)..(22726): a, c, t, g, unknown or other
  modified_base (23297)..(23306): a, c, t, g, unknown or other
  modified_base (24045)..(24054): a, c, t, g, unknown or other
  modified_base (24512)..(24521): a, c, t, g, unknown or other
  modified_base (25163)..(25192): a, c, t, g, unknown or other
  modified_base (26378)..(26387): a, c, t, g, unknown or other
  modified_base (29960)..(29969): a, c, t, g, unknown or other
  modified_base (30053)..(30062): a, c, t, g, unknown or other
  modified_base (30133)..(30142): a, c, t, g, unknown or other
  modified_base (30799)..(30808): a, c, t, g, unknown or other
  modified_base (32702)..(32711): a, c, t, g, unknown or other
  modified_base (33431)..(33440): a, c, t, g, unknown or other
  modified_base (34521)..(34530): a, c, t, g, unknown or other
  modified_base (35270)..(35279): a, c, t, g, unknown or other
  modified_base (35559)..(35568): a, c, t, g, unknown or other
  modified_base (36282)..(36291): a, c, t, g, unknown or other
  modified_base (37009)..(37018): a, c, t, g, unknown or other
  modified_base (37572)..(37581): a, c, t, g, unknown or other
  modified_base (38291)..(38300): a, c, t, g, unknown or other
  modified_base (39006)..(39015): a, c, t, g, unknown or other
  modified_base (40845)..(40854): a, c, t, g, unknown or other
  modified_base (40997)..(41006): a, c, t, g, unknown or other
  modified_base (41878)..(41887): a, c, t, g, unknown or other
  modified_base (41975)..(41984): a, c, t, g, unknown or other
  modified_base (42102)..(42111): a, c, t, g, unknown or other
  modified_base (43018)..(43027): a, c, t, g, unknown or other
  modified_base (43808)..(43817): a, c, t, g, unknown or other
  modified_base (44188)..(44197): a, c, t, g, unknown or other
  modified_base (46299)..(46308): a, c, t, g, unknown or other
  modified_base (46393)..(46402): a, c, t, g, unknown or other
  modified_base (46487)..(46496): a, c, t, g, unknown or other
  modified_base (46698)..(46711): a, c, t, g, unknown or other
  modified_base (46977)..(46986): a, c, t, g, unknown or other
  modified_base (47667)..(47676): a, c, t, g, unknown or other
  modified_base (48044)..(48114): a, c, t, g, unknown or other
  modified_base (48236)..(48245): a, c, t, g, unknown or other
  modified_base (48366)..(48375): a, c, t, g, unknown or other
  modified_base (48538)..(48624): a, c, t, g, unknown or other
  modified_base (49526)..(49535): a, c, t, g, unknown or other
  modified_base (49629)..(49715): a, c, t, g, unknown or other
  modified_base (49797)..(49806): a, c, t, g, unknown or other
  modified_base (50161)..(50170): a, c, t, g, unknown or other
  modified_base (50238)..(50247): a, c, t, g, unknown or other
  modified_base (50432)..(50441): a, c, t, g, unknown or other
  modified_base (51271)..(51280): a, c, t, g, unknown or other
  modified_base (51557)..(51566): a, c, t, g, unknown or other
  modified_base (51738)..(51747): a, c, t, g, unknown or other
  modified_base (52459)..(52468): a, c, t, g, unknown or other
  modified_base (53140)..(53149): a, c, t, g, unknown or other
  modified_base (53441)..(53450): a, c, t, g, unknown or other
  modified_base (53568)..(53577): a, c, t, g, unknown or other
  modified_base (54233)..(54242): a, c, t, g, unknown or other
  modified_base (54952)..(54961): a, c, t, g, unknown or other
  modified_base (55273)..(55282): a, c, t, g, unknown or other
  modified_base (55710)..(55719): a, c, t, g, unknown or other
  modified_base (56095)..(56104): a, c, t, g, unknown or other
  modified_base (56175)..(56184): a, c, t, g, unknown or other
  modified_base (56362)..(56371): a, c, t, g, unknown or other
  modified_base (57174)..(57183): a, c, t, g, unknown or other
  modified_base (59854)..(59863): a, c, t, g, unknown or other
  modified_base (60279)..(60288): a, c, t, g, unknown or other
  modified_base (60589)..(60598): a, c, t, g, unknown or other
  modified_base (60826)..(60835): a, c, t, g, unknown or other
  modified_base (61143)..(61152): a, c, t, g, unknown or other
  modified_base (61302)..(61311): a, c, t, g, unknown or other
  modified_base (61813)..(61822): a, c, t, g, unknown or other
  modified_base (61921)..(61930): a, c, t, g, unknown or other
  modified_base (62080)..(62089): a, c, t, g, unknown or other
  modified_base (63267)..(63276): a, c, t, g, unknown or other
  modified_base (64087)..(64096): a, c, t, g, unknown or other
  modified_base (64300)..(64309): a, c, t, g, unknown or other
  modified_base (64910)..(64940): a, c, t, g, unknown or other
  modified_base (65542)..(65551): a, c, t, g, unknown or other
  modified_base (65931)..(65940): a, c, t, g, unknown or other
  modified_base (67035)..(67044): a, c, t, g, unknown or other
  modified_base (68828)..(68837): a, c, t, g, unknown or other
  modified_base (69048)..(69057): a, c, t, g, unknown or other
  modified_base (69519)..(69528): a, c, t, g, unknown or other
  modified_base (69682)..(69691): a, c, t, g, unknown or other
  modified_base (70389)..(70398): a, c, t, g, unknown or other
  modified_base (70618)..(70657): a, c, t, g, unknown or other
  modified_base (71065)..(71074): a, c, t, g, unknown or other
  modified_base (71718)..(71727): a, c, t, g, unknown or other
  modified_base (72136)..(72145): a, c, t, g, unknown or other
  modified_base (73545)..(73554): a, c, t, g, unknown or other
  modified_base (75935)..(75944): a, c, t, g, unknown or other
  modified_base (76554)..(76563): a, c, t, g, unknown or other
  modified_base (76631)..(76640): a, c, t, g, unknown or other
  modified_base (76811)..(76820): a, c, t, g, unknown or other
  modified_base (77152)..(77161): a, c, t, g, unknown or other
  modified_base (77240)..(77249): a, c, t, g, unknown or other
  modified_base (77308)..(77390): a, c, t, g, unknown or other
ggcgcggccccgccgcgcccgaccccgggccgtgcatgcgccggttgaggcgctcgaagcgcggcacgtcgcgcgaggccaggtccgccaggtcgccgtccagcagcgactcgccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggttgtcggggcgcaggcggcgcagcaggtcggtgctggcggactgcagggaggcccacaccacggcctcgccgtgcaggtctggggcggaggaggaggggataggggggtggggggccggggggtggatgtgaggggtggagcagggttgacgggaaggagcacatgttaagggcaaagcttattgggagcggagacatgaaacaagccatgcccggcgcagggctatggaagaggcatcactggttgtnnnnnnnnnngagggcaacgcttgttgggagcggagacatgaaacgagccatgcccggcccagggctatggaagaggcatcactggttgtccgtgaacacctaatgagatgtgtcacacgccagggcggcaccgttcgattcagcacgcctccagccgctgcaccaggaaatcagctgctgcccaagcaacaggcctccccccaccatcccagactcccagccaatgccacctgtctcacccgcgccgtcactgctgagcgaggcggtctccaggcaggcactgggcgcgccgctccaccgccccagcgactggagctgcatggaggcgtccttcagcaggcgcagcagcccgtcccggcacgcctcgcggttggacacgcgccgctgctcctcctgccgggttgaaagcgcggggtgtgaggcagggcgcgaggagtgagggagaagaccggctgggagcaggcagagtgcctgcgccgcctgggagcccgcgggcgtcatgcatacacacacaccccagccactacaccgcctcacgggggtccgagtgctgagcgtggcatcgctgttgcccatgggcaggcccagcaggctcagcagccccggcttcaccatctcgtatgccttggctgcagccggtggtgggtttgtgatgctgaggggtctttctcgaggggctgtttcagcaggttgatgtttatgagagtggtttgcggtggggcccactgccagccacgcctatttcctgccacccagtggccacacaggccgcccccctcgccccgtctcctaaccaactcactccacctaccggtgtgccaggtggcagacgcgtcccggtccagcgcccgcgccacggccgcggccagctgaggcgccgctgacagcgcggggtgggagcccagcgcgctcagcgtgtcgcgatccagcccctgcaccaggttgcctgcgcgagaaaggacggcgatcgcatactcgtgcgccagtgagccgtgccacagcacggtgacggggcgtagcaccgnnnnnnnnnncgcgcgagaaaggacggcgaccgcgtactcgtgcgccagtaggccacgccacagcacggtgacggggcgtagcaccgggtccacctcgcagtctgctgctacggcctggggcgccggggggggtgtggatggtggagcgattgggagagggtgacgtgggttgggtgaagatggccggtggtaagctggagatattggtgctgatgagagacactgcaaacatccggtcgtctggccccgctgttctattcactcccttcagaaaagacaaaccctggcgcaccgcaccagcaggttgcacaggaactccagctctccctccagcctgcaatcgacgcaggaagaaagcagcgcgccgtgcagcgcggccagcctccggccggcatcagacagggcggctggcgggctaggggccggggcctcaggtggtgtggtgccgggggcgctgcgctgtgcacagagcgagggaggctctacggacggggtgccctgcgcgagcggggacacgccagagctcttcgcagcgttggtagcagaggtggaagccgtgtcgttaatgattgcaggggctgccggctgtaccctcctccttgataagatatctttgggaggctcccctgttccggcggagatgcggttcgctggaaccccagtcaggcgtcgctccaggggttccaggcctgccgcccgaggctcggccagcctgttcgacacagagggggcaacatctgctgcaggactactggcccaggcgttatgcggcgccagacctgcgtgccaaaggttgagacaatgcgcacatgggcaccggactatgcaagcgggtgctcaacatgtgaaggcagatgcactgggagagggacatccacagcatccattgagtattgtttttgattcttgaaatgagcaatcataaagataaatgtcgcaactcccctccagaatacattgattctgaggtcaatacatgccaaggaggaactccacacgcccccggcaagctcacctgtcggggtgggcttggggctcccttgtttgacccaggcagaagaggcctgcccactcacaaaagcagggtccacctctaccttttgcactctggcaggcagtatcttccggcggggctcctgcacaggatgtatcagattgcccaggatcggtacaatggagggggaatgcggtcgatgttgcagtggcatgtccagtgcatcgttggcaaaccgaggccccatgccatgtctgaagagcagatttggggggcagatttgacacgaatacactcccggacagctggagtgtcggggcagcctcacagacatgatcccaaaccctcaccgatttgggttcattcgtggatggaacattacccaatcgagggaacgcctcagagtatccagccgcactggtgggaagaggctgctgcggaccggtgctggctcgatggtgttttgtgggactgctgcccctggcatgttgctgcccagctgctccgatattgacgcgcgaactttcatccatggcgtctgaagggcctgtgcccttcttctcttggacttgacgcgcatgctgtcgctcagccgcgcccagcagcagctcagcctgatctcgaatgtgattcaatacctcgcggcggtatgcagcagggtcagtggaccacgggcatggtgtgggggcaccacatccagatgatggagccgctgggatggtttgtgacgcttgagtgagccatgcaatcaggctcctatggagctcgtcctcagccaagcagaggctcagcggggcagccataacatgtttcgatcgtgctacatgtttctgattggcttcccatacggggtacaatgattcgagcctcgtgcatcgctcgtcgggggacttccgttgcattgtcttcaaaccgggagcaccctgggcagggttcaacatcgtggcagctccccctttcttcatgaaggcgccccgcctccaggtgaaacgagcggtggcggtggggaaggtatgtaaagcggatgtatgcttatactctcactacgatttcttatttatcagtattcaacctcggtttcttccaaatcaaggatgttttgactgtnnnnnnnnnncgtatgcttatactcttactacgatttcttatttatcagaattcaacctcgatttcttccaaatcaaggatgttttgactgtagtctggagcgggccatagcccgccggcgttttctcttacgctccagtttccatcgcgtgcccttcttggcctggagtatgaagtcctccagcacttttgtatgtattagctcccgaagctgagcctggctcgtcgtgtaggtaagaggtccatggttggccggcgcaagggggcagtgactctggtgtgtgccattgcagtttctaatgctgtgcaacctcaaaaccgccacggttgcgcacgtttcgcttttactgctacatagactgggctatcagcacctgcggggtgggaatttacaccgctcaggtctagaatgctcctcacaccaatgcttgttgcactaagcgcaggagcattaccgagccggcccctggtcccaaggaggcgtgttttcaggagctcaagtacccccttaatggtttggcacccttcctgtattcatagtcttgtttcatagtctgtgaaggaaattttcaagggcctgcagcactgtttgtgtaaagtacatccccttattggaagcaagatgacatatcaagtaagggaggtgtgggaaagtgtgatcaaggaaagaatgtgggtgatggagtgggtatgcggtgagattgtggacagcaggcttgttattcctgactgnnnnnnnnnncggagtgggtaagcggtgggaatgtggacagcaggcttgttattcctgactggccgggcggccagcagaacccacaaaacagcactgcctctgtggatggccgaagcagggtgctagggagtgaatgaggtggcaagaaagatggcacgttacgggagcaaagggcggggcatggcaagcgnnnnnnnnnncagggagcgaatgagatggcaagaaagatggcacgacacgggagcaaagggcggggcatggcaagcgcggactcccctgagacactcctccctgccctctcagcaaagagcctgctccccaaacgcggtgcgtgggtggcgccaggtgtagtagatggcgtggccgagggaccgcgtcgcatagaaagcgaggagggaccaccacacagacgtcagcgtgccgggcagcgtgcgcagcacgcccagcgtcactgccaggcccacaacgttggagatgggcaggtggtccagcacgtttgagcccacgctgatccctggcgggtgggttagggggaaaggagtggggttcagtaaggaccggcatgggtgtgggtggtggtttcgagtgaaaaaggcaagcgtctccctttcgtggcaaatgatatcatcaggtgcctggcttgaagccaactgtgggtgccagtgactgtgtgtgccagtgactgtgtgtgccagtgcgcctgctatgctctgccgggcgttctccccatcagcaaaggcacatcttctcatcctcctccccacacctacatcctgtcttcctctccccccccctctttttagaaaaacccaccatccataatcatcatgcaggagcagagcgccagggcggccgctgccatgggccagatggcgcccacctgggcgatgaccgcgaggtcggtggtgaagagggccaggccgcgcttgaagacggccaccagggccagggccagggtcacgcccagtgcggcgccgcagcccagcagcaggcgggaccaggcctgaccggcgcggggaatgcgtcggtcccgcgcgatcatgctctgggccgccagggacagggtctcggggacgtaggacaggaaccagaagatctgcgtgagtgtggagttcaagggggcttgtgggattagagggcatgagcggtgaggttcacagacgggggcaagtctcagacacccatcaagccaggtgcacacaatcaccagcaattcctgatggatgatcaagcggtcgagcccacagcccacagacccctccagtgtgaaacccgcccccagcacctgcatggagacctggtgcgcagccagcccggtcacgccgaggccggtggcgctgacggccatgctgaagtacgcggccatgccaaaggcggtacgcgtgatcatggtgacagccacctgaaggggagaagggggggcaaagcagccggtgaggtttagggttacaatgccacggaggatggcctctacgaccagtcatggacgttgatagaaggtgggaagccatcacaggccatccataagccacccagtacctctccgcacccggcacatatgcatgcccaacctctgacctcaccttttggaactggcgcagagccgcggcctctggccatccctgcggtcgggagaggatggtgagtcagagaggggggctggcgagacatgagcccaaaaggaagggtgcaccagggcatcccctgcgcatggaactcatacatggaaggcagacccacgccgggatcttgagttgccagcaggcgctgcatgcaagctaacacactctcccgcctgtgactctgcggagccccaatccccccccaccccccctcaactcccaccgcaccgtccaccggattttcaggcggcggctgtcggtctggcccctgtgccacaggtacagcatgaagattgcggtgctgagcacctgggaggccgccgtggcggccgccgccccggcgactcccatgccaaacccgaagatgagcaggatatcgcctcccaggttcagcagccctgcccccatgaacacaagaaagggcgtcatggtgtcctgctggccaaggcacacgcccatggccacgttgccgagcatgacggctggggccgccagcgccctgtttgatttcagcggggattggggatggaagtcgagtaatgtgggaagtggggagttgcgtgggagatgggcgacttcatccatccgcacagatcttgctctatgacctagcaagaacacgcattggctatccggcggagcctgctcccatccaagaaatttggacaccctcttccatgccaacccaccacggacccacctgagccgcaggtaggcaagggcgtggggcaggacctccgcgtcagcccccatcctggccaggatgggctggccctgcgtccacagcgcgcccagcgccaggaagccaaatgcgacggccaggaccatggtagtccccaccaggcgctcgacccgtgccctcgccgcctcgcgctcgcgctcgctcagggccgggtcgaggatggagtctgccgccacagcgttggtggtggccacccccaggaaggagaagatggagaagacggcgttgaagatggcggcgttgggacccatggccgccagctgggcggaggagacgtggcccacgcaggccgtgtcgatgagggacatgagggggtcggccagcaccatgcccagcccggggccggcaaaggccagcacctccagcaggcgggggggcagctggaagcggggcgggggggtcctgggcgcctcggtcccgtccaccccggcaggagtctcaaggggtggtgtgtcggccaccgtgctgggccaccccgcgctgccgcccgccgcgggctgatccagagccagctcaggctcgacatctgccaggaccaggtccgggaagggcatgccggccccggcctcgggttcgaggctcgaccggcagctgggcggaagccgacgcggcgagcggcggggccggcctgtgcccccatgccacctcctcgacggggtgttggcggggtggaagcattgggatcgcaccatcatggtccggactggagccatgcgccgtgtgatgtcggacatggagggctgttgcgcggtcaacaacttggccggagggccttgcgtcgcgacatgcgactgcatgcctcgcgagtactgaggtagactgctgtctaggatccagtgtgctacaagtgtgcagtcgtatcaccaaagggggcagagtannnnnnnnnnnnnnnnnnnnnnnnnnnnnnnnnnnnnccaatatctagtgctcattcctcaatgcccagctccagcatgaggtcccccgggnnnnnnnnnngccaatgtagcagctgtcgatgtagttttgactacgcgctgcatttgggtgccgcggaggtagacgctcctgtcaatctacagaccgccttctgcacttcattcatgtgcctcatcacgtggccatccagctcaacatctagtgctcattcctcgatgcccagctccagcatgaggtcccccgggtctggtatggtggccggagcggcctcgccagcctcaccggcgccccggcccagcaggcggcgcagnnnnnnnnnngcctcccctgccggcagcgcccccccgggctcgaacaggtttctacgcagcgcctcgccggcggcccgccccgccggctcgccctccatgtgccgccgccagaggcgcgcgctcaggctctgcgcggcgaggtagctgtagtacgtcgcgccgtagccgaccaggtgcccgaaccgcagctgcgggtacaccgggaggtggggccccaggtcggccagcggcgagtgccggcccagcacctctgccgtggcccccgccagccgtgcctcgtccggcggccggctgctgtgcatggcctataaaagatgtggaatgacgaaggggccttgtatcgcagggttgtggagttgccagactcaagcttggcagcgaaaccagagacccaggacctcatcctcaccctttttaaagccccacctccagcacctccccctggacaaacctggtcgaggaggccaaggtgcacctggtgcagcatggtgagcgcggagaaggtgcgccgctgcgcctgctgcgcgcgcaccgccgcctccagctcggcggcggggcggtccaggagcagggccaggccctgcacgtcgcgcgcatagtgctcgaacacgtggctgggcacctccatcatgtccagcgggccccgcgtgcctgtcagcgcgggggggcggaggggagggacgacggggttgagcgtggcaggggctagcgaggggtcgagatgcacacagaggtgcaacgtgacggtgtgcgctattagtgcctccgatcccatcgtcacatgccccgtggcacgctgagcgccatggacacgctcatggcaaaacacaagggtgaacaaagtcacgagacccccccccctcctcatccccctggttacccgacaggtgctggtggcgcgtgcggctcaggagcgtgtgcagggcatggccccactcatgcagcagcagctccagctgggaggggtgcatcgcctggtcggccggcaggctggccaccagcgccagcacgggcgtctgtggcccgtcaaagcaggaggggggtgggtggcggtgtcattggagtgtcctgtgtttccttccccctcctggctgacccgccctggcacgcggcgatccctctcacaaaccccatcctcggaaaacatcacccgaactcctcccacctggacggcatcggtcccgtggccccggccgcagcgcaggacaaagtgcgcggcgnnnnnnnnnntaaagcaggaagggggtgggtggtggtgtcattggagtgtcctttgtttccttccccactcctggctgaccacgccctggcacgcggcgattcctgtcacaaaccccatcctaggaaaacatcacccgaacacctcccacctggacggcatcggtcccatggccgcggccgcagcgcaggacaaagtgcgcggcgcccgggaacttccccggccggggctggaagtcgaggtagacggtgcccagcagcgcgccgtccgcctcagagacccgcagcttggccaggcccggcgcccagccctcccccggtgacaacgcggcgtcccgcacccgcacgcccatcaggcgggtcatcagccggtccaggccgcgcagcgcctgacgcggcgagcatgacagcgcccaggccgaggcggcgtcctcccgctgccggtcctggggccgggggtgaggggtatccaggaacgtcggcgcggggccttgggtcgtgcccgagccccgatgcggcgggctctggtcgcgccgttgtatctaggactcttgccccaacatcatttcctcccactctgaacctgcccccccccctttcacaccaaacaacgacacccaccctggccaggttcttgaagtaagccacgtcccaggggtccagtggtgcaccgggcgccggcccgcccccggccaggtgccggcggggctcggtggcgtcgcgcatgaccacgagctgggccgcctcccgcgcggcggcgggggccaggcgccgccccagcgcctccaggaagcttgaggcggccgacggcgcctgcgccaggctgaagtcggtgagctggtaggcggcgaaggagtcgtgccccatcaggcgcgccgtgctgcgccgcgcctccgccagccggcacaccagtgccaggctggcgcggggctgccgcatctgcgccagccaggcctgcacaagtggatttaaggggggggtgagagcagggggtaagaatggcttttccatgggggccatgtgcagggaagtgccggcccccctcccctcctccccccttcccggcactcgcctgttttctggcttcggcagagggggagtgccccaggatcaggttcaggctggcgtcatccgccgccaccgtgacccgcgagcccctgcgcgccagcacccccgtaccgctgggcagggtgccggggacatctgctggcaaagggcgcagaggaaggggagaaggtggaggtgagtgaccttcaggcactcgatggcctgggccaataaagcacccaagttcaggcccctcacgacgccactccccaggccagggaacagggtacactgctcagcggacgctgccgtcgaaacagatgtcactggcagggctgggccttcactcagactccaccccggcacctcccagaacaaaaaccaaacaccctgtgccccaaccacaatcacacctgctaggctggagggcaggtcgaagccctggagggcgccggggtcgaccaggttctgccccagctcgtagcccaggctctgggcctccgccgtgagccgcgccatgcgggcctggccgccggcgtccaggtgcaccccgtaccgctcaaagtcgcgagcaagggagaggcccacggcccgcgtctccggcggcccagcgcgcgcacccggcgcgcgcagggccgatgagagcgcggcatacatgccgcggtgggtgttgaggccctggacgtaggagccgagggaaagacaggccgcggtggcggcctgccgccaggctgggtctgtgtgcacgttcctgcagaactccgcggtgtccagcacctggcagagctgcagggaggtggggaggaggtgagacggcggggtggccggcaggcatgggactcgagctccgtgccttgagatacacggcagaggcagtgggaactcgagggtggcaaagcacgttcgggggcctgaatggtatacacgcagctaccctctgcgacggagcatccaggaagcttgtgcagcatgcacacgccgattccaacgccacacgcaagcactcaagcaagcacaccacaccgtgtcggagacatcgtccaggaggctgatggtctgctctgagtgtgggacggtcaccacctgctgtaccaagtcattgcacctgcaggcagggacaagcatgggtcatgacttgtgacgaccaaggtcacctccctgcacacacctccaactcgtacaagaccacccatcccagatatgagaaccccttacttgttcactgtgtcacgcgccagagtctcccagtccttgggacaggcgaccaggcccatccccgcgaagccgggggaatgcagccatctgaccagggcgagtcgcggggtgcgaggtgtgcctgacaccagcatccccacgcactcagccccagccggtacaagggcagctcactgcgttggattattaaaaatgaataaatacattggtgttgcataccacggagtggtaatgcgctcgtcacatgtataggagagggctctccatgcgcgacgcacctcccgacaccaggtcttcatcacacacaagccacgtttccctaacactgccattgcgacagaacataatcctaaagccatgtaatataagcttacattcgtaacctcgcactctcgacctgtatcgtcgggagtctcacatgctcatagcatacttcggtgggggtcgtggcgtcagacccaacgctcacacaagcggtgctatgacaatcggctggttcccaaagtataactctccagatgcaatgagtcacgagcatccaacaaggggcttgcagttttgcagagaagtccatcgctgactcttccgcactatggattttatgcagctgaattgcgcgcgcgggagcgcctctcaaatcgggtcaggataatctcagccaagcacttccgtgcagtctgggttacgtctcggcagcattaggcagagaagcacggaaagtaaagtgacaagcgtgagcttctcgtcggatacatagagtcgcactgaagacaccgtctgcaatcctcctgatcactgccactctaggcgacgcggggtggggatcctatgtcggcagcactctcattccacccgctgtaccagggcgcccagtctcgattggagcctcgcttctgcttcaggggtcctgtagcttcaagaagagccccactttatcgcaaacgtgagtttacgcggcgcatggcgtgcatgcaggccgcacatgggactgcatgaggtcgccccaagaccaaattagcaatctcatgcaggggtggacattgccgccgccgccatcgcagctcccgcgagcaacgtggaggatgttggactcaaagatgccccgcttcgctccttgtatcccgaggagccctcccgtcccgagcctgtaagcagcagtgaggccgctgccgctgtgtgagtgccaggctctggcctgcctgcccgagtgacggcctttccaccaagatatcacatccattctctttcaactcaccacagggcgccccccgccnnnnnnnnnncgccgctgccgctgtgagaatgccaggctctggcctgcctgcccgagggacagcctttccaccaagatctcacatcaattcactttcaactcaccacagggcgccccccgcctcaaggtggccatcgtgggggggggcctggccgggttgtccacggcggtggagctcctcgatcaggggtacgaggtggacatctacgagtcgcggccctggatcgggggaaaggtggccagcttcaaggacaaggaggggaaccacatcgagatgggactccatgtcttctttggctgctaccataaccttttccggtggggagtacaggttggggttggcaggatggaggatgggctctgtgcatgcatacaagggtaacgtggaagaaggtggcttggccgctactgcagcatgtcctgctgcagtgataaaaagaatccatggcaacagccatgtcctcgtggacnnnnnnnnnncgtgcatgcatacaagggtaacgtgaacgaaggtggcttggccccacccgcagcttttcctgctgcaatgataaaaagcatccatggcaacagccatgtcctcgtggacttcgcaccctggcgtcaaagcttggttgagatgcctctgcgctcaatgtgtcagcccccacgtcgtggagcctgtgcctcgtactccactcgatccctccccttccccccaactccaatccaccccagcctgatggccaagtgcggggtgctggagaacctgctggtcaaggagcacacccacaagttcgtcaacgcgggtggtgacgtgcggaatctggacttccgcttcaacgtcgggtcggccaagattggcgcaccctttcacgggctcaaggccttcttcaccacgccgcagctgtccacggtggacaagctgtccaactccctggccctgggcacctcgcccatagtgcgcgcgctgtttgaccccgagggcggcatgcagtcggtgcgccgcctggacggcatctccttcgccgactggttcaggagccacggcggtagccagggatctatagaccgaatgtgggaccccatcggtgagttttctttccatttttcttcttttggggaggggatggggggcggcgttacaccccttgtttgggtgggcggatgagtggtgatgggtctgccagtggattatgtaactgttgtgagtgcatctcatatacgagaagggacgacagggttgcgcacagtnnnnnnnnnntatctcctgtgaggcatgctccacatattcccacccccaattttctccctttccagcatacgcgctgggtttcctggannnnnnnnnngggatggggggcggcgttataccccttgtttggctaggcggatgagtggggatgggtctgccagtggattaagtaaatgttgtgagtgcatctcatgcacgagaagggacgacagggttgcgcacagtccacatcctgtgccagacacccgtctcctctcctttaaagacagccagcagcgaccatctcttgttaggcatgctccacctattcccacccccaattttctctctttccagcatacgcgctgggtttcctggactgcgaggacatctcggcgcggtgcatgctcaccatcttccagttcttcgccaccaagacaggtgggagctgtgggtgttgtggcaaggttcagaagccgtgcactgcgtgtggtttggtggtacacctcatcacaagcccctcactcgaaagctatcatcgcacccttcccccctcctatcttccccttcccccacagatgcctccgtgctgcgcatgctcaacggctcgcctgcggaccgcctgctgcgccccatcacagactacatcaccgccaaggggggacggctgcacacgcggtgggggtgccgcgaggtcctgtacgagactgacgccgagggggcgcccaccagggtcaagggcctgcgcatgtccaaggccgacagcgagaagacggtgacggcggatgtctatgttgcggcgctggacgtgccgggggcaaagcggctcatcccccaggtgggtgtgagtgtgtgtttggaggtcatggggactagtccaggaaacaaccagcacgctatggtgacagggaaggtggatggtggcttgtttctgctcttgcactccgaaaatcatgagcatggaggtctgtccattcatcgcaggcctggcggcgggaccccttcttcgacaacatttttcagctggaaggcgttgcggtcatcacggtgcagctgcgctacgacggctgggtcaccgagctgagggaggccagcaacaagggcgaggagcccgctgggctgaacaacctgctgtacaggtgagcggactggattggacgttgccgcggcatgcaattattttagtctgggcatgctcaggacccaagtggtgtaccgtcaagatgagcacagctgaggggacatacatcagcatggcaccccttgacgacccccttcccccctgtctcagcgccgacgcggacttcagctgctttgctgacctggcgctgacgtcccccgtggactactttaaagaggggcagggatcgctgatgcagtgcgtgctgaccccggcagccaagtacatgccgatggagaatgcggagatcgcagctgccgtcgacgcgcaggtgggtgggccgcgctgacgagaaggatgatcgcgttgatcggcagtcgccatgaacgcatgcccacgaccagccacctgggcaggggcgccctgacactgccttgtaggctgtcatggaccccaaagtatacccatcctcacactctctaatctgtaggtgaagaaactgttcccatcggcagcttccctgcaactccagtggcattccattgtgaagatcggccagagtctataccgggaagcgcccggcatggatgttttccgccccgaccaggtgggaagtgcagtaaagtgatggtacaatgctgtggaagagcagaagaacgcagaactggagtgcggttcaacaatcttgaccgtcttcaccagcatggttgctgcgctacactgaatccactcacacgccgaccnnnnnnnnnnggtaaagtgatggtacaatgctgtggaagtgcagaagaacgcagaactggagtgcggtcctacaatcttgactgtcttcaccggcatggttgcttcgctacactgaatccactcacacgccgacctctctttggacccggcagaaaacccccatcccaaatttttacttggcggggagctacaccaagcaggactacatcgactccatggagggcgcaaccctgagcgggcgtcagtgtgcctacaagatcctggggaacgcacccgagctgctggagggccgcccccagcaggcccccactcaggaggcacagccagaagctgttggcgtctaagctgcagaacggaatgatttcaacttgaaattatcatacgttgccttgtgaaacatgcacttgggatgctggaaggattcagttgctggttggatgtcgcgccttctgcccgactacattccgggaagggccctagcggttcaatcatctgggcagaggggtcggcggaatgtgggcgaccgcgagtacgaattagctcgagacgttgctcttacttacacgagtacatattgggagggattcggcagaccctgtcttgtttacgcggccactgggcgtgaaccctcccttgcctccccccttgaatgggcgagcccttttacgccacccgcaagctcttgctggacgccacgcttccggatggagtggtggcgagggtgctggaagaggcggagcctctctccccgggcatgaccacagcgtacattctcctctgtatcgtgctcgtcattttctcgggcatcatggccggtctcactcttggactgctgtccctggacaggtgagcgaccttattgtgtactcaaactcgctacgtcaatctgccaatctaagcgcctgtatgttcctggtattcagggtggacctccaagtcatcaagaggtccggaactgagagggagcgctggcttgtctcacgaattgaaccggtgagtggtgtctgaatgtgtatgacgatacaatcatcaaggcagatccgtctcaatcgtggagggactggtgcatgccagggcaggcgagtcaactaggccggctgcatgggaggtccacttgacggctgtccactgcttccatggctgtgagtgccctacttcacccctccccctctctataggtgcttgcaaaaccacactaccttctggccacactcctcctttgtaattctggagccatggagacgctccccattttcttggaccggctgctcaaccccgtggcagccatcatcatttcggtcactgccatccttgtctttggcgagatcttgccgcaggtgcgcaaactgggggtggtgaggtttggaaggtactggctgcaccaagcacatctctgcatgctttttgcccagctggaagcacttccaggccaacccggcatgtccccccccttctcccccaggccgtctgcaaacgatatgggctgcagattggagcatacttttcctaccttgtgcgcttcctcatgcttttcacgggcctcatcacctggccaataggtgcgataatgctctgcagtgggggaccaccctgaacatgctgttgcatgcagggctgctgccgagagctcagatgcccgccaggtgatcgggagcttggcccccgcacatccaatgatgccccgccggtctcacnnnnnnnnnncgcacatctctgcatgctttctgcccatctgggagcacttccaggccaacccggcatgtccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcagatgcccgccaggtggtcaggagcttggcccctgcacatccaatgatgccccgccggtctcactccccagctcgccccagcgaggtccttggtctttgccttttgccatgcccacacaggcaagcttctcgactggatgctgggggaggacagcgccttgttccgccgtgcagagctgaaggcccttgtcaacattcacgccgagcccgaggaggatggcgcgctgtcggtgctcacccacgacgaggtccaggtgcgtcgagaaggggtggtggggctctgtcatggacaattgatatctgcacgcagaatgctcgccggaattggggggattccctcgttgccgggccgaggcatgatagtttcaggcagtaggagcactcactgggcccctcctgacctacctcaggtgattcaaggcgcgctggacatggcgaccaagacggcagacacggccatgacccccatgagcaaggtgtgcggtgggtgatcgctgcagtgcagtattccatgccacgctgggaggcctggctccgattcgatggctgtgtagcagcaccatgcatgcagctgttcagatgcactcaggcgcgacgaggacacctgatgccggactggtttcggttggtgccctgcgccgggccatggagccctgcccctcccctcgccgccaatcctcccctccccgcctccacaggtcttcgcggtgtccatcgacgccgtgatcgacgaggagatgctgcgccgcgtcatcgagcgtggccactcacgcgtgccagtctatgagggcaacaacaaggcggtgcgtagacgaggggtgatgtcggcggcgtggtggtgggaaccagccttcacagtgagccgcgcgtagtcggcgcggcctgtaccttgtccctgcctcctcagcgctgcctggaatggttgtgagagtccttcaccgaccggcgtgtgcattcaggattgagacccctcgcgcgttnnnnnnnnnnagaatggttgtgagagtccttcactgatcggcgtttgcattcaggattgagacccctcgcgcgttcctcgagcctaccacctcaccttcccgatgcccatgcagaacattgtcggcgtggtcctggtcaaggagctggtgctggcggagatggatggccacaagcgcatcaaggacatgaggatacgagaggtcccatgcctcaggtggggtgggagcggagcgatgttggcgagagtggcagtgggtgagggagggtgcgggcaggggtctcggaatacggtgtgcttgctggtaggtggtgaatgtctggannnnnnnnnnggcccgcgggcaggggtctcggaataaggcgtgcttgctggtaggtggtgaatgtctggagcaggcacccggcacccgtcacccattctagggagggcccctttcaccacaggtctgacatccctctgtatgatgtgctgaagatctttaggaccgggaagagccacatggcctgcctgaccaaagtttcgggcaagctggaagaaattctgggtgagcctggaggggtggatttgtggggcgctagctgcgcgctgatgagcttggtcgggaatggggagatgtgtgagactcccagagctgcatgttttgtgggatggtgttccggctgctccctgtgaggctcaaagcagtcggagcatcagggggcactggcccgtgccacttcatgacacgtgtggcgtgctccgaacatccaccctccccacttcctcagcgtctgagggctccctgacgctcaagggcggctccatcggcatggtgtctggccccggcggcgacaccaccgcctccggcgtgggcccctcccccggcctgtggctgacgctgcgcaagccctcggcctatgtcacggacctggccagctgccccgacatcatcggcatcatcaccatcgaggacgtgctggaggagctgctgcagcaggagattgtggacgagaccgacctgtgagtcttttttggggggggggtggggtggcgtggggaggaggactcgtacatgctggagggaggaggttgcgagctcgactgttggcgatgatgcagtgtgcctcccaccgggcaccgcttttctacctcaagannnnnnnnnngggggggtggggtggggtggcgtggggagggggactcttgaatgctggagggaggaggttgcgagctcgacnnnnnnnnnnttctgccaacacccatcaagtgggagctcatgtcggctcgaatccctcccgttgttgcttcatcgttggctccattgatgcnnnnnnnnnnctcccccaacacccatcgagtgggagctcatgtcggcttgaattcctcccattgttgcttcatcgttggctccattgatgccccccaccacaccaacaccaaccccctgtcccctcccaggtacgtggacaacttgcagacggtgcgcccaaacatgttggtgtcgctgcagcacctgcccccctccctgcgccgcttcctgtcccgcagcctggcggccacggcgtccccgctctccgcctcggccggcacccccaacctgcagcgctcgccaaactcccgggcgcaagccagccgcgcgccgtcggcaactgccaccgccaacggtgccgcgggggagggtgcgtcccccggcgtgacggacgcgcagcgtgccgccgcggcggcggcagactccaacgcgnnnnnnnnnncgccggtggggagggtgcgtcccccggcgtgacagacgcgcagcgcgccgccgcggcggcggcagactccaacgcgcagctggcgctggcagccgtcgcgggcgtgatcggtgcggtggggtcggggccgccactgcagcagaccgtcgccgggcagcacctgctgccgcgtgcccggccgccgccgagcgggagccgggccgcgtcgcgcgagcnnnnnnnnnncgcggtggggtcggggccgccccttcagcagaccgtcggcaggcagcacatgctgccgcgtgcgcggccgcccacgagcgggagccgggccgcgtcgcgcgagcgccgcgcgacggcggcggcggactccgacgccgagtccattgttggggagcgcgtgggcctcacctccggccaccgccaggaggactgaggattgggacctggggcnnnnnnnnnnacgtgggtctcacctcaggccacctccaggaggactgaggattgggacctggggcggccgggagccgccaggcgggaagtgtgcagcgcccagcctcctccccgcgcctcccacatcttgaaacagaaatccagaaggcatctgtgcgcgcccgttctttttttgtaagaatagccttcgtgccaccgaccctttcggatggtgccagcgtggggatgnnnnnnnnnngttttctgtaagaatagccttcgtgccacccaccctttcggatggtgccagcgtggggatgactaaccaccccagcgctgccgttcggagcacagagcggaacgcgggtgacgccgagacacggcgcatgcaagcacttgttacgcaattacaatctcaaataatgagcttgctgtaagtttatagaatggccgatatcaaggcggtcctcctggatgtcaatggcaccctgtattccgtggccgatgctgccgaacccgcattccgagagctggggctggaccccgccctcgcgccggtgcgtgcgggtgcattgatccattgggttctgaaaagcctggtattggcccatagtgttgtgatctgtgcggttttcatcgatcccagggtggcgcggtccactnnnnnnnnnnctgcacccctccaaagataagataagacacatcccgacctgcccctccgcatgcaggcccaacgtcccggnnnnnnnnnnctccattgggttcttaaaagcctggtattggcccatattgttgtgatctgtgcggaattcatcgatcccagggtggcgcggtccacttgcatagatctggaacattcagagatggagatgattcttgcatcgtggacatgcccctcagaactctgagccacgcaccctctccccaacaagcttgcaggcatggtnnnnnnnnnnctgcatcgtggacatgcccctctcagaactctgagccacgcacccctctccccaacaagcttgcaggcatggtttgccaacgtcctgaaggatgcatttgcagcacagctggcggggtttttccaaccattcagggagtttgcgggcgaccacctctacaagctgctcgcacagaacggcgacaccatgtgaggtgtttgagggggcgcatggggttgtcattcatcgacggcatgcaggatgctgtgttgacaccggcagaatgccctgtgcacccctccaaagatgggataagacacgtcccgccccgcccctccgcatgcaggcccaacgtcccggcggcggtggacacggtgatggcggccctgacggccgcccaccccttcccagacgtagggcctggggtcaatgcgctgcaggccgccggcctccgcatctccgtcatgaccaacggctccgccgcgctggccaaggcggtgctggcgcgggcgggcgttgagccgggcgcgctggggcccctcatggacatcaacatggcggtggcctggaagccggcgcccgccgcctaccagtttgccgtggagaagctgaagctgcagccgtacgaggtgagcgcgaatcgctggagggaacggcaggaaaggatgcgcgggtggtgcgtgtgatgggcggccagaggccatccctctgacgccgcggcgctgccgccctggctttgaacggatcctgccgcataccagcgcgattgttgtgcctcggccgatgtccccaccatcgccggcatcccaatcccactccacaccacaccacacacaggtcctgctggtggcggcgcannnnnnnnnngaagggcaggaaaggatgcacggttggtgcgtgtgatgggcggccaaaggccatccctctgacgccgcggcgctgccgccctggctctgaacggatgctgccgcataccagcgcgatcgttgtgcctcggccggtgtccccactatcgccggcatcccaatcccactccaccccacgccacacacaggtcctgctggtggcggcgcacccctgggacgtgtttgcggcgatgcgggaggggctgcagggcgcgtatgtgcagcgggaggcgctggcgcactggccgacgtacctcccaaccacgccgaggtacaccgtcaggtcgctggaggagctggcggcgctgctgaagccgtagtcggggggatcagcgaggggtctggtacgcaccggccccgcctgattttggactttcgcaggctctctctccccattcatcaaatgtgcacatttgcaaccccccgacgtgttgttccgtaagaatttctagatcatacattggaatagcaatgagaacgctgcagcaccccgagtcgagggtgccagcccgaaatcgtctagcccaggtgcnnnnnnnnnncgattttggactttcgcaggatctctccccctattcatcaaatgtgcacctttgcaaccccccgacgtgttgttctgtaagatcttctacatcatacattggaatagcagtgagaacgctgcagcaccccgagtccaggatgccagcccgaaatcgtctagcccaggtgcaccagcacagcgccctccggccccgcccgccagcgctgtggctggggcgcggcgtccttccgcggcatcagcgccgggaggaaagggagcacggccggcggcacgcacgtggcctcggcctgcgcctggggcaccagggagcccctcagcaggacggcgtgggacgcctgcgcccactccgcgcccggctccaggcgcagcacgtggctctcccccggggagaggtgcatctggatctcgtgttgtactgtgcgagggagtggagggtgtttggaggtgtgtgtgagtgagcggagagtgagcgtgcgctggttggcagcctgggaatcccggcacgccacgctcactcacccatgctctgcaggcgcggcaggccggggccgggcagcgaggcgccgcccttgaaccagaggatgaccgtgctgcaggggggtggcaatggggcgttgtcaaggactgtcgtgccaacggaaggcccctctccaggcatgggtgcagatccgaatgaaccaggggaagctaggaatcccttttgtcaccagcagatgcacagatcagctctccactcnnnnnnnnnngccagggaagctaggaatccctttcgtcgccagcagatgcacagatcagctctccactcccactaccagaccctctccacctggtgtccctgttgaggtccttctctgtcccctccaacacctcggcggcggcctggatcagcaggtcgtcctggcacgcgggcggcagggcggccaaggaagccgcggggaacgtgtacacctgcgggccctgccccagcgcgttcacgtgaggggcgacgctgcggcgccagggcgaggtggcgccgcccatgatgaggtccagggcgccgtacacgaagccgacaccctgcagggcatgaggtgtgtgtttggcgcgagggaggatgggacaggagggtgcccggtgcctcctttcgagaagggccagcaggagggtgcccgcaatgcctgagaacccattcatggacgatttgtcagcggctgctgctccactnnnnnnnnnnaaggtccagggcgccgtacacgaagccgacgccctgcagggcatgaggtgtgtgtttggtgcgagggaggatgggatgggagggtgcccggtgcctcctttcgagaaggggcagcaggggggtgcccgcaatgcctgagaacttatcaaaggacgatttgtcagcggctgctgctccactccacgacagacacaccactcctcaacctggccgtgcagcgtacctggtgggcctccgcctcccacccgccggcgtgcgcaatggtggcggtcaccacgcccgaggccaccacatgcagcgcaggggcggcagccgagtcggcgctgctccagatcgcgccctgcgtcctcgtgtggtctgtggcaatgggaagggtcgtgtgcggagggtgagtgggattggtcggggctcactggctggccctccagcagccttgacagaagcttgcaaagacgctcagtggccatccccgacccaaccagtccctgcttgccttgcagcctcgctgcgtccaggagcctccgcagctggggctcggaggcgctgcagaaaacagggagcgccttgagcatgctgaggggcctgggaacccgccaggagggacctgagtgtggcgtacgaggggggggggggggggggggnnnnnnnnnnnnnnnnnnnnnnnnnnnnnntgaaattgcagaagaacatacaatgatggagccatcaatgctccacatcggagaccagattgggcaaacggttttcccacatcttgctccccacctgtggcgtccagccttcggatggcgccatccacggcccctccaagctcagcctcctcggcctccagaaagatcccctgggcacatagagagagtgagagacgtcagggagtgtacggcttgaagcacaataccagcagcagcagcaccaaaacattgcaacgtgcctgctggtagagctgggatatgtactccctctggctccgcagcacagccatggtcgtcctggcaggatcggtggagggaggtcaacgctaaggatgtgggaatctgatttatgttacccagtcaaacatgctacgccgccgggtggaacgtaacaagacggagttgctctttccaaagcaatgactggtaaacgcattcaatcttcatcaaccaaggtccctctcttcacacacacacaccggtacgattggagggcgtggaaatggctgggcgcctcagactgccgagagaccaggctctcccgtgcggcagaagcttccgagtggacctcctcgctgatgtcgcttgccccagcccactgtgcgtcagaggaatggaaggcggagcgttggaaaatcattcgagacagtgtcaatgcccagtctctgccagccccagccctctaggctcaccctgagttcccgcaggaggccctgcgacatctccagggcagcctcacaggcggtgaccatctgccggctcagggatgcttgtagcagggctgcgtggggtaggatagggggtaggagtaataacctggcggagatgtcgggggatacaccacctggggctgcggctggttgaccagatcatcaccatcatgcacgacccttcgacttctctcaccggtgaaaggcaaaaaaatgaaggcggcgcagcgctgcccagcgcgcggcagccgctgcggcagcaccaggagcttgcgcagtatgacggcctgcgcccgggtgccccacccgccgctgcaccaggatcagattggggcgggtgggtgggaaggtgccggagtcatctcggccgagtcgatgctcgcctgcacgacatcatcctcgatccaggcaggcggtggtcccgagcaggcatggccccaaaggaggagagcacnnnnnnnnnnatgccggagtcatctcggcccagtcgatgctcgcctggacggcatcatcctcgatccaggcaggcggtagtcccaagcaggcatggccccaaaggaggagagcacagccagccgtgccgcagcctcacctcacatcctggtccaccagggaccagagggtcagcgggtcgccggggtggagatccacatggtgctccgcgacctcgcaggccaagatgagcacatccagcccctgtggagggatgatgttgcacctttcctccacggcaggcatgcgctgggaggccaggccccgcccacaggcccgcagaggaagtcaaagacccgccacacgcacctgggaagaaagcaggcccgcggcacgctggcgctggaagtagcgctgaagtccagttagcagctggccgcgctggctcgcctcgtcgctgccaagcgcggcgctgcgggtgaggcaggagagcgcggcagggatgaggttgccggcacgggcagggtgcgttcaagggcggaatcagaactggcatgatccaagttcccggacgcaaacaacagcacagagggccccttgcacttgaggtcgctagggtctaggtgtgggaagagcttgggctgggagacgaggcggctgccgccggggacgcttggcattcgctggtgtacagcgacactcctgcacgttcaggtagcgaggggtgttggatgcaggcttgcggggacgtcaagcaacaccaggtgacggtgcctcgccccctcgtagcgcccatgctctccgctcaccgtgcgggtgctccatgttcccgctttgcaagggaaccatgggtctgcatggctgcctcccaagcctgcgcatcgatgggagcttgagggttgctgctgtcatatagcagcaccacagtctcctcagctggcacggggtccgattcatggtgggcaggcacgacggcgctggccacgccagccctgtgaaagtgctgcaggaagtccggcgcggagaacagctttctcagcctggacatgcctgacttctggggctggccgggggtagctgcttccaggtctgtgggcagcgaaagaaggatctgcgtagtccaggcctcaaagcacagcccaagcatttttggagcaaacctgtgagagaatgcctcaacacccgtggacgtcgacagattcaaccaggtcaacaccaaaagcagagatcgaggaaacatgcctgccaactgaccgtgtggcagtaaaatctcatccgatttgagtccagcttgctccggctgtagagacgcaaagcgtcctgaccggtcactcccaccccccgactcgggtagagtcggagctggcgtactctccgtgccaccgcttgccccgacggtcgcagatgagtccctgtcgcccactgggagactggtgcttgtgccgccgctggccttctcgaaagatgtcatggctgcgaggtggctcgtcatctccgccacctgctcccagttggcacctgcgggggggaggacaagcgatagcaccagatcaacaactgctcaaacagcatccacaacttcacaggccatcaacacagcaggagacagtgccttggacccacatctgttcttctgaattcttagtgggagcatctggcagcattggctctctacacacagttccataccttgcgaaatgaagctgtggtccgtcctcagagccgcaatcttgttgtcggtaaacttttgcaggagactcagaccatgcaggcgcagctgcttcctggcagctgacatctgtgggttgggtgtgggggcattctggcttgctgcaggcctttgcttacgggtgttgcccaacaaagccctcaattgcacatgagcagtgtagagctcatgccttggcagccctgcagccaccagctcacttttttaatgccagaccaggtcatgatcggtcccagcaagggagcgttgaccaggagggtgagcaggacaaatgcagatgtccacaccacgatggtcgcgttttcagaggctacaggtcgggcatgggatgagtgatgagttgaagagcatggcccactagcctgagctcaatactttgtaagtcccaacaccttcctgcctctgggtttctggccacgcgctcagaacttcatgcctgcactgtcaccattccagacaacccgtgcgacttaccaaccacagccgatgagtggaagtttgatgtgatgatgaggtccgccaccaggatcaaggatagcgccccccggaggcccccagccatgacaaacactgcctgtcccaggttcaaccctgagatggggacgggttgatgatgggacggcatggggtgaatggaagggttcgcaagcttcgagcccttcagcataggtgctttgcatcccatgatgcgcttcacaattgctggcactcctgccgacacttctctcacatgttccgcctttcaggacgagggggttgaagagcaggatggtgacaaagcggaacaggaacatgaagaggaagatgatgggtatggagccataaacccagccggggctgattaggtaatcggatgacctgcggaatggattggattaaggtcggtagccgaacagtaagccatgaacacgctctgaggcgcagaaagcagatgctgggttcaggccgcaggtcaagagacgatacacgctatcagccaattttgtgcagctgaccaagaacgcaagactgacgatccccagccctacactgcaaacgcacacaaccaggcaatcacctgacaaggaagttgagggaggccacccccgcccagaagaagaccacgccattcgcgacggcggagacactatcccagactgcaaaccacaccttttcctcctcctccagtgcaaacctgccccagagggaggtggcagcaccccacagaccaaagactgccacggcaatgactcccgaggactgcaaaggggggtgggtcggtgcgaaggagatcagagccccagtggtcagaacatcttgcgcatgtagagcggtggtatcagccgttgtctgagcgtgtgacgccaactggcacaagttttggcagatgggcattcgcaaccaacgcaccctccagcatgagaacaatgcggatgattggcagcaggattgtttcgtgcagggttccgcatcgttttggctcaagcaccatactgctccaaatcccggagccatcataagcatgcagcccacctgtgcgggcccctgcccaacgtaaaaggaaaggtaggcaatggccaggatgactgtggcatccaggggcacgggaatgccgcgccacctcagcagacgcatgagccagccggtgaagtagccgaatgccagcccgatggccaggcctatgctggtgagcctggtgatgtgggcgggaaaagaaatctggtgatccgctgggccatgatccaaagaggtgatgaggaacgagggctggcaggtgtgagcatggcaggcatgccatctcatcatgcaaggaacttttgatgcatgctctcatccttccaggcagcaacacaaccaaatccaggccccacttgaggatcttgaccacgatgtggcnnnnnnnnnngcttttgatgcatgctcccatccttccaggcagcaacacagccaaatccaagtcccacttgaggatcttgaccacgatgtggcnnnnnnnnnnccgtcttctccggaggggaacctcagggggatgcgcatgcaggccgttcagcgcacctgacgcgtcgttgnnnnnnnnnnccaggagagccgtggccgggggcaggggctggttctggtactcctccagcacctcagcaaagatggagtacagcgtgatggctggacgtgggtggggaagggggtgggatgtgttgggtcgtcttttccggaggagaacctcagggggatgcgcatgtaggccgttcagcgcacctgacgcgtcgttgaagagcgcctccccctccatcagcaccaccagcagctccgggccattggctggatgggggttttgagagggtttggattgttgcctgggcatgccatcgtgacgatggctcaaacacctggacctgaggtcttccaagcgttccaccctccacatgcttcacccctccccgagcccgcaccggctttcagcagggcggacaccgagacggcgtctgtgggtgccagcatggcggcaaacagagccccatgggcccagtccatgccccgcccagcaaagcccagggcatgcaggacaaagggggtcagcaccagcacgttcaggatgaccatggcgtaggccaggatgccgatgttgagcgcgacctggttgatacgggaagggtagttttggcttgacaggggggttcccgagtggagggcagcgggcggacctagatccgattggatgcttggtgcaggtacctacannnnnnnnnncgaccggggggttccagagtggagggcagcgggcggacccagacccgattggatgcttggtgcaggtacctacagtggagggtatgcagccgctgcaaccccagctcccaaagccccagcccaccttgcgaaagagggagaacctgatgcgcagcgcagcatcggccagcaggggcggcaggaagacgtagaggaagaggtctggcggctggatgcccagccagatgctgaccgcgttgcctaggtggcccaggtttacgtaatagtttactaccccgagcacgccccccgccaccagcacgcctgtcagggccagtttcccagacaagccggcggtgaagagcaccgccagggccaggaagaggatggagtcttggtcctcgagtgggacggagcagtagttgaaagactctgcacgaggagagggtgggttggtgaccgggataacgggtggggaaggtcttactggttcagacgcagaccgcgccgtgggctccacatgctcattccctgctaggggatgctcctttggtccatgcatgcccctgaactcggaacctcatccgggaaacgcaggcgccaaagcaggcctgaccttcggcattggaccgtgacttgagcgtgacattgttggtaaggcagtaggcttcgtcgtagaacgacctataggtctccggtgtccagatggagtgcagtgcatgcgccagctcctcattgaattgcgtggagttcatcgcgcagatgcaatacttataggggttaaagcgctgtgggtgctgcgatcagcaccgcgcatgcagcgctgaatcggtccagatgctcaggtcatgaagcgaggcggagggtgtcctcggcgctctggccgtcgcaggaaggaccgttactcctttccatgacatctattatgaaccaaatgctttgtacacatcatccagagtcgcagctgcgccatgtggggatggctggcgcattgataccccaagagcatctcgcagggttttgcgccctgcgcatgatctcgtggaggggcgaggtgtcacaaaaggtggagcaagtctcacaagaaggggcctgcgatgccttcctccagatccagattgaatctgttcgtgtaaagtccacgatatgtctgcgctcacgatgacgacggcaccgtgcctggtgtcgagtccagggagtgccctgagaggtcgaaacttctctgccccgttccaaagtgagtttcggacatgctggtcacgagcatacgtgatgtttctatcacttacctgtggcacactgggcaactcgcatgcaccatcccacaggtgcctggcggggtcgggggagacgctgctccacagtccagatccatgcgatccgtgatccacccccgccgccgccggggccgcccgcccagccccccgtcttcaacagaatggaggacatgatccagaaccggttagggagcgatggcccccaggccggatcgcgctggagggaggtggctggggcctgggtgctcaatccgccgggcaacgagccctcagtggtggtgcactttgtgggcggtgcctttgttggcgcggccccccagctggcataccggcccttcctggaagccctggcggcccgtggcgccgtggtgaggaggctggcggcactggtgtggaggatgggtagggaaacacgagggtgcctttgaaatgaatgaggcaaggctgtctttgcatggaaggcctgatgtccgaacatcctactgctgctctacctggacagccaacaactcctggacgccccgagggttgccgagagggctggctggctgcggaaagaagcagtgattccggtggtttctgtgcctcgatcacctgcaagctcacaacacatccaccccacagcccactgaacaccnnnnnnnnnnggaagtctgaacatccaattgctgttctgcctggacagtcaacaactcctggacgccacgagggttgccaacagggctggctggctgcggaaagaaacactgattccggtggtttccgtgcctcgatcacctgcaagctcaccacacatccaccccacagcccactgaacacccccttccggcccccacacccacccaggtcatcgccacccccttccacaccggctttgaccacacacgcgtagcggatgaggtgcacttcatgtaccagagggccctgaaggcgctaggaccacgggcccagcgcctgcccacttatggcgtggggcactcgctgggctccctgctgcagctgctgctggcctcgcgctacgtcgtgcagccggccggcaacatcctcatgtccttcaacaacaagccaggtgagatgggctggcatgtgggaggtcatgcttgcttgctattcccttggtccatggaccatgtgccggtgggccacaggcatgctgtatggtgagcttggacaggcgaatgggtccgggctctatgtctcgccctgtcgaccaacgcctgacccgggcccttcccctgccccttcgccagtgacggacgccattcccctgttctctggctacatcgcgccgggatcgcagttcattggccccctgctgtcccagctggcggcgtcgcccctcagaagcagcctggagggcttcctgnnnnnnnnnnaaagggggccaggctctatgtctcgcccggtcgaccaacgcctgacccaggccccttcctctgccccttcgccagtgacggacgccatccccctgttctctagctacatcgcaccgggatcgcagtttattggacccctgctgtcccagctggcggcgtcacccctcagaagcagcctggagggcttcctggcctccctcaagagtgagctggctgtggaaacgaggggccgaaactttgggctctgaatgggacggcgttcacagaatgagctacccgcatgagtccctggatagatcggttgaggaagggctgcctctagggggaggcttcaactttttcgagcaggcatctctggccctgctgctaccgtgcatgtgcccatgcaatgctctcttggtcccgggcatccccatggccggcaccccccccgacgccccatcaagcatgccatctcttcatccgataaccccttgcatacctcctcatgtcacctccacaggccagtcccctgatgtggtgcggcagctgaccccggtgatcgagcagctcctgcccatctacaccgacatcgccaagggcacccgggaatttgtccccagcccggccgagtgcaaggacatgatccgcgaaggcaagggagtcaatggggaaaggatctcagtggatccctggagggcctttggtggccatccatggtggcgctgtggcgtccctggctcgaatcgtccctctgggctcctcccaatacctcctccccttcccctccctgtgcaggctatggcgtggagcgcaacctcctgattcgcttcgccagcgaccccatcgacgacacgccgcagctggctgccacgctggagatgtcgagcatcgcggacttgctggacctgcagcaggtcaccctgcccggcacgcatgtcaggcccctccagcaggtaaatgaaagggagagggagaggtgcaaggggggtgggaaggcggcgattggggaattgggggggtgcatagcagcagggtgacctccaccaggccctcctttgcccgatattcacatgccagcgcacgaatgtcgttgacatgnnnnnnnnnnggcagaccctcctttgcccgatcttgacatgccagcgcacgaatgtcgttgacatggacttaggaggcttctgatacatgtcttgcccatagatcaacccctccccccccctccctctaacaacaacaggagtttggccggctgacatcagacgtcggcaagtatgcgcaggcggcccgcacgcagagcgaggcgctgatcgaccagctggcgcagatggcgcggggggcgggcgtgcccgccgaggccaccgacgggctcagcggcttcgcccgcgctgccacgggctttgccggcgcgttcggggaggccatgctttccagcacgacagagctggacatctccagcctggccgacgagtgcggggtcttcatgggcatcgtggtacccccgccggccacggctttgggggtcagccccgatgcggggcgtgccggtttcacacccaggacatgaccatggaggatgtaatgtagttcgacggggcggggcggcggcctgtgggggatgcggcgattgagtacccagggcacaaattgagagctcacggtggtgggaaggggaaggcagccaaccagagtgggagcctgggggagaggccccgtaatatcacaccctggtatgatggcccataccgcagccatgcaagaatctcctgtggatgttttcaagtcctgagttcgtgatgcgacagccatgcaaggagggctcgagggtgtgtctcacaagtgtgcttgggnnnnnnnnnngatctcctgtggacgttcccaggtcctgaattcgtgatgcgacagccatgcaaggaggggtcgagggtgtgtctcacaagtgtgcttgggtgtgcatcccgttttgcattgtgttcatggaccctggctgatctgagcgtccacggttgggccagcagtggggctgacttgccatcgtctaggtcgctgcgccatccctccaccaccatatttaagtcgcacacgctcaccatctccatgtagcgagataggcgaccgtcgacccatgttctggagatcnnnnnnnnnnaagaccctggctgatctgagcatccacggttgggccagcagttgggctgacttgccatcgtctaggtcgctgcgccatccctgcaccaccatatttaagtcgcacgtgctcaccatctccatgtagcgagagaggcgaccgtcgacccatgttctggagatctaagttccgtaaccatatctcatgagtgacgggctggtccccgcaaagtggacggacgcagttggccggcatgcgaattatgatagaaccgtccatgaatgcattgtgggttgaggttcggaggtgtggcaagtggggtcgggcatggcatgattcattacagcactttggggaggaaggtggccgggtcattaatacccctgtcgaaaacgactgaacatccaacctcgcgaatgctaaattcaatgcaagagagcattcggttgactgtgactgcaaagcgccaccaaagtgtacttttactggagttgctgcttgaatcccttgcctcctgcgaggcgcatgcatgcgcagggccagcttgtgcagggcttcaaatatctcatggcttcattcggtgacgacaaaaatgagattgggaaacatcaatccatgcctgtacatagttcgcaatgttgccaagaactgccccgtaaccattctcctgctggcatgccaatgtatgatgaaaacactaccaacaacgtatgcggcgcacgagtcgaagatatnnnnnnnnnngaaaaatgagatggggaaacatcaatccatgcctgtacataattcgcaatgttgccaagaactgccgtaacattctcctgctggcatgccaatgtatggtgaacaaatgacacaattgcgcgcgcaggtgaccctccgacacactgatcaactcccgtgcctctccaccatatacaaggcaccccttccgtaatactggtacacctttatcatgactatgatcggcgtgcgttagtgcctgttggtatgtctcggcccatgcatgtcgtgcgtcgtcaccgtgtttcggtccatgcaacatgcagcgccgatccagcaccccctccacccaagaactggaggcagcgggcgaggcccatccctccaggaagtccgtaccctgccaaagatcattgcagtagatgcgggctctggtgagagcatggagtgatagagacccgggtctgtggtcctactcacatccccactgcttcaacgggaaactaacaacgcggcccatgcatgctcctcgcagtgacacatattacgtggcgcatgtgaaggaggcgtgtgcattcctgggagatggcatgggagccatacatgacctggaaaaggaggtgcatgggcgagtcaggcaagtcggtaacggccttggtgtgttctgtgagatgtattgggctgacgctcatgctgtggcatacgactgcccacttgttcatgggcacaccccactccnnnnnnnnnncaggaggtgcatgggcgagccaggcgagtcggtaacggccctagtgtgttctgtgagatgtattgggctggcgctcatgctgtggcatgcgaccgcccacttgttcatgggcacaccccactccaaccactcagcccagcattctgttcacagagacctcacagacacccaggagcaggggatgggcgtgacaactgaggtgctgtatgcccgggtcaagcccccagtgcccggggctcaatggacaggcgtcgtcacacaggtgcgaacaagggagccatgggttgtgcgcaggttatcccatgagtcttgcaaggcgtcccctgtggcttcgctgtccccttcactgcccacgaaaagtactgtgcagatcgcagtccaggcgctggagacggggctggtggaggccgttgtgtgcgtgcagagcgagccaggcgaccacttggcccccttgcccgtgagtggtggcatcagagggggaactgaggaggggtgtgcgccctggctcggcttccgtccaaccctcccaccctcccactggctcgcccacggannnnnnnnnnaagcgagccaggggaccatttggcccccttgcccgtgagtggtgggatcagagagggaactgaggaggggtgtgcgccctgggtcggcttccgtccaactctcccaccctcccactggctcgcccacggaccaggtggtggcgcggagcgtggcggacatcgtggcggcgcgtggcgtgaagccctccctgtcccccaacctgaacaccctggccctggtggagagcctgggcatcaagcgcctgctcttcatcggcgtggggtgccaggtgaagacgtttggttgctgctgctgttgttgttgtgtattgtttttgaggggggtggggtgttgttgtgtgggctgagtatttggtgccaggcctgggcacatgccattcccaccatgaccatcctggcaatccccctttcctcccaaggtgcaagcgctgaggcatgtggagaagcacctggggctggaagcgctatatgtccttggcaccaactgcgttgacaacgggcgtcgggaggggttggcaaagttcctgcaggccgccagcgacagcccagacaccgtgctgcactatgagttcatgcaggcgcgtgcgaggggaagaaaacgtggagaaagagacagcaggtgccagtcactctgtctcctgcaggcaggcaaaggcgaaacccctgcgattttctctctgcaagcaggactcaataccttgccaatcccnnnnnnnnnngggcgaaccccctgcgattttctttccgcaagcaggactcaataccttgccaatccccacatgaaaaccctgcaggactaccgggtgcatctgaagcatagggacggccacttcgaaaaagtgccctacttctccctccccgccaatgacctgaacgacgtcatcgcgccctcctgctacgcctgcttcgactacgccaatgccgccgcagatgttgtggtggggtacatgggcgtgccctcgctgggagtggacatgactcagcaccttcaggttagttggtgagggtgggcatcatttcttttgccagagtttggggccctgtcctgatgcagtgggcctgccttggattctctttggaaacccctcactcacccctcccaaccttcctccacccatcccatcaccagtatgtcactgtgaggaacgagcgaggggctgccctcctcaaattgatcgaggaaagagtggagaggaggcctccggtgtcggcgggcaatcggaaggcgctggtcctccagaccgtcttggccgatgacgagtgcgtctgtgttcgaggaggttccagatactgctgccaatgcccctgggcatgcacttgcagggatgcatacttcttgtctgccttcctgacgtgcctggcagcaggtctgcaatgaaaaaagcccataccaccaccacccattgcgcctctttgcgcagggcnnnnnnnnnncacttgcctggcagcaggtccgcagggaaaaaagcccataccagcaccacccattgcgcctctttgcgcagggccaagctgggcaaggggcccaagccgatgccacggttgctgggcactgccctggcctggctcctgaccaggttggggccccgcggcatggagtttgcccgatactccctcgactaccacgtcatcaggcaaggattgaagtcccatgcatgcattttgtgtcagcctttgccggtggctgtttggattctgcaccgtcacaaatccaaacatttcatcccctctagacaaacccggcatcgcaggaactacctccacgtcgtgcgcacctggggcaaagagagggcagcgaggcatgtgccagcctatgccaagcagattgtcgcagactacgatgccaagggtgccatctctgccaggtaggtgggtgcttctgatgggcagggtcgggctgcaggcagcatttagggccctgccatgcgggtgtcacctttactccatgcagcttgccatcgcaagtttttctgctggcattcacaggctggccctgacggacgcgacatcgagcaaacgcgcagccgagtcgagctgacctggcgaccatcagcaagtggcagctgtcgagtcctggcagcgccctgcacggctgctgctggtgctgccttgatattcttgcccatcatcacgccttgtagaatgagagactggtcaagagcccatgctcttctgctgtgtcagcagggcgcagggcttcactcccggccagcgcacaggtgttcttcacatcctcctgcaaggttattggctcggccacctcaagagagtcaagctacgccagggagtggcacagggcaggcagcacctcgtacatggcaaaacctgactctgcattcgtcactgcggccagaaagccggcctcgtcgagggtcggggagtcggaggtttcatcgccagagtcccgacgcccgccctcctcgtggccgggcgagaagatgcgacgcagcgtcgccacgtaggcctgggcgtcctgcaccgtcacgcccgcgctccctttcttccagctcagaatgtcaaaggccgccatgacccgccccctggccccgccgttcctgcacggcggggggtcagcgcgcatgggtgcatggagggaaagggaggcgggggcctgcggcccagtcccttgcggcatcccagcccggtcctgtggacccgggacccacgcaccctagggccgcaaggaccatgagcagcatggccaggtcgacgtgcccggtcctgccggggtcgagcggggccagcaccctcgagttcagcgtgcgcatcatgtgctggaactgcgcggcgggcgtggcgtggagcacgccgcgcagcagcgcctctgcacgcgtcagcctcagctgcttgccctggagtgtggttgtgggagggggggagggggggatggtggacgctgatggcggcaagggagggcgtggcgcgggaccccgccgcaatgtcatcacccaatgtctggagcgtcgccagacaccatgcctgcacctgcttcaggctcgccacgttgccgtcgtgggcctgcgccaccaggtcccccggcttgaccccggcgaggggcgccaggtgctgcagcaccggcacgtccacggcggcggtcacggccttcacatcgtaacccaggcgggcgagctgggagcggggcgtccgggcccccagggtcacgctgctggcgcccctggctggagactggtgcggtggaagtggtgggggtggttggggatgaggcggtgtgttttcgttctactggggagagggcatggcagnnnnnnnnnncgatgtggtgggggtggttgtggatgagacggtgtatttcgttctactggggagagggcatggcaggtgatatcgaggaggggacgggcgtgtgtgaccgaggactgcgttcaacacaagcaagtgtgcacaggggcgtctgnnnnnnnnnnaacgtgcgtgtgtgaccgagaactgcgtttaacacaagcaagtgtgcacaggggcgtctgttaaacctcctcatcgcccaacatgccgagcctcttaccgcgccgcctgccggcctgctgctgcccagcccacggctgaagaggccgcggctctggggcgtgggggctgcaccggtgcccagcgactccaccttttaccggggggaagggatggagagttgctctctcttttccaagcaaatgctgcacgagctcatcaaaaagccctatgcttggctattcactcgccacggatgtagtgagcttctgcccatcatcgagcacgccccctcgatccccctgcccgatgcacacaggcgccctggcgcgacatgcctgcgcggccttgtcggagatgtaggacatcatctgcgagatggcgtcccagtctgcgccctgcctcagcatcttcttcagctggtcgatctcctgctgtaagaggcctccctggcctgcagtggtcggggaagagcggtggaaatgcgtagggtggtccgaaagcagggcgccttgcgcctgcctccagctgcggggcttgcgtcaaggggcaggaatactcaaaacacacaggcgtgcatagtcggcttgaaaccaagacatgccccgagggaagagcatcactctgaaagctgctgcaccctccttcccctcgcagccctgcctcaccagagagcctgagcgcctgcttgaggttgaaggccgcctcgtcccgatcgccgatgcaggtctggaccacagccttgttgagcagggagcgccagtgccctgggtccgcgcacagcacatggttgaagctgcgaggaaggtgagggcgtgttgtgtgggactggggnnnnnnnnnngaacgcacaggcgtgcatagtcggcttaaaaccaagacatgccccgagggaagagcctcactctgaaagctgctgcaccctccttccnnnnnnnnnngtgccatactgcgaatcatgtgtgtgtggcccagttgggcgctgcagcccgccagctggccaggctcccgaagggccatctggatcaccaggccttgcagagctcactgacctcgtcnnnnnnnnnncgtgccatgctgcgaatcttatgcgggtagccccgttgggcgcagcagcccgccagctggccaggctgccgaagggcaatctggatcgccaggccttgcagagctcactgacctcgtccgcgtctgtgaagacctcctttcaaaccccccacacacgacaggcacccgctcccactcacctctggatggcgctctccatctgcttgcactggcgatgtaggttgcccatgttgaagtgggcctccagatgcttggggtcgcacttgacggcgttccggaagcactgcttggcgttctccacctggtccagcgcgcagtatgtgcagcccaggtcgcagtgcgcgtcggcgtagtcccgcttcagcctgagagggcaacatgagggtgggaaggggggaaaccccggcatgggtaggatgcgggctatggggtggcacttttacctacgagccggttgtcctcttgaaacggcgcatgctgcagcgcatctgcagcgagtctcacgagtgtcggttgcgccatcgaggcgtgcccctcttgtacacaacaggaatgtgccgctggccgtgaccccccaccatcccccctgcccccaattgcttgcacctgagagccgccttgagggcacgcttggcgccgtcaaagtcccccagcgcgtacttggccgagccagtgagtttgaaggcccggaagtggttggtgttaagtgctgtggcttgcctgattcagagggtgggggtggtttgtgtgtggtggattgcaatagtagggaggtgagccgttgccggcgaagctcagcgaaaggggttgggatcgagctgggcagcagccattcaggctcacgccgtccaccccatggaatttccgctcccctctagggtggccccaaaagtacaggcacacactnnnnnnnnnnggggcgggggtggtttgtgtgtggtgatttgcaataggagggaggtgagccgttgccggagaagctcagcaaaaggggttgggatcgagctgggtagcagccattcaggctcatgccgtccaccccacggaattcccgctcccctccagggtggccccaaaagtacaggcacacactcactcgtactcctcgcaggcagccatgagcaggcccgaggcctccagcgttatgcccaagttgacgtggaccttgacggccaggggccgctccgcctcgccggccgctgcgcagagggacagcgcggcgcggtactccgtcgccgctgcaacgtagcgtgccagcgcgaagcacgcgtttcccgcgcggaagtgggccagcgggtcgcgcggcgccgccgcggcggccgcccggaagctggtcagggcctcggcgtggcgccctgccgcgcccagcgcctgacccacctccagggccgccgcggcgcgtggcgggggcgggagggagtctactgccgcctgcacggcggccacgtcgtcaacgttggcgccgccgtccgccagccgccggcgcagctccgcggccaggacccggctgtactccgcctgggaagggggggggagaggggggcattggagggggtgcctggtgaggtggcaatgtgagtgatcgagagggtcagcggttgatgcctgcggcgcttcccgtacacctgagcctccggcagagggtccctcctgcatgcacatcggtgtgaggcgcaacagtccacaaaccgggtccnnnnnnnnnntgcgcccaggacccggctgtactccgcctggaaagggggggggagagggggccattggagggggtgcatggtgaggaggcaatgtgagtgattgagagggtctgcagttgatgcctgcatcgcttcccgtacacctgagtcaccggcagagggtccctcctgcatacatatcggagtgaggcgcaacagtccacaaaccgggtccctgcagtcccctcggcccctcttccgtgtgatctcaccacctcggccagggtccgcccgctccagtcctgcccaggtctggtcagctccgcgagacggtctcctggagaatcctgggcgctgtcgacggcaggcacgggcctgccctccgactgctcgacctccannnnnnnnnnccctggagagccctgggcgctgtcgacggcaggcgcgggcctgccctccgactgctcgacctccaggactgcggttgcctggccagaggactccctgcccgctccaggactcgcagcaggcatcgctgcagcggcccggccggccgcagcatgggcccgctcaccgaggactgcgaccccagcgccagctgtccccgctgaggtgccgcgcacagaacgcgcgggcgtcgcgccgagcgcggcacccccgcccgtcgctgagggggtgcatggcggtgcggcaggcacgccgccttccacggaaccttgcttgttggtgccgtcttgtggcgtcactttgtcgagactcgcaggtgcccgctgcagctgcagctccctggctcgcccggcgctctgccgctcccgatcgagcaggcgtgccccccgcggcagcgaagaagtcacggcctccagcacggcggcggtcccgggggagggctgttcgctggacgccacgctttccagcagagggcgggccggcagggtgacgctcacctccacctccaggtcgccggggaccgcggcgcccggccccccacggacctccaccacagcatcgtctgtggagtgttgaagcggggggttcttgggggcggcaagtcaccggcacaaaaggagcaggaaaccgaggcataatgatccagacacaaacacaccgccctcctgcccagcgcctacctggcagccgcgaccgcagtgaggccagcatctcctcctgcctgctgggcaccgccacctccctgcggcggaagaggccgcctgttctctccacgcgcggcgcctcccaggcctccacgctcgtgtcggggacgtggacggagacgcgccgcgcccgccgcgctggctctgccgtcggcagcgccgggctggtttccggggtgtgcacgcccgcagcacccgcctcttcctcctcggaccagcgcagccttccctccgttggtctgggcgccttggtaaccatggtcggcagcgacgcaaaggcgtccggggagatggcaggcccgggcgaggccgccgcgctggcggcggagtggccgggcatcggcgtgcctggcaggtcccagtcatcctcgctgaggtgtgccggtgcataggtcgccgctacctcgccggggctcccatcaccccgtctcccgacagcgccatcaccagggcccacgcccggccctgcctctgcgacttcgcagggacccgcggtcacggcagccacgctgtgcgtcgccgggctgtggcccgaggccgccggcggcgccccgaccgcaaccacccgcccaaacgtgtctggagacaggacctggcctggctccaggcgcagaaccgcggcgaggtactgcgcctcctccagcgccgcctcggcgtcgggggcgtcgtccagcgtcacggccagggacgccaccaggccgccgccgggcgcgggcgccaggcccctgacgttcaccctgctgccctctgcatttggttgggggaaagaagatgaggcagtgggcagggccaagcaggcaacggtgagaggtgccgagtcaatggcagcccatgcgacgcggtcaagggtgcaggacactcgaaatggacacctgtagtgctgcactacatttggcacccactcgagaccccagccatcctgcacgctctcaaacagttccaagtcagcagaaacttattctgcaggcaaggagtcccagccgtcaccacggaccctgtgtgaatccacacgggctcacccgggcaggactcctggagggcggcgaccaggggcgcggggtcgaagccatcctccgcgtccagcagcgccaggtgcaccagcacaggcggcgggggtgtggcgctgagccggcgggcggcgcgcggggtggggcgcagcatgcccagcatgcctggcggcgcgggtgtccggagggcggcaaacacgtcgccggccgactcttcctcctcgtcagcaggcgtggccggcagagaatcagaaagcgcggcacgggcgctcacgccccacgtcgagcccggcgcggccgcagtggggccggcggagttcatcgccgcgggcgtcgccagccgggcctcgccgnnnnnnnnnnggtatcgcgcgccgcatcctgcggccgggtgcctcgtgcgggaggggtgccgcacagcgccgccccgcccgccggctgcggcgtnnnnnnnnnncgtatcgcgcgctacatcgtgcggccgggtgcctcgtgcggggggggtgccgcgcagcgccgccccgcccgccggctgcggcgtnnnnnnnnnngggcgcggccgcagtggggccagtggagttcattgccgcgggcgtcgccagccgggcctcgccggccggcagcgctgggttgctggcgggggtggccgccatgctggcgggccgaggaaagggcgaaacagtccagggcgtcgcccccgggaaggccaaggggtgcatcaccacgggaaccccaggccctgctttcttcccnnnnnnnnnnnnnncccgctcggagaggtcacggaagccgcgcgcacagaagggatgagatcccctgcttccccgctgttctgtcgcgccagctccgccaggtgtttctgggcgctcagcagctccatcggggtgggagatggcgccagaggactcgggacgggaggggtggcttgcggcgtctgctggggaggtttgtggggtttgcatggtacactattgtctagaggacagaatagggattctagataggcacatgaaagggccacaggctccagcnnnnnnnnnngttgtggattttgcatggcacactattgtctacaggacagagtacggatcctaggtaggcacatgaaagggccacaggctccagcaaggcaggtcacaatcggctcatgcaatgcgtgtactgtaaacatgatgtcagtttgggccacccacagtcagcgacctgccaccccaggacggcataaccaggtacaagaacaacacacctcttccagggctcgcttcgcctcaagggcgtctgcggcccgttcgcagaccagacgatagtcatgctctatgtcggccaggccgctggtgtacagactacgcaggccgtcccgtgtcaagccgtgggaggagatgtggtccgagaaggacgcccatatctgcatgggcggaggtgagagttgcagatgcactgtcttaggcaaggcatttgggccgggcaaagagcagccattcattgacgatagcttgcacaagagagtctccatcgtacctcttcgacgatgagctgtatctgttcctctgtcaaggcagagtccgggttgcaggatcggaggagccaggcgacctcatcctgagccacgggaccatgtcgagggtttaaatgcaatgggggacgaaaggtgcggcgagtgcaagctagaattttaatgtcttccgagcattatatgcccctcatccatggactcctcacctnnnnnnnnnngaatgcaatgggggacgaaaggtgcggggagtgcaagctataattttaatgtcttccgagcttcatatgcccctcatccatggactcctcacctcgtcgaggccgctgtcggcattccgatccgaggcggagaatatgtgctgcacccgcagctcaaatggctgcagcgtagccgtcatgctcctccaatggacattcctccggaaacaggatgcagtcagtgcatatgcgagggcctggtgcgccgggtggttgcgcctgcgtgagtagcggcagggcgcaacagctgcgcgaatttgtgtaaacggagcctagggtactaatttggtaccgagtgccgggatggaactggggttgcaccctgagannnnnnnnnnnnnnnnnnnnnnnnnnnnnnnnnnnnnnnnnnnnnnnnnnnnnnnnnnnnnnnnnnnnnnngtaataaataaaactctttgagcatgcgtggttggagcatcggccccattgcatgactaagttgtgcttcccaaatccacgccaggacgtattgcgccaaagtcttgtggcaatgaccgggnnnnnnnnnnataataataaaactctttgagcatgtctggttggaacatcggccccattgcatgaccaagttgtgcttcctaaatccacgccaggacgtgttgcgccaaagtcttgtggcaatgaccgggnnnnnnnnnnagcgtgagtagcggcagggcgcaacagctgtgcgaatttgtgtaaacggagccgagggtactaatttggtaccgacttccgggatggaactggggttgcaccctgagatcaagacgtatgctagagtatttggccttcacatcacccaaaatatacacgatannnnnnnnnnnnnnnnnnnnnnnnnnnnnnnnnnnnnnnnnnnnnnnnnnnnnnnnnnnnnnnnnnnnnnnnnnnnnnnnnnnnnnnatgtcgcaaaaatgataccgaaagatcaaacatagtcatcgtaacctgaatttatactctagcgggcctactgcttatcgacggagcaggcgagttgctggtttgaggccctccaaagtgatcacttttggaccgggcaagtcataaacttaaacctctgtccgactttattccaattaattccacgcgacagtttgttttggtatcatggcgcctgcgagtaatggcgcttcacattcaggcgctacgccaggggctcagcaatccaacccgccaacgacatcgggagctcctcaggtgatgattggcagaatacacatatataccttctcgaaagcctatccgcctgcctatgacaacaagcactggggatcgggagtatatgtgcagcatttaagccaccttgccactctccccgaaccttcagttgaatgaggcacagctcctggcgctgaatcccaatgctgtgctggtcagcaagaggcaagagggcaatcccgtgctgcgacatatgcgcaatgtgcggtggcagtttggggacatcgtgccggactacctggcaggccccaacaccgccatcctcttcctcagcctgaggtgagcgcatgttgatgtctgatgtacccttgcatgctaatggctgaggcttggttggatgcatgattggggcatgctcaccgataatttgctgtcgtttgctcgaagaccattcaattttctctcctccccctggctttcatgtatgcggcacccaggtttcacttgctcaagcctgagtatatttatgggcgcatgaaggcgttgcagcgagcctaccgactccgtgtgctcctgtgtcatgtagacaccgaggatgctgtcggtcccttgggagaggtgagcgtgggtacacccgctgaacnnnnnnnnnngtttgctgtcgtttgctcgaaggccattcagctttctctccctcccctggctttcctgtatgtggcacccaggtttcacttgctcaagcctgannnnnnnnnnnnnnnnnnnnnnnnnnnnnnnnnnnnnnnnnnnnnnnnnnnnnnnnnnnnnnnnnnnnnnnnnnnnnnnnnnnnnnnccctcccaggtgaccaaggctgccattggactggagtgcaccctcatatgcggcttttcgccgcaggagtgtgcgcggtacnnnnnnnnnntcctcctaggtgaccaaggccgccattggactggagtgcaccctcatatgtggcttttcgccgcaggagtgtgcgcggttcattgagacatacaaaaggtgcatgcgtgagagcatcagcaggggttgtggttgggaacaatctgtactcaatcctgggcaaggcgctgttggaaagccagctctgatgcccttgtacatgacaagcagccccacaatcttggcgcacgatgtacagctttataattaccgattgcaacctcaacagttatgagagcaagccggcagacagcatccagaagtcggtgggctcggactttgtctcgaccgccactgctgcgttgacatccctgcgnnnnnnnnnnacacaatcatggcgcacaatgtacagctttataattgccgattgcaacctcaacagttatgagagcannnnnnnnnngggtaaacaagacagatgtcaagaccctaggagacaggtgccagagggagtgagtgggatggacacatgcaaactgacgcagaaactccggccatggaacttgccttggcgtttaagagttcatcgtgatgggtctcaatgctgtattaggtagctctacacaacacaccctgattgatgtatcnnnnnnnnnngcttgccttggcgttgaggagttcatcgtgctgtgtctcaatgctgtattaggtagcctctacacaacacaccctgattgatgtatccaacaacgattgaaacaggtttggatccatggctgcactcttctctgcatccaaggaggagctcgcactctgtccaggcctggggcccaccaaagtgaagcggctatttgaagcgtgagctgaagcggtgattgtgagggaaaactgtaggtagaccctgtattttgcaagaagatgtagcagctttgactagatggaacgttctctgtgatgaactcatgtgagcaccttctcgcaccggtatacaggttccacgagcccttcaggaataccctcgtgccgcaagcagcaccagaagtgagagctacctcgctgggacggccatcgcaagtattccagcttgtggacgcccaagctgcagcggaagtcaaggttgctgtggccgctcctccagatacccaggcgcagcctggtcctgcggtgacagatcctgctgaagatcccattccgtacagcttggaagatgaggatgatgacgacttcgcctgatgtgtgggagagtgggtgcggaccccttctctgcagagtcagtcccctggttgagcttgtaactgagagcctcaagagcactagttcagcgcgcgcaaactcagaagtccgaaaccggtgctgcatgcaaattcagaggcaagggatggagcgttaatgaggctcccactgattttaaagtcggtttcttagaaaatactgaacataaaactcaattgtgcagcgcttctcgaggcgactggatgctgcggtgnnnnnnnnnnagaggctcccactgatttttaagtcggtttcttagcaaatactgaacataaaagttaatcgtgcaacgcttctcgaggcgactggatgctgcggtggtctctctgaaaaaccagccgtgcactgctctccgccctggcttggcactgaatgaagcatgccgactcgaagaagaggcaatcacagtctcaaaaatctgtggagaggaaacggttagatggtcggcagcccctggaaggtgctgcgccgcaaacgtctgcacaccaacgacccaatgcnnnnnnnnnnaatggccggcagccccaggaaggtgctgcgctgcaaacgtctgcacaccaacgacccaatgccgccgttcctgggccaaatgtgcagggcatcaagtataccagagtgagtgaggagcaaggagagtaaaacagatgcattatggacggcatgcagcagcacatcacggtgnnnnnnnnnncagggcatcaagtatagcacagtgagtgaggagcaaggagattaaaacagatgcatcatggacggcatgcagcagcacatcacggtgtgctcggcatgagagccaacccatgctcaccactccttccaaaccccagaaagctggcaagcaggcggcgcgacaaccttttgtccctgggccgtccctcccagcccagaagctgtcgagcggtaggcaggctttcgatgaagggacaggccccattgtcttctggtctggcaggagggcccctggctgaccgaccttggtgatgcttgactgtgcaccaggctggtcattcaccttgaaggatagggtcttccacacagcattacaccatgggctcctgtacactcgcgccgttgcctcgccatcctcacaggaaagaacaagggcagtatcctggatcgcatgcgccagcgtctgacgggcggccgcttccgctggctgaacgagcagatgtacaccagcgagggtgccgacgcgcagcgcctgatgcagcagcacccagcatactttgacgagtaccacgagggtgaggggtgcggaggagtagggttgcaggtgctctttttccaagtctcaggcgaggtaggcccagtgtaatgtatcagttaacaccccttatcatgatcatcaatccgatccctcccccccctccctccccctccaattcctatgcaggctttcgggnnnnnnnnnnctttccaagtctcaggcgaggtagacccagtgtaatgtatcagatacacccttctcataatcaacaatccgatccctcccccccctcccccccctccaattcctatgcaggctttcgggaacagacgcggtcctggccccagctcccagtagagaccgcgctctcctggctggcctcatgccccaaggcctggcgtgtggccgatctggggtgcggcgatgcccagctggcagtgcgcgcagcgcagcgtgtcttcagctacgacctggtcgcacgtgctcctggcgtcgtggccgccaacatggcggacctgccgctgggcgacgccgccgtggacgcggcggtgatgtgcctggcgctgatgggtaccgactaccccgctttcctgcgggaggcggtgcgcatcctgaagccgggggggatcctctggatcgcagaggtgcagagcaggtgggatgtgggtggatgggaggtgctgcggatttcttaggtggggatgatgacagaagcatattcacccatcgggccggtcactccctgcgtttgctgtaggctgcaaaggcaagcggtccccagggaggtcgatgttgctttgtgctttgagtatgggtcaccatgctcacttcctaagccggcatgccctctgcaggttcatgcaggagtcggggcagnnnnnnnnnncctgagtatgggtcaccatgctcacttcctgagccggcatgctctctgcaggttcatgcaggagtcggggcagggcagcatcctggagcccttcattgctgccgtagaggggctggggaccgagctgaagttcagggacgagaagaacccatacttcctgctgctgcgcttcaagaagaagtccaaggccgctgtggcagatgtggaactggacgaagatgaggcggcctggccgacgctgcgcgcctgccagtacaagaaacgatgacatgcaatgcaatggctaagaaannnnnnnnnngcagagtcaaggtcctcgaaccaaggaggggtgcgagtgttggactgaaggaggatctcctcggatactgcagttgctggaaggaatgggctccggcccggcttgatccggtgcttcnnnnnnnnnnacagagtcaagtacctcgaaccgaggaggggtgcgggtgttggactgaaggaggatctcctcggatcctgcagttgctggaaggaacgggctccggcccggcttgatccggtgcttccccgagtatgaggttcgacagtatggcgcgcccctccttcggcatcccctcgaggctgaatgctcttgacacgcatttacctgcctcaccttgcgcacacgcaccgctccccctgcggccgtcgaggctcctaacgatctcttggcggaccggcatggtccggcctgcctcgtgaggtggcccttccttgagtgcatgccaagtccacgccatggccctgtgtagacctctgctaggcctcatgctgctactgggcctggccctggatggagaggccgggagcagcgtgcacactgtgttccccaccgagtgcacccgatactttacatggcagtccatgggtgcgccgcggccttgatgcctgcagatccgcataattgggatacatgaacgtgttcccagcacgccaattgcttgcaccgcggccctcccggtgatatacctgctagctgcaggtacatcctcccctaccccccatccccaccccacccccgcaggcatgatgctgagccaccgcctggcgggccagcccggccccnnnnnnnnnnaatatacctgccagctgcaggtacatcctccccaaccctccattcccaccccacccccgcaggcatgatgctaagccaccgcctggcgggccagcccggccccctgacccggatcatgtcgtgcacccacgaggagctggaggccatgtcccccgaggagcgcaacatctgcccaacccacgtggccccctcctacacggtgcacccccgcaccggcgacatatactccgcctacaacaagccggtggcggtgatcgactggctggcgcgcaccgagatcaaggaggagtacgtgctgatcatcgatgccgacatgatcatgctcacccccttcctgccggacgaggtgggcgcctcccgcggctgggcggtgtcggcctacttctcctacatgaagggcgtgaacaacgagctggcgctgaagcacgtgccagaggtcacgccccgcaacgacaccctggcggggcccaggggccggcgcggcgacatggtcggcggcttcaccctcatgcactccgaggatctgcgccgcgtggcgcccctctggctgaagtactcggaggacgtccgcttcgaccccgacgtgcggagtgatttctgcagtgtttcttgggaagggagggggtccggggggggagaggagtggagtatcacagcatgaggggtgctcaggatatggttgaattccagggatccagcagcacgaggcnnnnnnnnnntgtccgcttcgaccccgacgtgcggagtggtttctgcagtgtttcctttgggagggtgggggtcccggggggggagaggagcggagtaccacagcatgaggggtgctcgagatatacttgaattccagggatccagcagcacgaggcaactgccagctgggcagctgtcaaaccctggcaacctcttgtcggccacggcacgaggtcaggaccctctttaacctctccacacccgcaaatagcctccccatttccttttcccccaggcgtggacgctgtctggcgaccactacagcgtgaacaagggcgacnnnnnnnnnnccctctccacatccgcaaataccctcccctttccctcttccctcaggcgtggacgctgtccggcgaccactacagcgtgaacaagggcgaccgcccctggatctcggagatgtacggctactcctacgcagcctccaagtccgacgtatggcaccacgtcgaccactccgccatgctctacccgggctacaacgtcaagggtgcgctggggggcggctggagggggaggtgggggccttgggccagcgcccgctctccagtatggtgggccggcgtgcggtgtgcttgctcgccgtgacgacctgtgcatgtctggggcatcgcacgggcgtgatctccggctgggtgagtgcatgagcatctagatcttgcctctacccacccctcaacaccactgccctcccccaccatcgcagtactgcccaagnnnnnnnnnnttctggggcatcgcacgggcgtgatctccggttgggtgcatgcatgagcatctagaccttgcctctacccacccctcaacaccactaccctcccccaccatcgcagtactgcccaaggtgctgcactatggcctgaagatcgaggtccccaacacgccctgggtgtttgacaagcactaccactacgactttgacgcgatgatgtgtccgccctgggacctcaagtgcgtggcgattggaaaggaggggacagggggccaaatctcatctaggaggggctggttgggggagcatccctgcaagggccagtctgactcctgaattgtctgccatggcagcgacagtgctgtctgagggagtgcatggggtttcaagnnnnnnnnnngaaggaggggacagagggccaaatatcatctaggagtggatggttggggtagcatccctgcaagggccagnnnnnnnnnngttctccctgagcaataaatgcctcaaactgcaaggagggacactggcaccttcactccactgtcctgagtcccctcttccttgaatcactccctgctagcctgtctcccaccgccacacccctccatccccttccccccaacccttcacacaccacagcgacccgcccgcgggcaannnnnnnnnnattctccctgagcaataaatgcctcgaactgcaaggagggacactgtcacctgcactccactgtcccgagtcccctcctccttgaaccaccccctgctaggctgtttgccaccgccacacccctccatccgctcccccccaaccctccacacaccacagcgacccgcccgcgggcaagaagggcggcctcttcccccgcacgccccaccccgattccttcaagggctccgactctgacgtgctgcgggacctgctggccatccagacggtggtggtgctgaacgccgccttctgcgagcggcacgagaaggcctgcccgccctcggagcagctgtccacggagtgcgcggcggcgcggtccaccctggacgccctccagcgccggatgaaggagcaggtggaccgcatgcccgacccctgccgcaacagcgacacgcggtgcgagggctgggccaaggccggcgagtgccagaagaatgagggctggatggcggattactgctcgctggcctgcgccggctgcaagcccaagacgccgccggcgcggccgggcaccaaggcccccgtgctgaccgacggcgagggcgcgggcctgaagaaaggggggggcgtggggctcctacgcggcgcgacggacgccggggtcctggcggccaaggacacggccaaggatgcgggggcggcgacggcggacgccgccaaggatgcgggggcgggcgcaaccgacgccgccaagaacgttgccacgggcgcggtggacgccgccaaggatgcggtcacgggcgcggtggacgccgccaagnnnnnnnnnnaggcaaggacacggccaaggatgcgggggcagcgacggtggacgccgccaaggatgcgggggcaggcgcaaccgacgccgccaagaacgtcgccacgggggcggtggacgccgccaaggacgcggtcacgggcgcggtggacgccgccaaggaggccaccgcgggcgcggtggatgcagccaaggaggccgcgacgggggccgtggacgcggccaaggacgccgcggccaacatcgcgactgcggccgaggacgccgtcagcggcggcgactccggcggcgccgtccccgcggagagggtggagcgccttcgcgcgcgctgcacgcgccagccgcactggagcatgggcgcggtgaaggcctgcctggccgccgccagcaaggggcgcgagtaccagcaccccagcgaggcctcccgtggcgcgggggtggggtcggagacggttcgcacgctgggcgagcgcacgcgccgcctcgtcgctggcgcgggccagagcacggcaggcgcggcggggagcgtgctgcacacccccggcatcctgggtgagtgttttttcgggggcgggggggggtagcacgggggaaagggggtcggggcggcaggtcaccggccctgccccgccctcccctccatcccgagcggaagcccatctgctgaaagaagtccgcacaccagcctgctgtcaccgccatcctgccatcgctctctggcgcccctcccccgtacccagccagaaacattcctccccactcgtgcactcacctccccccaacccactcacccaggcttcgtggtgtgggcgctggtgctgctggtgctgctcgcatcgctgccgcgggtgcgcaagtcgctggccacgcccgtggcgctgggaaaccgcaccttcttcgggcggcggggcgacaagtcggggaggagcgagtgaggggctcggatccggcgtcaccaaatctccgcacacccgtggcctaccacgagggcccctctccactcagccgagccttgcctcggatgctttgtgctattccatgtttgcaaccaagtcttcacggtgaatgggaatggcgaggatttgagtggctgagaccctttgcgtggactcggggccggaaggggcaagcacggcatcacacgtcgtatagcttgcgcctcgtgggaagggggcgaatcagcttcgcggccgaggttcgcatcagcggttgagcagagcaacctcttggtgtcctcaggggtaagttgttgacctcgcaacggtgccagaccagccttgcagcaaaaatgccgcccgccaacagctggggtgcagcatgcgctcccagcacaggcgagcacggtgctcagcgccgccgcttgcgtgggcgtgccgcggcggcggtctcctcgacgcgctccccggcatcacgccgggtccccctgggctgcgtggcgatctctaccgtccccagctgcgtccccagctggtcgagctcggccgccagaggctcttgggcagctgcgtactcgtcctcggctgcacaatgttggggttgggggatttataaacgagggatcggggtggggcaaagcctcagatgctcttcgtgaatcaatgccgccagcacccaccgggccccatcccggcctggcgcgtcggcgacgtggcttccgacgcatcccatctcgccttccagactgctcaccggcacgcagcgcgccccgaccctcctcaaacgcgtcccgggcgcgctggagctcctgcctggcggtcagccatcgctccagcgccgccactcggccggcggccacggcgaccgccgcctgcgcctcctgtggtggggagcgggaagatcggcgggcagccttggcggcgagcgtgaggcatgcgcaggcgagtgtgcccctcagctctgccctgcttgctccaggcaggacgcaagcctagtccgtgaatcctccgaaacaccccaaccgacctgtccgccgcccaggctgccaaacctccactccgcccgctccagggggggcacgttgaaccccgaccccgacacgatcccccgccccgtgatgcggcggcagtccagagtcacgatgtccgacaccccgccccgcaggcgccggaccacgagctcgcggtacgccgccgcgctctcaaggctctcgaacaccagcgccgggccgaagaggccgtgcaggagagcggcgcgcgtgcccggcgtgcaggggcgcaccaggttgaacaggtagcccaggcagccgggaggccagatggggatgatgccggcctcggcgggggcgccccgcgctgcggccttggtgtgcggcaggggcacgggcaggggggggtctgtgccagccgacgccgaggcgaccagcgcccgcgccagctcgcctgccgcgtggaagccgggaatatcgccctgggtgggacccctgtgaatggaggggggtacgagggggagggagggatgcagggtgggaccaaagagggcttgcaggaacaaggaggaatgtattgctgggtgtcccaggtgcagggtgtgaaggaaggtctgggtggtgagccaccccaccaccaggcctcggcggcctgggcacccatctgcgccgcgctccatatcatcctccccccctcagtcaacggcaacgacagaatgagcaggccttcacccacgtgcctgtactgcgcggtgtnnnnnnnnnnaccaccaggcctcggctgcctgggcacccatctgcaccacgctccacatcaccctccccccctcggtcaatggcaacaacagaatgagcaggtcttcacccacgtgcctgtactgcgcggtgtgcgactgggccagcatgtctggcacggcgggcgtgtccgccagcgcggcgaccagccgcgcgcgggccgccatgtcggtgaccaccaccacgtccagcagcgagcgaaactgggcggaggcgatgcgcgccaggggcgcgtgctcgatggtggcagcctcggccaccacgcccaccaggccggggtcgcctgaggagagggaggggggtgggggcagggttgatcgcgtattctgcgcagcaccccagttgtgggcgggggagcagagtgcagggcagcagggctgggccagnnnnnnnnnngaggtttatcgcgtatttctgcgcagcaccccagttgtgggcgagggggcagagtgcagggcagcagggctgggccagggtgtgggttcgaggagccatcatctcgattcaatcccatacaccccagcgacggcatcatcgcacctgaggcaagcaggcgccgaatggacgccgccatgggttgcttggcagggccgaagcgagcctgtctgggctgcgaccccgacaacactggggggatagaaggggggggttggacgctgagttcccctggctgaatcaagagtgactgcatctacannnnnnnnnntagcgcgcctgtcggggctgagaccccgacaacactgggggggatagaaggggggggttggaggctgcgttcctctggctgaatcaagagtgactgcatctacagctcgaggcaggctggctgtcgtgatgttcgacactccttccagcagcgcaggcaaactgactcgccaaacagcaagtcggtagcaggtgctacccagcccccgaccacgccaggtcccacctnnnnnnnnnnagtcgacactccttccagcagcacaggcaaactgactcgccagaaagcaagtcggtagcaggtgctgcccagcccccgaccacgccaggtcccacctgcagcttggttctcggcatgggcctgccgagcagcctccagggccgcctccccggccgccaggctgtccagggccaggccctgcagcgtctcctgccgctgcgccagcaccgcctctgcctcctccagcaggccctggcgggctctggcggcctgcttttgaggggtagtcgaggggagtttgtggtgcgtggcggtcttgagcccttgcnnnnnnnnnncctggcggcctgtttttgaggggtagtcgagtggaacttgtggtgcgtggcggtcttgagcccttgctagcttgcggggcgtgttgtttgtatgaatagtaccccaatagccttgcttcctgacaacctcaacccctctgacctctcgtnnnnnnnnnngttgtgcgccgtgttgattgtatgaagagtaccccgatagccttgctttctgacaacctcaacccctctgacctctcgtgcagcatccagcttgcggcggtgggcgtcctgcctctccagcactgcctcccgcctggcattcagctcggcgagcgcgctggccctgcgtgtgtggagggagggggcagggtgatgctggcgatgatggtcttgccggggctaccaatgtcaccggccgcgaggtcgacatgttccagacctcggtgcacatcagccacacacaggagcaggcaccccacaaggacagcctcaagcaccgtgcacccacttggcagtgtggtcggtgaagaggagggggatggaccaggccgtcacccactggtcggagggtgggtccccatccgaccccgggggcagctctaggccctgggcctgcgccaccagctccagggcgagagcggcggcgcccccgccgccagaccctgttccggggtggaggagnnnnnnnnnngatcagccacacacaggagcaggcaccacacaaggacagcctcaagcgccgggcacccacttggcagcgtggtcggtgaagaggagggggatggaccannnnnnnnnnggggcacgggatgaggccagccggggaacaaacccttggatgctccggctcctcggctcccccctctcgacgcacccaggagtctctcccgtatcacgagcacttgacgcatctggctcccccacgctcccacacctgacccctcctcgnnnnnnnnnntaggcacgggatgaggccacttggggaacaaacccttggatgctcctgctcctcggctttcccccctcaacgcacccaggagtctctcccgtatcacaagcatttgacgcatctggctccccacgctcccacacctgacccctcctcgatgctcaggtcacccagcgccgctcgcccagccgcgtcggtctcggtctcgcaggctcccagggcccccagcgacgaggtgaggctgggcagggccgcgccctccggtggttcccccgcgtcaccgcccctcccgtcggcaccccagcgcagtgcaaagcgcacagggacgccggcggtcggcaccgaattccccgcctcgtccagcagctggactgcagcgctgcgtagcagcatccgctgtcgggtggactgtgtggagcggggaggtgggtttggggaggtcagggaagagcggcgatgatggctgatgtgtacaagggcacccagtggatcactgcaatctgcagcgtcatccagccctgcctcgcaacctccgcctccttgtagatgccctcccatccctgcgccctgctcacccctgcttgggcccgtcaccgcgttttccccggtccctaaccgtaccgcaaaccctccagccaccagcccactcacggtcccgttggtggcggtgagcaggtctggcaggctggcggcctccacgtccaggccggcaggggccccggggtcaaccaggaggcagcaggaggggctgcgcagctcgctggcctcccgcgacaggcctgggagcggtgatttatgtttggggaggggggggatggtgattgtggaaagtgcggcaggcgaggctatgcgtgcctgggtccaggattgtcgcgattacatgcatgcgcccatgctgatgtccctcccagtgtgcttgctgtcatccaggagacctgtcagctgcatccgtgctgtgcttcgtccgagccgctggcaggaggagtgccggaattgcccattgcagtccccacatctcccccaaacccacacccacacccacgcatccgactcaccgtcgagcaactcaggccgcgtctcgacgtactcggccgccagcgtccactctcccgcggccaccaggccctccagcaggaaggccatgagtccaggatccgcctggtccgcgcacggccccacgcgctgcnnnnnnnnnnacatctccccccaaaccacacccacacccacaaatccgactcaccgtcaagcaactcaggccgcgtctcgacgtactcggccgccagcgtccactctcccgcggccaccaagccctccaccaggaaggccatgactccaggatcggcctggtccgcgcacggccccacgcgctgcgggcgggcggcgcccgggccactcacgcgcaggcacagccccgcagcggcggcggcggcgggcagcggctcgccgtcctcggtggtcacccgcaccgcgacggcaactgccgcagccccccaggcaacgcgcggcggcgcggcgcccgtggtcgaaacggtctccccaccgacagccgcgacctccaggctggcaaccaggttcctcgggcgcatgaccagctccagcgtggcgtcctccagcgccacgcggcgcgaggaggaaaccgcgcgcagcgtgtagctccccggcacgtcggcgcgcagcgccacctcggcaaaggcggccgcgccggcctttgcgcgggccttgttcccgccccgcgccgagaccgaggccgcgcgaccgccgccgtcggaggccagcgcgctgccggccagggacacgtccagggtggcgcccgaggtccagaccgcggggttaccggcgcggtcggccaccgagacgcgcagactgggcaagacagcggccaggccgcagtggagggggcctggcgtagagaataccagtcgagccggtgggcctggaggagtggtggtgagggatgagggtgtgggtgtgggtcgggcgctgggaggcagactgctgttcgtttgnnnnnnnnnntggtgggcctggaggtgtggtggtgagggatgagggttagggtgtgggtcaggcgctgggaggcagactgctgttcgtttggggagggatgaggacaggggcatcgaggtggcaggggacgtgaggatgggcagctccccacagggtgtattcctccaccgtctgcaatccaacagggcttctgcattgaccagcccgagcacnnnnnnnnnnctggcaggagacgtgaggatgggcagctccccacagggtttattcctccacaatctgcaatccaccagggcttctgcattgaccagcccgagcaccgccgcacagcacactgggcgtgctgctcgagcccctagccctgtcctaccgcccaccacgcagacattgcttggaatgcttgtgaactacaatcaaccatcccccagccttcttcccagccccccacaaaacataattagacccacctgctgcgagctggagggtgagggaatcgggcgccatgtcggcgccggcaccctcctcgccggaccgaacggtcaggcgcaccgtccccggtgcgcccagcagcgacatcttgaccgagtacaccggagccactccctgtcgaggatggtggaaaggggaattaacagtgggtgtgtgccttgggggtcccctgtatttggcatgcctggagcccgaaactagggtctgcccagatccccccttgcctgacgagcttgaaagagtcccaacccacccccctcacgctcatatttccacctgggtggcagtcatccagccacactcccaggacgcggggtcaaagcccaggtgcccctcnnnnnnnnnnnnnnnnnnnnnnnnnnnnnnnaggagggtggattggggagcctggggtcgggcgcgccgacggtcgatgggcgggccacctccaggccatctcttgacgtcccagcagaagcatccgccccttttcacagtgctggggccacacaaacatgcttgcctcccccccaaccaaccccactcaccggttgttgtgggcgtccagagcctcgatctccagggtgaaaggctggccacagcgcaccgcgccgacgccctctccaccctcctgggacgcctcgcccgcctcgccctccaccaggctcagggcccaggccttgggcggccccggcaccacccccaggagcaaccccacctccaggagcagcgtgccgtcgtcggacgcaaagcgcacccactccgtcgaagccggcgtcgcgtcctgggcgccggcggcgttcagatcgccagccgcgtcgaggacactcgcttcgcccagagctgtggcagtctccggcacaggcagagtgggcaggcgcaccgcctcccctttccaggccaggcgcttgctgccgcggtgccaggacacggttacacgtcccgccaccgaccgctccacccgcccgccgccgccgtccagcagcgccnnnnnnnnnnagcacttgctttgcccagagctgtggcagtctccggcacaggtagagtggggaggcgcaccgcctcccccttccaggccaggcgcttgctgccgcgatgccaggacacggtcacacgtcccgccaccgaccgctcgacccgcccgccgccgccgtccagcagcgccaggcgcaggccggggagggaggagccggcgggcaggcccggcagcagcaggaggtcggggccggtgccgcgcggatcgggccgccgctgcaatgcttcgccatggagctccagagccagcgaggccggggcgaggctgtggtgcacgaccacggggcagcccagggccggcgcctcggcaccgtgacccgcccggcagcgtaccagggcggccnnnnnnnnnngggcgcacgaccacggggcaggccagggccggcgcctcggcatcatgacccgcccggcagcgtaccagggcggcctctagggtgggggtggcggccgaggcctccagccgcagctccagctcctgagcctggccggccgtgcccggcgcacagatcagcgccacgtctgcatggggagttggaagtgtgcttctcgtcgacagacctgtttctgcgggtgtacggacgccactctgtggcaacgcgagcccgacatgcaccctgccgtttgcgtcccccctcgattctccccaaaatcccgcatcaaacctgcgatggtcgccgcgccgtcgtcatccagtgggaagacggctgccgccgccggcgcatcgctgcagcagggccccgccagcctcaccgcggcttccaggccgggcagcgcgggcgaccggttgccccaggcgtcccaggcctggacctcaaagccgggcagggtcgctcccgcggtcacctccagccccgcgccctcgcccagcccctcccaagggtggggcggcagcaggcccagggtgatgggagggccgctgcgcaggcgcagggggagcctggcggtcaggcccggcgctcctccactcgccacacagacctccagcacgccatccagcgtgcgcagcaaggcgccggcgccctggccgccctgcacgggcgcgtcggggctgccgggcgcctgggcctccagcaggcccgactgccgtggcacggccaccaggtcgacgatgcgcagggggtcctggtccctgctgcagctcgactccagctccaccggcagctctgcctccccgtcccccgccaggagtcgcagcgccggctggggcagggcgtgatcgtccccggggccaggtgccagcgtgttgccgtgctggtcggccagcaggacggtgatgggtggcagcgcctctcctgtgaagtttggggggtggtcagggagaggatcgcgttaggatgcgagggaacgggtgcccccagctgcattgctgccctggagtccgggcggcgcgtggaggtgcagtagctcaggcatcgcgagcctgagaagaccctgcagctcaccaaagnnnnnnnnnncgaagtttgggggggggtcagggagaggatcgcgtgaggatgcgcgggaacgggtgcccccagcggcactgctgccctggattccgggcggcgcgcggaggtgcagtagctcaggcatcgcaagcctgagaagaccctgcagctcaccaaaggcgagggggcgcagggccgccgcagccgctccctcgccccccagacacagctgcgtgggggcccctgggctgacagccacatggatctgcaggacggggggtccctgtgtgaggggtgttcgggtggcaccgtgaggcaggcggtgtgcagcgtgggaatcgatgaatggggcgcaggacacagatcccacttgccgcagacgcaaacctcgccacgaccgatcccaagtcaccgcacacctgtgggccccccggggcgcagggcgagacggtgtactccagcacgtactgccccgccaaggtcagcccgttggccaggcgcgagaagtagtaggcgtccttcacggggctgtggttttcaacctgcagcaccagctcccggtcctgggtggcgggcacggcgacgacctcggcgacctccgcctcgttgacgaccggcggccgattctcgtcggcctcttgaagaggcccggccccacgccggcgccgccagcgcttgccgcccgcctcgcgctgggcagggccgaggggcgggggcgaggcgggggcctgggcgggcgtggcggacttcgccagcctccagagcgtctgcgtgaccttcagcgtctggcggctgccgcccaggagcacgcgcgtgagtcgctggccggaccctgacaccaccaggacctgggtgtcgggcagtgtgtcccccgccacgcagcgcaggccccctctcgccgccagtttcagcggttccagcctcaggcaggcagggacctggggacatggtttgtggaggcatcggtggggccgggggcctgggcctcatgagtcactgcaacagaaaggtcgccgctcccatacctggaccaccaggctacaccaccacacagcacttgggagcgaatccttgccccgtaccccagcatcgcagtggcaacctgagccaggtttctattgttggttcagatctctgtcccctcacccaaactcccacgaaacaagcgctctcgactgaccttgcccagctctcgctgcgcgtgctccacctgctccccctccggcaccgtctcccagcgcagacgtctcaaaggaaatccgcgcaggcagcccgcgccaaagacgtccgccggcagcagctccacgtgggccctccctcccgcgtggcagccgggcgcggcgccgggggcgggcacggtgaagcaggccagccggccgaggtgggcggggcgggtgtccaggcgcacgacgtcgccggcgcggaggctgcgccccccgccgtcgtccacacggaggaaggcggtgcaggcctcgcccagctcctcgcgcatgtgggcctgcagcctggtgtctgcggggtccaggaagcgcagcaccttgtccaggcgcgcgtggcaggcggccagccactcgcgcgcccgccggcccagggaacggtccccgggcacggcccggagcagcagggcgcgcaggtcgtcgcgcaggaggagcttgttgcgggtgacctggaaggcggggcccaggaagagggagccgcgtagccggaggaaggcctggtcgggcaggacgtcctgttgggtggtgggaggaccggagtggtgggaagttggggactcgagacggaggcggtctgtgccgggcagtgtacgnnnnnnnnnntgtgggaggaccggagttgtgggaaattggggactcgaaacggaggcggtctgtgccgggcagtgtacgccagatatacacatcagtcttgaagagcggaacacaacatatcacgccagggtccagccgcgggagcagctgagtggcggcatgcctcctggcccacacccacaacccccaagccaccttggcggctgcgttgcgtttcgtnnnnnnnnnngctcctggcccacgcccacgaaccccgagccaccttggcggctgcgttgcgtttcgtgcgcagcgcctcgagaaagggcagcgtgtccactttcgcccccgggatcagccggccctgccagaagacctcaaagatgggaggcgccatccaggggcctgagggtttgttttagcagagggagggggggttgatgcagggaaggcctgcatcaagccatggtgcatgcgtttccttgcgtccatttgggccccccaagcacggtatccaaacccctgcccccctccagttcaccgtcggtgtcatcgtcagacgcccccacttccaggtcagcctgcgacgccaaggaacccgccgcagccatgggcgccagggactgtgacacgggcaggtgggggtggaccagggggggactctgggcaggatgtggaaggtacacctcgaatccgaccatgccctcgtccnnnnnnnnnncgaggtgggggtggaccagggagagactctgggcaggatgtggaagatacacctcgaatccgaccatgccctcgtccagccatgtgctgccttgtcacagaccaccacagcccatatccatgttcaaacctcacctgggtgggagcctgcgagnnnnnnnnnnccaaacaccaccacagcccatatccatgctcaaacctcacctgggtgggagcctgcgagggattgacgccgtactgctgcgtcatgcctggcccagcatccgggcgggggccagcggaggggccctccagcgggacggtctctgccccatcctggaaggggaagtagtacagcacgccccagacaatgccctggagggttgggagaggtgactcaatggggtctccaactcgtctgtggaaggatgaaggtgctggaccccccccctgcaccctcgctcgtgatgatgcacctgctccgtattcagctcacccaccctatctgggacgtggagactgaaacccagctctgcctgctgaccgcgcagcatcctactctccagatcgtcgtcaacctagcatgtgatttggtgttgagaggaaagggacaggttggtaagttgctctaggagttgtggcaccacttgcatggcgcatctgtgcaaatagcgtagaccatggcgttgtaacaaacatgcacccgcctccctcgctgagtccttttcgaccactcgaccacacacacctcgtgaagactccgatgccagaggatgcggtcccctattatacactggagactgatggtgggacaggccggggcgggggagggacggctagaggaacctggttcccggttgccgccctctccatgtatgtagannnnnnnnnntactgatggtgggacaggctggggcgggggagggtcggccagaggaacctggtccccggttgccgccctctccatgtatgtagaagtggtagaggtgtgccagctcctgcgccgtgttgttgatggaaggtgggatgcaggagagatcaacgagtgatggaacccatggagatggtcaagcttgacctctgcttcctcacaccagaggcacagcatgtgnnnnnnnnnnnnnnnnnnnnnnnnnnnnnnnnnnnnnnnnctgcatatgcgcgagtcggcgccctcctccagcatctggtgcaggacctccggcttcaggccgcccagcaggacgcgcgtgaagccgccggcctcggagcctgtcgcctcctcacccacccactgctgggtgatggggaaggcctgttcccatggcgcctgggtcagggcatcgcccggcctgcggtggatcatcaccgtctcgtacacggcctggtgagcagatgggtgaatgagagggagctgaggacttggttcctagtaggcaaaactctttggggctgccagatgctcgaataggccagcatcgccaaaaacacctgcgctggccccccgccaagggatgcacatgggcttcattcccagcggtccagttggcatcatcaaaagcacctggcccagtcggtannnnnnnnnngaggcaaaattctttgcggccgtcagatgctcgaataggccagcattgccaaaaacacctgctctggcccccctgccaatggatccacgtgggcttcattcccagcggtccagtcgtcatcatcaaaagcacctggcccagtcggtagcgctgctccagctcccccgcgctgagctggagctcgtggacgtagggctcgcccacgcgccgcgtgaccatcttgacactggagccgatgaagaacgctgcgttcttcgagcccacctgttggttttattttagagaggccaagacgctatgagttttagtcacaagagcgggaacgccacccttcaaggcataatacaagacaaccaaacccaatccatttgcatccaactcactccaaagtaggagatgttgctgttcagatacttggttggggatgcgctgatggaaggctggctcagctggccccgctcctccatcgagtagttcatcacagcctgcacttgggggaaaaggcgttgggccaagggactgcggctgtgtgcatgatcctttgttaagtagccccgcttcaccttgcgcattgacgatgcaaaacattgcattgtcatgtgaagtaacccattcgatcgcctgcgcacccagtcattgagatnnnnnnnnnngcaagtagcaccgcttcaccttgcacatcgacgatgcaaaacattgcattatcatgtgaagtaccccactcgatcgcctgcgcacccagtcattgagatcgcgcttggtcatgccgcagcctgtgtcctggatgcacaccagacccttggcgctgcttagagaggagctgttcagcacaaaggagatggtgatgttcctcggctccgaggctctggaggtggccctcagggagttgtccacgaactctgccaaggcatacacaaaggggtgcttgccctgtgcgtggtgggaggtgggagagctgtggacgacagaggactccacattgggccagcattacagcaaccccttgatgcactgtgtcagagttgctgggtctgagcgtcaatgagcatggaaaagaaagtnnnnnnnnnnggtggtgggaggtgggagagctgtggacggcagaggactccacattggacccgcatcacagcaaccccttgatgctctgtgtcagagttgctgggcctgagcgtcaatgagcatggaaaagaaagtaagtacgcctgcatccagagccactccactcacctgcgcggcaaagtactcgtaatccccagccatggtgagggtcttggggtggggctggaagctcacggtctcctgccctggtgcggccagggccccagagtggcccatcacgtgcaggatcgtgtcagctggcacagcccgcaagtcaacgtcggattccagcggtcgggtgaagtctgtcagatggaactcctgcattgcaaggtttttgcaggggtgaagcaggaaagatagctgttgtgcagtaagtatcctcggcgtgtagcaagagagtataaattactgtctcccccaatcatcctcgaacgtgctcctcaaagtagccggaataacacctgattgcctagcctgaaatgctgagagactcttgccacgagttctggcaaggctggagctggaagaagcacttcaagcgctggtaatgtgccatgaactatctgtatgctgctagattctatcatttcaacccgagcctcgggcactggtggccacttcggacggaaggatcacttgggacgagagcaacacgccatcgcccagctagccgttggaagtgggaagttttggagttctgtcggcctattattctcacttttgcacttgctggagttagctctctgttcaggtccccggacagcttggggtatttgcgtgcatccatgctgcgggtgctgagacatgccgacaccagctcggccacctccgcaacatgggacaagtgatctgtgcgagcagatggaccgcgccgacaagcggtatccaacagatggacgaattaacataatgcaaggtgtcttcttgggtcataggatatcagtcagatcgatcagtccctgcaacaggctgaggttttcttcacccctcatctctcgagcccggggcgcccgggtgaccatgtctcaagcagggcacctcgctttggtgaccggaggcaccgggtttgtggccggagagctggtgaaacagctactggaaaagggttaccaggtgcgcaccacagtccgacctggcacggatgcctctcgcctgcaacccctcaagctgctggcccaggcactcccaggtgcgacttcttgagttgggataaattccagcattgcctcaagggctctctgtacctctcattgctgcggtcaagacggagcctactgagctacaagaccactttgaagggccctggacttctacagtttgattgaagcatcgccccgcactgcacccccaccatgttcctcctgcgnnnnnnnnnngctcattgctgcggtcaagacggagcctgctgagctacaagaccactttgaagtgccctggacttttacaatctgattgaagcgtcgccctgcactgcacccccaccatgttcctcctgcgtgggtctccgccccttcaaccccttcacacagcccacacataggaagcctggagattgttgaggcagaccttctggcagagcaggccttccaccaggccgtggctggggcggaggtggtcttccacgtcgcctcaccctttttcatcgaggccgacgacccgcaggcggccctggtggagccggcactgcgcggcaccgcctccctcttcgcggctgtcgccgcccagggcaagggtgcggtgcgccgggtggtcctcaccagctcctgcgctgcggtgaagggcatgcaccccgccccgcccaaggacgggcgccgctacacggaggccgactggaacacgacctccaccgtggagggcggccaggcctactgggtggggaaggtgaggcaacagaatacgtgggtgtgtaggggaaagggagatggggtccagctggctgactgaagttcttgagggttttcatgtggacgagggaggagcactgccaatccaaaccagggtgcagggaagatggagggtgtggatggctgtcagcatctctagagcccatctcccccctctctcatcctcaaacaacaatgaatgtaaacagacaaaagcagaggagctggcctgggagcaggcaaagcagcacggcatcgaccttgtcacaatcctccccgagttcattctggggcctgtcctgtcgccccacgcacgcggcacctccgtgggggcgctccagggctggctgcacggcgcctccgcccccggcaccttcacctttgcggacgtccgggcggtggcccgggcccacgtccgcgcggccgaggtgccgcgcgcgggcgggcgccgcttcatcgtcgcggcccgccaggcgaccaccgggcgccagatctccgccatcctcagggtgcgagacgatgcgtgcaggcgtgtcagctgatctcagcgccaagcgcgaccgtcccccaatcctcccttctttccaagccctccacaggagcacttcccgcacctgcccatcaaggacggggaggacggcgagccgcctgagtttggcgtggacgccagcgcggcggccgagttgctcagcgtgcacagcgtgccggtggaggagaccctcgtggacatggcccgcacgctcctcgcctttgggctatgagggatggtcttcgcagtgctttctggggacctctggcagccctggccgttgggtgggtgcacacaacccgcgtatgccccgtcatcgacccgctcttcctctatcggctccattacattggtgcccagagatggccccttccctttgtcatcaagcaatgaatgtctgtaaaagtcagatgaaagttccctcgaagcccttcctcctgagcctccccatcgattagtactgctggcgcaggggggtctcgatctcgagcgcagcctggggtgtgggattcgccagcgaggccaggtcgtccaggaattgcaccggcgtctcgataccggtgctgcccagaaaaacgtcacggttcagcttcttggacaggcggtgcaccgcccgcacctccgagtaggtggtgccgcccaccacgaagacgaagatgcggcggttggggccgccgccaaccccgctctgtgtggggggagcggtggggcgtgttcagcgagatggagcacgaggctcagagggttgaccaactgccgccagagcagagcattgcatgcccttgagctcgagatgatgtcactccagctcgcgagttcagcatgcacacgccgcacagtcgtgtcaggtaccactgcccgaacccgccacaaagaagggatactaccaccacccacctggacgctcatgttgccgctttcggtgcggtccaggttgccggagggcttgctgcgcgcccagttgcccgtcgtgcgcagcgtgcgcgccgaagcgacgccgcccatcatcgatttgggcgtggcctcggccgaggagggcgcgcggctcgacccgggcgagctggggggctgcacccaggggtactcgtcggtcgacaggcggttggcggctgggcggcaggggtggagggaagggggtggtgagggcgaggatgggagtgccagactgggcaccttcaaggtcccgctattcccaagcagcctgcttcaatcagtaaagtgagctacaccccgcattttctctcacccgcatcctccaccagctcgtggaggagggggacgaagcgggacagcgcgtactgctggtcatcctcgctgccctcccggtcctgcaaggatggagacnnnnnnnnnncgcgccctgccgcagtacaggtacttcgcgtgtggtgtcactatggggtgtgtgttgctctggcgaggactccctggggaaggtcccaactctccccactctccttgcctcccctgctgtgggccaccctgggcccctgtactgcctccctgccctcacatcaatccctttctctcacacgaacctgccacccagggagcagctgtccaaactgggggcgcatgtggagctggccacgcgcctcactgccagcgtggacgccagccgcctgacggagtttggaaagctggaacaggatctggtgtacggcgacgccacctccaaggaggtcatcgccttgctgtcccagagcggcagcattccccccgccgagaaggtcggtggggattctgagagaacacgaggtgatcgtctccccgccaggactgacctggtggggagggggcctctgtgcgacatgctgcagcggtcgagcaccagggcagggccggtcggtgtcagctagttgcatcccccgtcgccaacacccatgcgcccgcacaacgcctcacgtggcccgtccttactccactccgatgcaacgccaacacaggtgcgcctgctcatgtgnnnnnnnnnngcacctcacgtggcccgtcctcaccccactccgatgtaacgccaacacaggtgcgcctgctcatgtgnnnnnnnnnnaggggagtaggttgtcgactccatgctgtgagacacgccgagacggtcagcctgtcgtcaggaccctcccgtgatggctcaggccagcaacaaaatcctcagctccccatcctcacacttccccctcccagccccagcatcccagggatccggcttcagagcctctgtagnnnnnnnnnnctactccgccacgcacctcgagaagatggacccggtgcgggagcagcagtggcagaaggtggcgggcctacgccccgctgacctggcggtggtgaccaatctggagtacctgggcgtgccggtgtacaagcgctccaagggcatggtgtccctcggcttcgggcgcaagcgccaccgtgccattcgcaaggtgtgcgatggagggtttgtgggttgaggggctctacagaggctctgaagccggatccctggggctgggagggggaactgtgaggatggggagctgaggattttgctgctagcctgagccatcacgggagggtcctgacgannnnnnnnnntccccccccaccagatcggtcctggcgggaagacgatcacctcgtgtcctctcagaatccccaccgaccttctcggcgnnnnnnnnnntagcatggaatcgacaccctactcccccgtctccatccttgcaggaccgggagggcagnnnnnnnnnnnnnnnnnnnnnnnnnnnnnnnnnnnnnnnnnnnnnnnnnnnnnnnnnnnnnnnnnnnnnnnnnnnnnnnnnnnctactgatggaagcaggctgcttgggaacagcgggacctcgaatgtgcccagtctggcactcccatcctcgcccccaccaccccactccctccacccctgccgcccagccgccaac

SEQ ID NO: 48996 - DNA, 64 bp, Chlorella protothecoides
ccatgatgcaacgctgtgtctgtacaacagtacaggcatgagcagagccgggatcagttcagga

SEQ ID NO: 48997 - DNA, 61 bp, Chlorella protothecoides
tggtgcctgcgtagcctgcatcccacttccacctgccttaacaaccccactctgcctccct

SEQ ID NO: 48998 - DNA, 68 bp, Chlorella protothecoides
acagctgtcccggcccccagcctgggcagctattggcactgcactgcaccacgcagcgcctggcttgc

SEQ ID NO: 48999 - DNA, 67 bp, Chlorella protothecoides
ccccctagccgccagttcgaactgtatcataaaaattacccagcacacgtatcagagggatacgaac

SEQ ID NO: 49000 - DNA, 4711 bp, Chlorella protothecoides
  modified_base (253)..(454): a, c, t, g, unknown or other
  modified_base (911)..(920): a, c, t, g, unknown or other
  modified_base (1553)..(1562): a, c, t, g, unknown or other
  modified_base (2063)..(2072): a, c, t, g, unknown or other
  modified_base (2176)..(2185): a, c, t, g, unknown or other
  modified_base (2375)..(2384): a, c, t, g, unknown or other
  modified_base (3710)..(3719): a, c, t, g, unknown or other
  modified_base (4420)..(4429): a, c, t, g, unknown or other
ctcgggcagagagtgcagggagtcgagggatgggagtgggggcgcaggtgtgccgtgtcctaggctgccggtgggagggccggtggatgagtgagcgctgccctgcgaggctggcctggcggcacaggcctcccaaccccagcgccatgactgggaacggtcgctcggtgcactggctgaacaggcgcatggcctcacctcgaatatccctctggcccctttcacagaggcggagtgggagggcgtcgtcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgttgctgcatctgacgttctgtgcgctgacggtagctgatggggggaaagacaggacctgcagcaggcagtcagatgaggggggtgctcactgactccctcccatacccgactccaccaccttccccagagccgaccggcgagacctccgactgcagcagcaccctccccgaatccttttccagcgtgacgctgtgcaattccacggtcactcgccaggccccactgccccccttcccacacggacaacccggcttcattcccaaggtgcgtgcctgggtgggtgggtcagtgtctgctgcctgcaggggcagcattggtatggggaagggagacgtggtattcgacacgatcctgctctgtttggggggggcaagctactcatgcgtgcaagagggcccagtcaggcactgggtggctgtcaagccctgcaaggaaccctggtgtgcgtgcgnnnnnnnnnnaggcgggtgggtgggtcggtgtctgctgcgtgcaggggctgcattggtatggggaagggagacgtggtacttgacacgatcctgctctggtttgggggggcaagctactcatccgtgcaagagggcccaatcaggcactgggtggctgtcgagccctgcaaggaaccctggtgtgcgtgcggagactggcgtgggcggcatgatgtcaggcggagcgcatcgggccgattgctgggtcccatggtgcccccgtttcctcccctcccgtcttggagcgcccgctcagcgcagcaccaaaaaccccacacgcttgatcgcacagatcgtgccggggacgaagatgggcaagcacgcgccgagcggctttccaaccctcggcacgctctccgtggccggcaagattgagaatgcaaagtgctcggtctttgggatgcactccaagcggccctccctcatcctggcaatcaaggtgggggggggggagtgggagatcaggggcgtggggatgtgcgatggctctgcaggcagtcatgcctgggcgggggcgagtcgagcagtgcctttcgctgcgtcggacggccgccctcaagtccccgccgttgcggcccatcgctcctctctgcaggcccccgnnnnnnnnnntgtcggacggccgccctcgagtccccgccctcacggcccatcgctcctctctgcaggcccccgccgttgccgtgacgcccacagccgagaccctggcccctcacgttattggaagccgggtctggatccgctggccatatttgacagaggggctcatctcatgcatcggggacgagaccggcagggtgagcggagtgttgggtgctctggggcggccccttggggactgactttggtcgccagcaagccccatggagctgtggtgcgggcgcagtcgcaccctgggaagatgggtatcttgaaaaaactgtgcaatcagctcggcccccgcatgtctaccccaggtgcccgctgcgggggccccggtgatcgtggacccagcgtggaaggagaatgtggaggcccagaggatcgagttcctggagaaaagggtgcgtgcatgcgtcaagcggtggttggaggaatgcgggcggatgggtatgctgtcgcgaaccctctgcnnnnnnnnnntacgccgacggcagcttcgccaagagcttcgcggagaagggggaactggtgccgctgcagctggcactgcggagcaacccctcccccgacccccgcttcgaccnnnnnnnnnnaatcaagttcctggagaagagggtgcgtgcgtgcgtcaagcggtggttggagggatgcggacggatgggtatgctgtcgcgaaccctctgctgggagacaaggcagtgggccgcaggcatggggagtgggcctgccgctgctagagagcacggtggcttggcctgagcctgtgtgcagtgcgccggcagnnnnnnnnnncgcaagacagcacggtggccaggcctgagcctgtgtgcagtgcgccggcaggccagcgaggcattcacctgatgtgagcctgcccaacacctcctggggcgagcggcgagtcgcggcccgagcaacacgggagccacggagtcttcccccccctctcacactcccgccagggcgtggacatcgggcccagccccctgtgggtggaagtgcgtccgctggaggtgctggtgcgccacgtcgacggcagcttcgccaagagctttgcggagaaaggggagctggtgccgctgcagctggcactgcggcgcaacccctcccccgacccccgcttcgacccggacgcgctgcaggcgggcgcggcgctgttcgagcccggcagccgcgcggtggttggcaaggggccctactacggctgcctggcgcgggttctgggcccgggcgccggaggggaggtcgggccgggaccgcggcgcgcgatgagcgtcagcgtcgagccgccgccccccaccgccgccagcgcggccaagaccgcgctggcgctgctgggaggggggccgccgcgttactgccccgcccaccaggcggccaagcaggtcggcatcagcccgagcgccctgggccggatcgcaggtgcgctggcccgggggggtggggaaggggggggcgctggaggaattaggggcatgggtcatactatgttggggcgatttcctcagggttcagggccacagctggggggatcaggacggcggccctgtgccgatcccctctccttcagcctgcctggcgcccgcgcccgctgcactgcccactgccccctccccccttgcctcgccaccgccgccaggctcgctgtaccttgtgattggggagagcaggagggaccggctggacgtcggcctttgcgtgcggaatgccaagctgggcctgtgcgtcccggatgcggtgaggtttgtgccgcccaagcagccgccgccgcggccgcaggctgtgggggaaggacccccggcgcccgtgcccaagggtgaggagcgggcaggggaagggggcgttgggcaggggagggtgcaggtgtgttcagcgtcgaggccggctcgagccactgcactgcgctcatgtcaggggagcctggcgtgctctggtgggaatgtacgcgggatgcctccgcacgtcgggccgacctggacactcgcgcccatgtttgtggcgatcagagtgggacatgggatcgcaaagacggggtcctcttgtctctggccaccccagcctctctcggcagcacagtccgggggaacccatccgccaaacatcctcacccgcccaccnnnnnnnnnncctcggcatcacagaccggggggaaccatccgccaaacatcctcacccgcccaccctccttgccccacaaccaccccaggatcttgggagtactccgaggcgctgatcaagctgctgaagtcgtacaaggtcaaggccccctggctgtgggccgccgtggagcaggatgccaaggcctttgagctggacgcctccagggtctgccccggcgagacgcccgaggagcgcctggccgccgcggagggcctgcacgcctggctcaagcgccagcccatggcccggcggcccctggtgtcgcaggacgcggccgtcgcgccggaggcggcggtgcgcatgctccagggcgcgctgcccccgcccgggcccccggggccggcggtggagctgaccaacgtgcagccacacatgctcatccctcccagcgaccagggccacgtggtgtacgccgaggcaggcgagtggaatgcgggcagatgaggaggccttggaatgagggcggggggatgctggagggagaggggatggatgtgaggggcgagtgtcaccccgcggtgcctcgaacggctcttgggtagtgcatgcggtccgatcccgactgcaccgcatgtgctgactcatcaaggcccccccccaaaaaccaaacccccaaccaccacaggcggtgctttccagctgggccaccgcgtggtcgcgctgggggnnnnnnnnnnccaaccaccacaggcggtgctttcgagctgggccaccgcgtggtcgcgctggggggcacgggcgtgccgccctttggcgcgcgcggcagcgtcaccgccctcctccccaccgcggtggaggtggtgttcgacgggcccttcgccggcggctcggacctgggcgggcggtgcgcgggcgaggcgggagccctgtgccctccacgcgacctcctcaacctctcgcgtgtgcgcggcggcaagccgggctggggcacagcggcggcggccgcggcggccgccgcc

SEQ ID NO: 49001 - DNA, 79 bp, Chlorella protothecoides
tatcggtgagcatgccccaatcatgcatccaaccaagcctcagccattagcatgcaagggtacatcagacatcaacatg

SEQ ID NO: 49002 - DNA, 63 bp, Chlorella protothecoides
gcaccaaaagatgcgtgcaccgacccactgtcacccccttcacaaccacagcctcgactcaca

SEQ ID NO: 49003 - DNA, 58582 bp, Chlorella protothecoides
  modified_base (185)..(194): a, c, t, g, unknown or other
  modified_base (460)..(469): a, c, t, g, unknown or other
  modified_base (1394)..(1403): a, c, t, g, unknown or other
  modified_base (1923)..(1932): a, c, t, g, unknown or other
  modified_base (2453)..(2462): a, c, t, g, unknown or other
  modified_base (2532)..(2541): a, c, t, g, unknown or other
  modified_base (2772)..(2781): a, c, t, g, unknown or other
  modified_base (4141)..(4150): a, c, t, g, unknown or other
  modified_base (5519)..(5528): a, c, t, g, unknown or other
  modified_base (5608)..(5617): a, c, t, g, unknown or other
  modified_base (6183)..(6192): a, c, t, g, unknown or other
  modified_base (6697)..(6706): a, c, t, g, unknown or other
  modified_base (7258)..(7267): a, c, t, g, unknown or other
  modified_base (7576)..(7585): a, c, t, g, unknown or other
  modified_base (8268)..(8277): a, c, t, g, unknown or other
  modified_base (8535)..(8544): a, c, t, g, unknown or other
  modified_base (8876)..(8885): a, c, t, g, unknown or other
  modified_base (9667)..(9676): a, c, t, g, unknown or other
  modified_base (9833)..(9842): a, c, t, g, unknown or other
  modified_base (10093)..(10102): a, c, t, g, unknown or other
  modified_base (10155)..(10164): a, c, t, g, unknown or other
  modified_base (10539)..(10568): a, c, t, g, unknown or other
  modified_base (10760)..(10769): a, c, t, g, unknown or other
  modified_base (10838)..(10984): a, c, t, g, unknown or other
  modified_base (11433)..(11442): a, c, t, g, unknown or other
  modified_base (11864)..(11873): a, c, t, g, unknown or other
  modified_base (12132)..(12141): a, c, t, g, unknown or other
  modified_base (12510)..(12519): a, c, t, g, unknown or other
  modified_base (12936)..(12945): a, c, t, g, unknown or other
  modified_base (13098)..(13213): a, c, t, g, unknown or other
  modified_base (13460)..(13469): a, c, t, g, unknown or other
  modified_base (14225)..(14234): a, c, t, g, unknown or other
  modified_base (14615)..(14624): a, c, t, g, unknown or other
  modified_base (14955)..(14964): a, c, t, g, unknown or other
  modified_base (16097)..(16106): a, c, t, g, unknown or other
  modified_base (17768)..(17777): a, c, t, g, unknown or other
  modified_base (18202)..(18211): a, c, t, g, unknown or other
  modified_base (18973)..(18982): a, c, t, g, unknown or other
  modified_base (19324)..(19333): a, c, t, g, unknown or other
  modified_base (19774)..(19783): a, c, t, g, unknown or other
  modified_base (20630)..(20697): a, c, t, g, unknown or other
  modified_base (20864)..(20873): a, c, t, g, unknown or other
  modified_base (20971)..(20980): a, c, t, g, unknown or other
  modified_base (21078)..(21197): a, c, t, g, unknown or other
  modified_base (21656)..(21665): a, c, t, g, unknown or other
  modified_base (21963)..(21972): a, c, t, g, unknown or other
  modified_base (22704)..(22713): a, c, t, g, unknown or other
  modified_base (23198)..(23207): a, c, t, g, unknown or other
  modified_base (23636)..(23645): a, c, t, g, unknown or other
  modified_base (24529)..(24538): a, c, t, g, unknown or other
  modified_base (25016)..(25025): a, c, t, g, unknown or other
  modified_base (25427)..(25436): a, c, t, g, unknown or other
  modified_base (26498)..(26507): a, c, t, g, unknown or other
  modified_base (27177)..(27186): a, c, t, g, unknown or other
  modified_base (27437)..(27446): a, c, t, g, unknown or other
  modified_base (27508)..(27517): a, c, t, g, unknown or other
  modified_base (27600)..(27609): a, c, t, g, unknown or other
  modified_base (28159)..(28168): a, c, t, g, unknown or other
  modified_base (28519)..(28528): a, c, t, g, unknown or other
  modified_base (28637)..(28646): a, c, t, g, unknown or other
  modified_base (29365)..(29374): a, c, t, g, unknown or other
  modified_base (29468)..(29645): a, c, t, g, unknown or other
  modified_base (30007)..(30063): a, c, t, g, unknown or other
  modified_base (30115)..(30124): a, c, t, g, unknown or other
  modified_base (30176)..(30185): a, c, t, g, unknown or other
  modified_base (30342)..(30386): a, c, t, g, unknown or other
  modified_base (31065)..(31074): a, c, t, g, unknown or other
  modified_base (31577)..(31586): a, c, t, g, unknown or other
  modified_base (31947)..(31956): a, c, t, g, unknown or other
  modified_base (32214)..(32223): a, c, t, g, unknown or other
  modified_base (32878)..(32951): a, c, t, g, unknown or other
  modified_base (33016)..(33025): a, c, t, g, unknown or other
  modified_base (33090)..(33099): a, c, t, g, unknown or other
  modified_base (33268)..(33323): a, c, t, g, unknown or other
  modified_base (33496)..(33505): a, c, t, g, unknown or other
  modified_base (33966)..(33975): a, c, t, g, unknown or other
  modified_base (34470)..(34479): a, c, t, g, unknown or other
  modified_base (35309)..(35318): a, c, t, g, unknown or other
  modified_base (35983)..(35992): a, c, t, g, unknown or other
  modified_base (36073)..(36082): a, c, t, g, unknown or other
  modified_base (36638)..(36647): a, c, t, g, unknown or other
  modified_base (38019)..(38028): a, c, t, g, unknown or other
  modified_base (38358)..(38367): a, c, t, g, unknown or other
  modified_base (38463)..(38472): a, c, t, g, unknown or other
  modified_base (38558)..(38567): a, c, t, g, unknown or other
  modified_base (39568)..(39577): a, c, t, g, unknown or other
  modified_base (39979)..(39988): a, c, t, g, unknown or other
  modified_base (41276)..(41285): a, c, t, g, unknown or other
  modified_base (42118)..(42127): a, c, t, g, unknown or other
  modified_base (42208)..(42217): a, c, t, g, unknown or other
  modified_base (42404)..(42615): a, c, t, g, unknown or other
  modified_base (42702)..(42711): a, c, t, g, unknown or other
  modified_base (42798)..(42807): a, c, t, g, unknown or other
  modified_base (43024)..(43044): a, c, t, g, unknown or other
  modified_base (44192)..(44201): a, c, t, g, unknown or other
  modified_base (44963)..(44972): a, c, t, g, unknown or other
  modified_base (45626)..(45635): a, c, t, g, unknown or other
  modified_base (46002)..(46011): a, c, t, g, unknown or other
  modified_base (46788)..(46797): a, c, t, g, unknown or other
  modified_base (46858)..(46970): a, c, t, g, unknown or other
  modified_base (47032)..(47041): a, c, t, g, unknown or other
  modified_base (47113)..(47122): a, c, t, g, unknown or other
  modified_base (48573)..(48582): a, c, t, g, unknown or other
  modified_base (49967)..(50033): a, c, t, g, unknown or other
  modified_base (50226)..(50235): a, c, t, g, unknown or other
  modified_base (50345)..(50354): a, c, t, g, unknown or other
  modified_base (50464)..(50588): a, c, t, g, unknown or other
  modified_base (51665)..(51674): a, c, t, g, unknown or other
  modified_base (51916)..(51925): a, c, t, g, unknown or other
  modified_base (52089)..(52098): a, c, t, g, unknown or other
  modified_base (52714)..(52723): a, c, t, g, unknown or other
  modified_base (54340)..(54349): a, c, t, g, unknown or other
  modified_base (57735)..(57744): a, c, t, g, unknown or other
agcgcgaggaggcggcggccgtgcaggcggcggccgacgcgcgcggggcagccacgctgcagcgcgctgtgcacgctgttctgcgccaggccgcggcctgcggcgcaggcggcgccgagctctggggcctctttgccaggtgggctgcagcgctggggggggggaagaggtggcttgctgtgggnnnnnnnnnntgcaggcggcgccgagctctggggcctcttcgccaggtgggctgccgcgcgggtggggagaagaggtggcttgctgtgagtgcgggggtggtggcgcggcgcatgagacggcgggatggagctggagcgggggcttccaggcgagatgcatgctagagacctacggggcaggtgcttccgtcccccatgccaccgcatgccatgcgcccccacccccagtgtcccagcccccaaaaacacaatcccgaaacaggtaccacgaggcnnnnnnnnnnggagacctacggggcgggtgcctccgtgccccatgccaccgcatgccctgcgcccccaaccccggtgtccccgcccccccgaacacaatcccgaaacaggtaccacgaggccaccagcgaggacccctccctcgcgctggagtgcaggctgaaggaggtgcgggcgctgcagggcgccgcctggcagtcggacacgacgcgcttcgagcgcttcgcgcgcgcctcgctggcgctgggcgccgcccacctccgcgtggcggccgcggcggccgagggcgggggcaggcgcgagctttcggcggcgcgcatgcacctccgaggcgtcgtgcgcgccgcgcagcccggcttcggcgaccacgctctgcacgctgagctccggggggcgttgcaggacgtgcaggcccgcctggacgcgctgtgaggctgtccgggggcactgcagcctgcgtcgccgcttcgaggtactgcagatgtgcgaggagggccgggcagcgccgcgcggtgatctgctgtccatggcactcccccatgtcaggtcagccccctggatccattgcacagtgcaggaagttacagtgtacagcgatccccaatggcggggcgggcagtgaggaggggggggcattggcacagggccgtcggcaagatatggggggccgtccggtctggcggccggagtacaggccatggtacaggggtgcggcgtcgggaaagggaggcgtgggccgcagggcatgccccgagtggaaaactgggatcgtgccccggcatcttctccgacgacgagggaacgtgcgccagcgccccctcctggcgtttgccgggaagagcgggtgctgcgtggctcgggggcgcgggtgcgtcgtcggcggtgccggccgtcaaaacacgtcggggttgcggaaggccccgccggcggcgtcgnnnnnnnnnnccgccggtgccggccgtcagaacacgtccgggttgcggaaggccccgccggcggcgtcgggcggggaccccgcggccgcctgcaggtgcacctgcagcgagtagttctgcacctgcagcacctggatgcggcgccgcgcggcgtccagctccgcccgcagcgccgcggcctcggcctcccgcgcgccgccgtcctgcagccgcgcattctggatggccacggcgcgtttgagcagcgcattctcgcgccccgcctcctgcagctgcgcccggagccgcgtggtggggctggccccgtcctgtgagaagtagggggggaggtgagggggggggtgaattgatctcgtggatgcaggcggtggaggacgacagtcgtcgacaggggggcagaagatgggtgtggttgcgctggccggggatgagccggccgcgacagagcacgctgaccgggtgggtgcctgacgagggcgaggccccaccactccggggcccatcgccgatggcacagagcactgcgccannnnnnnnnngccgggtgggtgcctgacgagagcgaggccccaccattccggggccatcgccgatggcacagagcactgcgccagcatgcggctggagtcctcagcgcgcctggactccctgcaccccccgcccctcacccctccgagaccacaccgcacctgcttggcggcgtgcaggatcacgccccgctcgaaggcctccagcacgcgcgccgcccgggcccgggcatcctccaccgaccgcgccgcggtcatctcgcggaccacctcctccacccactcggcggcggagtgggccgtgggggagggcggcgcgctgggcaagccgcccgctccctgcccctgctgctcctgcccgggcgtcgggcggtcgccggggatgaaggcgggggcggtccccgagggggccgcctcccgcgcaccgcccagctggagctcgttcagccgcttgatcgccgcatccacgtcgttgccatactcctctagcacagccgcgatttcctggggggggggggggggggggggggggnnnnnnnnnngccttgagaactatccaggccactggtgcttcccgcagcattgagaagggctcaaacagtcccagagtgnnnnnnnnnngggattctttgggagccttgagaacaatccaggccactggtgcttcccgcagaattgagaagggctcaaacagtcccagagtgaagagacggtgacgaaaagggggacctcgacaggctacttactgcccagcgctccatacactctcacaacccttgcctgataccattgaggtatgacgacctcaggccacaccaccctcccagccatcgccatgagcatcgacctcgnnnnnnnnnntactacccttgcctgaaatcatcgaggtatgacgacctcaggccacaccaccttcccagccatcgccatgagcatcgacctcgcaaccacagaattctccacaaacctggtcactcatgctcgggaagagggctgccagggccagaatcgtcgacctcttcagactgggtggcagagctcgggaggcctgcgcgcagctgctgacctgctctcctgtccaccgcccccgcttgcctgcgagcggggagacttcgcccagcgctgccccctcgccgtgcagcagacgcttcgagccggcgtgggatgcgacagacatgccgaccccctgtcctggagggggtgtccaaccccggagggataggaggcctggggaggagggctgcctctgatgtgaacgaaagaatcggactatgttcagctccaggcgttctcaggctgtacgtgtcgcgacaagcacctccctaaccgcgacttccgaggctgagcgacagacacgggtgcctcccgtgtggtgtaacaaagagaggccgtgtgacctgcgtcggggttccaggcaggactgatactcataaagggccttcaaatggccgatgccaagtctggctccatatacaccatcgctaggattcagggggtcccgatactccctccactaccctcccctcgattgggaggggcgagctgaggaaacctggaatctgatgctgcccatgccacggtggacccccttgccagcaggcccgtgcgccaggaggcccgcaccctgaatcaaaatcatgcaacgattcagaggcacaagtagtctgaccagtgtcgagagggtcgtacgggtcacgccctgattcggcgagaaacactcggtccggacccagcgaaggtttattgcctggctcgctttttgccgagccccgatacgaggtagcacgccatcatgctgaggagcgccagggcacttgccagggctgccacgctcctgcgcgggtctggcgcgtccgtgcagccacagcagcagcaggaggtgcgtaatgtggacccgaggttgcaaccaggaccctgcctgatactggtatcgggattgtgttgatgtcagtaaaacgtgatgcggtccgcaccatgactgtgcaggtgctccgcgtcgcatccagggcctttgccaccaacagccacgacatcttcaacattgtgagtgggtgggtggtgttcgagtatggggtggagttctgcctccatctgtgtcatgcacagtgatctatccccccccacccccctgcacacctccatcctttcacctgcatacccccagcgacaaccccccatccctcctccccgctccagcaccggcacgagccgcacaacaacnnnnnnnnnncatacccccaccaaccatcccccatccctcctccccactccagcaccggcacgagccgcacaacaactgggagacagagttcgacttcaccaaggagaacatggccaaggccaaggagatcctgtcccgctaccccgagaactaccaggcctcggccatgatcccgctcctggacctggcccagcagcagaactccggcttcctctccctggccgccatgaaccgcgtggcggaggtcctgggcgtggcccccattcgcgtgtacgaggtggccaccttctacaccatgttcaaccgctcgcccatggggcgctaccacgtcatggtctgcggcaccacgccctgcatgctccagggcgccaagggcatctacgaggctgttagccgccacctgggcgtggtgtacggccagaccacgccggacaagctcttcacgctgtcggagatggagtgcatgggcgcctgcgtcaacgcgcccatgatcgccgtggccgactactcgggcggcgtggagaagttcacctacacctactacgaggacctgaccccggaggacgttgtgggcatcctggaggacctcaaggcggggaagaagcccaaggtgaggagggttttgggggattgggtgctagaagtggaggggaaggtcatctggggcgatggagagggtgagagaagagtgtacctctgatcacccagcccctgcagcggccagggtgttggggaagtggctacaaccagccacccaagccaggatgttgacatggaaatcattggcaagtgggacagactctgttatcatcgtgacctccagccgcccattgccaccccatcgactgtccaggtttagccaaagcttcacctgcccccaccctcatctctataacaggtcgggagccagcaccgccacaatgcggagccctcgggtgccgtcgcggacggcaagtgggtggaggactcgcccggcgccaacatcacgctgagggggccccctcccggaccctactgcaggtcggcctgggatggtcgtattatcgtcatgggcggaggggtggagctgtgcgtgaatttgccagcctctgctcagcaaatcgcatactggccatgtgcatcgggtacattgcccggacgggcccagctcctgccctgcgtgtctatcgtggtctccatctccctccagaccgtcaccctctcctccctccctctacccaccacccaggaatctggacgagcccccagcagaggcggccccagcgccaccaaagtagagtctcggcgcgcagagggcaaggcggtgcatgcgctcgttacccccttggtgccctgaagaatgtgccgctccctcctgaggcactgaatcgcctgtaannnnnnnnnnaggatggtcgtattatcatgatgggtggaggggtggagctgtgcgtgagtttgccagcctctgctcagcaaatcgcatannnnnnnnnngctcggcgcgcagggggcaaggcgtgcatgcgcccggtccccccttggtgccctgaagaatgtgcccctccctcctgaggcactgaatcgcctgtaaacgcaagcacagctgcatggcaacctgcacagcgctttgaaccagtgtacaagcacacagcgtaacgctcacgcccctgcgcctgcccgcccgcccgcacaccagccagtcgccaacgacagcattcacagcggcagctcggcggacagcctctggatgtcctctgcctgtgccacgggcagcaggtcggtgcgcccgccgcacatgagtgcggtgcggaggtaggaccacacggccgcggcgcgcgggttcaggctcagcgcgcggacatagtaccgcgcgctggcgtcgtagtctgccaggttgctgtagctgatccccatgttggtccaggcccgcatgtagttgggcttcaactccagcgcctggttagggtgggtggaagagtgacaaaggaggtgggggagggtagactgtgaacttcagacatgggatggaaagaggggaagcgtataggggtggagggtannnnnnnnnnagggggggggggggtaagactgtgaacttcagacatgggatgggaagaggggaagcgtataggggtggagggtatggctggcatcagcagttagagatactcatccttggagtctcatttcagcccgctgaaagccatgattgggacatcaggagttctagcagacgtgctgcctcatcaagccggccttcccagacctccttccccccttccatcctttcctcccacacccgcacaccttgcggtaggcgggcaccgcgtcccggctctggctgctgttggccagcgtggcgcccagcttgttccacagcgagtagtcctggggccgcaactccagtgcccggcggaaggcctgtaccgcctcgtcgtaccgcctcgccaggttatggaccacgcccagcgcggtgtgcaggtcggcgtcccgcgggttggccgccagcgcggcctccagcagcgatgtctgcaggaaagggtggggagaggggaggaggggaagaatttcggnnnnnnnnnnacgcggtctccagcagcgatgtctgcaggaaggggggggagaggggaggaggggaagaatttcggaactactacatgataatcaaccgcgcaaggggccagaatccgacccatggcccccctgccacttcctcacggccaagctgcaggacggcacgccaggcgcacacgacatcgagcgccaccatcttcctgtcaagtccccatttcaccaccaaccaaccaatccctcaccacatggaccaggctctggctggcatccgcgggccgctggatgccggcgacgacgggggcgtgcgtcgggtggcgcgacacccactgtcccaggtactgcagggcctcgctggagtccagctcgttggtgtgtgagacgcccaggctgagcagggtttccaggttggaggggtcgatggccagcgccctgcgtgcgcggggagcaactggagtcggcgaccgagaggctgtggattagatgtacggttggatgtaggcaacagcgagcgacctggggtggtcagctcagccgcgccccccccccccccccccccccccnnnnnnnnnncagatgtacggttggatgtaggcaacggcgagcgacctggcgtggtcagctcagctggaccccccccgccccccccctccctgcgcacctgttcatggcggcgatggcctgctgatcgtcgtcgttctcggcctggacgttgcccagcaggcgccaggcctcggcgttgttgggcgagcgctggcactcggcctccagcgccagcaccgcctccgtcagcacaccctgccagggtggagggaatgacaggtcgacgtggcatgaagcgcaggcaggcaccccctgggcgcgggaggactggatggcaannnnnnnnnntgtcagcacaccctgccagggtggaggaaatgacaggtcaacgtggcatgaagcgcaggcaggcccccctgggcgcgggaggactggatggcaaaggggggaacctcggtgggcaggggcgtcagcaccgccctcctgccgcgcaccctcgggagccaggctgggccactgtcccttaccttcggagatgccaacactccctcccctccctcccaaatgcgcacccgcttgaacaggtcccagcccttggccatggagtcggtgtcgctcaggaaggggttgttctcggccattacgtaacccccatgagctgatggcgcctgggcgccgtgcaggcgctccagctcggcgtcgtactccgcctgccagtcctcggtctggggcccggcgaactcgctcgcccactcccccgccacgccctcggcaaaggcgtcggcccagtcgccccccgtgcccgccgcccgggcctggaaggaggcgaactcctcgccccagggggagggcccgtgcgtggcggagggcgccgcggcgtcggccgtgaactcccgcgtccactcggaggcggcgggggtgacctccgtggcctgtgtatgtgcgtgttgagggagcgggggaatgtaaacatctcacaactaccatagggatctgcacaagctcccaggaccaggggatgcaaaagatgnnnnnnnnnntgtgttgagggagcgggaagatgtaaacatctcacaagtaccatagggatctgcacgagctcccaggaccaggggatgcaaaagatggtgacggtggagtccacgcacagggggtgcactgcactttctgcagtgtggtccgtgacgtcaatctttccgtcggccgtctgctcgggacacctctcgcacattggctgccactgctgggcaccctctttccaaacactcccacctctcaccttgttgccctccaggatnnnnnnnnnngttccgtcggccatctgctcgggacacctctcgcacactggctgccactgctggcccccctctttccaaacaaccccacctctcaccttgttgccctccaggatgacctcgccccggctcatcttggagatgaatttcaggaactggctgttctggaacttggggtccttgttggctgcaaggtgcgaaaaaggggggggtgttgaagtgcacgatcgtcgttctcttcgaggggatggggtgctagtccggctgaactcaagtgtgccaggcattttggtttgttcccacacgataggctgccctgggccatccccaatctagggcggacnnnnnnnnnntctctttgaggggatggggtgctagtccaaccgaactcaagtgtgccaggcattctggtttgttcccacacgataggccgccctgggccatccccaatctagggcggacccgcccccatcatccatgcctatacccgcgagacccaccccaaccgttgaacatagaccatcaagctcctataccatccacaccatacggggaccttctccccgaaacaaactccagggcacctgccagcgtgtcggccagcctgcgcgactgctccacagcttccacctcggaccggccctcccgctgcgccaccccggcgctctggaagtcgtccacccaggcggacgccggcacctcgcccgcgaattcgccggcccaggcctctgcagctggctgggcggcgccctgccgcgccgagaactcgccggcccagccgccggactgggtgccgtccgcgacctgcagccgcgcaaagtcgtccacccaggcaccgggctgctgcccatgcatctgcgtgtgaggagggggaaaggcaatagcccggggtccgctaaagtgatgtggttatgcagtgcacgtctggccaagggtgtttggcatgttagtatgaggaatttgagcgccgtgcacaagctcagggtagagaaggaggccatgtgcaagctgggagagacagagcacgaggggttgctggcacggcacatgcagggaacccctcttgagcaccccctcaatgcgcccactgatgaccgcagggggaaattgcgccatgctctgtgcagctgggagnnnnnnnnnntgcaccccctcaatgcgcccactgatgaccacaggggaaaattgcgccatgctctgtgcagctgggtgcctgcctgccttcatgcattgttgcacaaccccaatcaatcgtcaacgaggccctcaccatggcttggttggcggcatggtctgtcaannnnnnnnnnaccggactgggggccgtcggcgacctgcagccgcgcgaagtcgtccacccaggcaccgggctgctgcccatgcatctgtgtgtgagaagggggaaaggcggtggcccggagtccgctgaagtgatgtggttatgcagtgcacatctggccaagggtgtttggcatctgagtgtgaggaatttgagcggcgtgcacgagctcagggaagagaaggaggccgtgtgcaagctgggagagacagagcacgaggnnnnnnnnnnccccgcctgaggcccggcggcgccagagtagatgttgtcccagctggcttgannnnnnnnnngcccgcccgaggcccagcggcaccagagtagatgttgtcccagctggcttgacccagggaggggggcagggtggtgggatcaatgttcaaggaggaaagcagggcgccgacctgtgcgtcggcaaactggccgccctgctccgcaaacatttggcgagccataataagcgagcgatcgcgaatccgtatctgggcagcacagcatgggtggggtggggtggggtggggggtttaaggcatgtgcgtgggtcattgtgtacactcgtcgacaagcaggcgtcgcaagccgttgggcagaggatactgctgtatgatgaggccaactccaagcagaccttcaggatgcacagcaggtacagcaccctcatcacctcnnnnnnnnnnnnnnnnnnnnnnnnnnnnnnggcatggcagtcttcccgctgtccatgaaggcctgggggagagcaagtagcgtcgagactatggtacgctgtatgaagcacagcctcagtctctgctagatatccatagcatcgagtaaaggctcctggtcagcaagcctgcagggcccccctgggaaaacctcagctgtgcgacacacaccttgaagaaannnnnnnnnnacacccagccagcacacacctggtctgccacaggcaatggcacggctggcaggtgcatggggtggaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaagcctgcagagccctgggaaaatctcagctgtgcgacacacaccttgaagaaaggagccacagctgtctggagcgtcatgtgggccagtgggccaccctgcccagggtgtgaagcgccattgtatatgctctcaaactctgcaaagtcggggagacctgcctgggcggggccctgaggaaagaaggcgtccagggcttcgctgcggggcccctgcatgcctggcagctgcagggcagcttctgctgctgcagcagcactgggcgcctggtagtgctgcatgtgttggggtgccgcggcaccccctgctcccaggccaggcagctgcacggatgtccaagggtgaggacaatggggcgaggctgcaaaacttatttgcgactaccacatgcatgcggatccgagcagcatctgcacaaccactggcatccctggacaagtagcgatnnnnnnnnnnctatttgcaaccaccacatgcatgggaatcggagcagcatctgcataaccactggcatccctggacaagtagcgatggcagggtgcaccattgggatgaacaccaccggtgacaagccccaagcttgcaccggtccaccgtcctgccaagccattggtggggccgcgcacctcctgaacttgcgcggtctgcttggccctgcgacccaaaagggcatctgcgagagatgccgcagcattggatggccctgctccatcgctggggccgcatgcatcggccccggtgaccaggtcccggagtcccgacatagggctggggccagaccgccgacttccacacactgacgctcggcgaagcacaatataggaaagagtacacctgtaatgtttccgttgtatcggacctctcctctagtcctgctnnnnnnnnnnggattgtacctgtaatgtttcagttgtatcggacctctcctctagtcctgcttggcccaccttcagattagcaaatatcgccacgccggagtttccgagcgcgagagggatttcggattgccactatcgtgagcaatgcaccgtcaagccaactctggacctgttcactgaggaagtggttctgatcgagatgggattattgtgttgtctgccaaacgtccccgtctgtgtttgaaaggccggagcacctgggcagagnnnnnnnnnncaatggagatgggattattgtattgtctgccaaacgtccccgtctctgtttgaaaggccggagcacctgggcagagatcctcgttgccagtctaatccatgcttcctggttgagacctccgcttgccgctttctttcgactccgcattcgtcctgacagcctctatgcaggcattcaggatggtgtgggtgaaggtggcggtcttggccgctttggcaacccagctcgtggtcgggtcgccctatacccttccgtcccatctcgccagcgtccaggctgcttacaacgactcggcattcatcatcacaggtaataaatgctacacgtacgggggaatgccgctgcttccatgctccctgaccacctctnnnnnnnnnncttgatgctacacttacgggggaataccgctgcttccatgctccctgaccacctcttcctgcctgtgtgccggatcacgacaccgccctaaaaatccatgctcagagtccggcgagctccagctgaagctgtgcgagtgcgagcgcgccgcgggggcgcccaacggcctgtcctgcgacaaggcgggctggttcgtgtcctcctgggagcggcagggccagtgggtgacccccttctccatcgccggcagcggcacggttcccctgtcccacgccatctgctgccgcccctgcctgcccagcgagctcccccccgactcatctggccgcattcccagcggcgaaaagccggtggccgtggtgtccctggcctgccacgtcagcactgacgagacgccggggcactgcgaggtcgctnnnnnnnnnnccccagtggcgaaaagccggtggccgtagtgtccctggcctgccacgtcagcaccgacgagacgccggggcactgcgaggtcgctgggtccagcctggtggcaggtgtgacgctatgggcccgggggggggaggggggggggggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtctcacaaccaggccctgtgctgtcatggaccccgagggtggtcacctctgcatgatggcagtggtgccctgccctggccttggcacgggacccaaccaggtgccacgacctctgccctctcccgcgcctatcgcttggcccctggcttcaggcacacaacatcagtacactccattcgtttgcttaaacacccctgactgcccatcttttcctacaagtcagatcccctgcctttccccccaatnnnnnnnnnnacagcacactccatttgtttgcttgaacacccctgactgcccatgttctcctgcaagtcagatcccctgcctttccccccaatccccctccccccaccacaccctttccccgcccgcgcaggcttcagcgagtcggtgcaggtgttcagcgcggcggacactaactaccccgtgaacgcggcgcgttgttgcacgccctccctcctcctctccaacggcgacgcctgggagctggagcgctgcgcctgctcccccggcgaccccggcgccgacccctctgtgtcctgcggcggcaccaacacccacaggctgctggccgggtacgcagaccgccgcgccacgccgctgggccagtcggtgcccgtggcccccgctgactgctgcgcgctgtgcctgtcgcgccacttccaccccatgtcccagtgcgacgacctggccaactgcaacgagcgcggcgtgtgcaacctgggcgcctgcgactgcttccagggctgggccggtccggactgctcggcacgcgactcgcgcggcggccgagggcgcggcgtgcccggctgggccatcaccctcatcgtcctggcgggcctgctcgtggcctccctgttcatcctggtggggggccacgtgctcaacctcctcggcgaacgtgttggtgagtggtgacgctggtggggttttgagggaggggggccgcggtgagtcctcgtgctggcagacctgggggggctggggtctgtgcgcccagcgtgggcctgnnnnnnnnnnacccgcgccggcagacccgggggcgctggggtctgtgcgcccagcgtgggcctgcatccccgagtcccgtgcgactccgccccagcacgggccaaacgcaccgccccgcgcgccctcgcagacgcggcggcggggctggccggcgaccccgactcgccccgcgcgcccctgctcatccgcatcgacgccggcgacgccgggtcggtggggtcccaggattccgacagcgacgcgtcggacgcggaggacgggcagctggcgcggcgcatcgcggccgccatccataccctgaacacgggggcgcctgggggcctgggagggggtctggaggcgagcgacgcggggccggggacgggcgaggacggcccgaggcgctccccnnnnnnnnnncaccctgaacacggggggcgcggctggggccctgggagggggtctggaggcgagcggcgtggggccggagacgggcgaggacggcccgaggcgctccccgagcgccggcccgcaggacgatctggagggtggtaccctccggactgtgccccctgctcagacggccgacccgggcggcccagacctcgcagcggcgccgcactctgcagcggcgccagactctgcagtggcgccgcacgccgcggccgcgcaaggccccggaccccctgccgcccccgacggcgaggggcccgccagcgcgatcgcgaccaagtccgccgcgcaagggacnnnnnnnnnnagactctgcagcggcgccgcacgccgcggccgcgcaagcccccggaccccccgccgccccctacagcgagggacccgccagcgggatcgcgaccaagtccgccgcgcaagggacccgcggcggctgcagcctggggcgcgactgcgcggtgtgcatggtgcgggagtgccaggtggtgctggtgccctgcggccacacctgcctgtgcaggcggtgcagccggaagctccagcgctgccccatctgccgcaaggacatcgcgcggcggcagcggctcttcctgtagacaacgccgtcggggcctgattcacaaggccgatctgtacactactgtaccccagcagggaggcacacccacctgcactcgcttgccattcacgtcacgtgcgccaaatgtacccctgcaccgtggtgcaagcccagcaatgttgcttgtttgcatttccgttgatcccacgggacaaccctcccgcaagtacattctcaggtgtgatggcctcagctatgtgactgcagcagcgttgcttcatatgtattctgcaagagtgtcagggtcggcagggcggagtgaggggcagccttcaacagggaggcaactcgtcggtatactgtagagagtggaaagatcaagcacgagcggtatgggttctgtaagacctgaatccaatatattgcaacacaggcacgaagcaaaatcctccctcactcagccgttcacgggtcaatgtgggtgtctgtccaggtcaagcactggcaggcgtgggcgcccgacagcacaggctcagaaatctgcgctgctgccgcgctttcctcccttgcccctccgcaggctgcttcgctgccgaggcatgcagctggccaggcacccgttgctcgtccagggacgcttctcccagcttgctcgggagcagcgtcccgccgtggctggtggtgcggcgatgggtgccccgcacgagccctgttgcgtccaggggctcccccgacgccctttccaagaagttgtcgaggagctcccccgcctttgcaaaggccagcgcagactgcgcctcaggcggccggtcgtcgcctgccaatctgtgaccgctgtaggtcgaggagtatcgcgcagggttgctcctgctgccctgggacgnnnnnnnnnngatctgtgaccgcggtaggtcgaggagtgttgcgcagggttgctcctgctgccctgggacgcgtttggttcgatcttcaggatgccagcacctgagtttgaggcagggtaaggggaagatacgtttgcagcatgactgtggtcatatgaggactgacttggaggtgcaggatacgcatgcaacatggcaaacgtaaaggatggcgcgacagttgcttatctgtcatccatccactcctgtccacaacaccctcaacggcccgatccccactgacctgtcagcccgagcagcaagctgacggaggcggtgttgaaggattcgacaaccatgctccccatgctttgagccactcggctgggcccacgcgagagggcaggcggcagtggtcctgcaagacgagccccaggtgagacttgtgggcaggggattgtgtgcacgacggggtggctgctagccaaactcatctacgtgatgacgagtagcgccagggaatggaaacagcagcacagcgcagcacagatactccaaactgggaaagcaaacctgaggtccagatgtcatgacggtcccagctctcagccctcgctgaattgctccactcagcctgaacaagaatgtaagtccgatgtcaaatcgccgggccaaacacctccgcgcccccccaggcaggtcatgcagtgattgcatagatctccacttgaagccctcgtattgcatgctgccagctgtggccgctttgggttgcccatcaatatggccctgacaattgacaccaggccgccagccaccctgcacacctgttcaaattctgcagaaccctgacccgccttcgatctgggtgagactctttcggaggagaacccgagtgcatcgacccaggtcctgacccagcgtggcagggtactgagcttcgggccctccatgccggtcgtggtctctggcggcggggctcctgcctcggccccgctgtacaagcaggcagggcgcggcgcatcggccgtgcgaggcttagggctgctgaaggactcagattccccctcccgcgcatccctgcacgggtgtgagatttggagggcggctgcagtgctgtgacaggctgaactctgtggggagcgctggccgacgtgccctcgcgggtagcaaactccatgctggcagtgcagcagaagccgcatgaggtttccctgccaaacagtatcaggcgctgccaaggccacgacccctgaaagtacccactggagagcggctcacatgtactccgtggccgctggggtgacggaggcggagtgcaccgacgcgtcgggggtagatggcgtcgcgggagtcggccccggcctccttccctcccaggtcgggcgcggggaggtctggcccgagtccgacgcggcctccatccagggcacgcccatgcccacctgcggcctgccggccagaaggcgccagccctcccccgccgccaggcacttttgtcggtaggtgcaccaggcccccacgatggagggcagccggctgcgggcgaggggttgaggggggccgagtgcctgctgagtgctccatgggtgccccagatgctgcggccagcccgcagagcgacaggcagaggcatggcccggcgaccggcaatgaccctccctccccccgagcccagagtcgggagtcacnnnnnnnnnncggcccggcgaccagcaatgacctttcctccccccgagcccagagtcgggagtcacgcgctgactcaccggtacgtcgcggccagctggtccttcacgatcccctccacgatgcggcccaggccgaagatgcccacccggatgcggccctccagcgtctggcggcaggcgtcggggctggtgggggccaccgtcaggcgcagccggatgtccagctgcaggtcggggggggaagggctgaggtccagggctgggagctcgtggcccacacgtgattcccaggcctgctccgcatgctgcgcaccttgtgccccagcatggggctctcggtgcacacggacagggagtaggggggcctggcgaggttcgagggagcgtactcaatgatctggggtggaagcggggggggggggggggggggggggnnnnnnnnnntcacggacagcgagtaggggggcctggcgaggtccgagggagcgtactcaatgatctgggtggaaagcggggcgggggggggggggtgggagggggtactcccgacagcagcgccaaacagggcaaggcagaggcccacccatctgcatctcccagccacagggtcatgcgccctgccgcatgtccaacttcgcacatcgtgaaactccagcttctggaagctagcctggctctgcagtgctttgggcacccaggccccaaaatcggggctggtgaccaaccgcaccacctgtgagccctcaggtgaggtccaggcctccacaaactccatggtgccgattttaagggtctgagagggcgatagtatgggtcggttgcacttccctgaggtatctgctgccactggggcctcccatcaccgctacttacccggctgagcaggtctctgaacgccttgctgtcacgctcgagcatgtacctctccgcattcaatgggaggtcggcagacacaatgaagaatcctttctccttcatgatatgattttaggcgcaagtatgatgagccaagtgcttatgcgggctcaactacgacgacgaccgtgcggtgtcgtaggtggccattccgaggtggcaacctgccgggcaagcagacgcttacgtgagcccagctagttgtccgaaaaagtacacaactataatcatcgacaatttagttgaatgcaggggcatccggcccagaaggtggtgggtcggaaattttgnnnnnnnnnnccgacaacttagtttgattcaggggcatcaggcccagaaggtggtgggtcggaaattttgacgctgggagttggggcgcgcggcaacaatacgatgagcgtctggttagctggacgaactgatcatctgtcttgcaggtggcttgagtttgtcaatggtcataaggggtaggaaagaagccaacttgtccgaggacacaatcttggatgctgttcctgttcataagccaggcaggcagcgagggcagcaggcagggcagtgaggacggcaggagctgaagccaccgtcctcagtactgcatggaatagaaggccgacgtgccgtcggggaggacgcggtccnnnnnnnnnncgaggacagcaggagctaaagcttccgtcctcagtactgcatggaatagaaagccgacgtgccgtcggggaggacgcggtccctgtgttcctctctactggagtagggaactgcgcagaaatggaaaaagggtcggtgatgggaagtgcgggcctgggtcgggagcgggggtgtcacggcgtggcgtgtggggtgcgtgccttgctttctcgcgctgactctgcatcatgaaggatcagtgccgactggtgtggatgggcgcatcgggcaaacgcccagccagccgcatgaggacctcttgccactggtgagtgtgagtctcatcctgtgagccccctctctcctccctccctacccaagcaccccctgacacccgtcgggccacccccacacccccacagctcacccgagcggggcgccggcggtgcctcctcacgcgcnnnnnnnnnngcacccgtcggcccccctcccacaccctcacagctcacccgggcggggcgccggcggtgcctcctcacgcgcgccctgctccacgtcgccctgctcccccgccgccttgtccacaacctgcacgtcgctgagccccggcgtagccagcgccgcagccgccagctggtcgtacaggggctgcatctccgcaggcgcctcgaccttgccctccagcagcgccgaggcggcgacggggccgccgtaggccgccgcgttggccgcctcgtccacggtcagcaggccgatggcataggagaagtcgaaggaggcgccgcgcagggcgccggagcccacggtgccgtaggaggccgcgggggaggtgaggaagtctcggcgcacgcgcgtcgccgcgccacacaggatcccagactcgatgccggtgaaggtgcggtggcggcgccgctgcacctcggcgcgcagcttgggcgtcatgcatgcggtgacggaggcggagtgcacgcggccaaagcccaggcccaggcccgtggtctccaggcgcaggaagcagggggcgctccagcggggggtaccggcgtcgtcggagggcagcctgcggcatggtgatggggaggggagtcgtgggtgggagccgtggttcatggcgccaggcgccttgtgcaggaaagcagccctccttgggcatggacggcagtgtatgtgagtgcgaggtggcatgtgccggtggatgtgcctcctccctcaggccttcccccaagaatgtgatctgcagggaacggttgtttcatgccagtccttctatcaagctggcgtccctgataaaacttgtaatgtcccagactagtttatnnnnnnnnnnnnnnnnnnnnnnnnnnnnnnnnnnnnnnnnnnnnnnnnnnnnnnnnnnnnnnnnnnnngcgggagatgagacacccggtcttgcgcgcccgatagaagacgagggagtcacattgcgatatccaaaagggcttcatgagggctttcgagccgacgatgggggtcgcatcgccgctggacccctcagccgtgactgcggacaggtactcttggccatcctgacagnnnnnnnnnngctgtctcgccccagggttatcccccctctccacctcccctccttcccccctcccttcaagcccgcgcctgtgtatcatgaagccgaacccgtgggtnnnnnnnnnntctgtctcgccccagggttgtcacccctctccacctcccccccctcccccctcccttcaagcccgcacctgtgtatcatgaagccgaacccgtgggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttcgagccgacgatgggggtcacatcgccgctggacccctcggccgtgacagcggacaggtactcttggccatcctgacaggcctgctccaaggacgacagcttcgccttgtactccgaagacatcttcgctcaaggatactgcaccacagacatcaagctggcgtcggtcacacgttccctgtcaaggccgagcctcgcttcgaaagtatcacggtgtgtggtgtgatcaatcacgcgaaaatggggttccctgaactgcgacgccatccctcagcatctgcattgaagaattctactgctcccccctagaccaggattcaggcaggtttacaaggggcacacacgagattgacagaggatgaaatgtcaacacttcaatgcaggagcaggtggaagaaaggtggggtcgtgcattgagtgtggcattgggacacacgtcacggaagcatcgctcgnnnnnnnnnntcaggggcaggtggaagaaaggtggggtcatgcattgagtgtgaccttgggacacacgtcacggaagcatcgctcgaggatcacgctctgggcgctcattcgcaatcgtatcaggcctcgcgtatcaccgtgccgtcgtccaagaccacgccctggttggggtcatgccctgcagagcgagggggagtccagggctgtgaatgctgagggagtagaaccaggcggtgcatgccaacgcagcaggccaaagcttcaccaaaaatgtggctgtcagattatcagggtggcagcacaggcnnnnnnnnnngcgcagcaggccaatgcttcaacaaaaatgtgtctgtcagattatcagggtggcagcacaggctccaagcagatgtgacctgggacaggctgaagtcccccccccctttcccccctttcaaaatcccaccgatcaacctccagcacttcaaactcacccagcgtggcccggtccaggctactcctggtgagggagggcgcggccgacaccctttccacgctgtgcacaatctccgccagctcgccatatagtggctgcatctcggcggggacatccaccttgccctccaggatggaggtcgcactcgcgtcggggccgtaggcggcggcgttggcctcgccatccaccatgagctggccggaggcgaaggagaggtcgaaggaggcgccggtcacggtgtgcgcgcccacggtggcgtaggaggtggcgggggcggagatgaagtcggcctggtccatgatccggctgccgcacaccaccagcgcgtccaggcccgagaacttgcgccggcggtgctcctccagcgtgtcacgcaccctggagttcatgcacaccgtgaaggaggcggagtgcacccgaccaaagcccaggccgaacccggtggtgctcagcttgacgaagcagggggcactccagcggaagagggaggggtggtccgtgggcagcctgggggacagggtgggcatgggaagatggacggagactgtgaggtgatgcgccgaggtgaagccnnnnnnnnnnaggacagggtggggatgcgaagatggacgatgactgtgaggtgatgcgccgaggtgaagcccggtctgagtcgcatcgagcaatccgcgtcggaggaaggggagcaagggactgcccagcccgagtgccgcgctcggggcggtctcggccgaccgaccgtgcctcaccggtgaatcaggaagccctctccttgggtgcgggagatgaggcagcctgttttccgggctcggtagaacaggatggaatcggactgctcgatccagaaaggtctcaggggcgagcggaagacattcagggggcgggcgtcgttggaccggtcgcgggctgtcacttcacgtagaatgtcctgaccgttggcgcaggccgtctggagctgtgttctgttgtcggtcgacatctggaaataatttatatggaaactcactggtaaaccctgcgtgtgaggttgtggttgtgtcccgtcgtcggttttacgcgctgtatgnnnnnnnnnnttaatttatatggaaatttactagtaaaccctgcgtgtgaggttgtggttgtcccgtcgtcggttttacgcgctgtatgcgcggtgtggcgtgctttctagaaacgctccgcgaatggtatcgcacgaccatcacccaattgagcgaaacatcgcgatcaagtgagccatgactcagcaggcctccatgaaggagcctccaggtctataaaatgagcacacacgggcaacagactgcctgtgctacccgtgtgaatatggcccaggacgaggagcttccccactcggcggaaattcatgaggatgtcagtcaatttaagctatgcataatgatgaacttgatagagctatctagattcttggggagaaagcatctcaatggacgttccctgaagtccacccccggccaaacagggatgcgctgagacannnnnnnnnngctccatgaaggagtctccaggtctataaaatgagcacatacgggcaccagactgcctgtgctatccgtgtgaatatggcccaggaagaggagcttccccactcggcgggaattcatgaggatgtcagtcaacttaagccatgcataatgatgaatttgatagagctatctagattcttgggggaaaatcaacgcaatggacattccctgaagtctttcccccggccaaacagggatgcgctgagacagctgtgaagcgcctgggtccacttgagatcgctctcacgaggaccttcgaaaggaattagcatgaattttatcattagatctgccgtactgcaatgatgtctctgttctgatgggtgcagctggagttttagttcctccccctaggaagacccgaccacgtgagagaagctcccctccatgggcagggccgaggctgcaaccccaggtaccgacccggatcgctcgttattggaatatgggccctgtctccccagaaagaaccaaatcatctatagccaagccaggtgcaaaggtatcccttaataccttcgtcgcctcggctggggcggtcctcctgcggcacgctcccggtgattcctcattggtgccccgcaagggcttggccgttcctctgtccattgctgctatcattagatgaccatggcccttacctcgggcccatactggcgcctagctgtggccctgtcattggcattcgccgcgtgtacggttcccggcgcgcgcgctcagggtgcgtctccaagggctgcatgcccctggcctcccctctgctacattttgctggccggcagtgctagtcttgcgtgcgcagactcgcgtaggggctctctacagggcgtttcatcccccccccnnnnnnnnnnagcagtgctagtcttgcatgcgcagactcgcgtaggggctctctatagggcgtttcatcccaccccccctccttccgccaactgcaggcaactccagcgctgtgtcccttgtggccaccggacctgtaaggatctgttggagggtcttaaaggggaggaaactcagtccaaagtgcctaatgttgaatcaatggcccgagattgcatgcatgcggagtccaagctgccgttcctcggcatgcggggaatcacgctcccgggctttagtgctcactacctccccgctctgcccacatggcaggtgctgatcaatgagatcctggcaagcaacactgccggcctgaaggactcctctggcacggcctctgattggctggagctgcgtaacaccgggtcttccaccgaggatctcggggtgggtgggggggggtgtccacaggctttgttgcatttttgaactcctggctgccaccaatgnnnnnnnnnntgggtggggtgtccacaggctttgtggcatttttgaactcctggctgccaccaatggggattcccttgggaagtgatgtgtccctggttctgcaaggctgcaatgttgtttgccctttgcaatcaggccttcctctgacatctgcaggggtatgtcttgagcgacggcgagaacagctggaccatcccgagcggggtttccattccggcggggggctaccagctcatatttgcgagtggaaagggctcaaagtctggtgagactggaatgtggaggcatagacattgcaagctgaggtgttgttccccgcatcgggtcaaagtgcacagttgtgcagcagggcaggcatggtccacctctgggtagatgggccgctggcctccctgcttccagtcctgggcnnnnnnnnnncacagggtccacctctgagtagatgggaccgctggcctccctgcttccagtcctgggctctcatgacctgggcacgccctccaccgtcgcacaggtgacgcagaggtgcatgccagcttcaagatcggggcccaggacgctgcgctttccttgtcggacgccagcggcaatgtggtgtcggcggtgccctaccccacgtgcgcgaggagggggtggtgcaggggcactcctgtctcgccagggtgtcggcgtcgtcccctcgtgcgctgcctgtgcctggcccgcatgcagtcggctacctggccaccagggcgccaccctcccatccttcttcccatccctctcacagcacgcccaccgacgtcagcttcggggtggtcgggtctggtcagacggtgcaggcctcctccggggctgcagcgccccagtatgccatcctggccagccccacccccggggcgaccaactcagcagcacgcgccggatcgcccagtgccgcggggtgaggggatgcagctggctttggggagtgagggacccaaactcgcgcgattctggcctcaaacgtgctccttctccggaagaacaggacgctggggatcccagggagggtcaggtctccgttggatctgttgaaggattgcagccagtaagccgagatcaagcattctgctcccccaccctgtcccccacaacaccacaggacgactcgggatccaagcccccgccccgacggctccagcgccatcgccatccagaccagcgccttccccagccagtcgcccatcgcgggggtggacctggtgtacaccatcaactatggcaaggaggtggtggtgcccatgagggcccagtccccagggtcaagtgtttacgccggcagcatccccgcatcggccgccgcggccggcacgctggtcaggtggcacgtcgtggtcagggatgaggccgggaacgaggggcgggatccggccccgcccgaaaccactgacccacagaactttgggaccatcgtggcggacacgtcggactccacctccctccccatctttgagctgtgannnnnnnnnncgacccacagaactttgggaccatcgcggcagacacgtcggattccacctccctccccatctttgagctgtgaggccgggggcaaaagatgggaattgggagggagcctgatgggtgcctttgtcgcttgtttggaagccaaaggtgttggggggtgacagggggggtgtcgcgtgagttttgtcctgctgaggcaggactgcgattcccacctggtgcccagttagcctttccgaggagcctcccgtctctgagtgcctctgccaaaatcctgctcctcgcgtcgtccccacccctggccccataaaccttcgcagcttctgtgcggatgccaacgcgccctggagcaccgggcccgagagcgggggccaggccctcacgggcggcaagggctacgtcgatggctgctccctctggttcaacgggacctactacgacaatgtctcgctcaggtgcgaatggacgcctgggctgacgccagtgtgctgcaggcctggcagggttgtttttcccaatggagacgggccccacctcgtggaggcagcggcaacatgttcctcagcggctgtgagcgacagatttggcctccagccaaagaattcttgccctgccacttgaccagtgtgggtttccccatggtgtgtcagctcaactgcacaactcttcttcnnnnnnnnnntagccaaagagttcttgccctgccaattgaccagtgtggggattcccattttgtgtcagctcaactgcacaactcttcttcacaacatggaacctgtgtacttgcaggcgcaagggatccacgtccctggcttggcccaaacccaagatgagggtgtcggcgggaaaccaaggaaaggtgaggtgcagggagcttgcctgaggatggccggggccgtaccgcacagggatgataggctcactctgacggannnnnnnnnnaagcttgcctgaggatgaccgggaccgtactgcacagggatgataggctcactctgacggannnnnnnnnnttttggcaggagctgcaatgtcgggggtccttgccctgagtgcttgcacacggtgtccatgcatcccggcatatccctgtcannnnnnnnnnccattgacattggccggtggcttccaggtccagatgtggcaccccctgcatgtctgcttgtaggtgtgcgagcgcaatcacaaactcctcacacctggtctcataccccttggcaccaggtctttgccacctcagcgggctacaaggtgaagagcttctccctcagcgcaagtgagtgccagcgttgggcaggagctgcaatgtggggggtccttgccctgagtgcttgcacactgtgtccatgcatcccggcatatccctgtcacagcaggggcatcgcatcgtacatcagccctgagccttgcacatccctctctcagactgggcggagccaggggagaacacctttacgcgggagccgttggtctggaagacgttccagtgagtgggaaggcgtcactggtggtgggccaatggtatcgctctgttgcactcacacgttccaagagccaacatcccccccataccagaccaccgtgccgccaccaatcctcagtcccagacaatgccccatcgtcccctgcagggagatgggagtggactacctggnnnnnnnnnnatgggcaaatggtattgctccggtgcacttacacgtttcaagagccaacatctcccccgtgccggaccactatgccgtcaccaatcctgagtcccatatactgccccatcgtctcctgcagggagatgggagtggactacctggagtcgtaccagtcccatgtccgcttcaacggcgcctactttggccgcttcatctacgtggaggactggactcccgagtcgctgaagcgcaacggctacgacaccagtgacattggctccctattcaaatcagaaagtggggagtacagcaacctgcgctgggacctgcccaagggtgggttttgggggggggggggggggggggggnnnnnnnnnnctggggttgggggtgaccggagtggaccaccagggatgctgcacgctggggacagtgtcatactccagtatcccttcaagacctgctgcaccctgcttgcgcctcgccnnnnnnnnnntcaggtattttgggtcttgggacttgtgtgtgtggggggggggctcctgtgccctccccactggggttggggatgaccatagtggaccaccagggatgctgcacgttggggacagtgtcatactccaatattccttcagagacctgctgcaccctgcttgcgcctcgaccgcattgctgtcctgaacttcccctcggccccctctccccaaatgcacctgcagaccaggtgcccttctactggggccaggatgagcccaaggcggacgaatcggctctcctcctcgagctgacgcggggcctggccggggcgggttccaaggagagggagaactacctctttgatggcctgaacctcccaaaggtgaggcaggcgcagtgtggtagggggcaagggggacggagcttctctccaggcaggcgtgcatgccatcgagcactacctgctggggtcctcggtggtggtctggtgccaggttgctcaagccaccaggccccactgggtgtccagctgtgcatagagcctgctcgctgaccccccacccaatgcatgcgtgtgttgcagcacctaaacccccttcccacctccctccccctgctgccccaggtcatcaactatatggccgcccagaccctgatcctgaaccaggatcgctgcaccaaaaactactttgtgtaccgcgaccgacccagcggccagtggtccatgctgccctgggnnnnnnnnnngccaggccccactgggtgtccagctgtgcatggagcctgctcactgacccctcacccaatgcgtgcgtgtgttgcagcacctaaacccccttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtggagtcggggttcggcattgaccgcggcctgggcggcgtccccgctcccgactactgcatcctggcctgcgaccagtggaactcgccgctctactgcgaccgcaaccacgtgcaggacctcaccgtgtccacaccctggacgctcatcctctccaactacagcctgggcaccagctccggggtgagcactgccggcaggcgcctgctccgctccgacgtggttgacaggcagctgctgcaggcggcggctgcctctggcggcgcgctggccgagatcgctcccaatggcgctgcggaggtggggctcaagctgccgctcaactccactgtgccggccaacgcccaggacgaccagaccnnnnnnnnnnnnnnnnnnnnnnnnnnnnnnnnnnnnnnnnnnnnnnnnnnnnnnnnnacagatgacaggtggttgagacgcctctcacgcggcaggctgctgtgtcgannnnnnnnnngcagatgacagatggctgggtcgcctctcacgcggcaggctgctgtgtcgannnnnnnnnncctggccgaaatcgctcccaatggcgctgcggaggtgggactcaagctgccgctcaactccaccgtgccggccaacgcccaggacgaccagaccctcctgggtgagcctggggggttggggggctctggaacagggtggctgggtgaagggcggagnnnnnnnnnnnnnnnnnnnnnnnnnnnnnnnnnnnnnnnnnnnnngccatggatggcttgctgtggaatcttcacatcgatctggaacacttccaacccccatcccaaacctgaacaggcaccccgcccacgggcgcaaacgggacgtacaactacatgctggacgccgtgctttccttcccacgtacgcggagcatgtacatgcgccgcctgcgctcgctcatggacgagttcaccaacggcaggctggaggggctggtgaccagcttctacgagcaggttaaggaggaggccaccagggacaacgccaagtggggcaacccagggaccccgctgcgcggataccagtgagtcgcgggggagcaggacctctggtgttttgcgtgtggtggggtgacttcggtgctgtgatgctgggcctgcgtcagcattgcagcgccattcaatctcagcatgcacgtcccttggccccaatgccgagcctctcccaatcatctcgactcccgccaggtcgctcacgacggagcagctccccattcgcaagcaacagctttacaacactttcggtgtggacggccccattcccctcatcccaggtgcgtcgcatgtgcagcacgggatagaaagcgtggggggtgaggaggagattctcaggccactaaatgccgtatgcattgctatcactctgatcagctgtcttcccagtcacccctcattgcacctnnnnnnnnnnaatagaaagcgtggggggtgatgaggagagtctcaggccactaaaagccgtatgcattgctatcactccgatcaactgtcttcccagtcacccctcattgcacctgtgtgttctcaccacctctgcaccagcacaaggttttcaagctccaacctccatcttggatcctttccaatcggcagatgctcagccctccagctaccgcctgaacctgggctctgtgagtggcgacgccggcgggtacgtggagctggtcaaccctaacgactttgccatggacctttccgacgccaagctcagcggggcggcggagttcacttttgctaaaggtgaggaaatggtatcgcttgggagcttgaagccagggaccaggagcaagcatcgttacccatctctgtggccacccaggttcccaccaccccgtctatcccctcacggtcgttctccaccctgcaaacccacaggcaccactgtcgcggcaggggactcggtgcatgtggcannnnnnnnnncacctatctctgtggccgcccaggttcccaccaccccggctatcccctcacggtcgttctccacccttcaaacccacaggcaccaccgtcgcggcaggggactcggtgcatgtggcagccgacgtcggagcttttgtcaaggccaagggcggcgcgggcctgtatgtggtgggccccttctcggggtccatccagggaccggccgcaagcgtgagcgtgcagagcgcgggaggggactccctggtaggctgaggttcagagctggatatctctgacagccgcaaaccatgcccctcactgtttttgcaacggccatacaccattcagacatccctggacctccgtcccggttcctgtaccnnnnnnnnnngcagagctggttatctctgacagccgcaacccatgcccctcactgtttttgcaacagccatacaccattcagacatcctactccctggacctccgtcccggttcctgtacctctgatgccgcactaggctagatctgcgtcgcactgatgtaaagcccgaaacgccttttctggtcaggaacagcatagaaaggtacactttaagagcatcaaagagtccgaggtgagcgagctcaccatattaccaggctgtcattnnnnnnnnnncacgccttttctggtcagaaacagcctcgaaaggtacactttaagagcataaaagagtccgaggtgggcgagctcaccatattaccaggctgtcattctgtattctgtgcgtcctttgctcagagttcgatccgggaagcgcatattggacggtcctgtgtagactgagtgcaggacgcgacaacccgggcgatcggagctgcttgggaaagtgacagcaccgttacatgcgagaaatgcaatgacaacggctcgaatcccgggcagagttggatataaaggctgcaagaaacttgtctcgtcttgccagagttagctcacaccacgaccgccctccggacagccccgaccccgccgtggtcacgagcccatcgacacgctgggggcctcgttgcaggcgggaggctcctttaaacatcattatgggatgcagggagctaccatggctcgcggtcctttgcacactggcaatgctccggcctagcacatgccagtccccaggcgcgtcaactgcatgggcccgggcggggaggggcggacgggaacgcgacaaccccacgggtcgctgggcattacgtccaattttccttggtagatacacaatgtcttaattaaccatttaaacccgcaggaatccagctggtcgtgggtgatnnnnnnnnnnnnnnnnnnnnnnnnnnnnnnnnnnnnnnnnnnnnnnnnnnnnnnnnnnnnnnnnnnnnnnnnnncgagacgagactgcccgattctgagtgtaaatatatatgagcaaatacctcctttgtaccccagnnnnnnnnnntgagacgagactgcccgattctgggtgaagattcatatgagcaaatacctcctttgtaccccagnnnnnnnnnntgctgggcattacgtccactcttccttggtagatacacaatgtcttaatttaccatttaatcccgcaggaatccagctggtcgtgggtgatgctccctccccggcacccagcaccgcgtcgagccaggtgtgtactcatcgtaccgcagcacagtcgttggtgccattnnnnnnnnnnnnnnnnnnnnnnnnnnnnnnnnnnnnnnnnnnnnnnnnnnnnnnnngtgcggatcaatgaggtcgtgctgaccaacaagaatagcttcacagacgccaatggggactcaccctcgtgggtcgagctgtacaacacggcaggcagtccagtgaacctccaggcaagaatacggggaagggatgtaaaggtgaatgagtgctgatcgcctcagggccatgnnnnnnnnnngaaggggaagggatgtgaagttgaatgagtgctgatcgcctcagggccatgagtatatacgctgtaacatgtgcagatccagcacatcacgccctgtgccccacgtgacacgcacaggggtaccagctgacggtcagcaaggcgagcggcaaggcgtcggcatggacctttcctgccggagtctccgtgcccgggaatgggtacctgctcatcctcgccgatggtctggacacaggtgagggtgcaaaggctggatgtggcatgaggttctcactccttggagagggattccatgcgccggcaaacgatacttgtcttccgctcacgcatctggccctcaaacaccagagatgatgattccacaaagatgcaaggagtacagtcctcccagcaagccatgcaccggacatccccagactcgtccttcatcccatctgcgccgccaccaactcctctgcagnnnnnnnnnntagtcctcccagcaagccatgcactggacatctccagactcgcccttcattccatctgcgccgccaccaactcctctgcagtgtctgggagcgaggtgcacgccggcatcaagctgtccggctccagccagggcctgagcctcctggatgcgtccggggcgagcatcgggagctgggacctgcccgaactggccgatgaccaggcttacggtgtggccgagggcgacgtccaggctctggatgggccctcgggcacatcccgcctggtgtacctctcccagccgacccccacctcggcaaactcgggggctgccgacacggggccagtggtcgcacggtgggtggctgggtgggctgggtactcgatggactcacctgccagctcaagcgctgcggatggctgctgggatgactcgtgcccacataggtcagggacgcctccctgctccggcaacagcgcccaaaaccatgtcatccacagcgctgtacagacgnnnnnnnnnncgatggctgccgtgatgactcgtgcccacctgggtcagggacgcctccccgctccggcaccagcgcccagaaccatgtcatccacagcgctgtacagacgaatgcaacctacactgatacacccctcccctcccctttccatcgcgccgtgtgcagggtgaccgaggatccagccccccgcccaaacggcggctccgcaatccccatctcggccgtggtcactccccagcaggcgacagtggccggggccacactcacctacgtgatcggctacggctcccccgtcagcgtggacatggcagcgacgggcggcacctacaccgccgacatcccggcggctgaggcagctgccgggcagttggtgcgctggtacgtgacggccaccgacgcgggcggccgcaacaccgtggtgccggccaaggactccaacggcgcggtgcaatactttgggaccatcgtggcagacccgaccgactctgccagcctgcccatcctggagttgtgagtctggtgcaaggggggggtgcacttgggatccggggtggtcctaattagaatccgtttggatggggtagtctgtgccatgcatgtatgggaacctcatggggcaggtgtttgaatgtgtgagagaggtgctgtgcccaagcatcgaggccagcgtgctgtttgtgatgacaagagccctgccacggtcatgcagcatgaccaacaatgcactgccccccctccacccaggtactcagagaacgacagggcccccttcagcacgggtccctcctccaatgccattgcagtgccgggcggcaagggcgatgtgaccggttgctccnnnnnnnnnnggagaatgacagggcccccttcagcacaggtccctcctccaatgccatcgcagtgccaggcggcaagggcgatgtgaccggttgctccgtgtggttcaacggcactttttacgacaacgtctccatcaggtgcggagaagatgtgcaagcggctcattggtcgacggggaagcaattcgaggtgcgacactcctgatgagacatcaccctctcaccatcatttgcctgccgcaaaacccagacggcgtggagccacgagcctcggttggcccaaacccaagatcaagatcaagtccgagaatggaaaggtgccagggaggggaagagggagactgattgtccccctagtgtcgggagctatttgctcggccggcgtattagaagagggagtccagaatcctcgcacaccatggcttgtgacatcctgcccccaccactgagtaggtcttcaagctcgggggactggactacgaggtcagcgcatttggactcaacagcagtgcgtcttggtggtgcagactgcccttgatccttggctgtatagggttctctgagtcggggatggccttgtcaacgatttaattggcaggtcttgcttgtgtctttcacccaggaaaagcccagaagccgtgtcccacttcctacctacctcacagactggtttnnnnnnnnnngcagtcaaaggtcgcgatgacgggcatgttgtcgtatgtgagaacaagattcatccatccttgcacggatgtgccacctgnnnnnnnnnntgtgaacgatttgatgggcaggtcttgcttgtgtctttcacccacgcaaagcccagaagccgtgtgccacttcctacctacctcacagactggtttgagcctggcgccaacaccttcacaagggaacccctggtctgggaggccttcaagtaagttggtgacagtcaaaggtcgcggggacgggcatgttgtcatatgtgagaacaagagtcatccatccttgcacggatgtgccacctgcacgaatctgtcgtgcctaaacttgcagcaaccacacccctccataccccaacatcacacagccaaatgggtgtcgagagcctgctctctttccacgtccacgtgcgcttcaatggcaagtacttcgggcgcttcagtctgcaggaggagtggagcaaggatgcgcttgaggtgaggcagtacaaggggtgagggcaatcattgctggttcctgcctcgatctgatttgcctccatggcataggctgggaagcccccctcccccaatcaacccatccaccaatcatacccctcctaaattccgcagagaaacgggnnnnnnnnnngaaggtataacagacaaggggtgagggcaatgattgctggttcctgcctcgatttgatttgtctccatggcataggctgggatgccgctctcccccaatcatcccatccaccaatcgtacccctcctaaattccgcagagaaacgggtttgacacctctagttcggggtatggccccttctggaagtcaaactccggcatcggcaccaaccttcgctttggcgtcacgacaagtgcgcagcattagttgtggaatgtcgagggtgtgaattgctcgtcagtgcaggcctggtgtgagggggtactgggtgtaggatattcccaaccgtgcacttgggcattctctgccaggtcttgagcacacctgtgtcccaccacggagggccccctcaggtcttcagagcggtgaacgtgtgtgctgcgccatttcacctttcccttcttccccaacactcccacgccctaccaacagcggacctgcccgtggtgtatgagttggagagctccaagtccaagcaggacgcggcggtgcaagcgctggaggccttcaccgccggcctggccggcggtggccccgtggcgcgcagcaagtacctgtttgacgcagtaaacctgccccaggtgatcaactacctggccgcccagaccctgatcctgaatcaagaccgctgcaccaagaacttctacgtctacctggacgcctccagcggccagtggtccatgctgccctgggacgtggagtcggggttcggcatcgaccgcggcctgggcgggcagcccgcccccgactactgcaccctggcctgcgagcagtggaactcgccgctctactgcgaccgcaaccacactcaggacttggtgatcagcaccccctacggccgtatcagccagcccgtgaccctgggcgcaacctctgggacgccggcctcgcgccgcaggcgcctgtccagcctgcagacggcgctgggcacgccgcgcctgggcaggaagctgctgcagagcctgttccaggacaccaccgtggacacgggggcggggcaggacctggactccgactacgacgcaaacctcaccagcggtagggttgtagggagcagggtttttgttcatctgttgcttacttctgcatggaagagagggtggggtatgtcgaggggagtttgcatggtttgacaaaggagtgtgtgggaaggtgtagggcagggtggtgggagtgtcacacgagtgcaatgcaacaacttgcacggaccaggagagacccagcaatgaggctcctggatgcaatcctgcggcccgactcggctccctcagctgtgcactagagacccatgcatgggccccactcctgcactcaagctctccccaacacgttnnnnnnnnnncctgggcactagagacccatgcgtgggcccccctcctgcactcaagctctccccaacacattcttgctctccccctttcccttcttcatcaggccgacccgccagcggggccataggcagctacaactacctggctgatgccgtactttccttgccgaggacgagggccatgtacatgcgccgcctgcgcacgctgatggacgagttcaccggtggcaggctggaggggatcgtgacgacgctgcacacgcagatcagggaggaggcaatccgagacaacgccaagtggggcaactccggcaacccagacaccggataccagtgagcggnnnnnnnnnngtatgccaactcgctctaggggttgcacagtcacccaacctgctccccaccaccctcccgccaggcaactcatcaaggagcagctgccactgcggnnnnnnnnnngcagtgttgggtcttggttgtggggctcttgggggggtttgacattctgaaaatcccatgctgggctcagggtgcagtagaggagnnnnnnnnnnccagtgatgggtcttggttttggggctcttgggggtttgacattctgaaaattccatgctgggctcagggtgcagtagaggagggtgggctgcttgatggagtccaaagaagaaatggctgcccgtgtatatgccaactcactctaggggttgcacaatcacccaacctgctccccgccaccctcccgccagacaactcatcaaggagcagctgccactgcggaagcagcaactgtacgatgtctacggccctggcggcgatcatcccttcatcccaggtacgaacctgttgccatgtgcttgctgatcagtgcttggggttgggaggcggtgctcaggggtggagctagacgatgtgggatgcaaggtccaggcagtctgcagctgttgagcggaagatcagcaggaatgcatgcggcgtgtgggaccatgggctgccgcaagtgtcccgtgcctttgtgctgtcgctggcaatgcacgcctcagagcacgcacgcctgctgcaacctcagccctccctaccctctgtgcaggtgcacaggcggccggcgctgggctgaccatcggtcagggccacacggatgccgggagctggttggagctgacgaatcctggggcggaggctgtagatgtgtctggctgggctctgaccggggatgtggacttcaccttccgaccaggtgagcagctcgtgaaaaccaggagtgcgcatggtttgtcgggcgtgatggggaaaaccgcaccttgacaccaactcacatcaaccttgcgacacatactcgccctccaccctgcccacctctagggaccgtggtggatgctggggacaccatcgtggttgcagccgacatcctgcagttcaagtcatcctacggtgggcaaggcaagtatgtcgtcggcccacttccccagcctctgacaagcagcagcccatcagtcagcctcgtcaaggcctagggagttgatgttccaggctgtggaacgtacctgttaatgttctnnnnnnnnnncctgacaagcagcagcccatcagtcagccttgtgaaggcctagggagttgatgttgcaggctgtggaacgtacctgttaatgttctgtgcatgcttggtagctctgaaacccattaagattgttcatatacacaccttcagcaacatcgaccaaagagggcaatggccaatataggactgacaaactggacatcaagagcatgaggcttattatatgagggggatacacagactttgcagtgctggattccaatgggtggattcattctagcaggaataaggcttgagctgggtggtgctgaggtacatgatgaacagtaagcaggacctaaagaatgttggcgtcgccctcacctcccaacatctgcactgcatgctgcctgtagcagctggcatcttggnnnnnnnnnngtgagctgggtggtgctgaggtacatgatgagcagtaagcaggacctacagaatgttggtgtcgtcctcacctcccaacatctgcacagcatgctgcctgtagcagctggcatcttggcaggtgcatgtgaggtcctcatcctctgccatgatctgcgcagctcccagccaacccctgctcatgaccacgacctcgggagattgagagccaaccgccgaccgcttctgtatcctggaaagcagcctgcgagaaggcaagggctggcttttgagcaggtgtctccgtaggagcccttcagctctctcggtccacgtttccagtacctatcaacccctcggccctccttcgtacctttgggctgtatagggtcctcgcacttgcgacagggcgcaatgtacgaccacggtcttcacaccaggcccaagctcggtgtcaatgaacttgtcgacatcggcgtccttgtcaaagctggcggcggggcgattgatgcagccccggatgtgccctccctcgaagtcgtagtctctgacgtccaggaccacaacccccgctccagcctcactgcatgcagggatggggtgtatttgggaactcgatgtggcaccatcatgatcattcaacaactctggcttagtatgccgggttcaccacgcacctctgaagcaggttcttgacctccctggcgggcatggccctcaggcgaggactggccatggccaccacggtgcgcttgggagcttggcaacgcagtcccctgactccaaggctgagcattgacatgggtgaggattataaagtgaagtcgaggtcacagtcagtgcccatatccctcggaactcccccattcaatcattccttcacaatcaggtcctcccagaatcaatgccacactcacgatgcgctatgttacagggcctcggtacactggagcaatatgatgcacacctccaaaacagcctaacaggagaagtacatgcccagacgctgggatgcgcagtgcacgggagatgcatgcatggagggccgcctgtacaggggtccgggtcccagcctcagtgctcaggaaatgcacgcacgaggggggggggggagtgctgtgcactagtcctcctccccctcctcatcgacacctgcattccagtcggcgtcgctctcctccccatcctccccctcccctggtgtccacgagtcatcctgtgcaggggaggggtggcgtccatgatcttacgatgaccaggcctgcctgcaagtcctcatgacgggggcttgtgcgctgctcccccagcnnnnnnnnnnctcctccccctcccccggtgtccacgagtcatcctgtggaggggtggcgtccatgatcttgcgatgaccaggcctgcctgcaacttcccctgacgggggcttgtgcgctgctcccccagcaccctcccctccacgggtgcacagcaagggcccctccgacagctttgagccattcagcatactttccagccgattcccctccccaccaaacacctcacctcgctcgcctcgcccgggcccgaccaccgaccagactgccacatcagccccagcagcgcggcctgccagtcctgcgtccccagcatgctcagcatgctccccctcgactcccaccagtcgctcggcaccacggccgcgcctgcctcgtcacgaatgaaaggcgggggatgtgacgcgcgggctttcagcgagcaggggtttgggtttcagcacacaggggcgacgccttgccactccatgtgctgctcgcacgccacactgtccatgtgcatccgaccaacagcagacgtcctttgctccctctaccaccctcccacctgtctccaggtcgtggttgctgggcagtcctcctttctgcagctcaaactccaaggtctggctgctgccgttcccctggaggtccagcgaccatacgagccagagggggggccgctggaactcgctcctgaacgtgaccagggcccttacctcagaccccgtgctggtccgatggctgtggaaagcgagaccggaatgcgacagcttggcaagcatacagggtgcacatggggatgcacatcgaacagagcccacattggtcctagctctggcatcatgcctgcctggccacaagnnnnnnnnnngaactgccaggtcagcgtgatacccaggcacccaccgagtcatgaagggcggctgctccaggcggagcgagctggggcggnnnnnnnnnngtggggatgcacatcgaacagagcccacgacggtcctggctctggcatcatgcctgcctggccacaagctgccaggcacgcgccgcctgcactccacatgattctcggacttaggcaccagagccaggggaccccccacactgcctctagcacagccccagtgaggcagctctgcactgtcaagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtggccctgggtggcacagcggcccaaggaaatcaccatctggcatggctgtggcgctgccgtggcaagaccaggccctccctgcnnnnnnnnnncgtggcccagggtggcacagcggcctaaggaattcaccatctggcatggctgtgtggctgccgtggcaagaccaggccctccctgcnnnnnnnnnnaaactgccaggtcagcgtgatccccggacacccaccgagtcatgaagggaggctgctccaggcggagcgagctggggcggtaggcctggtgcagtcgcacctccacgtggtctatgaagcgcgtctcctccccgccatccaggcccacaaagaattcccactcgtgcttgttcttgcgtgcctgggcatgaaggtgtggggggccttggcaaggtannnnnnnnnnnnnnnnnnnnncccttctgtcctgcaccctacccttggtatgagggtgtgacggttcccaaagcgaaggacgaggtactgcaccccccgctcggccaggtctgcttcctcccgggagatggccagctcccgtgcggcgtaagcgattgggtagtccttgcgtagacgctcctcatcggcaagggcatgcgtgccagactggagggagatgggctgcctgtgagaaagggatggatggtgagatctgagaaacgccccagcgccaccgatagtcgagtctgccctgccagtgttaggccagcatggaggcagccaagcaggctcatgaaggaggtccttcagccccccacagccgacaagtctcgacctgcacattgggcagtcgcgtgaacggctctccctggctctgcccgcgtccccgggtcggggcacggcaaatagtctgtggaagcagaagctgcaatatcgatgtccacatgcggtgatcagggggtggcacaggatctcctggcacaggggacacaggcatgtgtctggtacatcctcctcgacgagcacagcttcctggggagcctctggggccgcagggtccgcctcgaccttgctgaccaccaccgacaggatccctgcttctccggcctcaggactctggctcgtgtccacccgctgcctcttccgcttgaccatgtgttgatggatcgtttgtgaaaatattaatgacaatgttggccctattgtcagagctaaggagtgttgcatctctgagggcactccggcatccgcgtcatcacttcaaggtcggatccatcccgcatggcaacacggctttcagcataaagaccactggagctggtctcgggtgcccttagcaatcggaataatataactatcgcatgggatgtatcaatgcctcccatgagtgaatccgagaagcgtgcggcgagtgttagggggtgggcactctgtccagcacccgctcagaacgcatatccccgagcacagaaggagtagactggcgcgattgattgcatgctggcgccgagccaggcctgccgacttacaagattcaacgtgaggctctggggcccactgcatggcgccaggcacccaccaccgcgcctccactgtgagcatggggacgcccgcccgacggtgtggcnnnnnnnnnncaggaggtgggcactctgtccagcaaccgctcaggacgcatatccccgagcacagaaggagtagactggcgcgattgcttgcatgctggcgccgagccaggcctaccgacttacaagactcaaggtgaggctctgggccccactgcatggcgccaggcaccacccaccgcgcctccactgtcagcatggggacgcccgcccgacggtgtggcctggcctggagccttggcgccagtctggcgtgaatgagctgcgcggctgggggcgaaagggtccgcagagcgtgccaattacccctggcacacccgccctggagtgtcgctggcgatgcctggccgacgccgcagtggcggtgctccagacccccgaccctgcgcagaaggcggcgctgacgcacgctgcttggcgcgccgtcagcgacggcacgctgcctgtgggtggcgagcccgccgccgcgcccccgcccgttccagcccggcctccacgtccccaggtcggcatgggaagggggtcgagtgctgccccatcgacagtgggcggcgtaacgcccccaccggcatccacctggtacctgcaccaaggccctcagctggatccagtggcttgcctgacatcctcccctccgtgcaggcctacccatcacatgcatgaacaggtaccccttctcctccccaaacacctccccacacacctcctgccttccagctggtggcgccgaagcaggtccccaccgccaaggcctcgcgccttcccctgcccgcnnnnnnnnnntgcctgacatccccccctccgtgccggcctacccatcacattcatgaacaggttccccttcccctccccaaacacctccccacacacctcgtgccttccagctggtgtcgccgaagcaggtccccagcgccaaggcctcgcgccttcccctgcccgcctacatgctgcacagcctggcccacgtggagctgaacgcggtggacctggcctgggacacggtggcgcgcttcgccgccgcgcccctaccccgcgctttcttccttgactttgcgcgcgtggcggacgacgagtcgcgccacctgctctggtgcctgcagcgcctgggggagctgggccacgcctatggcgacatgcccgcgcacagcgtgctgtgggagggcgcacaggccagtgcaggtgggtgccttgtgtggcggtggggtggtcgtggggagcaggtgacggacgaggagggggggtcacacagggaccagagcatgcagacaggtgggtggatgccggtcgaggaagggggaccgtggcggggaggagaccaagcgctctgtgcccgtgaccctggcgagggcatggacgacccgcttcaggcgggcccctccgctcgccatgctgcaggggacgtggggtccaggctggccgtcgtgcccatgtcccagnnnnnnnnnntccgagcggcatgggcgacccgcttcaggcgggcccaggccgctcgccatgctgcaggggacgtgggatccaggctggccgtcgtgcccatgtcccaggaggcgaggggcctggatgcggggccacgcctggtggaccgtctggtggggctgggggacgcccgcagcgccgccatcgtgcgacgcatcgcgcaggaggagagcgcgcacgtcgccgtgggtgggtcgggagggggtgatcggccgccgtgctcgttgcgtgggggaggtgctctgccccactcgtgcgcggatgtgtatgcgcatctggccacggcttcatggccccgcatggcccgcctgcgagcattgtgcctgcggaggcgcannnnnnnnnnagagaccgcgcacgtcgccgtgggtgggtcagaaggggatggtcggtcgccgtgctcgttgcgtggggaggtgctctgccccacttgtgcgcagatgtgtatgcgcatctggccacggcttcgaggccccccaggcctgcctgcgagcattgtgcctgcggaggcgcagagcggaacaccgatcgacgatgcaccgcttcaggctcccgctcgccacccctccccgccctccgaacctccaggcgtggtgtggttcaggggcgtgtgcgccgcgctgggagcagacccaggccatgccttccgcgccacgatatgcacgctgtgccccgacgtactgcgcggcccctttgaggccggggcccgtgcgcaggtggggctgccacctgagtggtacgacccgggctgctggccggagggggagcgcgagaggctcgctgaggcggtgcgggcgcggaaggagggcgcgctggacgggcgcacggcagcagaggtgcagggcggcgggcgtggggacacggcaaggggaccccagacggcactcttctcgagcaccctgcaagacgcagagaatctgggcgccctgcgtgcccgcctcgagcactttgtcgctggcgagacggcgagggcggcgcctgcgtctgctgcgtgaggaaagcctgacttgcagcggaagcgactcgagggggaaatctctgcaatgcgatatatccacatcgtcgggattcctctatcattgttacttgacgttgtacagactgctgccatcaaaggtccatnnnnnnnnnnccttctcgggcaccctgcaagacacagaggatctgggcgccctgcgtgcccgcctcgagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctggactcctctatcattattacttgacattgtacagactgctgccatcaaaggtccatnnnnnnnnnngggggccccgggtcccacagctcctgccccagccgcatcaaagccctgcagccgccacgttggcggccaggnnnnnnnnnngtcatttccatgcatcccacgacgtggcactgtgcacgagggcagtcagacgggagcaacctagcaacccaccactctgaggggccccaggccccacaactcctgtcccagccgcatcagagccctgcagccgccacgttggcggccaggcgctcgtgcagggggcgccctccctccggcacctcgaagcgacgccccgtgatggtctggtacagcaggatgtaccgcctggacagctccaccaccagctccgccggcgcggcggggagcacggggtcgttgtaagggtcgcaggccccccggaaccagagccgcaggaactccttgtccacgttttccggctcctggcccgccgcgtgccgcgcctcgtagctcccggccagccagtaccggctggagtccggggtgtggatctcgtccaccagccggatggtgcccgcgccgtcctttccaaactcgtacttggtgtccaccaggagcaggccgcgcttggcggcctccgcctgcccaaacctgaagagctccagggcggcggtgctcgcagtgtcccagtcagcctggggttgaaagggtgggtggggtgatgtttggcgggaggggatgggaaggacgctctggggttggtattgcatgtcaggtaagggagattggttcatcatgaaggtgcaggcatccagcaacacagccgatccttgagcgagcacaccagggaccaggaagatgaccgatatagagttcctgttcaggtggagtccaggcaaagcagcccaggcacacacccatacccaacacacacacacacacacaaactcactgacctggctcatgagcccctgctccacgatctcgcgcggcgtgatggggacgtcatgggtggcggccttggtggtgggggtgatgacgcactgcgccaggcgcgcgttcttggccaggccgtcggggaaggtgttgccgcagtaggtgcgctcccccgccgcgtagtgcgtccagagggaggtgtcggtgctgccggtcatgaagccgcggcacacgaactcgacagggaacacctcgcacttggtcatcagcgccgcgttggggtcggggagggagagcagggcgttgggcacgatgtggcgcgtggcctgcatccaccaggcgctggtctggttcaggacctggcccttgaaggggacggaggccaggatgcggtcgaaggccgactggcggtcggtggtcacgatcagcagccggtcgcccaggtcgtatgtgtcacgcaccttgccctggatggatggcgtgggatgggcggagggggtgatgagggggtgggagaggtctccagaggaggacagcgcagaccggacggtgagccggggtactgtacctcacacactcaggcaggacccctccagcctgcctgcaccctttcccctacccaacccaccacatagtgtgtgccaggcaggtcnnnnnnnnnnaggtgggaggggtgtccagaggaggacagcgcagaccgaacggtgagcaggggtactgtacctcatacagtaaggcaggacccttccagcctgcctgcaccctctcccctacccgacccaccacatagtgtgtgccaggcaggtcgagagacgtctcggtcaggcagtcgtccagggcggcctcaatgaggggggtgagggaggggtccagccccgtcacggcctccaccgtcgcgccctgggcagcgacccggcgaccggaccagcgccgcgcgggcgcgtgtgcaggcacagagtggggagcaaacaactgcggtgtcatgattctatggcgtgaggtgctgtggctggcctgtacccgatggcatgccgtcaggcaaggcgaagccatggtctgcactgtcggccagatgtgcagcagcttgtgtaaatccctatgacgtgggtcgtatctcctaacagacgaattccttacttgggtcgatgtaatgcactgcagcatgcgcgatttcgagcattgattggaggacccaccctcgagagggcactcgccgacacagcgcgcccagcacggccaaatcaagtacagcgtgcatgggccagtcgatgaaacgcaaggccacccgctccaagaccatatagatcactggtggagcgatgcgacaggttcgagctcgcacagagcgctagatcatgctctgtcgcgctgctgtccgagcagcgcgcagcaggtgctgtgggcgagtggcgagggtgcgcgattgttgacgtgcatgcagaccggtacccgctcgtcgctgtctttctttgctttttactcgtccagaacttccagatgtccatgtattggcattattgcaccgatcgcattcgaccacaggcacgtctcgagcgagcgggtgtccaatgcatccctccgctggctgtccagcggcagcctgccgcccgatcccagcctggagacgggcagcagcgcattggaggcggccagcgacgccctctcggtggccagcacctcctccagcgccgcagccgagccctggggccccctgcacgtctgcatggcggggctggacgcggtgcactccacgctgggcctgccctggtgggccactctttccttgctggcggtgagcgtgcggggcgtcatgttcccggtggccctcaagggcatgcgcgcgggtggcgcgctgagcctgctgcccgaggcccaggccgcggcgaggcgccagtgggaggcgggcgggggcgggcgacgcgtccctggggtggacagcgaaggggcgcctggcggggcgggccggctgacgggaaagccgggcacctcgggctctgggcgacgcggcacaacggaaagcatcaagtcagaccgagagccaggggcnnnnnnnnnnnnnnnnnnnnnnnnnnnnnnnnnnnnnnnnnnnnnnnnnnnnnnnnnnnnnnnnnnnggctgggtgctgggcgccccgctgctccaggtccccttcttcgtggcgggcatggccacggcgcggggcctggccgccacgcactggcccggcctggaggtgggaggtctggcctggttcactgatctcaccctgccagcgctggagctcggcagcgtggcagcgcccatgggctccctgggcctggtgctcnnnnnnnnnnggaggagggcgaggccacgccccagaaagcaccccggaaaggcccacccctcccgctggtcgtacaccacctggaccgcctgcggctggcggcaggcctgccccaccccnnnnnnnnnnagaggacggcgaggccacgccccaggacatcccccggaaaggcccgcccctccccctggtcgtgcaccacctcgaccgtctgcggctggcggcaggcctgccccaccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgatctcacgctgccggcgctggagctcggcagcgtgacggcgcccatgggctccctgggcctggtgctccccgccgcgatcatcctttccatctccagcgtcctggacgctgcgctgcgagtgcccgggggcgaggccgggcagggcgacgaccgcgcggcgctggcgcgctttgcgctgccctacgtccggctggccatcgacatcggcctggtgcccctgttcatcatcgccctgcaagtgccccagggtgagcacaagatttagggggtttgggggggctagtgttccaagagatatgggggaagcaggtatcctctgctgacgtcgtaccgcctggcttgaaaatgacagctgggcgggaggcagcggccagccccttgttcattccaaggatccctcgtcgctccacacactctgggtccccctcgcctcacgagtccaaacactgccccctcaccacctccaccctcaaactccaaaccacgcagccgccctgtgctactggctgaccagcagcggcatcacgctgctacaaggcaagctgctccgctcctcgccggccgccagacgggcgctggggctggagccgggccacggcacgcagagggcgccggccgccgcgacggccgcgatggccgcaacccccaagcccaagacgctggagggcaggccacagccggcggccaggggccagctctccctgggcctgcgccgggtgctggtggaggcccagtccggggacgagggaaagctgttcgagcgcgccgccgagctggtcgccgcgcgccagccgcgcgcggcgcgcgaggtcctgctccgggtgctggagctggcgccgcggcagcccagtgccgcgttcgccctgggccagatcagcgccacgaggaaagcgtgggacgagtcggagcggtggtacgccgccgccgcccagtggcacgaggtgagaggggtctgccgacggtgcccgagggctttggacccctcctttcgtcatgcagagggtgtggatgcagtgggcaggtgccggcaggtcacgatggatctccctcccttgcacacatggtccctgtcannnnnnnnnntgccgcccagtggcacgaggtgagaggggtttgctgacggtgcctgagcgctttggactcctcctttcgttgtgcagatggtgtagatgcagtgggcaggtgccagcagatgcacggcggacctccctcccttgcacacatggtccctgtcatttcagacgcgtggtctccattgctggtcacgatttaccgacttccccccccaacatctcacaggatccacaactcgtcgcccgctcctnnnnnnnnnngggcacgtgggggggtcctcatcatggattgggtgactgtagggcgaggtgccgtttgctgcactcccgcaggccgagggcttgctgctggggcagccctcgatcccttgtcgtgatcaccccaaagcacccgcccaccacgcggaacagacggacgatctgannnnnnnnnngcattgctggtcgcgttttaccgactcccaccccaacatcccacaggatccacaactcgtcgcccgctcctggttcggggcgggcgtggccgcgaagatgcagggagagccggagcgggccctccccatgtttgcgcagaccgtccagactgcacaggtcggcacgtggtgggggtctcatcatggattgggtgactgtatggcgaggtgctgtttgctgcactcccgcaggccaaggggttgctgctgggccagccctcgatcccttgtcgtgatcactccaaagcacccacccaccacgcggaacagacggacgatctgaaggcgcgggccctggtggcccaagcctccgtgcaccaaggcctgggcgaggtgggcgccgccatcgacgtcctgcgcgaggcagcgcagtacgacgacaaggtacgaggagtgggggtggaaagagggaacaccaatctagtgtcatggctgttccgcgctcgtgatggtggtctgatttggaagacggcccgttcctccggctagcagatggaaccgccgtaccgcacgctcaagggtggcggctcaccgaccagctcatctaacatgtagccaaaccgcccacccgcacccnnnnnnnnnnaagtgggggtggaaagagggaataccaacctggtgtcatggctgttctgcgctcgtgaaggtggtctgatttggaagacggcccattcctccggctagcaggtggaaccgccgtactgcacgctgaagggtggcggctcactgaacagctcatcaaacatgtagccaaaccgaccacccgcacccgctcgcatcctgcaggtggaggcgcagttcatccagcccctgctgcagcgcgcgttgaagaagaaatgatgcggcggcattgatcacagcatgctcgtgccgctgcccctctcacttgtacttgtggactgtctgtacaactgcattcagacccccttttgagagttctggggtgatctggcatcacgctgcggcaggatccttgcccataccacagacggtggcatgccattgtcctagtcctaataccacgacaatggcagcactgtgagttgatgaaggaaacaagacctagagtgttgttctcacatactatatggtgccaggcttctgggactcgtcagcggcctgaggtcctgttcccaggtctttctggaggtccccaaaagatacagtggcagtccctcgtcgtgccgggcccctctgagaagggtctggcgcccagcccgtcaggtagatgacctgcggcaggattgtggagggagggttgcatgaccttggccttgttttggaccgtcgcttccttcaggagctcaaatctggctgcatgcaggcctggcagggtggcgatataagcaagcagtagattcctgcatagaggccagcccagctggactggagacctgtgatcagaaactgggcaccacctcatgccctcccggacctacacccatctccatagcaccacaaagacccacccttgcctgaaaggtggctggtatgccctgctcgggctccccctccttcccaaacagggaggagtagatggccgcggtggccagggcggagtcccggggcaggaaggcccggcgctgagtcagcgcattggtctcggccagctggcgaaggtgccgcaccagctgcatcgcgtccctgcgggggctggtgagagagccagctcttcttccagttggctggaacaccgctcttttcatttggcagggcccgcaaaggcttcaagcggagtggttgcagggcaaaagatgcgtcctgcacccctgttccctccggtcccccaactaaccacccagccgcaccggtattggacttggatgtcgtccacatccacggcggggatggtgaggcccgcccgcgtcagcaggttgccggcgtcgcggacctgcgccaggggggataggcgcggcgccacccccccctcccgctcctgctgcgccagggtgcaggcaatgcgcagctcctgcagcgtggtgccgcccagcatggcgcccaggaagagcccgtctggtttcagggcatgcctgcactgagtcaggaccccctggagatgaaggaggtgggggactcgttggcaacaaggagctatcgtgatgtggggatggtgcgcctagtggatgagagtcttgaaaaacggcacaaggacgaaatggttggccggtgtctaggccagggtctgacgaaatgttgggcagannnnnnnnnngtggtgcggccggtggatgagagtcttgaaaaatggtacaagaacgaaatggttggccggtgtcaaggccagggtctgacgaaatgttgggcagagcaactgtagccgacaacccggggtctccgggagctgtggttgttcagaagtccctcgtctgactgcggtgcatgccagcctgatgcgagcacgcagggtggcccgcccgggtcagacattgctgtgcctccatggtgcaggcgatgcgtcacaatcgctcgtgtggttgcccggggcacggagggtacacgttgcactggataagacggaaagatctccgggggagcaaaaccaggcacccatacctcccgtccttgctgaagcacttcaggagcaaccaaactgtggtacacgcacagaccagccccctcaaaagactctggcagctcttgtcaagacagcaaagggccacccagagagctcaaaaccatagattccaccaccgtcatctcacgggaacatcgttgatccagtggagtcccaggcaggcaacgacagctgtggcagaggggaaaagggcgggcgtgactggacggctcgacctgccccacattgcatgcccttcctttctggactggcatcccaacacaggtgtgccctccgcagcctccccacccgctcaccatcgtatgtcccaggagccaccggcagggtctcattccgggtgtcggtccagtgcacatatgtatggggcgtggaccgcgcgctcgcggcatgcagcctggccagtgcgtccagcatggcctgcgacgtgtccacatgggtcacgtggcgggtgccgggcgcctcccgctccaggcgctccgcgacctgacggccggcccctcccagcaccagcaccgactcgaaagcccgagtgcagtccttgagccggtccagcagcctgtctgccacctcatcctgggatggaagaagtggagagggagccgtggtagggcccccgggggggtcctcttgcttgtacatgctttgttgcattaggtaaccaccatgaagaccatgcacaccgtgccctcattcccacgcaccaggagaggatcggggccggggtcatacctcgcagctcgatccctgtgacgagccttgagctccctggatggaacaaagagacatcctcggtccgccttcatcagaggccagggtcatgtggatgtctcggggaaaaacagcctcatgaatgccggcgcccctgcagacccacgcacccatcgaagatgttgagggatgagtctgatgccgtcaccgatgtgtgcagcatatatgccgcttgtcgccaggcctcgctgtgcgcatctttggaacgtgccacagcgcgcagcatcaggaccagcggagggttttgcgatagggcacccggagggagctgcagggagaaccaacttgcgccgatcgctgaatggtttccattgaataaaagtgcaccttgcgtggtgggagtgttgctgctgtataggacttacaatcatatttgtagggttgtcgctgcagtccacgtggcagggggcagaccagaagatggctccctcaaaactcggttcctggcgccctctgtaaccaggcaaacttgatgctgaataagttatagtgtacatggttcatcatgagatatcagaaaatggtacagagctgacagcgggggttgttgttcctgggcgccactcaggcatacacgggcctgttgaagatccaggagaactccacggtcgcgggcggcgcggcctccgccttcttggccttgcgctgcgccagcttctcgaaccgcgctggcagagagcagagcagctcctgggcggcgcggccctccggggtcagccccgtcttgccctccacgtcccagcgccggatgaggtggcgcaggatgccgatgtagtcgccggcggtgtacacccctgcccgctccgccactgccgcaaagtcgtcgaacaagttgcgccccccgttgcgcgcgccgtgctggccgtcgtccatgaggtgggcgggcatggtgatcttgcgcatcatcatgtgcgcaaacgccaccatggccccgctggggtcgcgctggaagatggcgtccatggtccgcgtgtacgccgcctcgtggcgcgactcgtcccgcgcaatggtcccgcagatcttggccagggcctcgtccccggcggcgaccgccaggcgggcggtggagccatggctcagcttggtggcgcgctcctggaagctggtgaacacaaaggcgtggtaggggtggttctccgtgcccgggtccatgcccgaggagatgaggcgctggatggtgcgctccaccgccagcatgtccacccgccccgtcagccacatgtacttgttcagcaggtcgccatggcggttctcctccgcgatccaagccctgggttggggggttggagggggggcttgtttgtgagtgagtggaagcagtgaggaacggaagcaggatgcaacatgtaattgaagcaggcctcgtccactgccgaagcaatcacacatagccctggggtcgaggcgcgtacctggtccacttggcgtaggggtgctggctgtgccctgtctcatcgcgcacgacgtccagggtgttcagcatggccatgtaggtgggcagggcctcctccgtgatcatgtcccccaccaggcagaccagcaggtcgtcggggatggccgccgatcgcgcccgcaggtcgccgatctggtcgaagaatgcctccgagttcgaggcggggaggaagtcggtaggttgccacatctcgtccacgggcgtcaggagggggaggatctgggactcgaagacgggcgccagggaggccacgcagtctagttgctgggcgctggcggagtggagcacctgcggggaacaggacggcgaggagacatgggacatgagcatgagtcatgacgagaagggcgcaacaagcaccgcacatccaacactgcttggcaatctcatgtgactctcacctcctgtcgaatgatggtgggggagaggttgagggccgagcgaggggctgcgacggtagctgcggccacgggggtcaccatgcgggatcccgcgcgccccgccgatcgacgacccgactgcacatgtccgatgagagcggcgtgctgagactggatggtcttcatggtggagactgcgaatgggggtgattgtatgggacttggagacctgcgagatcgacgactcacaatcatgcgtacatgccgaccggagctcatggacagacaggtatgggtgtgctgcctacctgaggcctgatgcatgccgaggctatgacagtgaaatatgtgttgaagcctagcgccgatagggagcgtcgcagaccttggacgaactgatcagcgagtcctgttgcaggaannnnnnnnnngtgacagtgaaatatgtgttgaagtctagcgccgatagggagcgtcgtagaccttgggcgaactgatcagcgagtcctgttgcaggaatttgcggaggcctccggatgcccagtacgtgcttggtgagcgatgttcggcctgcgcgatgattgctctgcgatgccaacaaatgtgaatctatgcctttgaattcctgtttcagtgctccttatacccccttcatcccagcatcgaagcacaggaattctggcagctggactacgtgcagagggcacgtctcggtatctgaggaaagcggggaataaaaggtgtccgcgcgctccctgcgtcattgcgccgacgccttcgatctcgcgggcggggtgggacattgtaaacaacggattcctatcggtcacgcctgccgacgtcggcaggcagcgtcaatcgcacagagggctatcacgcacgagtggaatgaaatcagagggagaaggggtggtagtggtggggtgctgcaggggggcggctggggtcccaagcccaggggcgccgccgccggggggttcaagcagcctgcgggccagtagccagcatggcaagcccctagggcgacctttcctcctctgcccccgggtacaccatatcacccgtctgcagctcccgcgcgcccgccgcgtgcgcctccgcgccggggtccacctggcccgccccgccgtatgccccgccgtgcggcgcctcctcgcccaccttccactccggttcctgcatggccgtgctgaactgcaccccccggctccaggccggccacagcccgggccacatgctggggtgtaggccggcatgggcgggctggcc

SEQ ID NO: 49004 - DNA, 61 bp, Chlorella protothecoides
ctggattgaggcggcctcagttttggcgggttggagcgcgcatttcgattccgcgacaccc

SEQ ID NO: 49005 - DNA, 61 bp, Chlorella protothecoides
aggtgcaagcacggctagggtcattcgttcaccctgccagttcactctggatgaatggcag

SEQ ID NO: 49006 - DNA, 70 bp, Chlorella protothecoides
actgtagaagtcggccatgtggtggcaacgatcgacactgacaaggctggtacgttgtatggttggcttt

SEQ ID NO: 49007 - DNA, 69 bp, Chlorella protothecoides
cgggcgtagcccccgcgtcgtccgcggccgccacccatgcctctgcaccagggggcgtggggacatgtg

SEQ ID NO: 49008 - DNA, 63 bp, Chlorella protothecoides
cccaatcgcaggtgacgctcgctctaggccaggaaaactccccgcctccatctccaccaccta

SEQ ID NO: 49009 - DNA, 61 bp, Chlorella protothecoides
tcaccgcccttcaccttcttctacatcatcaccagcctcgatgatagccccgagggacatg

SEQ ID NO: 49010 - DNA, 61 bp, Chlorella protothecoides
ttaccagccccgacacgatgcaggctgcgcactccccccccggaacccccgtaaaagtcgc

SEQ ID NO: 49011 - DNA, 68 bp, Chlorella protothecoides
ggtggcgccctccccggggccctcggcgaactcgaaggtggccttgtagcctgccagggcggtatgga

SEQ ID NO: 49012 - DNA, 61 bp, Chlorella protothecoides
acgcgttcatccatgcacgggacgcagccacggtacctttgctgccgagctggttggtgga

SEQ ID NO: 49013 - DNA, 87 bp, Chlorella protothecoides
gtagacgtgggggcgtcggtccagaagaggatttctggggggccgtccgagaagtgctctatatgacacctcgatcgataggtggga

SEQ ID NO: 49014 - DNA, 114 bp, Chlorella protothecoides
ctcgccaggccgttgccctgtgcagggcgagagggggagaggaggaaggggggtcagagattcagaagggtttgaaaggtcatcgcagagttcatcaccccccatgctaagcag

SEQ ID NO: 49015 - DNA, 68 bp, Chlorella protothecoides
ggagatacagacagccacaacagggaatggtggcgagcatcccgccatgtgcacctcgtctgctgtga

SEQ ID NO: 49016 - DNA, 79 bp, Chlorella protothecoides
cagtggtgaaacgatgagaagccgagttggttatgggatagaattcgtcagcgccttacgcagccgttaaatgcggaca

SEQ ID NO: 49017 - DNA, 65 bp, Chlorella protothecoides
ggggaccacactgtggcttatagaagatcactgaatgccaccagccagtgggctggtcctcgaac

SEQ ID NO: 49018 - DNA, 102 bp, Chlorella protothecoides
cactcatcctggattctctttggactctccgcgtgtatgttaaataatgctgtcccaggtcccaagtactttccttgctgtacacctgccatcgcctctgcc

SEQ ID NO: 49019 - DNA, 61 bp, Chlorella protothecoides
tgggaggttcgagcggcccagcatgcatgcacccgagcgagccatcgaggctgagggccac

SEQ ID NO: 49020 - DNA, 79 bp, Chlorella protothecoides
gcacgtgccgtacacccgcaggggaaggcggaatacacgtcgccttatgtgaggggccagtcgagcatggagacgaaga

SEQ ID NO: 49021 - DNA, 61 bp, Chlorella protothecoides
ggagtgaaatgggtggggccaggcccgggaaccctgctgccccttccctcctgagtctgta

SEQ ID NO: 49022 - DNA, 79 bp, Chlorella protothecoides
ctccgactccaaacagctcccgtaacaattgaacccaagatgcacctcccgccctgcctgccagtgagcagccatctcc

SEQ ID NO: 49023 - DNA, 61 bp, Chlorella protothecoides
gtactgtatctctcgcggggccatcggctgccaccttgcccacctacaggcccagatgaga

SEQ ID NO: 49024 - DNA, 61 bp, Chlorella protothecoides
gtgtgcttggcggggcagtgtgcccacatcaccctgctgctacctctgagtcttcagtccc

SEQ ID NO: 49025 - DNA, 61 bp, Chlorella protothecoides
catctccagggagggcgagccccatgtgctgtgggtcgacccgctgagcacgctgagcacg

SEQ ID NO: 49026 - DNA, 14027 bp, Chlorella protothecoides
  modified_base (631)..(640): a, c, t, g, unknown or other
  modified_base (1018)..(1027): a, c, t, g, unknown or other
  modified_base (1230)..(1239): a, c, t, g, unknown or other
  modified_base (2597)..(2606): a, c, t, g, unknown or other
  modified_base (2805)..(2814): a, c, t, g, unknown or other
  modified_base (3068)..(3077): a, c, t, g, unknown or other
  modified_base (4732)..(4741): a, c, t, g, unknown or other
  modified_base (4816)..(4825): a, c, t, g, unknown or other
  modified_base (4900)..(4909): a, c, t, g, unknown or other
  modified_base (5116)..(5134): a, c, t, g, unknown or other
  modified_base (6461)..(6470): a, c, t, g, unknown or other
  modified_base (6827)..(6836): a, c, t, g, unknown or other
  modified_base (7627)..(7636): a, c, t, g, unknown or other
  modified_base (8053)..(8062): a, c, t, g, unknown or other
  modified_base (8575)..(8584): a, c, t, g, unknown or other
  modified_base (9026)..(9035): a, c, t, g, unknown or other
  modified_base (9459)..(9468): a, c, t, g, unknown or other
  modified_base (10049)..(10058): a, c, t, g, unknown or other
  modified_base (10305)..(10314): a, c, t, g, unknown or other
  modified_base (10398)..(10407): a, c, t, g, unknown or other
  modified_base (11102)..(11111): a, c, t, g, unknown or other
  modified_base (11554)..(11563): a, c, t, g, unknown or other
  modified_base (12221)..(12230): a, c, t, g, unknown or other
  modified_base (12486)..(12495): a, c, t, g, unknown or other
  modified_base (13483)..(13492): a, c, t, g, unknown or other
gcgcgcagcctcggcggccgcgcgcgcgcgctcctccgcggcgcgccgccggtcgcgcacgttgccccaggccaccaccgcccgcagggacatggtgcgcgccttctccgccgtcagctcctcccccgccagggcctgcacgtggctgcgcagcgccagcgccagatgcgcgggcgaggggtctgggctgcctgccacgggcgtcgcggccgctatctgtggcgactggagtgcctggtcgctgccggctggggtcgtcaaacccggggcgccggcgctcggtttccgaggccgcccgcgccggggttggtgtgggccgggggtcgcctcgccaggtgctgcctccacccccacaggggcggcggcaggggcgggcgacgccgcagccgcccctgcagggctggattgggccactgcgggcaggccaccgcgggcccggcgtgtcctcacgcccggcgatgtcgtgctggggtctgcgaggccaatgccagcggacccaggctctggcccctgtcggctcggcaggggtgatgccgccggccccgcctgcggctgggcgctcgagtccccgaaagctcctgcccgagatcttgcctccgcgaccgcgctgcgtcctcggcgagggtgctgnnnnnnnnnngggccgatgccagcggacccaggctctggcccccgtcggctcggcaggggtgatgccgccgaccccacctgcggctgggcgctcgagtccccaacagctcctgcccgagaccctgcctccgtgaccgcgctgcgtcctcggcgagggtgctggtgagcgtgtgccgcggccaggagcgcatctatgggacgcttggtgctggctggcgctgtggatggggcggggacagcggccccatcgccagtgcggggctcggctggtcttgcttcctgggcgctgccttgctgggggcgcggcgctgtgctgaccgcggcagcagggggggtggccaagctccctgtgttcagggggcatgcgggtggtggggggtggtggggnnnnnnnnnngtttgctgggggcgcggcgccgtgctgaccgcggcagcagggggggtggccgagctccctgtgttcagggggcatgcggggggtggggggtgggtgtcgcatgaaggccgatgctcttcggcacacgtctaaacacggcaccgagcacctcacaagttcaagccgccaagctggtgctcacctcccacgggtgacgaggcagnnnnnnnnnncctgaaggccgatgctcttcggcacacgtccaaacacggcaccgtgcacctcacaagttcaagccgccaagcaggtgctcacctcccacgggtgacgaggcagcggcaccagcgaaggtagcgaggacgggagaggctcccttgcctccggctgccaccctctccgctccctcagtcccaccttccctcgagtccccatctagcttgcgacgctgtaagcgaaaatttcaccgtgtgatgatgagggaagttcacttccaaaggcaccgcatgacacgtccagggcatacccctcgagacccagcccggcacctcgggcccacctcaccgctcgaacaccagcacggggagcgaacttcgtggacttggattcagaactcttcttgtcggtgacaagccgatcgagggtgctgaggtcgaagttcatggccggtctctaggcacacttcacacaggtcactgccggctcgacataatgaggggtcgtgattctctatacagcaataccttcatcagaatgtaatctagtatattttttcttcaagacagggtgttgtcgaagtgcatgcatggtaaagacccccatatacaggatttcggatccccgacttttgggggggggggggcgctatcatatcaaccattccaggacatctgatgtcgtggatgcttaatcagcaggaatgatggcaagacagacccctcaaatctgacaagaaatcaaattgttgttcacaactgtaaaccaagtcccaaacttcaggggttcaggccaggtgattggttagcagcggggtcatccctggcgagatccgtcttgaattttgtggtgtactctgccaggctcctcctcccgctgaagacattgggggaggtgggctggggggcattggccagcaccagcaggccggctgctacagctgcgatcgctagcgctcctcctcccacggcaaaattgaaggtgccggagctgcggccgccgtcctgcctgcttccagaaacatactggcgaggctgcatcatgggtaggagccaggataattggagaaaaccggatctgggcaaactgcaatggctcaggtggagcggcttcaagagacccatgccacaagcctgaaagccctcgagcacactggagtattgggaacgactcacattcctcatgagagacaacttgcccatgattccaatcagcctcccctccttcgtacctccacagggtagatgttggcctgccctgctgagtccttctccgtgtacccgatgccctgcgggatgagacagaggaatgactgccttcaatagtagaaataatactgcatgccataaacgcatgacacccccagccgtcccacgcnnnnnnnnnngttgccttcaatagttgaaaaaatactgcatgccacaaacgcatgacacccccagccgtcccacgcaccgcattcttgttgttcccaaagtcgagctggcggtccttgccctccttggtggatgctgcgaccgacactgaacgcgcggagggaggaacaggctggaaggtacccttggaaacaccccacgctgcgttgnnnnnnnnnncccaccgacactgaacgcgcggagggaggagcaggctggaaagtacccttggaaacaccccacgctgcgttgggggctgagaccgggaggggactccccaggtgcggcacgaaggggcgggcgccgatgggcagggtccgagcctgggatagtccagaggcattcatggtcgccattctgtgctgcagtcgatattgaactggtgatttaatggttttcagtgtgctttgtgccggcacctgcctggtgtgagnnnnnnnnnnacagtcaatattgaactggtgattaaatggttttcagtatgctttgtgccggcacctgcctggtgtgagtcaccgcgaggccgtcatgaagccgtgcacggcgctgcctggggcccccaccccacgccaccgtgagatcgggttgtcgaggttagcccacgtgatcggtcgggagggcgggtcctccaggccacaaacccccttaaacatcttcatgatatcattcataccgaaaaccatcgtcccccaccacacttcaacttcccactggattacaacacgctcagtctgcgcttccacctcccagagccctctccacggcatgcaccctgtgcagcagggtctccaggtcgctggcgctgcgcccgcgctgccccggctcctgcttggcggcccagggccccaggctgtgccggaggtagtgcctgaggccccgacgcagctcttggagggcgggccgctccctccagggcttgaagagggcggccgggtcgtcgcagcgcagcagcaggtgctcgaagaagaggcgccagaagacgacatggcgcgcggactgcgccccccgccagtcccccttcttcaggaaagcggggctcatcgcgccctgggccaccgcgtccgcgcacagccgcgccaggttggtcagccggcgcaggtccatgtcggggcccacctctcccagcgcgtcccagcaggcgtagcgcagcgtggtctggtgcgtgcggctggtggcgcccagccgccccaggagcagcgcgtagtaggggttgtaggcgccctcctgcaagcagcatagcacgatgacccgtacaatctcttgctcctgggtgccctgcgtgtttcggagacccggggatgtgaattgaagggggggggagggggggtccatggggggcgcggggagaaaacgagtgggaatggggcgtcgttgtgattggaaacagcgatgaggaatggaaagatgagagcattgccaagcggccctctgcttcattccgccccacccgcttgaatgcagcccccacactccccggaacccctggaatgaagacctgtccttcccctccaccttccctgtccccacccactcaccttcaggcccaggcgcacaagcttctcaaaggcgtccacgtagtcctcgctgcccatgaccaggcagaagacggtgcggcgcacctccgtgttcatgccatgccgcgcggcgaggcgcaggagctgcgccggggtctggccccccgctcccggggtatcctccagggcctccgccgccgccaggctggcgccgcgcagggagggcaggcgccccgcggccgccgcatcggcggcgctgggctgccaccagaaacccaccttgacagggctcagcacctttgaccaggggatgccccccaccgccacctcctccacacccaggccgcgaagccacttgagggtggtgggggagagcaccgcgtgccgcccgccgtcccgcttcctgcgcgcgggtgtgggtgtggatggggtgggggtgtgcttcgggtaaaccccaaagggcggggaagcggtgcttgagccaggtgcggcccatcctccgcagcacgccatgccaacggcgacagagggcacacggccccctggccccagcaacgaagacccttgggtaggcagcacggctnnnnnnnnnnacccacccccctccattacgcctccctgtcttatccccaccctttgcacacctgttgttcttggtgtccatcacnnnnnnnnnngcccacccctctcccttacgcctccctgtcttatccccaccctgtgcacacctgttgttcttggtgtccatcacnnnnnnnnnntacgccatgccaacggcaacagagggcacacgcccccctggtcccagtaacgaagacccttgggtaggcagcacggctggcgtccgcctgccagctgtctggcccgccaggtcccaatcgctgccaggcttgggatcatgcagcaccacgttgtacgggccactcatcctcgataccgcttcccattgcagcacacccagaccccannnnnnnnnnnnnnnnnnncaggtccaggagcgcctggcccctggccgacagcgcgccgcgcgcgcgcgcgtcggctgcggcctccgtcactgccactatgtaatcgcgcatggcctgcgggtcggcggcacgcaggctcagccccgccgcgcccagtaagtgggaggtggcggccacgtcggcctccccgaaccggcgccgccaggcgtccagcagggacatcaccaggtcggcgcgcagcgcgcccagggcgtgcagctgcgctaccaccagcgccaggttgcgcgccgccagggcgtcaccgtcgtcgcgcagcgaggcctccagccgcgctcccagcgcagataggaaggccgcgatcacgccggcggagcgcacgctggccgccaaccccgccacggcggcggcggcgacggccgcaaaggcctcgctggcgcgtgggccctcggccgccgcggccgtcagctcgtgcacgaccgcgtcggtcaccgcacggcgggcctcgtcacggtgcatgcgcgccagctcgcccacaatgccctgcaggttggactcggccaggcggttgagctggccgcgcaccgcgcgcgccacgcgggagtcttggatggtggggtcgctgcccgcggccgccgcccgcgccgcaggaggcaggtaccttcccaccgcagccggcggtgagggacgagcaggtgcgggtctggtggcggctggctcctggggtttcccagcggagcgctcggtgtcctcgccgtcctccgagcctgaagccccaactgcttcatcgctgcttgttcccccatttgccgcactgctgtcgcctgcaccactgagatccgaaccctcagggtcagatccttcctcctctgagtcactcatccccgccaggaccgagtcatcctcctcgctaccgctggctccagagtctgcgaggccatccaaaaggctgtcctcctcgctgccgctggcaccatcagagtcggccaggccatctgagaggtgaccgtcctcgctgccactggcgtcagagcccaggtcgctggcagcatcttcaccgtccgaggcgtagtcactcacagagccgctgtcatttgacccagcgggcgaggcacaggaggctggagtggctgccgctctgctcggtcggccgggcttgcccccacgctccatggctccagatggcgacgatgctttgggaggcgcaaccttggcgcctggaagtggtgagaaggctcggggttttgtggaagccttgacgcactccatggattgcggtgatgtagagtgggtcacatcaatccccccatttcacgcgcatgctcttgcgccacattcaaggctaccnnnnnnnnnnatgggtcacatccgcccccagttcacgtgcatgctcttgcgccacattcaaggctaccacgtaatttcagcccccccagctccccaatcaaccactcaccaccgaggacgaggtcgtccaggccgtcgcccacttccttcagacctctcccctttttcatgcccagcttgcgtgccagttcagcctgcagggcttgctctgctgccagccccgcgacagatccatcggagccggtgagcacctatggccagggaagggagggaaaggcgacgttggaggcttagtgtagccaaccagatgccgtttgtacgggcatcaatcatttttttgagtgcccagtaggcaatgcaggtggcnnnnnnnnnngtagtgtagccaaccagatgtcgtgtgtacgggcatcaatcatttgtttgagtgcccagtaggcaatgcaggtggcaggccgcatgctgagagccagaccccagcatccctcgcggcacctgagagccctctggtccgagcagctcggtgaacttggtggtggatcgcttttgcttcggattccgcacggcagactcgtcccttccccgcttctcgccccgtaactgcgggtcaccacctccccggctccttccgcgtcgtcctctgccgaggcctccacggctggcctcctgttcagagcccgtcgcagtcacccgaccaggaccagccgacctgccacccctgtggccactctcagctccacgtctgccgctacgctgagcatgaccgccgcgtcctctttctccatagcggcccccacgagctgtggagctcccacgaccccggggactggccctgaacctcccggagtcccctgcagggcggtgccctggggtggaatcggggaatatctccttcgtgagcgagaagggcaggcgcggccctaggctggggccccttccacctcctctcctcgacatggggcgaagatcaggctgctatccacctcgcggagccgttgggcattctcgcgaggacttgcgcactgcccgacagcaggcaccccaggggaagcagctacctcgcctggcaatgcatgccaggatgttgttgatgatttaatttatatgttgcatatgcgtcgaccatgcgagtcatctgagatgcgttggtttcatcgtggcacttcnnnnnnnnnncgatgatttactttatatgttacatatgcgtcgagcatgcgagtcatgtgagatgcgttggtttcatcgtggcacttcctggccctggcgcgcaatgccacgtcggcttggcgcaaggtttctgaggcatcgcggtgcgccgatactggtccagaccagtgccgaggcacaacttccactgcctctgcagcggtatgtctggggaagcagcgtcacagccgtcgtttctcctccgtctgctccatgacataaaggaggtccccaactcgccgtcggtcgatgcagagggaggcggtgctggcggcaaggatgtggggccactcatctgcctcggtgccggcgtgcgcctcatccaccagagcggcgagcagggctccctgtcggttgtgcgtatgcctggatttccacacagaggannnnnnnnnnctccaccagagcggcaagcagggccccctgtcggtcgtgcgtatgcctggatttccacacagaggagggctgggctgggctgggggcagcacgtctacagtagatgcccgcgcaatatacaagtccaggatacatgatcctggtcaaccccaacccctgcagcttcatccagcccttctgtgcatgctggcatgccgcgtccgtccccgtcatgcagccatgggctagtgcttgcaaaacccagtccccgttccccctaccccagctcacgcgatgtcctgcagccctgcgatgcactggtccacgctgggaatcggcccggccggcctggcccgggcgccagcagtcagagcccggttctgctgcaccaggcgcacgccctcctgggccaggcggccgaggccggccgcgctctgccgggccagcccgagggccacctgtgctcggaggagcagctgctggagggccagggtctgggcgacgacgaggcgcttgcagacgcccggggtcgtnnnnnnnnnntgccagcccgagggcctcctgtgctcggaggagcagctcctggagggccagggtctgggcgatgacgaggcgcttgcagacgcccggggtcgtgcccaggtcgcccaggttctcggggcgctccagggcctgcgcggcggggtagggcatggtgggcctggggctggcgtggggcatggttggaggccgcggcatccagggcatgcgtgacgtcaccactggccgtgagatgagcaggaaaccatccacaaggcccactccctcccatacttaacctcaccggcaggcgaagcaccacattggagatggtgcgtaaaagggaggtcagctgggcctgcgtgggagagggcttcgagggtagaggccaaacgcatcaaccactgctctcgacaaatggcttgaggcatgcccggccacgattctcagatcccacctcatgctnnnnnnnnnntgtacaggccaaacgcatcaataactgctctcgacaaatggcttcaggcatgcctggccacgattctcagatcccacctcatgcttccgaaatgactcgatctcctccccggccttccgatataatttcctgtaagcaaccaggatgtccccggaagccattcgatgaccacggtacaagttgcaggagcggtctctgctacgggacacgctgcgacatcctcttccggccagaattcagctcgcatggccacaatgtcattgcatcacatatggatgcaggtacgtcacgtatgtggcgcaaccatatattattccgtgttctgctaaggccgtcatggcccgaatgtttggctgggcgccatcactgatctacaaactcccctactccccaaaagccccgctgcagatttcagtgagagttnnnnnnnnnnaggacacgctgcgacaccctcttccggccagacttcagcgcgcatggccacaatgtcattgcatcacatatggatgcaggtacgccacgtatgcggcgcaaccatataatattccgtgtcttgctaaggccgtaatgccccgagtgtttggctgggcgccatcactgatttacaaactcatgtactcccccaaagccccgctgcagatttcagtgagagttacagttggaaaatcagttgcatactgtacaatttattagatgagaggtacatgcatttgtcgtcgtgctcatatggggtctgcaaggtatatatcagggggttgatgactcggatgctctactccatgtcctcgtttgcgaaagctgctgcaatggtgtcaagcacagcctcaagggtggggtcgatgtcaaagagcccgccaaactcggccggcttcctgaccaggaaggcatccagggatgtgcccttgatcctccggagggcggcagccgcgaggccacccagtgccagcatgcccagtgcgccgacggcagccagttgaatgttcgcctgcactcctccaaacacaccagcccgcnnnnnnnnnncaacattcaactggcggccgtcggcgcactaggcatgctggcactgggcggcctcgcagctgccgccctccggaggatcaagggcacatccctggatgccttcctggtcaggaggccggccgagtttggcgggctcttcgacgtcgaccccacccttgaggctgtgctcgacaccattgcagcagctttcgcaaatgaggacatggagtagagcacccgagtcatcaaccccctgatatataccttnnnnnnnnnncgccttggctcaatgctcaaacatgctcatcattatgctggacacccatcacgtcaacatgcctctggcatctcagcgcaggannnnnnnnnntgctttggctcgatgctcaaacgtgctcatcattatgctggacacccatcacatcaacatgcctctggcatctcagcgcaggaacccccgccagatcgaatactatgcatgcacttccgccggtcgactcagcccaaaactgcactggggtctgcacctaccgaaagcagctgcgacggcaaagccaatcatggcagaccgcccagccagccgctcaaaagctgatgactgtgcctgcaatcatcagataaatgttgagctgggtcagcttggaggggattggaaagcagagggtgagcgattgtgaggagcaagaattttgctataccaccgttgccgcgcaccttcagcgccgcgatctcgctcattatgggcagcactcggccaccggttacgagtggcccacgaccgccctgacaggtcggcctgcatggccttgttctgggcagggttgcgcacgctgccttgttaaagggctgtttgagtgtcttgggcagcaccggtgaaggagagaggatgctccgacatgagtactgcatgctgtttcaagtttcccgggtaggttcaaaagtccagattgatgatttgcggcctctgagctcaaggcagaacagaaaatgattactcggaattcttgttatttttgctcctgcattccggcgaaccccttgtgttagagaggtgctgtggcttcnnnnnnnnnnagaattcttgttatttttgctcctgcattttggccagccccttgtgttagagaggtgctgtggcttcggcgccttccgcacggctgacctgccgtcgagtcggagcacgcgcggcacgccgggtccccgagccccgaaccctgccactccatcgcctggccggatgagccagggggtgggcatgctcaacaacccagtagctcgtaatcgtactatccgacatacatggcgatctcgcattagaggcaagtacgtggtgccttggcctgacgggccgaccggatgtcatgcccagaatcatacgtcattctgcacaacgtctccaagaagcacaatgtgggaaccatcagtagatgtgccactgccttcaatgtaacgcaggtacgcttgtcattcgtctggtctggaggacagagtatctcctcagcatgctaggcagggcnnnnnnnnnnaaagcacaatgtggggaccatcagtagatgtgccactgccttcaacgtaacgcaggtacgcttatcattcgtctggtctggaggatagagtatctcctcagcatgctaggcagggcccgccaaggctcctctcccaccccgccctactccccatcgcagatctgcctcgtcggctcgaataggttcaatgcctttgggagtcatggttcagatgcccacgtggacttcggctggcatgccagcatcgaggcctgctgccaggagctgcgggaggagaagggcgcacagatcgtgggcgtggagatcatgccatctgccctccccgtgcactccttccccttccgcggtcccaccgccttcatgctggggaacgaggtgcgtaagctgtatgtcgtcggccgcgtggacgtctcccagccggccatagccggcccacccatgcccctcccccctgcctctgcctcgcagggtcagggcctaagcgagcggcagatacggaactgtgatgccttcatctacatccctcagtacggcgcaggcacggcaagcctgaacgtggccgtggctgcatccatcgtgctccaccactttgcgctctgggctgggttcccggagcgtggtcgtgagggccagaagttcattgtagcgccccggcccnnnnnnnnnnttgggctggcttcccggagcggggccgtgatggccagaagttcattgtagcgccccggccccagtccgccagggggaagggtgagatgggagggatgatggtgtcacagtggaccgttctcaggaggctctccttgaattttcatggcggcacaatggccatgaggaggttgcgtggtgattttgtgaggggttatatggcgatggcggcacctccaagtcctctgtacttccgctcgcccgtctggtgaatctcnnnnnnnnnnggtggaccgttctcaggaggctctccttggcttttcacggcggcacaatggccatgaggaggttgcgtggtgattttgtgagggggtgtatggcgatggcggcgcctccaagtcctccgtacttccgctcgcccgtctggtgaatctcaagctgtcccagccctgcgctgtaggtctggtgaagccacccccgggcaggtccaatgagggtgctagtcatggtgaccatggccccgaactgacatttgacttcagcgacgctcaggcggatttgggcgcccaggcggagtcccagctgacccttgttgacggataatgagagctgaagcttagcttgagattgccgtgtactattttcataccgcactgctgggaggagcaccctcccgtgcaggcccgcaccggtgtatgagcatgctacgcgtggcaagccaggccagtagcagttggcaccggagccccataccccggccggggtgccattctcaccccatctggaggagcattcgattaccttgaggatcgcttgtcaatactggttgcctgggaggacaggatgcagaacgctttcgcgatcctgtcgggcgatcagcccgacaccgcaacgagcaagtcgcggaagaatcggaagaaggccgtgcagaccgccccggctgagccaggggtgttcaaaccagccgaggaggtcttcgcggtttccgatgactttatgcaggtccgcgggcggtcacagggcaaaggccgtgctgagtccggtatcaaggctggaggacggatgcccaccactgccgagctggagaccgcggccgcatctgctgacccctccacacgcccggccctgatctcggactggctgagccaggtaggggggtgctcactcgtggctgggtgtcgtgggtgcagcactgcagcctccgggatccctggctggcagagcaaccgctctgccactctcagggtcctgttaaacacacaccgatgccgctcnnnnnnnnnncggctggcagagcatccgccctgccactctcatggtcctgttaaacacacaccgatgccgctccccatccaaaacgcctcctcgcagatctctagccccaatgcctcggcagcacagaccttcaaagaggtgggtgccgggggtgctgagtggccaactgcatgtttgcgtcctcaccaacacagcccatgccgcgccccccagccgtgtcaaccagtcctcgccccctccccaccaggcactggcgggcggcacggccctggataccctgctcgccagcttcctggcgtcccccgggtccgaagcggaggccgacgccctggcccggctggtggcggcggccgcgcacgagacctgcccccccggcgtcccgtcctccctggtggccatgctgcgcgcgctgggctccctgcacgccagcgacccgctgggcggcctccccgccgcgcccccagcgctcgccgcgctgtgcacgctgctgcggcagggcgacggcctgggctcgcacactcgcgccacggcctccgacgcgccc

SEQ ID NO: 49027 - DNA, 83 bp, Chlorella protothecoides
ctgaacaagaggtgtgtggtgtgtggggggggtgctgaggtggaggcatactgggggtcggttcaggtgagctcgcggagcgg

SEQ ID NO: 49028 - DNA, 64 bp, Chlorella protothecoides
cacaagtcagccacccatccgccgcaatccttcaaacagaggcaactttgactatgagcagggc

SEQ ID NO: 49029 - DNA, 63 bp, Chlorella protothecoides
ccctgccatgatctggccggggcggcgcgctgcgcacaggtttgctgggcgcaagcccactcc

SEQ ID NO: 49030 - DNA, 69 bp, Chlorella protothecoides
atcacgagcatgaaattcaagatttgttttattggaatcgaagagtgttgtgtgagtcaaggtcaggtg

SEQ ID NO: 49031 - DNA, 80 bp, Chlorella protothecoides
gggggggccaagtagcgggtgcctggcattctcaggctgtcgcgggagcctgtgaatacctttttgcccacgcatgcgtg

SEQ ID NO: 49032 - DNA, 95 bp, Chlorella protothecoides
ccgttatcacctcagattcggagcctgggggtgactggagggccattcccaggcgtcaggcacttgctctggcaccagagcgcgagccaggtcac

SEQ ID NO: 49033 - DNA, 61 bp, Chlorella protothecoides
ctctgcatcagacaaggcctttgggctgggtgtcaagccgagagccggcttggcatcgctc

SEQ ID NO: 49034 - DNA, 79 bp, Chlorella protothecoides
atgagtgtcgaccagcactggacggcgtggcattccccttccatcaacggcaagccccctcacacagaatcatgccccc

SEQ ID NO: 49035 - DNA, 115 bp, Chlorella protothecoides
gttgaggatgtccttctggaagcaggagccaccaaagccaacagatgcgttgaggaacttggggcctatcctcgagtcctttccaatggagtgtgcgacctcttgcacatccgca

SEQ ID NO: 49036 - DNA, 75 bp, Chlorella protothecoides
ttcgacacccaaacttccctcctcaggccaatacccatcgccctcgctcacagatgaggatggggctggccttgg

SEQ ID NO: 49037 - DNA, 64 bp, Chlorella protothecoides
ctgtactgtccaatccccagatttcctcctgatatccaagccactcctgcccacagtgattgtg

SEQ ID NO: 49038 - DNA, 707 bp, Chlorella protothecoides
  modified_base (126)..(135): a, c, t, g, unknown or other
  modified_base (231)..(312): a, c, t, g, unknown or other
  modified_base (561)..(652): a, c, t, g, unknown or other
catggtgcatgggcggcggcacaggggcagcgcccccccccgctgctgggggggcgtgtgcgatgggcgtagacagggagtccctgccccccagccccacagaggagccggccaggggccggcccnnnnnnnnnntccccccccacgctgctgggggggcgtgtgcggtgggcgtggacagagagtccctggcccccagtcccacagaggagccggccaggggccggcccnnnnnnnnnnnnnnnnnnnnnnnnnnnnnnnnnnnnnnnnnnnnnnnnnnnnnnnnnnnnnnnnnnnnnnnnnnnnnnnnnngcgccgcaagctgcccagggtggaaggggaggagtgccgtcgcgtcgacgggggcggagccacccgctgggccggcgagtgtggatgcgacttggaacggggcgcttggttcctggacgacggtggcgcagctctcggcagaaccgaggcccccagacgacggcgtcgtgcacggccacggcagggtggaggtgctcagccggcccgagcccggcacccccgggtcgcaggggacgccggaggccctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgtgggcgcctgccacgcctcgctgcacggtgcttgtgccaccacctgtgcct

SEQ ID NO: 49039 - DNA, 76 bp, Chlorella protothecoides
aagtgcgaacatacgacgagggtaagagtcgctggtgtcggttttgagcgttaatgctgaagttaacccggaacgc

SEQ ID NO: 49040 - DNA, 152 bp, Chlorella protothecoides
catgagcattggttccctgccatgtagaaagggtggtgacaggttgtttgataccatgagacaggactaacattcgggttgcatgcacatgcagagtgattcaactcgaagcccacttgcacacactatcaaaataccccctgacaactagc

SEQ ID NO: 49041 - DNA, 61 bp, Chlorella protothecoides
ctcggagggcatgcccaaggcccgcttcagtcccagcagccagtcggcagccagcgcggag

SEQ ID NO: 49042 - DNA, 68 bp, Chlorella protothecoides
cgcccacgacagtggtcatgccagggggggcgcggaattgctccgccagccggttgatggcccgctcc

SEQ ID NO: 49043 - DNA, 68 bp, Chlorella protothecoides
acatccgccgctgcacaccccacgcacgactgcagggggtggagcgatgggagctgtatgtgatgacc

SEQ ID NO: 49044 - DNA, 61 bp, Chlorella protothecoides
gtggaggggcaccctgcttgttcagggagaacccgcctctccctggccgcacccggcttgt

SEQ ID NO: 49045 - DNA, 61 bp, Chlorella protothecoides
ccttgccacagaccgtctacttccggaaggtgacagggccaggccacatttccgagcgccc

SEQ ID NO: 49046 - DNA, 65 bp, Chlorella protothecoides
cgccccacccgcatcttgccaatcccaggctttgaaattcctcaatctcgaggaggttcatggta

SEQ ID NO: 49047 - DNA, 91 bp, Chlorella protothecoides
ggacccaaggcacgtccgatccgtcccgcactgcagcacggcccctgatgcattcgcctgcgttgcagcgcgacctcacggcgtcgacccc

SEQ ID NO: 49048 - DNA, 219 bp, Chlorella protothecoides
agtagtgcacaattgccaggccgccgattctagcggtattaatcacctattgcttctgtagtaatgttgagaagtccggaatagccggaagcatgcacgcacgcaaactttcatttcaggcagttgtatcgcacagagcatcaaaacatttgctatcatttttacatcgttgggcattcttggcgtcgatggaacaagatcctatcaatgattctagaa

SEQ ID NO: 49049 - DNA, 78 bp, Chlorella protothecoides
caagacagccagcacagaggtgctcctgtcaagggtcgcgtggatccttccccaacctgcgacggggcctggcctggc

SEQ ID NO: 49050 - DNA, 74 bp, Chlorella protothecoides
atgccacggactgtaggaaatggaaacatataatttatttgacgaccagggtaagcaggagatacacacggcca

SEQ ID NO: 49051 - DNA, 61 bp, Chlorella protothecoides
gtgccatcgacagaggatgctgcgcccagactggccgccaggcaggccgtccagcgctgca

SEQ ID NO: 49052 - DNA, 69 bp, Chlorella protothecoides
ggcgtcttggggctggggctggggctggggttgtacggtgttggaggaggtggcacgctggttggtggc

SEQ ID NO: 49053 - DNA, 8825 bp, Chlorella protothecoides
  modified_base (598)..(607): a, c, t, g, unknown or other
  modified_base (1045)..(1054): a, c, t, g, unknown or other
  modified_base (1568)..(1577): a, c, t, g, unknown or other
  modified_base (1759)..(1768): a, c, t, g, unknown or other
  modified_base (2195)..(2204): a, c, t, g, unknown or other
  modified_base (2505)..(2514): a, c, t, g, unknown or other
  modified_base (2751)..(2760): a, c, t, g, unknown or other
  modified_base (3934)..(3943): a, c, t, g, unknown or other
  modified_base (4439)..(4448): a, c, t, g, unknown or other
  modified_base (5059)..(5068): a, c, t, g, unknown or other
  modified_base (5293)..(5302): a, c, t, g, unknown or other
  modified_base (5671)..(5680): a, c, t, g, unknown or other
  modified_base (6801)..(6810): a, c, t, g, unknown or other
  modified_base (7763)..(7905): a, c, t, g, unknown or other
  modified_base (7957)..(7966): a, c, t, g, unknown or other
  modified_base (8386)..(8395): a, c, t, g, unknown or other
  modified_base (8718)..(8727): a, c, t, g, unknown or other
ggcgcgcatgcgcgcccgcgcccgggatgacgaggacggggacgaggacgccgacgaggcggggaccgggcagcggcgccgcgcgctggcgggcccgctgcccgccagctacccctcgccgccccgcgcgcccgacggccccttccgcctgtccggcgtgtatcttgggtgcatggagaacaaggcggggttccaccccatccgcgaccccgcctccaagtggtatgtgtcggaggagcagctgcccaacagcgccgtgcccttcggcgtcaagtacctggcggggtgggggtacgtcctctcccgcgacctcttcacgcgcatcgtgcacaagaccaacctgtgggctgcggaccccgagtcggcgcccgcctggtacacgtgagctggagtcggtggtcggctgggatggaactggggtgtggctgctggggacgcggcccaggcccgcttgctgatcctagcgcactctgaaacgcgcgaaatgccaaaagcacctcagcacgggccctttgtgtttgccacatcctcaagccctcacacagaatcccccaccctcctcaccctaattccaggctgctggcttgggaggatgtcnnnnnnnnnncaccctagcgcactcgggaacgcgcgaaatgccaagagcacttcggcacgggccctctgtggttgccacatcctcgagccctcacacggaatcttccaccttcctcaccccaattccaggctgctggcttgggaggatgtcctcatcggcatgatgctgatggacgtggtggacctcccggaggaccacagaggtatgtcgtgtggcgggagggacttgaccgccactttgtctgatgagcaggcatagggaagagtcaccagatgctggcagaggccagctttccagaggccagcatggcattgtgttactggcacggagcaacagcacctgctccagcggtcggtgaccaacagagtatcataacaccggcacctcagtgcatgggcaatcatgggactcaaaacgagtgtctccgacgtcaccgtcttcacccannnnnnnnnnagaacaacagagtatcattacaccggcacctcagtgcatgggcaatcgtgggactcaaaaggagtgtctccgacgtcaccgtcttcacccatcggacccccctttgtgccaggcttcagggcggcatggaggtcctgtcccgcagagaccgtgctgaggcacctggatgtggacgcccccgccctcctggacgggctgtatgcccaggaggagtcggggctgtggggcgcccgccccgtgcagtgcagctccggaaagttcctgccgggcgactactccggctggaaggcgtggcgagatacgctgccgttcgtggagcggctgtaggctggccggtcccttgcaggcgggagcacatctgccctagccagttgaagggctgctggggagcggcaagccctcgcgcggtatcgcctggcacccaccccttctttcccatccatcgtcaccttactctgcgccgtggcctcgccaggtgccatacataccgagcactgcagtagctccgcctccnnnnnnnnnnattcccgtccatcgtcaccttactctgcgccttggccttgccaggtgccatgcataccgagcactgcagtagctccgcctccctcgccaccgttccctcccttgctacccctaccccccttcgttgcgctccccgctcccggaaccttgttgagcacacgagcatggtcctggacattcctnnnnnnnnnntcctcccttgctacccctacctcccttcgttgcgctccccgctcccagagccttgtcgagcacacgagcatggtcctggacattcctgtgttacatcttctctcgtgaacgattgcagttggaatgcgtggtacaggggtgtcaaggcaagggggaaatcggcggagtgcgaactgatcttccagcgagacatctctttcttcgcagcggcaggggtccataaagtttgcggggcgtcgagcagaggatggccagcggcgctgatcaatcagcagcgttgtgggcgccaggcgcggcagagggggtggcctgccactcaacaggtacgtccgggtcgagagcctccctccagctcactcagcggtgcaggccgagcctctgagcctcgccccccccgcccaaccacctgcgtctactgccccacggnnnnnnnnnngaaactttgcggggcgtcgagcaggggatggccagcggcgctggtcgatcagcagcgtcgtgggcgccaggcgcggcagagggggggcatgccactcaacaggtacgtcggggtcgagagcctccctccagctcgctcagcggtgcaggccgagcctccgagcctcgccccccctgcccaaccacctgcgtctactgccccacggcggaggtggccaggatgaggttgaccgccacacccaggaagatgacaaagaatcccgcccaggcgatgagcccgttgcggcccagcttgtaggagnnnnnnnnnnaaaggggggaggttgttgggatgcgaggccattacttcccagcagcatgcccacgcagactccatgactcacagctgactgccattactcagccaaactgataaagtcatgcacactaggacccctcaacaaaagccatgccgggcattccatgctgaccagccccttgagagggacccagcccctgcagcaccccccagtgatgcgtaccttgcccttgcgtccggaggcatccannnnnnnnnncgaggtggccaggatgaggttgaccgccacgcccaggaagatgacgaagaagcccgcccaggcaatgagcccgttgcggcccagcttgtaggagtcgccggactcagaccagaggtcgggcgtgtagatgggggagtacccgtccacattcgcgccatacttgttctcgaagcggtacacgccgtagccctgttgatgtcggagaaggggggaggttgttgggatgcgaggcaattacttcccagcagcattcccacacagactccatgactcacagctgactaccattactcagccgaactgataaagtcatgcacattagaccccctcaataagagcaatgcctggcattccatgctgaccagctccttgagagggacccagcccctccagcaccccccagtgatgtgtaccttgcccttgcgtccggaggcatccacccagtccttcttgttctggaagcgggagcggcccatcaggttgttcttcaccacctcattctcgatcccgttcagaccctgcttggcgatgtcggtcttcttgttggagcggaccagggtgctgggcctggcgcgggtgccgctcgtgctgcagaggagagtgcgttgggcgacgtgaagggggggactcgacggcatggcctctgggcagcatgcagagagcggcagccacagactcggaggcttcctccagcaccacgcatgggcgccgaggaaccctctcgcaaatcattatgccatgtgaaaccttcctgagccccaaaacagggctccgatgcgacagaatctcgccgcgccaacagctcaccgcaggggtgcggaccggatcccggtgggcgcgaaagcgctctggctagccacagtctgcatcttgagcgtgctggaagggcggggcaaagagatgaggatcctcggtctatgctcggctctctgttcgggtgaggaccggcattcgatccaagtgcgatcgcgtgcacacatgaatgatgtggtccggggtcgaatgcttgtaggcttcccacctcgaaattgcaagcaacccctcacaatttttcaggctccacgatccatcaccgagccctcggcctggtatcacacccttcccatttaatcattcagcggcacagtatccctagctggccccttgctggcagccacctcctgctggtgcttcnnnnnnnnnngccattcaatcattcagcggcacagtctccctagctggccctttgctggcagccacctcctgctggtgcttcctacgtccgagacccaacagcatcaggttcaccagcttgccccagctatttgccacgggcgagacccagcatgacgagcgtaccggcaccgatggtcacctgccccagcacgtctggccaccccagccctggacacgcatgcatcctcggggcggaacccgccagcgcgccccatacgcccacctgccgcctgcgccagcggtagacgacgctggaaagcgcggcctcgccatagaccagggcgagtccggcgaggatgccgcacacgtccggcaccggcgtctggcctttggtcaccgtttggatccagcccagggtcagccacgcagattgccggccctgggaaaaggggctggcagacacgccggcaaacagatcatcgtccaccatgctcgttctggacccaccaggggcgggcgccggnnnnnnnnnngttggtcaccgtttggatccagccaagggtcagccacgcggattgccggccctgggagaaggggctggcagacacgccggcaaacaaatcatcgtccaccatgcccgttctggacccaccaggggcgggcgccggcctcgagggctctgcgaggtagccccccaccacctgcagcgtggtccaatgggggtggcaattgcgtcagggcattgggtgaggtgtatggggcatgaagggccgccatcgaaccatcacctctcagccagcgtcagatgggcggctgcgctgttcaaccccccaccaccgtatggcccatgagtatcaagggcaccgccccacccctgccatgccgaccttgagggccaggaccaggctgctcgatgtgaggacgccgggcgattgatacgcagcagtcagtttcgagggcgctcccagtcggtgtgctgcccaggtgacagccactgggcagggaagattgagcaggcgcatcaacatgacaggtgagcagacgatggctgtgcagtcaggcccacaccagttgcttggctgtggggcggtgcacccccccatcctaggccttcagggtagcctcccagaatgaacagagcccnnnnnnnnnnagagatttgggaggctcaagggggccgcgcacaaccgaggacatttccagacgctggcggcgcctgtcagcaggaccacagccttgctgtcagcgaggcctgagcagacgtcccaatgagccggaatcgtgctgggaagttccatgccaagcccattgagctcgacgcgtgggcagcagcgtcctcccgtacaaggcaggctctagcaaagggatgtgcatggcnnnnnnnnnnggttgcttggctgtggggctgcaccccccatccaaggcccccagggtagcctcccagaatgaacagagcccgcacggcaagccttgcaagagaaactcaccatacagcgcctgcgagaggaaggtacacgcgaccaaggtccagccaaggtagaatgtgcctcgtgcggcctgaatgatgcatgcctcaggcaggagggaggcaacattgcaggccagctggggccacgaagcatgcagctgcgaggggcggggcagggcagagcatcgtgtcaagggaagaggagggggttacaaggggtacattgggcacgagggatggaccgatgcatactcgttatcatccctcccagtgtcggcgagattaggnnnnnnnnnnaggcagggcagagcattgtatcaagggaagaggagagggtcacaaggggtacattgggcacgagggatgggaccgatgcatactcgtcatcatccctcccagtgtcggcgagattaggccagctgacttccatttggcgagtctgttcgaaggaaataaactcatgcggggcaagttcccagaacacggccagtccccctcagcaggccgggcgcaccatgggagccgtggccagccgccaccactctcgctgctccacaacacgccggggtagaaggccccatgaacccacggatttagggctctgggatgcggccgccacccagccgccggccagtgccagggagagggacggcagggagggggaggccacccacgcctgtccaatgctcaccaggcctaggcaaggggcagagatgcggaggtgggatggggcatgcgagggctgctgtgccacggtggtgtcatgcctggtcgtgcgccgcagccactcactgctgagcagggccacgtcctggagggcactggcgcaaggatggtaaggggcggggatggtgggctccaggtggggccagtaggtctgcagtgtcctctgggtgggccacgctgtggggttgtgcctccccatgcctgcccactccgtgccagcccgagctacgctgcgcagactcgatgcagcgccactccacagatctttcgcagactgagccacaatgtgcaagggactggcatcggccccaccgtgagccattcctcatgggcaggcccacggcctggaagtgatctttgcccagacttgtgggaggtagatcagggacccggctattcccaactattttgcatgcatatgctcattccatttatgtgttcactataaaacatgagtatcgagcccgcgcaaagactgcgaggatgcaccctcggtgtatttgcctttgcacagttcctcctttcgttgtttgacctaccctcctcaaaccatctcggcttcatgttcggcacactccctacactcacacgctgtcagttctcgctcaccaacgcacaaattaacaaccggaagcgcgtcccagtttgaatcccgcagttactctctgaagatggcagaagcggcgttgtcnnnnnnnnnnactcgacttcatgttcggcacactccctacactctcacgctgtcagttttcgctcacgaacgcacagatttacaaccggaagcgcgtcccagtttaaatcccgcagttgctctctgaagatggcagaagcggcgttgtcgaagagcctggacgagatcatcgcggagcagaggcagaaggagacgacgaagagagaggtgaacagttctgaccgcctaaacgtgctaggtcgcgcgtgagaatcagggggagtcgtcgaacccatcacccccctgccatccctgcagaagcagaccagcaagcgtggaagcaaggcccagcaggccccagctacccggaaagggtcaagaggcggtcagaatagctcgcgcccgccagccagaggagcccccgggcgcgtcatcactgtgacaatcaaccgcagcagtggcgtcgtgaagagggtaggctggggtgggggtcaccagggacttgcatgtcacgttgcgtggggatggcagcctggagggtacatgaagtgtccctatcaaacccgtggcttcatattcgatgcacaggcaggcgatgggcaccggggaagacccgtcagtctcgaggatcctgagccgagaaacaccgaggcccgcatccaggccctcgagggcgccggaaaatggggccacgacatgtttgcgcgagcggagggcaagggcgccgctggaccacgttccgcatccgctctgggaaccaagctgtgagcttcatggaggggaggagggaatgaggagtcgtgaccggcaaggaggatcaaccttggcatcgtccagaggtggcctccctggccatgccatgcacatccctttgctagagcctgccctgtacgggaggacgctgctgcccacgcgtcaagcttgatgggcttggcatggaacttcctagcaccattccggctcattgggacgtctgctcaggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggactctgagcctaatagacaacagggaagggaggctgcaggaggggggaannnnnnnnnntggctgtgagcctaatggacgacagggaagggaggctgcaggaggggggaacttgcttcctgtccgctcctttgtgaccatgctcgcgagcctgacgcatgcttaagttttgctcaatctggtctttgctgcgccgagtgccagcatactgcaccttgattggttcatgcatgtgccctctttcacatgggtgctgattctatacgctgcaggagctgttctcgacctgcggcgaggtgatccggcacagaatcatctttgatgcaaggtgaggagctgtgctgagtggagtggcagcggaattgaacctgatcaagggcttgaggttttgggcatgccatgggcaccgtttctccgtctgcaaggatgagagaatatggttcgtgatacatgcagagtggtttattctgtcagttgccnnnnnnnnnnggtggcagcggattcgaacctgatcaagggctcgaggttttgagcatgccatgggcaccgcttctccgtctgcaaggatgagagaatgtgactcgtgatgcatgcagagtggtttattctgtcagttgcccatctaagaataggtgaagtgatcccttcccccacacacatgccaacaccaatcacgcacctgctgtctccgagtgcagtgggcgctctcaggaggccggcttcgtcgtgtaccagcacaagagcgaggccgaggcagcactccagcggtacaacggcgtggcgctggacgggcgggtgatgcaggtgggcgnnnnnnnnnntgtgtaccagcacaagagcgaggcggaggcagcactccagcggtacaatggcgttgcgctggacgggcgggtgatgcaggtgggctggggggggcggg

SEQ ID NO: 49054 - DNA, 78 bp, Chlorella protothecoides
tctgcccttcgctgggcttggaaaaggggccatccctgagcacgactgcgcgagctccctaacaagacacccttgggc

SEQ ID NO: 49055 - DNA, 66 bp, Chlorella protothecoides
gccaggccctctcgcagtttggggacgatccacacaacccgcgacaggagcaccgctgtgctcgct

SEQ ID NO: 49056 - DNA, 61 bp, Chlorella protothecoides
cgaagcggcggaagttgaagaggagggcgaggaaggcccagccgatgtggacaaaccactc

SEQ ID NO: 49057 - DNA, 61 bp, Chlorella protothecoides
gtagtatattttttgggcggggaagcgcgaacagcccctgttttttctttttgggcctagt

SEQ ID NO: 49058 - DNA, 121 bp, Chlorella protothecoides
ggacgcgctgcgggacggggcgctgggcgttgaccccggtggcgccgcccactacgagtccgactcgctgcacacctctgccctgccctccgccctgttttaccctggcgagcagctgcgc

SEQ ID NO: 49059 - DNA, 17224 bp, Chlorella protothecoides
  modified_base (460)..(469): a, c, t, g, unknown or other
  modified_base (922)..(931): a, c, t, g, unknown or other
  modified_base (991)..(1154): a, c, t, g, unknown or other
  modified_base (1632)..(1641): a, c, t, g, unknown or other
  modified_base (3164)..(3173): a, c, t, g, unknown or other
  modified_base (5029)..(5038): a, c, t, g, unknown or other
  modified_base (5771)..(5780): a, c, t, g, unknown or other
  modified_base (6756)..(6765): a, c, t, g, unknown or other
  modified_base (7522)..(7531): a, c, t, g, unknown or other
  modified_base (7822)..(7831): a, c, t, g, unknown or other
  modified_base (8538)..(8547): a, c, t, g, unknown or other
  modified_base (9559)..(9568): a, c, t, g, unknown or other
  modified_base (10565)..(10574): a, c, t, g, unknown or other
  modified_base (10644)..(10653): a, c, t, g, unknown or other
  modified_base (10812)..(10821): a, c, t, g, unknown or other
  modified_base (11431)..(11440): a, c, t, g, unknown or other
  modified_base (11829)..(11838): a, c, t, g, unknown or other
  modified_base (12947)..(12956): a, c, t, g, unknown or other
  modified_base (13226)..(13235): a, c, t, g, unknown or other
  modified_base (14050)..(14059): a, c, t, g, unknown or other
  modified_base (14122)..(14131): a, c, t, g, unknown or other
  modified_base (14546)..(14555): a, c, t, g, unknown or other
  modified_base (15178)..(15187): a, c, t, g, unknown or other
  modified_base (15373)..(15477): a, c, t, g, unknown or other
  modified_base (16071)..(16080): a, c, t, g, unknown or other
  modified_base (16242)..(16251): a, c, t, g, unknown or other
  modified_base (16891)..(16900): a, c, t, g, unknown or other
ccccgcccgcgcccgcgtcacgcggggagcccgaggccgcggagccgagcgccgccgacagcggcgaggaggccgcagcggatgcgccggcgccggacgacacccctccagcgccggccgtttcggaggcccgggacgggtctgaggccggcgcgcccggcgccgcggaggcccaggccttccagggccgcctgcacaggcactggcagcaccggctggaccacggcgaggccgcgcaggccgccatgcgggaggagtacgtggaggccggcgtgacccagttcatcgaggatgccatcgtcaagcatgaggacaataagtggggcaacaaggtgggctgtgacacggcggtatgctttgctttgcgatgttgtgtcggaagagaggggagggaaaggcaggcaggcctgtgcacggggaaagggtgcattgggtgagagggggggggggggggggcgcnnnnnnnnnntcacgctttgctgtgtgatgttgtgttggaagcgagggaaggggagcgcaggcaggcctgtgcatagggaaagggtgcattgggtgagactggaaatggggggatgcccgctccctggctgggcatagggtctcgggtggtgggaggagcacccctgtgtcacacgccgtgtgccatctgtcaaacaccccttgaaacccacccacccctcctcttccagctctccgccaagctgtttgtggcgcgggagtttgtggagaagcacatccgtaacaagcacgcgcacgtgctgcaggcggagcgagagcgcctccaggacatcgtttactgggagaacttccagtgcgtgtgggaggagggacaggggagttgcccgggatgcccaggggggtggcctgccgtggcgtccgtggggcccacatggcacggaggggagtacagctgatcgtgctnnnnnnnnnntcatgccgtgtgccatctgtcaaacgccccttcacccccccccccccccccccccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcccgggatgctctggggggtggcctgctgtggcgtcagtggggcccacacggcacggaggggagtacagctgatcgtgctgaacgcgtgccgggacccaacccccgcctctgagcccgcattgatattcggttccagcccgctgacgtgtgcttgccgccccttcctcgacgccaggtcgttcaaacaggaggagaagcggcggcgggaggaagcccggggcgccggccgacagagggggccccaaggggcccgagggatgggcaggtgcgggggacgggatgtagggtgtttggagtgggagagggggttggggggttccttcggaggagcaggggatatcccccaaccatctggtataggaagcacacagcatgtttgagccccgaggttctggtggcgagacacaatgcccgtgcacgcctcctccactgtctggccccccactcttgtgtccaggccacggggaggcgggcnnnnnnnnnnacgagacacaatgccagtgcacgcctcctcgactgtttgggcccccctcttgtgtccaggccacggggaggcgggcgacatgggccggaaggcggccatatagtcttcgaccagggcatggtcatgggtcccggtgggccaggcatgctcgtgccagggctgatgatgccgggggcgggaggagccatgccccccgtgatcatggcccccatgaacatggtgctgggccacatgggggcgggcgggcgcggcggcggacgaggtgaggtgcagatgcgtggcgcggggcggcgctgggtcactgggtccatggtggggcagtgggcctggtcggcgggggcgagcgtgggggtgccggtcgggcgtccggccctgatgcatctgtgatggggcagccctcgatccatgcccctcccctccgcccttcattcccaggaggcaaccgcggcgggaagggcggaggcggccgtggtggtttcaatggcggccccatcttcatggccccagggtctggaggcaagcccgggggcccagctccgaaccaggagtacttcgacctcgacgccccgaagaacaaccgggccgtgctcgactatggtgacctgtgagccggcacctgttctgtgatacggatgcaaacatgacatggcacgctgtcggaagggtgcatcatcacttgccatggccgtgaaggccccccggggaggtgctgggcatcaggccaacagggccacccaagtgaccagttccgcacgcccagcacgacacgtacccaccgcggaattccgctgtatgagagcgcgaggtgaatgccggcacacgctccaacacgcaattgctcttcaagaattcatgtccaggccctcattcaaggtgccacgccctcactgtctgcaaagtggctgtggccatcgcctctcaacttccgtgagacattctggtagagaggcctggctcgcagattcgcttaggaccatacctagacggtgtcgggggtgctcatcacgacactggcctgagcagggccgtggaagctcggcgcgggtgggtgcaactccttcgggccgggagtcatgcagggcggagagtccctccccggcacttccagggccggggggctgcccccgctcgcaggtggttccaggaagccgagcaagcccctggatgaggtgaggagtgccagcgcggcatggaaggattcgtgcaagcaccccatggcgcagggtgtttggtcaacaaccagtcctccgctcaccccccctcctcgcgccagacactgcctgcggcaagtgtggccctggcctacccggatgccctccctgccaagagggtgggagggcatgcctggaaggtctggctcgtgtgtggcgactgtttcctcataggtacgtttgggactctgcggagaccaggatgtcctagggactgtgtcctggcaggctgtgcctgcagattcatgagcagagatttccctgagacgcagctgtgctgtgttgatcgtcatccttgggcccccccccccnnnnnnnnnnagagcagagatttccctgagaggcagctgtgctgtgttgatcgtcatccttgcccccccccccccattttaggcctcgctccagtactggtccacctgtccaaggacgccgacggctcctacggattcaaccccattgccgtgaacctgctggtggaggtggtgaagaccctctttgcgctgggcaccctcatcgcatacgtgagctcctccgcgtgcctgggtggtgggggcagtgtgcgtgtgtttgatcttgtcatgccccagcaagggtgcatgctgcgcagtgtagggctcttgaagtggagcggccatgggaaatgaatgtcccttggcggggcgggggcctgggagtccaggctctgcagccccagtcctctccgcggtagcgcatcagtctcagagactcggctccgcaacgaccaggccctcttcccagtgttggtcgccataccccttctaggttttctgtttgcccgtctgtttcaacccctcctaccttgctgtactcccgccctctccctgaccaccactcttgagccacaacgacccccataacccgaccaactcaacccctccgcagggcaccgggcgcccagggattcccctgacgcacagcctggaatcgttcgcgcgcgacgcgtcgcacaaccgcctgctggcggtgccggcactgctgtacgcggtgaacaactacctgaagtttgtcatgcagctctacttcaagcccaccacggcaaaaatgctgggcaactccaagatcctggtgatcgcagtgctgatgcgcagcgtgctgcgtcgctccttcaccaccttccagtgggaggcgctgttcctgctggtcgccggcatcaccgtgaaccagctcaactactgcgcgggtcagggggtggggggcatggacgccgtgaccccggcggccgtggccttcacgctgtcctccatcaccatcccctccttggcctccgtctacaacgaggcggcgctgaagaggcacatggacacctccgtcctgctccagaacttcttcctgtacttttacggcgcctgcttcaacgccgtcggcctgctggcggtggcgggggcgcagggctccggcatcggccacctcttccacggctttggcacggtgaggggggtttaggttggggattgggggggatgagaggggatgcaggggtggagtgatgccggcaaggaggctgggaggttgcggagggctgaacgctgtgcctggggcgggcgagggactggccgtggccagatgaacctgggatagatccgacatatcattctagtgtgcagggtgtgggtttggaatgccagggagccagataaccctgtggcgtgccaacttcccctgggtgccgtgccaattgggcggcgcctcgctgtcaagaacttgcaggactgtactgcccatcgccggcaggaatgtgcatcttgaacagtataccctcccccttctccaccccttcccctcttcaggtaaccctcctgctggtggttaataacgcgcttcagggcatcctgtcctccttcttcttcaagtttgctgacacgatcctgaagaagtacagcagcaccatcgccaccattttcacggggatcatgagcgcggccctgttcgggcatgccctcaccctcaacttttgcctgggcgtgtccatcgtcttcatctccatgcacatcttcttcagcacggggccggggagcgcggccgcgccccgtgcccagcccaacgctgctaagctcacggtggggcgaggggcgatggaggggcctggcagggaggcaagctgtgatcatgtggggtcctcctcctccgctagttcatcggagagctaggcgctgtcnnnnnnnnnngctgggagggaggtaagctgtgatcatgtggggtcctcctcattcgctagttcatcggagagctaggcgctgtcgatcagcgatgtggatacatcgacccagcctcgccctgtgcgcaccgcaggtgtcgcccagcatggaccatctggcactgcgcggaccggaggggagggcggtggacctggtgactgcagccgagagcggaatgcacggtcgcagaatatcgcaggcggagccattgcttccgcgataacgtactgtctaaaacactcgcgaagggcaagggtcggagggagggtagattcgccgtccggtgaccggggcgttcgaggggcctctcgggaatatcgccggtgtgggctcgggctgagcccgcgtgtgctactgagcagcgtgaggcatcatgcagctactaagctgctagtggacccatcttctttcgagaattatcggggccaagggcggcactccactcccaaccccatctggcaatcttccgaccccaagggtcaccagggcatcagaatgcctgttcgggtgacagcggcgcgattgcatgctagcgcaataagctgccggcgcccggctgcatcacagctccattaaagagagaacatacatactctcgtatggagcaacacagggctcaggcagatgaattcaaccacatgcctgccatgtctgtggtccgacgagctcgcatggttacgtcaccagcctggtaaccctcgcnnnnnnnnnnctgcatgctagcgaaataagccaccggcccccggctgcatcacagctccattcaacagagaatatactatcgtatggagcaacacagggcacaggcagatgaattcatccacatgcctaccatgtctgtggtccgacgagctcgcctggttacgtcaccagcctggtaaccctcgcccctcgttggccgcttgcgagctgaaaatcggctctcaaacacatttcatgcctcgtgtgtcgccgaggagccaatgctgcggtcctgagactggtgcgacacgggggagatcggcccgcttgtgaccccgggttgccgttgtagggatagaagcagcaggaacgggctgggtttcaaacctcaccgacaaggcagggccctgcgctcttttcggatcgcttggaggatcatctctcttctctcttaccacgcagcaccttggtccctcttcccctcgttggtccagaaatattcaggccgtgcgcgctctcccttcccgcttcctcctcgtaccactttaactctgccgaagggcgcgattattcatctctctgcctacggaaagccgtcagcacgcaatttggttgtgggagtatggcacgagacacccccacggtaacggcgggggatccgcgaatgcatgcccggctgctcaggctgccagcatgctggcaggtggatcgtgtctccacccccctccatctctctctcgacagagcacctgaaatcttctcggcctggcacatttacctgtggaccgcgtgggtgaagggagctgggggatgaattgccaatccattggggcagctggccccaaagcctctcagcagccacagacccagggaagccccccctccgatggcgtaacgtacactgattgggccggggtcccatctgcgcagctctcaacagggcaaggtgtgtggagggagtgaccagggagccctaggcttgtcccagctgcaaagcagcttccagnnnnnnnnnncctgggccggggtcccatttgcgcagctctcaacagggcaaggtgtggagggagtgaccagggagccctgggcttgtcccagctgcaaagcagcttccagggtgtcctatctgcagcccagagtgctccacctcatccagggcccctcctcctcaaacccaacaggctcctgggctaacgcccctgaaattgacgcccaatcccctctcaacttcttcacggatggtcaagcgtatggcctgcaggggtatggtctccccacccagagtctacagctcccctctcagatggaggaggcagacaggaactgtgcgtctggtccaggcaacaagaccctgtacctgggtgagtgcatggcatgaacagtctggattcaggattgtgggcttgagttgatggggcattccaagcaagcctctactctgatgcatttgcagggctgttcagctcacagcctctcatcgctcacccctgcaatccgaagtgccaagtacagacattcaactttgatactccaactccccctcccgctttcaggcaacttgcaccctttcatctcggaagccatgcttcacgacgtttttgctgggtgtcggggcgtgctggagctcaagatcatcaaggacaaggccaccggcatcccggcagggtatggctttgccaagtttgtaggtgagagtctttagccgggtttgtgtagagcggcggcgcaggcatctgttgggcagtggtgcgtctatgctgatgcatgatgccnnnnnnnnnnttatggctttgccaagtttgtaggtgagagtgtttagccgggtttgtgtagaggagcggcgcaggcatctgctgggaagtggtgcgtctatgctgatgcatgatgccctgactcgactcggaggctgccctgtatgtcgttaagggggtgctgggcccacctgctccaggcaatattgtggggcaccctgccgacaggggctccatcatccccacggcaccgatctttcatctccagttccccgtcgcccgcaatccacacccctgtccgttcgcccaccccctcgcagannnnnnnnnngcagaggctgccgcacaccctgtatgtcgttaaggaggtgctgggcccacctgctccaggcaatgttgttgggcaccctgccgactggggctccatccttcccacggcaccgatctttcatctccaattccccgtcgcccgcaatccacgcccctgtccgttcgcccaccccctcgcagatgccgtgtctgctcaggagggcctggatctggtgggcaagcccgtcctctttggccaggaggtccgcatcaactgggctttccagaaggagcagcgggaggagctcggaaaccacgtacatgtcttcgtgggtgacctggcggctgacgtcacagatgccatgctcgcggcggtgaggggcccctggctgtgggttggacatggctgggggtgtgagaattcgactgtgaaatgggcggggcaggggggatggatccggggtgcggaggattgaacccgttggagcatgggcgggaggaggagcgccaccccggcggcaaatgccatgcttgcctgttagtgaatgaggaatggaaggggtgacatcacaggcagccgtgccccttgcttttagaagttggccatcactgcagcgagacggggctgcatgccatggaatgactcccgtatcatctgcatgccgccccgtcctctgcctcacgcattgcctcagcgtccccacccttccattcccacccatcagtccnnnnnnnnnncttagaagtcggccatcactgcagcaagacggggctgcctgccatggaatgactcccgcatcatctgcatgccgccccggcccctgcctcacgcactgcctcagtgcccccacccttccattcccacccatcagtcccctgctccgagcgttcatcaaccctcctcaactctccaactgcacaggcgtttgaggtttatcctgggtgcagtgatgccagggtgatgtgggaccatgccagtgggcgctcccgtgggtatggattcgtgtcttttgcaaccaaggctcaggccgaggccgccatccaggtgtgtgctgctgcgccggtcgcgtggtttcgtaggttatgtgtgtcggggatggggggtgtctgggcatggttgggggcgacgggcaagtttccgtccagaggacgggtggagggaggtgggggtccgcgtgtgagaggggggcggagtgctggtgcagtgccactgggcgccctgctggcttgcctccctggaagaccgccttcgtcccaggcggcccttctcacttgaacaccacgcaccaaggaaagcatggccatctccgcagggccagcacgggcagaccatcggctcgcggcgcgtgcgctgcggctgggcgcagcacaaggtgggggagagcgcggcgccggtggacgcggctgtgctggaccgctccgaccccaccaacaccaatgtgtatgtgggcaacctggacgtggcgctgaccgactccgagatccggcgccacttcagcagctttggcgcgctggcagagatgaagctgcatcgcaagggcgcatacggcttcgtgcggttccgctcccacgccgacgccgtacgcgccatcgtcggctccaacgcccaggtgtgtgttgtgttggggggaaagggcggtggaggggggtactggtggtgtaatgagaccttagtgcacgtgtgtgactctggtttgagagtggaaacgcaactgcctgaaaccctgggaccccacagttctcgctcgcnnnnnnnnnncgtgtgtgactctggtttgagaggggaaccgcaactgccccaaaccctgggaccccacagttctcgctcgctccctaccccacatatgcctgcaagcccaacccaaccctcaacacccccctgccatagccgctgggcagcaaggtgctcaagtgctcctggggacggcaccccagcctgcccccctccggcctgcactcccacctgctgctggccacgggcgcggggctgaacccaatgctgcccctggccctgtcggcccccgccccaggcatggtgtccggtgggctgggctccggcctggtcaaccccatgctgccggcgctgccgccggccatgaaccactccctgctcccgccctaccagccccccgtggtacactacggggggctgggcgggctggacggtgagggctccacccagcgcatgctgggcctgcagggggagggcgccggcgccccgggcggcggcatgcccctgggacccgaccccagccgcgagggcggcgggggggcaggacagccctacgccggcggcggccagcccggcccctccctcggcgctcccggcgcctacaacccaatgtttttctatagttgattgtacgttcatgtcaccctctcttttgggtggcgcaggcccgcccttgacacatatgccctccgtcctctctctccctcattccccctttccctccccccatccccactccaccccaccccacctgcgacgtagatcctctgctccctgctcgatctctttccatctagattgcaacgtgtcccgccgtcccctccccgagccccgccaaacccctcccggggcgctgagtgcacggggcacgccaacaccatgtctatatgaggctgactgccgagctctgatcccatgccattgttctctgctcgcgggggcggcgcagtccggccccacaccccacccccccgcgcctccccactctccgttccgctctcaggccctctctctccccgggctnnnnnnnnnnccaaacccctcccggggcgccgagtgcactgggcgcgctaacaccatgtctatatgaggctgactgccgnnnnnnnnnncgggcacacattgcacccttgtttcacgctgggccacagccggcggacgccgactcggtccccccttgcccgtttgcgaggggcccagcccacccgcgccggccgagacaggctgcgcgtgggaagcgtgggaaccccatgcactcccccatctctccnnnnnnnnnntgggcacacattgcacccttgttccacgctgggccacagccagcggacgctggcttggtccccctttgcccgtttgcgaggggcccagcccacctgcgccggccgcgacagggctgcgcgtgggaagcatgggaaccccatgcactcccccatctctcctttccctcattccagcactggatcacagatggttgaagtttgtcccacccccatgcctcttcgcattctttccgcgctcgacgcgtcaggcgtcgtgcgcccgaggcacgcagggcggcgctctgggtcgacccagctgtggggccggtgccactggtccagtattttccagcacagcctccttgagtacttgcacattcagatcaggctgaacgatttttcctgccaccatggtatgcttccagacatgttatagatggcagccgggaccccgattgagatgtgcatgatggaagggggaagtccacagcgaattgcgcatgactgtaggggaggccaagggatcccaccatcgtgaaggaggaggaagtcaagcacgcaacagcataaggctgtgtgctattgcctgtaccgactggagtccgacaggcggtggggggtgtcctgaggnnnnnnnnnnaggagatgtgcatgatgggagggggaagtccacagcgaactgcgcatgactgtgggggaggccgaggggtcccaccatcgtgaagaaggaggaaatcaaccacgcaacggcataatgctgtgtgctattgcttgtaccgactggggtccgacaggcggtggggggtgtcctgaggaaggatgaaggacaggtggggccagctgccgtgcttcatgctgattctccactcccaacctcatatccctgcagtttcaacccgcctgcccggcaaggtcacccacgcgcccaggaacccgcgccactgcttaagggatacccaaattgcatagtgtggtaaaaccaatggttatgttgggaataaacgttcatccgcgcgctcaggcagcttnnnnnnnnnngcactggttaagggatacccaagttgcatagtttggtaaaactaatggttatgttgggattaaacgttcatccgcgcgctcaggcagcttcgcgaggtggcaacccctcgcaggagctgtccggcaacagccgcccccttgtcctccagcatcgcagtagcgggagccagacgcgcggggcgagggagcaccaacgtggaactcccaccatgcaaaaaccctccaggagacaccagcgcgtgagcgcccaggtttcccagcccctcgccccctcgacctcccacgatccgtatgagcggctcatgcaggtgagatccccctggaaaaagctctgtgtaatgttggactgctgtgatcacgactctatatggagcgagggcacccacttgagttctcctcctctattcaggatgctgaggcctttctgtggaaggatcttgaacacctctttgacgaccaagggatcgacagctcccgttatgaagaggctgtgaacttttcagacccgatctccaaattctcctccctgcgaggtcggtccctgctgccggatcagaatcatctggaactagttgggaggtggtgatatgcgtggggggatctcgtccctgggtctccatcattggaacggtgagctgaggtcacaggcagccctcgtccccagctggtttttccaatcagtaagcagggccaaggcacccccctctccccgcgcctcgccaccagaccatgctcaccgctacccccaccccaggctacctggcgaacatttccttcctgcggatcgcgctgagtcccaagttccacttgcacgacatcaggaggactggaccccttgagcttaccacccgatggacgatggacatggagttgtctttcaatcggtgggtgtgtgcgacgtggctcgccatagctggggataaaagtcaggggtcggtttgagctagcagggtaatcctttcatctctccagcctgcgtactattatgttgcctgggtcgtcaccctactccctcatgcatgcatcgcacgaggtgcctctgacgctcctctgtattcactacctccccaggttcaaccccctcaagccctggtacgacccaaagccgnnnnnnnnnnttccttccatctccccagcctgcgtaccatcctgttgcctaggtcgtcaccctactccctcatgcatgcattgcacgaggtgcctctgacgctcctctgtactccctacctccacaggttcaatcccctcaagccctggtacgacccaaagccggtctttacgggcacctctatcatgacagtgaaccctgacaccggtgagggggccaagatggggttgaatgtgtcgcagatgggccgcagctcagcctgagattgtgcttgaagcannnnnnnnnncacgggcacctccatcatgacagtgaaccccgacaccggtgagggggccaagatggggccgatgtgtggcagatgggcggcagctcagcctgagattgtgcttgaagcaggcctggacgcctatgccctgtatgcacacatgggggctcctgactgaagccacttcgcatgagctcttgccagccacctacgtgcccatccccatcccatgcagggaaattcgtttcccacatagatacctgggacgcggtgagcaaccagtcctacctctcgctcgaggccgtgcggcacctcgccagccaggtgggcgggtgtcatgggctgggaagcacagcgtgtgagcatgcagattccccagccagcctgctgcaccctcgtccctccctgctccccaacctccccaggtgctgacgctgcgccagaccccccaggatctgaccacgcccagctacctggtcctgaagaagactccgcggtacgaggttcgacagtacgagggctttacggggcttgagacacgggcaggcgaggcccagggccaggccttccagaggctggcggggtacctgggcgggaagaacagccagggcaggaagctggccatgaccacacccgtgctcacggatgacaagggcggcatgcgattcgtcgtgggcgcagacgaggctgtgagtgggggcaaggaggtggggacgccttgattgggagattcgggtggtgttggcagggaggcatgggcgcaggcctcatggcgacgtgcatgtcgcgctcctctgggccgcaaatcctctgcatgccatccctgacccgcatcnnnnnnnnnntaagggcggcatgcaattcgttgtgggcgcagacgaggctgtgagtggggggggggggggggnnnnnnnnnnacgccgtgattggaaagttcgggtggtgttggcaggggggcatgggcgcaggcctcatggcaacgtgcatgacgcgctcctctgggccgcatatcctctgcatgccatccctgacccgcatcccacgccagggcgaggatgggagggacctgccgcaggcatcggacgagtccattcgcgtgacgggcagccctccccagatccagggggtggccaccttttccggcgcagccaaccagactctggcggcggccaaggctgccgagctgaggaatatcctgcgagaagacggccataccccggctgacgcgacctcgtggcagctcgcgcagtacaactcccctctcgtgccggggttcctgcgcaggaatgaggtgctgatatccctgagcgactacaaactctggtagctggnnnnnnnnnnagacaagtccatccgcgtgacgggcagccctccccaggtccagggtgtggccaccttttccggcgtggccaaccagactctggcggcggctaaggctgccgagctgaggaacaacctgcgaggggacggccataccccggctgacgcaacttcgtggcagctcgcacagtacaactcccctctcgtgcccgggttcctgcgcaggaatgaggtgctgatacccctgagcgactacaaactctggtagctggcttgagggactggtgtgcatgtatacttgattctttcgtgcagctgtcacctgctcgccagcaacacctttgattggaagtcaacgtcccaagtcttcatgcacgagcgcttggcagcctttgtacagttgaactgacaattacaaatacggaagaatggggccagcagggactaatgggtcgcctggcaggagtacgacaaggggcaggttcagagcaagtgtgtgtgtgcgcaggcaggcagcaggggagggtgagcgtcacgatgaggggacggccagggggtgatgaccgtgcccaagaggactagcttgaggacggcacgctggcgagggaggctgtgagattggcaagcaagatacgaaccagtgnnnnnnnnnngctggtgtggatgtatacttgattctttcgtgaaggtgtcacctgctcgccagtaacacctttgattgtaagacaatgtccaatgtgtccatgcacgagcgcttgcaagcctttgcacagttataatgacaattacaaatagggaagaaagggggcagcagggactaatgggtcgcctggcaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtcacgatgaggggacggctagggggggatgaccgtgccttagaggacaagcttgaggacgacacgctgacgagggaggctatgagattggcaagcaagatacgaaccagtgctcggggctattgatgcgtgcgtgtcctcatgtgcgcgcccaggcaccgcatgcagttgcccaggtggtcccacaggcagcgctggccggcgggggagatgtagtgcgacacgaggtcgtgcaccctgcagccattgaaattgaacctgtggcgtggaggggttgggagttctggggcaggggggaggaaagagcagccagggtgctccgtgtggctggaggctcgtgtctgcactgtgacgaggcacaggatgtgaccacgctcctgtcatacatgggagaacctgcaggccccgccgggtgcagccaggtcgagcacatgcagccaccggcctccatctattcttctccatgccaccccatcccccgccctcccaccatccaatcaccgcggcccctcacctctcgtctcgctcgtagttgataactccgccctcgtccgctgcgacacgctccacccactcccccaccgccacgtccnnnnnnnnnntgtgtattcactgtgacgaggcacaggatgtggccacgcttccgtcatacatgggagatcctgcaagccccgccgggtgcagccaggccgtgcacatacagccaccgccccccatctattcttctgcattacaccccatcccccgccctcccaccatccaannnnnnnnnncaccccgccctcgtccgctgccacgcgctccacccactcccccaccgccacgtcctccagcttgaacaggggcgggcgcacgaggcgctcgacgccgcgcgccaggtcggcgctgagcacgtagcccgcgccgtgcgcccagggtgggtagcgatcgccgggccactcctcaggcgtgacgtgccagcgggagtggggatcacggtgcgggccgccgcctggcctctccacgaagcccaggaagaggcgttcggcgggcgcggcacggatgcggtccagcagcggcgccacgcgcacgtaggagtcgtcgtcggccttgagcacgtgcgtggccgcccggtcgtgggccgcggcgcgcaaggccgccagcgtttggtgcgtgatgttgaagtaggactcggcgacgtcgcggaggagggtcacatcgccgtggcgcgcggcctcggcctccacctgaagagagggaggagggggggaggggagtgccagagtgtggggaaagcaggcggggcggaggaatattctggctttgtgtttcttcacagaacagcagcaaagaccacattcgccttgggcctcaccatcccgggccctgccgtgccccgcagcccccacgtgccacacacacctgctgcagcgnnnnnnnnnnttattttggttttgtgcttcttcacagaaaagcagcaaagaccacactcgccttgggcctccccatcccgggccctgccgtgccccgcaggccccacgtgccacacacacctgctgcagcgtggccggatcggccggcgcggcgagaaagaagcggacggcgtgcagcgcggggtgggagccccaggtggctcggatcgcgtcgcgccgcgcttgctccgcgcccttggataggacgcccacgaagaggaccacgtcgtccgggggggcggcgtcgcccgccgcctcgctcactcccgccgcctcgcccgcccccgccgcctcg

SEQ ID NO: 49060 - DNA, 61 bp, Chlorella protothecoides
cgcgggcgtggacgtggtggtgggcacgcccggccgcgtcatcgacctggtggagcagggc

SEQ ID NO: 49061 - DNA, 61 bp, Chlorella protothecoides
cctcctggtttgatttccttatagtggcgggatatttgccaatgtgcactcctgcagcacc

SEQ ID NO: 49062 - DNA, 74 bp, Chlorella protothecoides
tccccacgtctggtgatgacgtgcccatgtgggagggtggtcactgtacacacccatgcagcttaccatccgcg

SEQ ID NO: 49063 - DNA, 80 bp, Chlorella protothecoides
ggatgattcttctgtgaatttgctttagctatggtcgcaaggtatcgcgttcgacgcagaagatgcttgtcgcggaaatc

SEQ ID NO: 49064 - DNA, 61 bp, Chlorella protothecoides
ccagtgcctgaagcggggcgatgactttcgcgagatttcgccgccccagtctgaccccctc

SEQ ID NO: 49065 - DNA, 77 bp, Chlorella protothecoides
gggttgcagcgaggagtgccggtgccagcctgtaggacaggcctggcggggccgctcgtcagggtgcccccaagatc

SEQ ID NO: 49066 - DNA, 61 bp, Chlorella protothecoides
tctatgcgtggctggggctggatgtgaaggtggccgtgcagaaagagtctctagattacgc

SEQ ID NO: 49067 - DNA, 61 bp, Chlorella protothecoides
acctcgtgaccgaccttggcagcggccaggtaaggtggggtttgtgggggatgaagaaccc

SEQ ID NO: 49068 - DNA, 61 bp, Chlorella protothecoides
tcaggcagtccctcctcggcccccttctcgaccaccagccagtccccaccctggacaggaa

SEQ ID NO: 49069 - DNA, 61 bp, Chlorella protothecoides
gcgcccactcctgcccagcctacgcccgcgtccactcctgcccagcctgtgcccgcgccga

SEQ ID NO: 49070 - DNA, 61 bp, Chlorella protothecoides
acgccaggtactgctgggtggggtatgccgtgggcgagcaccccacgttgatggcggtggg

SEQ ID NO: 49071 - DNA, 71 bp, Chlorella protothecoides
gatgccctgggagagtggaaaggcaggggggtggggggtttggggggctgacccagggagcattgtgtaag

SEQ ID NO: 49072 - DNA, 140 bp, Chlorella protothecoides
ccagcgtcctgaaggattggtgactggtggacctttgagaggacgataggttggacatgacgggtgcttgtactgccaatgtccattgtgctgaacaaacatgcattgcggaatgggagggccatcatccacctccgcca

SEQ ID NO: 49073 - DNA, 80 bp, Chlorella protothecoides
aaggccgagctacccaacccttttgcggtcagtgcggcagcggagggccggcgttgctccgccgtcccccgcccgggacc

SEQ ID NO: 49074 - DNA, 70 bp, Chlorella protothecoides
ggatcccgggacgggctgggggcgcctggcgctggggatagctgggtgaccgccgcttcctccattccgg

SEQ ID NO: 49075 - DNA, 73 bp, Chlorella protothecoides
agtcatggcatgtcctgccaagctggccgggtgccaacggggattcctctgatgatgatcccaagcacacgat

SEQ ID NO: 49076 - DNA, 63 bp, Chlorella protothecoides
gggcccctgctccggccgccaggccctcgtgttgggaaggaaggtcggcatctcggggatgaa

SEQ ID NO: 49077 - DNA, 61 bp, Chlorella protothecoides
gggtcggtctgccagaagcgccgcagctgcaccccgccagcccatgggtccagacggcaca

SEQ ID NO: 49078 - DNA, 536 bp, Chlorella protothecoides
  modified_base (476)..(485): a, c, t, g, unknown or other
ggcgcggcacgtccccggcgcccaggcccggcagcgcgcacgccacgccggcggcctcgccgctgcgctcgccgggggccgcctcgccgggggtcaagacctgcgagaactgcgggaccacggtgggtggacggggtgggtgggctggtgggtcactgcacgcgcgggacgacctgactccatcctgcgcggtgatttcttggccatgcaggagggtgctgcgagggtgtgggtggcccgccttctcaggcccattgaaccccctggaaatcctctgcacacgacccattgcatccactccacacagaccacgccgctgtggcgcaaggaccgccaggccaacatgctgatgtgcaacgcctgcggcatctactacaagaaccacggccggcaccggcccgtggagctggtggccgcgccggcacgcgcggcgccggggtcgaacgcgctttccacccggacccagccgcccgtcnnnnnnnnnncgagccccctggaagtcctccgcacacgacccattgcatccactccacaca

SEQ ID NO: 49079 - DNA, 61 bp, Chlorella protothecoides
aggcacctggatccataatcagggtccatgaccccgagccaggatgcggaagatgtatcat

SEQ ID NO: 49080 - DNA, 110 bp, Chlorella protothecoides
cctctcgatgccccttgacccctgccattttgaggcccgtgctgcagtacctcaccttcacgccgtctatatatgtatccagctgcgtcccggaggtggtgaaggccacc

SEQ ID NO: 49081 - DNA, 63 bp, Chlorella protothecoides
cgcgccgccaaaggcggtgggaggtggtgcgccggcgccgaacagcgagggcgtgctgctggc

SEQ ID NO: 49082 - DNA, 69 bp, Chlorella protothecoides
ggccgccattggaagcaggatcttgccaagcctgagattcgccctcaagggatacaagaggtgcgtttg

SEQ ID NO: 49083 - DNA, 69 bp, Chlorella protothecoides
acttcatcgtgccctcccggtgcgagaaggggggggcccgggtgaagaaggggcgggattggtgccgca

SEQ ID NO: 49084 - DNA, 69 bp, Chlorella protothecoides
ttggctgggcatatgaaattggaggttgaacacagcacattgcctaccattgaggaacttccttgggga

SEQ ID NO: 49085 - DNA, 61 bp, Chlorella protothecoides
acacgcttgcgctgccagatctcatcgttggggatgcgccgaggtcagacgcgagcatgca

SEQ ID NO: 49086 - DNA, 101 bp, Chlorella protothecoides
actgcgcctaggtcgcgggaagaaagtgaggatgggaggggcacccgcacgtcgctgatgcttcttcggcccgcgggcgcggacccggtcgtggctgggtg

SEQ ID NO: 49087 - DNA, 113 bp, Chlorella protothecoides
cagggcccaagaagcctggcgcagcatttaatatggtcgaagaggttttgtagtcgaatattgatgcccttgattccccatttcaagccatctctcgaagagacgctgcccaa

SEQ ID NO: 49088 - DNA, 61 bp, Chlorella protothecoides
agaaggacatccccgaggacgacccacgcaaccccgccgtcatcgccgacaacgtgggcga

SEQ ID NO: 49089 - DNA, 66 bp, Chlorella protothecoides
ccccctccagcctcgtaccatgtcacgcagctcccgcagggtcaggcgcagcgtggcctggtggtc

SEQ ID NO: 49090 - DNA, 78 bp, Chlorella protothecoides
gcgcccagcactctcttcgttcagacgccctgcgtcagtggctccactccccagaccgtggcagcccaccccacaggc

SEQ ID NO: 49091 - DNA, 61 bp, Chlorella protothecoides
gtgggtacgaggccgtccagaggtaggcggggggcgggacggagcgggatctgggtatatc

SEQ ID NO: 49092 - DNA, 61 bp, Chlorella protothecoides
ggggggtcctctcgcccgccgcagggtgactgtgacgctgtagccgttggtacgccaatgc

SEQ ID NO: 49093 - DNA, 13359 bp, Chlorella protothecoides
  modified_base (1654)..(1663): a, c, t, g, unknown or other
  modified_base (3112)..(3164): a, c, t, g, unknown or other
  modified_base (4233)..(4242): a, c, t, g, unknown or other
  modified_base (4384)..(4488): a, c, t, g, unknown or other
  modified_base (4652)..(4692): a, c, t, g, unknown or other
  modified_base (4847)..(4907): a, c, t, g, unknown or other
  modified_base (5105)..(5227): a, c, t, g, unknown or other
  modified_base (5593)..(5602): a, c, t, g, unknown or other
  modified_base (6179)..(6188): a, c, t, g, unknown or other
  modified_base (7524)..(7533): a, c, t, g, unknown or other
  modified_base (8218)..(8227): a, c, t, g, unknown or other
  modified_base (8465)..(8474): a, c, t, g, unknown or other
  modified_base (8894)..(8903): a, c, t, g, unknown or other
  modified_base (10022)..(10091): a, c, t, g, unknown or other
  modified_base (10504)..(10513): a, c, t, g, unknown or other
  modified_base (10883)..(10892): a, c, t, g, unknown or other
  modified_base (11443)..(11452): a, c, t, g, unknown or other
  modified_base (11810)..(11819): a, c, t, g, unknown or other
  modified_base (13162)..(13213): a, c, t, g, unknown or other
ccgccccagccgcggccgcggctggggcggcggcgggggaggacgggcaggctcacgagccggccgcgccccaggtggcgcaggggagctggcaggacggcggcggcggggatgcgcccgcgccgcaggaaccggccggcagggaggaggagggggaaaccgcgcaggccgccgccctgctggcggccgccgccgcgggtggctacgactgacggtcccgtcgcccaggaacgagaccgcgtgcacaatcgagttaccttgccaaagatgcatccatgagctgtgaaactgaaggatttccacgtgctgcttggcaataagatcggggaggggggtgaaggggtgggtggcaggtgccaccccacctacaggccggcagagagggaaaggcagcgtaggtttcatggccaagtcgaggcaggccttgaggtggtcaccagggagaaggctgctgtcagtttgcacaggaattcagccggatccgtgcagtaccatgtccaacgttcgcctgaattctgcccatgccttcaagggaccgcggtagaaaggacgaagaagcgcggtcaagaggcagaggctgccaggttttaaaagcgccaggaagaagatggtcgggctggagatgaggcttcaagcgcaccattcctcgatacctgaacctaccccatccacacacaagctcgctcactcggcgccatgacggaggcggcacagctcaccgacgagcagatacgagctggctgggggggatccgtgtgggggtgggggaggtgcggggtcttcccgtgagccaatgatttacctggaatcatccttattgcacgttgcagagttcaaggaggcgttcgccttgttcgacaaggacggtgagtgttcacgggcagggacagggtcacagatcaccagaacacgctgtctgatcaagccagccacctgtcaccgcctgtcccgcgaacgcatatctcacatcctttcgcctttttcactgcaggcgatgtgagtatccgctccccggggtggaccgtgaccgagcaactgtgggatatgtcctgggggggttgcaggcgcacacaatggcagcatgcgccggttcttcactcatacatgatcccgtgaatccaatcttctaccaggggaccatcaccaccaaggagctgggcacggtgatgcgcagcctgggccagaaccccacagaggccgagctcaaggacatgatcagcgaggtggatgcagacaagaacgggaccatcgacttcccagagttcctcagcctcatggcacgcaagatgaaggactcggacagcgaggaggagctgagggaggccttcaaggtcttcgacaaggacggcaatggcttcatttcctctgcggaggtgggttggcatgggttgtggagggcttggctggggctattatagtggaggcagtgggtaggagccctggttgggatacaaacaggggagatcaagctcagggcatggcataggaatagctgcctccactctccggctgcatttaccctggttctttgagacaagggggctagtggtgacgactttcacacttgccacccgtcatccgtgggtcgcggcagccctatggcttaccgacagtcttctcgtcctctcatcattataatttgccatgcagctcnnnnnnnnnncccgtgggtcgcggcagccctatggctcaccgacagtctcctcgttctctcatcattataatttgccatgcagctccggcatgtgatgaccaacctcggcgagaagctcacagacgaggaggtggacgagatgatccgggaggctgacgctgatggcgatgggcaggtcaactacgaggagtttgtgaagatgatgcttgccaagtgagggcctcgccccaatcgtcaatgtgctggcggtgggctgcggatccgatggtgaacgatgccctcctgacgatcaccaccccatgacacacatcttcaaggcccgtgtgtctgaaagcgacactgccatgtgtactgcgtagttctggtgtaagcttgcacgccatcactggggggaaaggacgtgggcagaggaggggagtttggaaaggtctgtctggggctgcccccgttgcccactgtccaaatcgaggtaacgcaggaaatttatctccgcgcccagatcatcagcatgcagtcgtaagggggaccgcgtgttgccaaggagcatacacggtgcatcgtgaaagcgggagatgcccctagcgtgatggtgggggtgaacatggttctgaagggaggtcgaacgccagtgcctcgccccagccttgcaccgtcgtccctacgatactgcccgccagagacctcgtgacaggccttccatgcaccgcactgaaccttgcagattagtccttggtgggccgcgggagtggccgtcccggcattgctgctcagggccacaaagggtggccggaaacccacccccgatcgtgcgggtactgccaggcacgtcgggtgccggtgttgtggttggttccatccgtcgatgccatcatggcagctgtgaaatgataccgatcatgcctgacacgccatgcaggctggactcgacgggctctgatcccagctttgtgtgcgagcgggtgtgcacctccgaccggctcatgagacggctaggcggcctggccaaggtgagaactttggggagggggtgcgcatcatggggcactgcaacacgccctccatgttgccctcggcagcctctgtgcttctgcaacaacctccacgctgcttttcccacccgcccatacaggatgccaccccaaacacgtgcgtcacggtgtgtggcacgtcctcccaggacgcctgcgccagcgcgtgcacgcgctccgtctgcaccaacctccaccaggtcccggcctggaacgatacctgcatcgagcgctgcagcagcgagtgcgtgcgcgggcgcagcgcctgacccctggcggcccccgtgcggcggcgccccctttttattccctcccctcgccagcctctcacatgcaacgctggcaatgcacagttgacaacgagcgcacatgatggatcgagggggagctggcggcatgcgtgcataggggggggggggggccccccggnnnnnnnnnnnnnnnnnnnnnnnnnnnnnnnnnnnnnnnnnnnnnnnnnnnnncaggcacacctgcgccccctgcgccccagagcacccctcactcctccgcctcgcgcccctgcctcgacttccgcgccgagcgtcgcagcgagcggcggatgccccgttccgtgggactcatgtccagggacggtgaggggtggctggcggcgggcctgctcccaggtgcgcagacctccgccccaccccgccggcgcgccgcgctgcgtgtgatcgaccccggcgcgcccctgccttcctcgggggagctcagtggggcccccgcgcgacgccgggcctgggaatgggggggggtgaccaggggctggtcgctgaggggggggaggtcgtcctgcggcagcagcgggctgtcgccctgccggccggccgtggcatcctcgccgctcagggggagcatggggtttgggactgcgttgggattcggaggtggggacgtgagggtgtggaatccgaatccctgcccagaggcatggtcgacaggcgcaacgatcactatcaggcgcgccaggcgctcagcatgtggggagtcgacgccctcaccgtacgcatagtctgtggcggcgagcgcggccgccgaggccgtgctcgggtcgctgtcccgtagcttcctggcagatctccgcaccggggtggcagcctgggggtgtagggagggaattggtggggatggcagagggacggggtcgcagccatgctggatgccagctgggggtggaatccgcgcacaagttcatgggccagctggggccccgaaaatgtgcaggccccggctcagagggtcaagtatcgacacggccagggcgggtcccagcactggtccctcaccccagaatcaacagtcctcgtcagcacgcaccatcctctggccggtggcgccctgcaccgcggcgctggccctgaccggggtcagcaggggcagcgtccccagcagcggccgggtggcggccgctgccccgccctccagcctcaggtccgccagcagcgccgacagctcccggcggccggcctgcaggccccgcggacccccctccggggcacgcgcgtcctcggcggcggcggcggccacgcnnnnnnnnnncagggcccccgagcccgggggtgcctcggccggggcgcagggtttccagtgtggggaggggcggcgccgaggacgcctggtggtggtgggacgtggcgtctgggtctgcgctgaccgccgcagatccctggctcctcgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgctgtctgtggggcctctgctgcgcctgtcggggagggcgtccagcccccccccgcgccaaacaggtcggccgcgacgccggcgccgtcggggctggcggaggccgcgccgccgcgccgcggcggcgcgccccggaagatcgtgacggtggcgggcggggannnnnnnnnnnnnnnnnnnnnnnnnnnnnnnnnnnnnnnnnggcacgccctgcccgtctcgctccacgccgtccgacaccctttcctcctcctccggcccgccgccgcagaagcgccacgcgtccggcgacagggcctccagcggccaggagcgcaggctgggcgtgggcgaggccgcggggccccgcccctcccnnnnnnnnnnnnnnnnnnnnnnnnnnnnnnnnnnnnnnnnnnnnnnnnnnnnnnnnnnnnnggccggcgggggggggaggcgaggtcggaggcgggggcgaggcggtgggagggggcgatacggtcggaggaggcggggccgtccgaggggccggcgcgttcggttgcaaccagtccggccgagtgcgcgtcgcttggccctgccacgccctcgccacggcacctgcctgcgcgccccgcctcgcccgtgagcagtacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgtcccgccccggctcgggcgcgggcgggggcgagggcgtcaggccgaacgcgccgttggcccgccagccggcggccgagggcgccggccccgccgcgtccccggcgcggccgccgcggtaccgccccgtcagcacctggatgctgtcggaggtggagccggtggagagccgctcccaggaggggctgtccaggggatccgcgccctctgcgcagggtcggtggggtgaggtcgggtgtcgcgccgtggggtgcatggagcgaggggggaaggttgaggtcgagggagcggtactcctgctcaggacgaggcccctcttcccgctcgagccgcggcctcagacatgcactagatcgctgaacctnnnnnnnnnnagcggggtgaggtcgggtgtcgcgccggtgggtgcaaggggcgagggggggaggttgaggtcgagggagtggtactcctgctcaagacgaggcccctctccccgctcgaggcgcagcctcagacatgcactagatcgctgaacctcaccaccggacccctccccacaccgtgcgcttgcctggccagtcgttggtgcccaggctgccctcctcatcctcggggacaggcccatacttgctgaccaggcggtggaagggcgtgctccccgcctcactggggcccgtggaggagcgccggctgaagcggctgggcgccagggaggagggggtgccgccgccggtccccgtctcggaggccgggctgaagaagcgcaccctcctcccgctggccgccgcagggtgggtgggggagggtgcgccgccgaggtcctggcttcctgccgggggaggggtggcgccgaagcacagctgcttggcggctgggtcacgtacgacctcgccgccagcatcgctgccggcgccggcccccgaggcgccggccacgcccagccgcgacccggcgccgggcttgcgcacnnnnnnnnnnccgctcccggcgccgtcccccgaggcgccggccacgcacagccgcgacccggcgccgggcttgcgcaccgaggccgaggcaaaggccaggcgcttgagcacgtcctcgaagccggtggtggggcggggctgggcgggggggttgtgcgggctgaggggcctggaccctgccagtctaaccgcccggcccttcagcccggagcggaggggggtggcgccgcgacgcgcggcggcgggggagcctggaggttgtgaggtgagggtgaacgtgggaaccagggttgttgtcgtgcttacaccacatgggcacccggcacctcctgacaccagggcttggacaaagccctgtgccgcgccacccccacctgggtgtggagcggcgcccttgagctgccccagggcggcatcgatggccgaggcaggcctggcatcgcgggccctcccttcctgcagcgcctccatggcggcctgggtgtccggagatgagtcgaggaaggagggtgaggcatcgttgcagaagatacttgcatgaggatgcatcacacggcttcgctcatgccagccctagcacacccgccccaatggctcctgtctgtggcccgcccacctgtgtgtgtcctgcctcgacgtgcttagccgcccgctccgtccagtaagcggcctgggtggcgttgggcagcaccgccaggccctgtgctttgagcgcatgggggtcgtggtgcctggagatcagggcggccgagggggcatggctccctgcctgggcccctgcatgtcacaagagggtgcagactgcttttcttagccaggggaaagggggtgcggggtgtgcaggcggtgaagcgatgcacgcgctcgatgacctcggactccccagccccattggagggtcgtcctgcttgaaatcatgcacccacccgacgctgccgggacgcggcccacactctggtggaggttggtcgctgtgatctgcaagagacacatcagtgtggctggaatgagcagggatgcagggaacaagacagcaccagccatgcatgggtgtaggttggtttgctgagtgtcgcctcaatacccccctcccctccctgcctcaccccagcagggacttcggggtcccaggaggttgtcaagccctggttccagtcgggaaggtccaggccggatgtcatggcctcagcgagtctgcttatcccggattgagcctccgaggcacctgcctctgggtggggtgaagctcggatttctcgactatcaggccacaactagcgaggccggcagtaacgagtggatgaatggcttaaaggtgggcttccgacggaggcagcaaggcgtgnnnnnnnnnntcccgattatcaggccacgaccagcgaggccggcaggaacgagtggatgaatggcttaaatgtgggcttccgacggaggcagcaaggcgtgaaggggttctcgcaagcgaggcgacaggagcgcagctgttgcttcgccaaaacgaaaccccaagaggaaagcggggaagcgcgattcatcatggggggccccggaagacgcacattcctgagccaggtgctgcacttcccgcactcccaccgggggatggtaatctgtgccgcgcctgaccatcatgaccgagccggccgatcccgaggttcgttctcctttgtcgactgccttcccatcgcccatccccctatctctcgctcctgctcccccgcaaccgccgattgatatgctccgtaggttgaaaccatgtacgacgacgcccccgagacctctgaacccgccaaggagccggcatcgggggctgcggaggagccgagtgcggctcccactgctgcgcaacccgatgagggcgatcccctctccctgccaccccacggcgccgatgtctttgttgggggcgtgccccgcacggccacgtcggatcagatacgggattgggccagcaagatcggagaggtgggtgctagcgctgaggtgggtatgttcttctcaccgagcataaactccaacagatgcaggcaggggcgcgcnnnnnnnnnncggtgggtctgtacttcttaccaagcaaaaactccaacagatgcaggcaggggcgcgcttgtgagagggggcctgcatgatctcgtcagcgagggatctcagggaggaggtttggactcggcgccccagcactccatgcagcctgctgctcgccgtcttcccgagttgacggccatgcgataccgcacggcaatgctccgatgtggagagaccagcgataccgacacgccaaacccannnnnnnnnngttcccgagttgatggccatgcgataccgcacgccaatgctccgatgtggggagaccagcgataccgacacgccaaacccacgctcactcctccccgctgcccctcccagccccacgcccttccaccctcctctcccccacacggtctccaatccaggtacacagcgtcaccttggtcccagacgtgacggaccctacccagaaccgagggtatggattcgttgtgtttacaacacgcgactcagccaccgccgccctggcccagctccacagcacggagctgccggaccaccccgggttcaaggtgaacaggggttttgcgaggattatgagtttcagtggttgttgtctgatggaaggggcggggttgggaatataatgagcttgcgagggtggccagcgtggcagccctggacccannnnnnnnnnccaggggttttgcggggatcatgagtctcagtggttgttgcctgatggaaggggcggggttgggaatctaatgagcttgccagggtggccagcgtggcagccctggacccaggtcggggggcgcggctgccgtcgcctgcacccgagtttgattgctggatggggcctcccccgaaccgcccacacccagctcctcccccctacctccctccaatacaatacactccccaggtgcgggtgcagcccagccagagcaagcaccgcctgttcctgggcggccttcccaactccctgacccaggcggagctgcgcgccgtgctggagccggcgctgcgcgggctggagggcgtggagctgatgatgagccgcgagaacccggagtccaaccgcggcttcgccttcctcgacatgtacaacgcggcggcggccaaggccgcgcgtgccgtgctctccgcccccgacttccgcgtcggcggacgcggcgtcaccgtggactttgcagagccgtcggcgcgggggccaggggccgaccgcagcgccgcggcaaagcccgccccctcgcgcaacgtcttcgtcggcgggctgcccgccggcgcgggggaggacgcgctgcgggaggcctttgcgcgcttcggcgctgtggaccgagtgcatgtaccccgcccccgcgacggcgaacccgcctccaagtttggcttcgtgacctttgcggagcgcgaggccgcgaccgctgcggtggaggccggcgacgaggtggaggtggcgggcgagcacgtcaccgtgcgctacggccgcagcgagcctggcggcgcccggggccgggggcggggcggcggcggcgggcgctacggggcggcaggctatgcggacatgggcatgggcgcggggcaggggggcatggtacccctcgtccccgtgcaactggccaacggacaggtgcatcggaaggggggaggcacggcttcgtggcgcccgtgtgtttcagatgctggcgggttttcccgagcgagacgcgctccctgctattgctcaagcggaacggcctcggtctcatcttccatgacaccctcgatgggtcgatcaggccaaccccccacccagtgaatttaaccccccccnnnnnnnnnnnnnnnnnnnnnnnnnnnnnnnnnnnnnnnnnnnnnnnnnnnnnnnnnnnnnnnnnnnnnnttgggtacatgatgcagccgggggccttcatgggcggcaacatgatgatgatgggcggcggcggcgggtactataccacgcagcaggggggctggggcggcggcggggatggtccgcagcgaggcaacggtggcggagcgagggggggaaggggccagtcccggtatagaccctactgacattcgccagcgcatgcccgctgtctgctggaccgaggggcgggtgctgcaggctggcgccctcctggcggctcagcgactgtctagtccgagcagccaccgctcgggcaacctcccgtgggcttgccccgcacccccgaggcgcttgacccccatgaatcctggtgccatgccacacttgactggagccctgccactgttaagtcatcccccgcgtgcaccctcttcgtgacnnnnnnnnnnttggcgccttcctggcggctcggcgactctctagtccgagcagccaccgctcgggcaacctcccgagggcttgccccgcacccctgaggcgcttgacccccatgaatcctggtgcaataccacacttgactggagccctgccactgctacgtcatcccccgcgtgcaccctcttcgtgacgtgcacgcggagcaggggcatcttgtaagcatgccaatgagtcgcacacagaggcacgcatgggaggatggtgggccctggcacatggaggcccctggccgacactggcccactccaggggatcccgtaaggcatggatccgaaattttcactcccacgccattgtcatgagccctgtcgccggagtgannnnnnnnnnggcaggggcatcttgtaagcatgccaatgagctgtacacagaggcacgcatgggagcatggtgggccctggcacatggaggcccctgggcgacactggcccactccagggggtcccgtagggcatggatccgaattttccactcccacaccattgtcatgagccctgtcgccggagtgacgcggcgatgattggatttgcgcatcgcggcggattgcctggccatgatctccttctttccagggaagatttggcgatgccatacagcgggggtgattcggatgcctgaagggtggccgatgattgtgtcgtgcacaatgccgctacaaccccgcaccgacacatcaccagcttgcgcagtggcgcggcgccagcgagtggatgtgacacaccggccaggcgcctgaacgggcttcgcacgagatggctcccggagcggggacgggttctccgcaggtgggccccgggacacctcgcatgcgtcaatgcagaatcgtaatgcaattcctgctgcaataaggaggtagcctgtgtcccgcaggtgccggaaannnnnnnnnnccgcatgcgtcaatgtagattcgtaatgcaattcctgctgcaataagaaggtagcctgtgtcccgcaggtgccggaaacggagtccaacctgacctctgcattggagggcctgcgacacacctttgtcgtggctgatgccaccttgccggactgccccctcatgttcatcagcgaggggtgaggcgctagattcaagaccaaattgcgtgtgctggggaggatgctttttgtgtggagtcaccgaaccgtgcatgagtgtggtttgttgttgtcgtggtctcactgtgcgcgcaggaaccactaagcgtgtgaattatatctggggacgcacggaatggcaacaggctcttccctccnnnnnnnnnnccgtggtctcactgtgggcgcaggaaccactaagcgtgtgaattgtatctggggccgcacggaatggcaacaggctcttccctccgctctttcttggcaggttctctgcgctgacggggtattcttgtgaggaggtgctggggcgaaattggtgaggacgggaggaatgtgtcttcgggtgcctgctgggttgccgcggggtctcgtgcgatgtctgggagggtggcctgtgtcaataggcaacgagggtaaaagccgcctgctgtgcattccgccctcattgtcatcgatgcagggtccctgccagcacacctattgccttgccgcccctccccgcctggctttacgctccttcgtctgcctcatgccgcatcctgtgtacccccttggctgtctgtctgccaccctttcagaacattcaaacctcaccccaaggcccattcccctcttccctccccgcagccgcttcctgcagggcgagggcaccgaccccaaggccgtgcagcggctgcgccaggccgtgcgcggcggcaaggccatctgcacgcgcctgctgaactaccgcaaggacggcacgcccttctggaacctgctgaccatgactcccatccgcgacggttcggggcgcgtggtcaagttcgtgggcgtgcagatggacgtcaccagccgcaccgacgcgcggtggctgagcgaggagggcgcgcgcagcgagggcacggcctcggaggaggaggcggtgccgcacctgatccgctacgacgagcgcctgcgccgcggcctggccgcgcccgtggtgggcgaggtggtggcagctgtgcgtggccgcgaggccgcggcgggcggcgggggcgtgggagggggcgacgggggcacgggcggggacgctgtgggcggaccccccacccccacgcggctgccgtcgccgccgcggcgcgcggagggcgcgctgccgcgcgtggcgctggacctggccaccaccgtggagcgcatccagagcaactttgtgatctcggacccgacgctgcccgactgccccatcgtgttcgcctccgacgacttcctgcgcctgtcggggtactcgcgcggcgaggtgctggggcgcaactgccgcttcctgcagggccccgacaccgaccgcggccaggtggcggagctgaaggccgcgctccgcgaggggcgcgaatgcagcgtgcgcctgctcaactaccgcaaggacggcagccccttctggaacatgctcaccgtggcccccatccgcgacatggcggggcgcgcgcgctttctcgtcggcgtccaggtggacgtcaccgcgcaccccgaggcggagcgcgccgccgatggcnnnnnnnnnnnnnnnnnnnnnnnnnnnnnnnnnnnnnnnnnnnnnnnnnnnncgcggtgaacgccgcggtggcgggactgggctggggcggccctgccaccgcccccggcgccgacccctgggccaagttcccctccgcgctgcggccgctggggccgcacgccgccgcgcgcgacgggggcgcggctgaaacgctgc

SEQ ID NO: 49094 - DNA, 70 bp, Chlorella protothecoides
gcaggagggggaggacacggaggacgccgatggtgacgaagagggcgcggcgagtgggagcgaggcggct

SEQ ID NO: 49095 - DNA, 61 bp, Chlorella protothecoides
gatggccttggccgtgtggcgagaggctgcaagcccccccagcttgatcgcagacgctcat

SEQ ID NO: 49096 - DNA, 61 bp, Chlorella protothecoides
tggccatcatcgcagccgtgtcgacggggggggagtcgctgcccatatcccagcggctgga

SEQ ID NO: 49097 - DNA, 61 bp, Chlorella protothecoides
cgagggcgaggccctgggcttccccccgcccagcccgaggtcgggcgccggcgccggcaac

SEQ ID NO: 49098 - DNA, 72 bp, Chlorella protothecoides
gttttggggggggaggggatcgcctgggtggaggaggggaccgttttggggggggaggggatcgcctgggtg

SEQ ID NO: 49099 - DNA, 61 bp, Chlorella protothecoides
gcgaccagcgaagggcgctggaagcggaggggaatgagcgccatgccagcgtagtcgcgca

SEQ ID NO: 49100 - DNA, 61 bp, Chlorella protothecoides
taaaaatattttcactatttaacgaattatgctctttattttgaaacccatcaacgaataa

SEQ ID NO: 49101 - DNA, 61 bp, Chlorella protothecoides
agggcgagaagatcgccctgagccggcggggggagaagcactggcgcctgattgggtgggg

SEQ ID NO: 49102 - DNA, 61 bp, Chlorella protothecoides
ctcacggccgagatggcgtgcatggcaggggcggcgatatattttatttgcacgggaatgc

SEQ ID NO: 49103 - DNA, 61 bp, Chlorella protothecoides
caggagcaccgactggatgttggggagcaccccgccctcggcgatggtcacgccggcgagc

SEQ ID NO: 49104 - protein, 4 aa, Unknown
  Description of Unknown: 'KDEL' peptide motif sequence
KDEL

SEQ ID NO: 49105 - DNA, 22 bp, Artificial Sequence
  Description of Artificial Sequence: Synthetic primer
tgttgaagaatgagccggcgac

SEQ ID NO: 49106 - DNA, 20 bp, Artificial Sequence
  Description of Artificial Sequence: Synthetic primer
cagtgagctattacgcactc

SEQ ID NO: 49107 - protein, 364 aa, Chlorella protothecoides
MHQASVSTMKTIQSRHAGPIGHVQSGRRSAGRAGSRMATPVAAATVAAPRSALNLSPTIIRQEVLHSASAQQLDCVASLAPVFESQILPLLTPVDEMWQPTDFLPASNSEAFFDQIGDLRARSAAIPDDLLVCLVGDMITEEALPTYMAMLNTLDVVRDETGHSQHPYAKWTRAWIAEENRHGDLLNKYMWLTGRVGHAGGGAHHPAMLAVERTIQRLISSGMDPGTENHPYHAFVFTSFQERATKLSHGSTARLAVAAGDEALAKICGTIARDESRHEAAYTRTMDAIFQRDPSGAMVAFAHMMMRKITMPAHLMDDGQHGARNGGAQLVRRLCGSGGAGRGVHRRRLHRHPAPPHPALGRGG

SEQ ID NO: 49108 - DNA, 1292 bp, Chlorella protothecoides
atcaaaggcatagattcacatttgttggcattgcagagcaatcatcgcgcaggacgaacatcgctcaccaagcacgtactgggcatccggaggcctccgcaaattcctgcaacaggactcgctgatcagttcgcccaaggtctacgacgctccctatcggcgctagacttcaacacatatttcactgtcacagcctcggcatgcatcaggcctcagtctccaccatgaagaccatccagtctcggcacgccggtcccatcggacatgtgcagtcgggtcgccgatcggcggggcgcgcgggatcccgcatggcgacccccgtggccgcagctaccgtcgcagcccctcgctcggccctcaacctctcccccaccatcattcgacaggaggtgctccactccgccagcgcccagcaactagactgcgtggcctccctggcgcccgtcttcgagtcccagatcctccccctcctgacgcccgtggacgagatgtggcagcccaccgacttcctccccgcctcgaactcggaggcattcttcgaccagatcggcgacctgcgggcgcgatcggcggccatccccgacgacctgctggtctgcctggtgggggacatgatcacggaggaggccctgcccacctacatggccatgctgaacaccctggacgtcgtgcgcgatgagacagggcacagccagcacccctacgccaagtggaccagggcttggatcgcggaggagaaccgccatggcgacctgctgaacaagtacatgtggctgacggggcgggtgggacatgctggcggtggagcgcaccatccagccatgctggcggtggagcgcaccatccagcgcctcatctcatcgggcatggacccgggcacggagaaccacccctaccacgcctttgtgttcaccagcttccaggagcgcgccaccaagctgagccacggctccaccgcccgcctggcggtcgccgccggggacgaggccctggccaagatctgcgggaccattgcgcgggacgagtcgcgccacgaggcggcgtacacgcggaccatggatgccatcttccagcgcgaccccagcggggccatggtggcgtttgcgcacatgatgatgcgcaagatcaccatgcccgcccacctcatggacgacggccagcacggcgcgcgcaacgggggggcgcaacttgttcgacgactttgcggcagtggcggagcgggcaggggtgtacaccgccggcgactacatcggcatcctgcgccacctcatccggcgctgggacgtggaggg

SEQ ID NO: 49109 - DNA, 1155 bp, Chlorella protothecoides
atgtcaattttttcatggattgaagacgaaaaaaatttaaagttacttaacgcacctaaatccggccaccgcccgggagatttaagcttatggattcggtgtgaaaactgtggggtcattttatatattaaacatttacaacaaaataagcgagtttgttttggatgtaattaccatttacaaatgaacagcatcgagcgtattgagcgttttattgatgcaggtacttggaggccaatcaatgaaacaatatcgtcttgtgaccctttaaaatttaaagatcaaaaaaaatatagtgaaagattaaaagaatcgcaagaacaaacaggattacaggatgctatacaaacaggaactggctttatagaaggtattcccattgctgttggaattatggattttacttttatgggtggaagtatgggttctgttgttggagaaaaaattactcgcttaatagaatatgcaacagcacaaggacttactttaataatattttgcgcgtctggtggtgcccgtatgcaagaaggcatcttaagtttaatgcaaatggcgaaaatatctgctgcgttaaatgctcaccaaaatactgcaaaacttctttatattccaatattaacttcaccaaccactggtggtgttacagcgagttttgcgatgttaggtgatttaatttttgcagaaccaagagcccttattgggtttgccggccgtagagttattgaacaaacacttcaagagcaattaccaaaagattttcaaacagcagaatatttattacatcacggtttaatagatcttatagtttcaaggttttttataaaacaagcaattgctgaaacaattattttatatcaacaagctccaacaaaagaattagggcttcttgcttttaaagagcgtcatcgtttaacaatttcgcaagaagagcaattacgacgtttagtagagaattcatccaacttaaattttagtggtttaatgaaatcgttttttcatttagttactggtaaaaaagaagaaaaaacaggattattaaaattaaaacctttgccgtttagtaaagcttttaaaaaagttcctaaagttaataagtataaacgtgttaaatttttaattccgaaaactcctaaatctgatataattgatgtgtaa

SEQ ID NO: 49110 - DNA, 846 bp, Chlorella protothecoides
atgaataaacaagaaacaactagtttccacaatttaccgtttttaaaaaaaactaatccaaaattacttataggagtaatgcttggaaattatgtattttttatattagttcttccactttttgctctattttcattaatttttaaaaatagttggagagaaattttagaaaaagcattagatcctattgcaatttcggcttatgcttttactattaaaatggctttaacagcagctcttttaaatagtgtttttgggtttttaattacatggatgatcactcgttatgaatttaggggtaaaagatttgtagatgctgcggttgatttaccttttgctttaccaacatcagttgcaggccttactttagctacagtttatggacaccaaggttgggttggtaattatctaaaaatggcaaacattcaaattatttatacaagatttggtgtacttttagctatgatttttgtatctttcccttttgtaataagatcattacaaccggtattacaagaatttgatcatggtttagaagaagctgcatggggtatgggtgcaagttcatttcaaacttttttgcgggttatttttcctacattggtgccagcattagttaccggatttacattaagtttttcgcgagcattgggtgaatttggttctgttgttatgatttcatctaatcttccattagatgatttagtaacctcagttttaatttatcaatcattagagcaatatgattattttggagcgtctgttataggtgctgtaattttacttcttgctttaattattatttttttagtaaatacagcacaatctttctattctcgtcgttaa

SEQ ID NO: 49111 - DNA, 2387 bp, Artificial Sequence
  Description of Artificial Sequence: Synthetic polynucleotide
atgggtcttccttggtttcgtgtacatacagtagtattaaatgacccaggtcgtttaatttctgttcatttaatgcacacagcattagtttctggttgggcaggttcaatggccttttatgaacttgcagtttttgatccatcagatcctgtattaaaccctatgtggcgtcaagggatgtttgtattaccctttatgacacgattaggtgttactcaatcatggggtggttggactattagtggagaaacagcgaataatcctggaatttggagttatgaaggtgtagcagcatctcatattatattatctggattattatttgcagcttcaatttggcattgggtttattgggatttagaacttttccgtgacccacgtacaggaaaccctgctttagatttaccaaaaatttttggtattcatcttttcttatcaggtttagcttgttttggttttggtgcttttcacgtaactggtttatttggtcctggtatttgggtatcagatccttatggtattagtggaagtgttcagcccgtatcaccatcttgggatgctacaggatttgatccttttaatcctggtggagttccggcgcaccatattgcagctggtattcttggtatattagcaggtttgtttcatctttgtgttcgacctccacaacgcctatataatggcttacgaatgggaaacatagaaacagtactttctagtagtatcgcagcagttttttgggcagcttttgttgtttctggaacaatgtggtatggttcttcttctactccagtagaattatatggaccaacgcgttaccaatgggatttagggtttttccaacaagaaattgaacgccgcgtacagagcagtattggtagtggaaaatcagcaacagcagcatggtctgaaataccagaaaaactagtattttatgattatattggaaataatccagcgaaaggtggacttttccgtacaggtgctatgaatagtggtgatggtattgctgtaggttggttaggacacgcagtatttaaagataaacagggtaatcaattatttgttcgacgtatgccgactttctttgaaactttcccagttttacttgttgataataatggtgttgttcgagctgatgtaccattccgtagagcagaatcaaaatatagtattgaacaagtaggtgtttcagttactttttatggtggtgaattagatggtgttactttttctgatcccgctactgttaaaaaatacgcacgtcgtgctcaattaggtgaagtttttgaatttgatagatcaactttacaatctgatggtgttttccgtacaagcccacgtggttggtttacttttgcacatttaatttttgctttatttttctttattggacatatttggcacggcgctcgaactattttccgagatgtttttgcaggtattgatgctgacttagacgaacaaatcgaattcggtgcatttcaaaaacttggtgataaatctacgcctcgacaatcaatataaaataattttaggttgattaaatattaatttgtgtgtttaacataaatttttattatataaaattaaataaacgttttttttacttaagctaaaaaatttaagtaaaaaaaacgtttatttatattaaaaaattaaatatataaataagcagttaatatggaagcattagtttatacgtttttattagtcggtactctaggtattatatttttttcgattttctttagagaacctccacgcgttcctggtaaataatgttggtgttatttaaataaaaaatctattttatgaagattaatattaaaagaattcttttaatattaatcttcatgctcttcaaaaggatctctcaattcttgcgaaggtgggccaaagcctatataaattgaataacctgtaatggttataagtaaacaccacaaaaaaatagtaataaaaatagctgaattttccataatttttttccctaatacattatatattaataataaatacccacaaaatcgaaaaatttcaataaaatttaaactcaatatttaatttgtaaattcacataaaaatatagaaagtaaattaaatacaatttttatttaaaattatggcaactggaactacatctggcagaaaagcttcaaatacacaaaatattcaacctggcaaaataacttctttgggaacactactaaaacctttaaattctgaatatggtaaagtagccccaggatggggtactactgcaataatggggatttttatgggattatttgcagtttttcttgtaattattcttgaaatctacaatagttctgttcttttagaagacattactgtgagttggaaataaaaaataaaaaaaagat

SEQ ID NO: 49112 - DNA, 1115 bp, Artificial Sequence
  Description of Artificial Sequence: Synthetic polynucleotide
cacgtccaccgattaccaaactactattaaagagcgtttccacgtggtaaaacctcctctgggaatactaatttttcatgaggctgatcttgagcagccatccaagcacgaataccttcattcaaaagaatattttttgtataaaaagtttcaaattctgggtcttcagcagcacgaatttcttgtgaaacgaaatcgtatgcacgtaaatttaatgctaagcctactacaccaaaagcactagtccataaaccagttactggtacaaataacataaagaaatgtaaccaacgtttattagaaaacgctacaccgaatatttgtgaccaaaagcgatttgctgttacaaaagaataagtttcttctgcttgagttggattaaacgcacgaaatgtgtttgcaccgtcgccatcttcaaatagagtattttctactgttgcgccatgaattgcacaaagaagcgcagctcctagaacaccagcaacacccatcatatgaaaaggattcaaagtccagttgtggaaaccttggaagaataaaataaaacggaaaatagctgcaacaccaaaactcggtgcaaaaaaccaactagattgacctaatgggtaaattaaaaatacagcaacaaaaactgcaataggtgcagaaaatgcaattgcgttatatgggcgaattttaactgaacgtgcgatttcgaattgacgaagcataaatccaattaaagaaaaagcaccgtgtagtgcaacaaatgtccaaagacctccaagttggcaccaacgagtaaaatcaccttgagcttcgggaccccataaaaataataaagaatgccccatactattagcgggtgtagaaacagcaacagttaaaaagttgcaaccctctaaataagaagtagctaagccatgagtataccaagaacttacaaatgttgttccagttaaccaaccacctaatgctaaatatgcagtagggaataataatagacctgaccagccaataaatacaaaacgatcacgacgaagccagtcatcaacgatatcaaaccaaccacgtttttcttgattttttccaattgctatagtcataacgagactatctccttgtaataatttatg

SEQ ID NO: 49113 - DNA, 1410 bp, Artificial Sequence
  Description of Artificial Sequence: Synthetic polynucleotide
acagatacagatacaactaatttagaacaaataagacccgtttttccttttaccgctattgttggtcaagatgaaatgaaactagctcttattttgaatgtaattgacccaaaaattgggggcgttatgattatgggtgacagaggaacaggaaaatctactactgtacgcgcgctagtcgatttattaccagaaatagagagtatagaagatgatccatttaattcagatccgcatgaccttgaattgatgagtaaagaagttcgagaaaaaatacaaaaaaaagaatcattatctatcattaaaaaaaaaatttcgatggtagatttgccgttaggggctacagaagatcgtgtttgtggtacaatcgatattgaaaaagctttgacacaaggtgttaaagcttttgaaccgggtttattagcaaaagcaaatcgtggtattttatacgtcgatgaagttaatcttttagatgatcatttagtagatgttttattagattctgcagcttctggttggaataccgtggaacgagaaggtatttcaattagtcacccagctcgttttattctcgttggctctggaaatccagaagaaggtgaatgtagaccacaacttttagatagatttgggatgcatgctcaaataggaactgttaaagaaccccatttacgtgtgcaaattgtagaacaacgagctgattttgatgcatcacctttaaaatttagaaatatttataagcaatcacaagaacaactagcaaatcaaataattaaagctagagagttgctaccggaagttcaaattgattatgatttccgtatcaaaatttcgcaaatttgtggagaattggatgtagatggtttacgcggagatttagtaacaaatcgagcaagtaaagctttagctgctttttatggtcatactaacgtgaatgaaaaggatatttttaaagtaattccgctatctttacgtcatcgattaagaaaagacccgttagaatctatagattctggggataaagtacgtgaagcctttaaacgtgtttttgggtataattaaataacttgacaaatctttttattgataagtattaattaataaaaagatttgtcacgggcttatcgtctaatggataggacaggaaccttctaagtttctaatgtaggttcaattcctactaagctcaaattcaattttaaaaaaatttaataattattaataaaaatatgttataataaaattatctgtagcctataaattaaaaactaatttttaaatacatgttaactttaaaaatttttgtatatactgttgtaacattttttgtttcacttttcatttttggatttttatctaatgacccgggcagaagtccagggcaaaaagatattgattaatttttctatt

SEQ ID NO: 49114 - DNA, 111 bp, Artificial Sequence
  Description of Artificial Sequence: Synthetic polynucleotide
atggctgcacaatttttaccaagtatattagttccattagttgggcttctttttcctgcaatagctatggcatctgtgtttttatatattgaaaaacaagaaattaattaa

SEQ ID NO: 49115 - DNA, 1487 bp, Artificial Sequence
  Description of Artificial Sequence: Synthetic polynucleotide
tttaattttacaatgatgaacctaatcctacataagatccataaaaaaatgttcctaataaccccaatacaacaactcccccaacagttccaataaaccataatggaatacgaccggttgtgctagtattagacataaaaaaatctccttttttttaaaggaccccaataaagtactaactggggttaatttgtgaattaatacgtcaattttactaaaaaatataagtaataattaataaaataaactaattgaaaatataacttgaaaacaaaactgctaatacaaaaattaataataatccccagtataaactggttctatttaattctacagtttgtttattaggatttggttttgccataaaataatataacctttttcaattttacctaaataatataaatattatttaacgttgaataaattgcatagccgtaatagcacctaaaaagaaaactgtaggtactgctaatgcgtgtatagcaagccaacgtacagtaaaaataggataagtataggattttcttgctgtcatatgataaaaattctaattattctttaaaattagaaatttttaaatttctaatttaaaggtatttgtttaattaacttgagataattgttttacttgatctaaagcgttaaaacgatccgtaatgagtggggtttcttgtcgatcttcagtaaaatactcacttggtcttggactgccaaaaatatcataagcaagacctgtactcacaaataaccacccggcaataaataaagacggaatggtaatactgtgaattacccagtaacgaatactggttaaaacatcagaaaaagggcgttctcctgtagcaccagacatgctataactccttataatttttttactataacaaaaagttttttctttctttttttagtataccaattttttcaaagagcttcaaagttttcaaattgttttaattcatttttatatttggcgaacgacggggtttgaacccgcgagtgatggagtcacagtccattgccttaccacttggctacgcccgccatgtattaattggagcggatagcgggaattgaacccgcacctcttgcttggaaggcaagggcactacctttatgcaatatccgcttctttttttaatatatatatatttgtattaaaaactacatttttaaaaaatcctaaaaatgtttaatactctctactcctcaagtatactaattaatagttgttacgataaaattaattagttaaaaaatttaaaaattttaggaaatcaaagctatgctttcaatttttcaattagtattatttagtttaattttactatcttttttcttagtggttggtgtacctgttgttttagctttaccagatggctggggtgaaaacaaacgtcttgttttttcaggtcttggggtttggttaatacttgtatttgctgtaggtattttaaattcatttgtaatttaatgcaatctta

SEQ ID NO: 49116 - DNA, 7212 bp, Artificial Sequence
  Description of Artificial Sequence: Synthetic polynucleotide
attattgaaaataaaagatttatttatataatgtggcacctaatcgtacagcaaaaagccctgtaactaatgctaaaaataatgctataaatatttgagaatctgcaagcgacataaattttaataatatttaataaatgctatttactaattttttaagctaaaattattggattttaatattaattaacttataaatttcctttacgactggcaagtaatataataacaagtgggccggccgcaataattaaaaataaacttgttaattgaaaaaatatttctaaattcatgatgtattttttaatttcgtaatttaataaaattttaggtgaagtaaaatataaaatttaaataatgttaaatttgtattagaaaaaagcttatattagtttaaataataatataataattttaaatatttactttaacgaaaacttactgacgcctgccaaacaaacgctaataataaaaaaaatacaggtataactggtaaaacgtttacaatagggtcgaagggagcataagcttcaggtaattttgctaataataacacgggaatcctccaaaataatatattttgagcaattgaattgtatgttcaaaactactattcaattttttacttaatttagtattattatgctagaaaaatatattttttaccaatgtttttaatactttaaatatttaattcaaaaataaaatcattataataaaaatataaaatattaataaaattaaaatattgtataaacataactataataatgtaaaataaaaagtagttgttcttatatacctataagatatatttctttttatagtacttattattttaagtatatactaatttttagtgatttgtaaaaaaaaattatgaaattagcgtattggatgtatgcagggcctgctcatataggtacattaagagtggcgagttcatttaaaaatgttcatgctattatgcacgcgcctttaggcgatgattattttaatgtaatgcgctctatgttagaacgagaacgcgattttacacccgtaaccgcaagtatcgttgatcgtcatgttcttgctcggggttctcaagaaaaagttgtcgaaaatattactcaaaaagaccaacaacaaaaacctgatttaattgtattaacaccaacttgtacttcaagcattttacaagaagacttacaaaattttgtaaatcgtgcatctttagaatctaattcagatgtaattttagctgacgttaatcattatcgcgtgaatgaattacaagcagcagaccggacgcttgaacaaattattagattttcagttgaaaaagcacgcaaaaataatgtattaaatacagaaaaaactattaaaccttctgctaatattcttgggatttttacattaggatttcataatcaacatgattgtcgagaattaaaaagacttttaaatgatttaggaatctcaattaatgaaattgttccagaaggtgggtcgattaaaaatttaaaaaatttgactaaagcgtggtttaatctagttccgtatcgagaagtaggtttaatggcggcaaattatttacaaaacgaatattccatgccttatgttggaataaccccaatgggtatcgtagatacagctaattgtattcgtgaaatttctactattattaaaaaccacaaccctgatatagaatttaatacagaaaaatatattgatcaacaaacaagatttgtatcccaagctgcgtggttttcgcgttctattgattgtcaaaatttaacagggaaaaaagctgtggtatttggtgatgcaacacatgcagctagtatgacaagaatattagcgcgtgagatggggattaatgtttcatgtgctggtacatattgtaaacacgacgctgattggtttcgtgaacaagttcaaggattttgtgatcaagttttaattactgatgatcatactcaagttgcagatatgatttctcgcattgaaccttcagctatttttggtactcaaatggaacgtcatattggaaaacggttagatataccatgtggtgttatttcagcacctgtacatatccaaaatttcccattaggttatagaccgtttttaggttatgagggtacgaatcaaattgctgatttagtttataattcgttcacattaggtatggaagatcatctattagaaatttttggtggtcatgatacaaaagaagctattacaaaatcactttctacagaatctggctgtagttggtcacccgatgggttagcggagcttaaaaaaataccaggttttgttcgtggaaaagttaaacgtaatacggagaaatttgctcgtgaacgaaatattactgaaattacagtagaaataatgtatgcggcgaaagaagttattggtgcatagtaattaaacccgtatgcactatttttttatggaataataaatataaaaatttagcttttattattaaaacatggttttatatttatctatttttttatagagtttaatttttaaaattttaaattagatcaattttaaaaattatttagaaagcaacaataataaatattataatttttttataattaaatatattataaaatagaaatttcaatcaatattatttagttagttgaatttaccctcgagagggaaaggagaatttttcgccatgacaattagccccccagaacgcgaatctaaaaaagttaaaattcttgtagatcaaaatcctgtagaaacgaactttgaaagatgggcaaaacctggtcatttttcacgcacgttagcaaaaggtccaaatacaactacatggatttggaacttacatgcagatgcacatgattttgatacacaaacaagtgatctagaagatatttcgcgaaaagtgtttagtgcacattttggtcaacttggtattatttttatctggttaagtggtatgtattttcacggcgcacgtttttcaaattatgaagcatggttaacagaccctattcatattaaaccaagtgcgcaagttgtatggccaattgtaggccaagaaatgctgaatgctgatgttggtggcggatttcaagggattcaaattacatctggatttttccaactttggcgtgcttcaggtattactagtgagcttcaattatatactacagcgattggtggtcttgtattcgctgcagctatgttttttgcaggttggtttcattaccataaagcagcgcctaaattagaatggtttcaaaacgtagagtctatgctaaatcaccatttagcaggtcttttaggtcttggaagtttagcatgggctgggcaccaaattcacgtgtctcttccaataaacaagcttcttgatgctggtgttgatcccaaagaaataccactcccacatgaatatatttttcatccagaatatcttgcacaattatacccaagttttggcaaaggattagtaccgttttttacacttgattggaatcaatatagcgatttcttaacttttaaaggcggtttaaacccaattactggaagtttatggctaacagatactgcccatcatcatcttgctattgctgttctttttattattgcaggacaccaatatcgtactaattggggtattggacatagtatcaaagaaattctagaagcacatagcggtccatttactgggcaaggtcataaaggtttatatgaaatattaacaacttcttggcatgctcaattagctattaacttagctttatttggttcattatctatcattgttgctcagcatatgtattcaatgccaccttatccatatttggcaactgattatggtactcaattatctattttcacacatcatacatggattggtggattttgtattgtaggtgctggggcacatgctgctatttttatggttcgtgattatgatccttataataattataataatttattagatcgtgttttacgccatagagatgcaataatttctcatttaaattgggtatgtattttcttaggttttcatagttttggattatatatccataatgatactttaagtgctttaggacgtcctcaagatatgttttcagatactgcaatacaactacaacccgtttttgcacaatggattcaaaacattcatgcgacagctccaggtttcactgctccaaatgtattagatcctacaagttttacttggagtaataatattgtagcaattggtgggaaagtagcaatgatgccaattccattaggtacagctgattttttagtgcatcatattcatgcttttactattcacgtaacggttttaattttgttaaaaggtgtactatatgctcgtagttctcgattaatccctgataaatcaaatttagggtttagatttccttgtgacggtccgggtcgtggaggaacatgtcaagtttctgcttgggatcacgtgtttttaggtttattttggatgtataattctttatcaattgctatttttcattttagttggaaaatgcaatcagatgtttggggtactgtaacagcaaacggcgtttctcatattactggtggtaattttgctcaaagtgcgaacactattaatgggtggttacgtgactttttatgggctcagtcatcacaagttattcaatcatacgggtcagcactttctgcttatggacttattttcttaggagcacattttgtttgggcttttagtttaatgtttttatttagtggacgtggttactggcaagaattgatcgaatctattctttgggcacataataaattaaaagtggctccagctattcaacctcgtgctttaagtattacacaaggtcgggctgtgggtgtagctcattatttattaggtggtattgcaaccacatggtcattcttcttagcaagaattttagctgtgggttaataaactttaacaatttagaggtttttgtaacctctaaattgttaaatgagtcgtttttttatttgttaaaatatatgtattagtgcaatctttttaaagattgcctttaataggagaattataaaatggcaacaaaatttccaaaatttagtcaagccttagcacaagatccaactacacgtaggctttggtatggtttagccacagctcatgatttcgaaagtcatgatggtatgactgaagaacgtctttatcaaaaaatatttgcatcacattttggccaattagcgattatatttctttggacttctggaaacctttttcatgtagcttggcaaggaaatttcgagcagtgggttcaagatcctcttcatatccgaccaatagctcatgcaatctgggatccacattttgggcagccggccgtggaagcttttacacgtggcggtgcttcaggtccagtaaatatatctacatctggtgtttatcaatggtggtttactattgggctacgaactaaccaagatttatataatggatctatttttttaattatactttcagcattatttctatttgcaggctggttacatcttcaaccttcttttcagccaacgctttcatggtttaaaaatgcagaatcgcgattaaatcaccatttagcaggtctgtttggaataagttctctagcttgggcaggtcatttaattcatgtggctattcctgaatctcgtgggcaacatgtacgttggaataattttctgactgttttaccacatccggctggattaactcctttttttacaggtaattgggttgtatatgctcaaaacccagatgcagctactcatgtttggaatactaatgaaaacgctgggagtgctattttaacattcttaggagggtttcatcctgaaactcaaagtctttggttaacagatatggcacatcatcatcttgctattgctgttgttttcatattagccggacaccaatatagaacaatttttggtattgggcatagtatcaaagaaattctagaaagtcacactcctccgtcaggaaatttaggtgctggtcataaaggtatttatgatactcttaataattctttacactttcaattagggttagctttagcgagtcttggcacaattacatctttagtagcacaacatatgtattcgttaccaccgtatgcttacttagcgcaagattttactacacaagcatctttatatacacatcatcagtacattgctgggtttttattaacaggtgcatttgcacatggtgctatattttttgttcgtgattatgatccagaagcaaatcgtggcaacgtgttggcacgtattttagatcataaagaagctattatttcacatttaagttgggttagtttatttttaggttttcatacattaggattatatgtacataatgatgtaatgcaagcttttgggactccagaaaagcaaattctaatcgaacctgtttttgctcaatggattcaagcttctcatggtaaaactgtttataattttgactttttattatcatcatcaacaagtgctccaagtattgctggtcaaaatttatggttacctggatggttagaatcaattaataatgaaagtaattcattatttttaaacataggccctggtgatttcttagtgcatcatgcaattgctttaggactacatacaactacattaattgggatcaaaggtgctctagacgcgcgtggttcaaaattaatgccagataaaaaagattttggttatgctttcccttgtgatggtcctggacgtggtggtacttgtgatatttcagcttgggatgctttctatcttgctattttctggatgttaaatactataggttgggttactttttattggcattggaaacatcttggcatttggcaaggtaatgttagtcaatttaatgaatcgtctacttatttaatgggttggcttcgagattatttatggcttaattcttcacaacttattaatggttataatccttttgggatgaatagtctttctgtttgggcgtggatgtttttatttggtcatttagtgtatgcaacaggatttatgttcttaatttcttggcgtggttattggcaagaattaattgagactttagcttgggctcacgaaagaacacctttagctaatctaattcgttggcgcgacaaaccagtagcactttctattgttcaagcacgtttagtgggtttagcacatttttctgttggc

SEQ ID NO: 49117 - DNA, 248 bp, Artificial Sequence
  Description of Artificial Sequence: Synthetic polynucleotide
tactgtaaagatttacgatacatgcattggttgtactcaatgtgttcgtgcgtgcccaactgatgttttggagatggtaccttgggatgggtgtaaagctagtcaaatcgcgtcagcaccgcgaactgaagattgcgtaggttgtaaacgttgtgaatctgcatgcccgactgactttttaagtgttcgtgtatatttaggtcctgaaactactcgtagtatgggattagcttattaataataatatt

SEQ ID NO: 49118 - DNA, 84658 bp, Chlorella protothecoides
gttcatcaatatcttttttagttgagttttcttcggaggttgattctggaatcataggttcttttattttttttttttttatttctttgagtttctctttttctaaacctttttgtggttgttcgttatttttggtttcttcctctttttctttaagtagtggttcttctacttgcaataataattgtttttcttttttagttactatttcttttatttttatcatagtgatttacctccataaataacttattgattttatttttaaaattttaagaaatttacatataatatactattaaaataaaataattgttattaaaaacatactattttcattgtttttagattacaaatcatttaagttcttattaatgataataaaaagaggtgcaatgttttacgttttttttatttaattttgctttttttgtgctaggagggagttgaacccccgactccatggttcgtagccatgtgctctagtccactgagctacaagcacgtacacgtacatctttaatatatgtacgtgtactaacaaattcaaaaaaaattaattatcagttttaatcaattgagaccaacctaatgttcctaaagcttgattccgacgtaatggtcgtgtgatcaattctaaaatatcccgagcatttgtaaatccatggatttgggcaaatgtaaactcaacagaccatttagtattaattcctcgcgcttctaacggattagcatgcgccattccagtaattgctaaatctggttggagttctctaatacgttggatttggtgataattatctggtttttctacgattcgcggcaaaggaacgttcattttcttgcacgttgtttctaataaagctaactcagcagcttggaaccgtttatccatatatggaattccaatttcataaacaatcataccacaacttattaagaaacgtgctaatgatatttctaaaagattatctcccataaaaaaaacagatttccctcttactaattgtaagtaatcttctaaactttcccaaatggcttgttctctttcttctagcccttgtggaattataccaaaaacagaagaaattttttcaatccaagctcgtgtaccgtcagggcctataggaaatggagcacaaataagtttgcatttttttcgtcgcattagtgtcgttgccgttctacttaaaaaaggattaataccacaaacataaacattttcgcctaaatgaggtaaatctaaataacgatgtgatggtagccaaccagaaacttcaatattatgtcgttttaattccatatttaactgatttgctactgtattaggtaaagatccgaataatactaatgaagggtgtttctttgtattttctgttaaagtttcagtgggacatcgatgaaccatagcagcaagaacagtatcttctccttgtgtaaatgcataatctaatccgttcgcccgtgctacaacaataggaattcctatttctgtttctaatctgggggccatcccttctaaatccattttaataatttcagttgtacaagtcccaatccaaacgattacactaggatttctatcttgttttatttctaaacaaagacgttttaattctttatagtcatttaattgagctgaaatatcgccttcttctaattcagccattgcgtacctaggttccgcgaaaatcataactcctaatgcgttttgaaggaaataaccacaagtttttgttccaattaccaaaaaaaagctatcttctattttttgataaagccaagctacacaactaattggacaaaaagtatgataattgccagtttcacattcaaaagttaggttatcagtcgaaaggttatttgtcataatttatagttattgaattgtaatctctttaaatattaatatttagatatttataaacgtaaattaaagtattattttttgataattttatcaattttaggatttatttaaatcattaaaaagtctaattcaggagaaacaggattacttggcgtttttttaatatttaaataaaaatctgataatagcgtaaaaagttcacgatcagccaattgattagcaacaacaccttcgggttgtgataataattgatctgctatattaagataataatcacaaatataattaaaattaggctctaattcagccatttcaaaaagagtttttccttgaacacgcgaaattctaatatcttcaatcagcggtaaaacttctaatacaggcattgggcaagcttctacatatttatcaattaaatcgcgtttggctgttctattaccaattaaaccagctaatcgtaatggatgtgtgcgtgctttttctttaacagaggctacaattctatttgctgcaaataaagcatcaaatccattatcagtaacaattaaacaataatctgcgtaatttaatggagcagcaaatcctccacacaccacatcacctaaaacatcaaaaagaataatatcatattcgtaaaatgcgttaagttcttttaataatttaacagtttcaccaacaacatatccaccacaacctgcacccgccggaggaccccctgcttcaacagaatctacaccaccatatccttgataaataacatcctcaggccaaacatcttcataatgatagtcttttgcttgtagtgtatcaattattgttggaattaaaaaacctgtaagtgtgaaagtactatcatgttttgggtcacaaccaatttgtaatactttttttccacgtcttgctaaagctattgaaatattacagctagttgttgattttccaataccacctttaccataaacagctaatttcataattataatatccttaaaagtaaatttgtaaataataatacagatcaattttattttaacaaacaatattaatagttgattacatgttttagtatataattatttaaaatattattaattaatatttaatatattattaggtcttgcttttttattttaaataatttataataaataaaaattaaattataactaaaaaaatatgaattttgaagcaatcgaaacagaattatcgcatggtaatctaataaccctatttttaactactgtctattattggacaaaatttttacgctacccaaaaataggatataaggttttcggcgtatttgggattttactttcaaatttttttataattagtcaactctgtttacgttggcatttttcaggacatttccctttaagtggtctatatgaatcattgttgtttttagcttgggtattactttgtttatatgcttttttagaaatttcaacaaaaagagagtttgctgcgttatttgtttcgccgttagttttacttatcgtagcatttagttattttagtctgccttcatcactctatcaattacacccgttagtaccagctttacaatctaattggttatttatgcatgttagtgcaatgatagtaagttatggggcattattattaggttctcttttttcaataagctatatatttataaatttttcttttaaacctcaagaatataaaactccacctgcaaatctaatcaaccaagatgagccaaaacctatatatgcaatgtataatagtaattaccctttacaaaaaaaaaataaagaaactcaattactttttttggataattttagttatagattaatcggaattggtttttgttttttaacattaggtattctttctggggctgtttgggctaatgaaacatggggaaattattggagttgggatccaaaagaaacatgggcttttataacttggttagtttttgctatatatttacatatgcggtttgttggtaaatttaaaggtataaaatcagcttgggtcgctagttttggttttattattatttgggtttgttatttaggtgtgaatttttttggtaaagggctacatagttatggattctttataacctaatatattttctatttatttaagtttttaaatatgtaagaaaactggtttttttttattaaaagatatataattaataaaaaggtagttttcttaatttatttgcatatttaaaacattattattatatttatttctgagatgataaattttaaaactcttcaataaatataaaatatataaaacattttaatgtttttagtaatttttctagtataataatctaactatattaaattttaatcaactggttataaaataaagtttaatacaattttatactataaaaagaagtaattaaaaaatgaattcaaaattattaataataattatttgaaatttctgtaaaaaaagatatataataaatataaaattttgcagaataccttaaaaaaattatattaggagaatataatggcagttcctaaaaaacgacaatctaaaacaagaaaaaatttaagaaaatcacagtggaaggcgcaagcgtcggtccaagcaaaaaaagctttagctaaagcaaaaactgtattaaaatcattattaaataaagaaaactaataatgattttaatgcagtttatttagaaaaaaataaaaatgagcgaatttttatgaataaacaagaaacaactagtttccacaatttaccgtttttaaaaaaaactaatccaaaattacttataggagtaatgcttggaaattatgtattttttatattagttcttccactttttgctctattttcattaatttttaaaaatagttggagagaaattttagaaaaagcattagatcctattgcaatttcggcttatgcttttactattaaaatggctttaacagcagctcttttaaatagtgtttttgggtttttaattacatggatgatcactcgttatgaatttaggggtaaaagatttgtagatgctgcggttgatttaccttttgctttaccaacatcagttgcaggccttactttagctacagtttatggacaccaaggttgggttggtaattatctaaaaatggcaaacattcaaattatttatacaagatttggtgtacttttagctatgatttttgtatctttcccttttgtaataagatcattacaaccggtattacaagaatttgatcatggtttagaagaagctgcatggggtatgggtgcaagttcatttcaaacttttttgcgggttatttttcctacattggtgccagcattagttaccggatttacattaagtttttcgcgagcattgggtgaatttggttctgttgttatgatttcatctaatcttccattagatgatttagtaacctcagttttaatttatcaatcattagagcaatatgattattttggagcgtctgttataggtgctgtaattttacttcttgctttaattattatttttttagtaaatacagcacaatctttctattctcgtcgttaattttatattgaatttagaaaattgtgtttttatattttgttatataatttattttaaattattcattaactaaaagaaaaagggtatatggctctttttactttttttattaaaaagaacttattatatatttagtatatgtcattaagtgaaaatattcgcgattatgttgaagtattagctggagttactgaaacgccaggtaatcctatcgagtttgaaaaatttatttcggaaagtttactttacgttttaaaaatatgtcaaacttgtattttacagtttttaagttttcaatggattcgtgattttagtctattacctataaaaataccagctttttatgaatcactcgttgggcaaacgcccccaggatctttatttgattttttagagattttacatgtagagcaaaatcctttattagttgggtttttaaatagtgcttttttcacgcttccattttctataatacatattatttcaattagaagattattaattcaaggaatcccagctgccgttttttcttttggtggttatattgctggtcaaattgtgtttattagttgtgttacttttggtatacaaggtataattattccatggttaacattagaaccgttaaactatattgctggcttaattcttgttgcgcgcattattttttcattacggtttgaaagtttacttgcattaaaaacttggcatcacccaaaatataaaaaattttttatatatagttttttaatggcatggtgtgagcaaggcgctatttttcaatttttaagtaatgtgactttttcagcaaacccaacaattttacaagggtttacttcgaatcatttagggttaagtattgccaataattttttatatataactggcattttacttggatctgttgtttttacaagcttctggatgtggttttttttaaaagtaaaaaactttgtacttgaccgtacgatgttttatactagtaaaattatatctgatattaatagagtttcttttatttgctcaatagctattagtttagcaactcttccttattatgcttataattatatattaacaggaccacttggttttgtttcagaagacgacgtttttgaatcgacaatatttagtcataattcggtaccagatatttctcctgaattcagttatattactgaaggaaaactgatggaattaaaactatttccttttaataggggtcaatatttagtttatccgggagaggatattacagtgagtatggaggaattatcttatcgatctgattatgcgtgggtgagaagagtggaaaaattatcattagatgtggtttctactcatattaaaggacagcgattagcagaaaatttaggatttaatagagtaactcaatctcaatcagagcgggttttaccacaagaaactccattgatattttatcgtcttgaattaaacaataagatgaaaaaaaatgataaaattcaggagattataaataatatatttgcaccaacttctgaatcatccactacatcatcttctgtggcttattctgcacctgcacataatgaaccaataacatttacggactacttaaaaaaacaatacgaagagttaggtattgagtatgatcctattaaagctaaaaagtatatagaaactgctcgagaggtagcggaaattcaacctattgttgaagaaaaacaggttactaagaaaaaaagaaaagttaattcagaggagccaaaagaaccccatcaagtaatacttgatagattttattactggtatgattttgaagatgttagtaccgatgaagatgatcgccttcagagcttcattataagaaataatgtacaaggtatgtatctttttcctcaagctttcattcaaaatgaagttactcttggtgaaatccatcaacaaatatcattacgtcttaaacagcaatataattcaagctggattttcaaaagtttattaaaattggatattgattgcttattaaatcgacaacctcgaaaatttcgtttaagtggagagcatgaatatgatttattagcaaaacgaaatattttagctaaatattatgattctttacgtttttatacaaaaatgccgtattcaaatatatttgaagaattttttagtggctcaaaaaacttaactagtcaagtttataatcaacaatttacaggaactttgcgaaatcttactaaatattttagtttaacagtagatgaagaattagattttagtaaaaataattttttagaatatattgctagtcatgattttgatttcttaaaagaagatgatcttcaattaatttgtgaagaggctgtttatgaagatgaggaagcggaagaaaatgacgaaacaaatgaagaggaaaatcaaaataatgacgaactaaatttaattaatgaggatgaaaatagtgttgaaagccaaactttagattttgcgaaccgtgacaatgaggtaactgttgcagaaaatgaagaagaggaagaagacggagaagatgaggaagcggaagaagacgaagaagatgaggagaatgaggaagatataatcaagatcctcagtaacaaccaaaatactggaaaatacaattatattgatgggttagaaaaaataaaacgtactaaattagttttaaaatttgatcaacctctttataaacttaatgattcagatattggtcctgagcctcacgaagaattatatgatttaattaataattctaataaaacagagtatgataatgttgctttggatgatcaatatagtttacctttatatgttgggtgggatgaagagtcacgaaaattaatgattactaacaaagcaataacaagaaaatttgctggttcatatatgtacgttactccagaatttataaaaaattctactactgatacaccaaatgaatatttatcgaaaaagcaatatcattcagtacatgcagaagctcaagtaaaaaattatttaaaaatacaatctttaaaaaaagaacaggcaaaccaactcatcaagtttacttgttggccacttgctgaagaggaatttaaaatacttccacatgaaaatacagtaccttatgttgtattaaaagaacgaaaagagcaagttgtaatcgaaccccaagatgagtatatggtagaactctttgaagctgttaaagataaagggatacctgctactcgagaatggctaatggaatacatgcttgaaccaaataaaagagactaccgtcctttattacgaaaattaactcctaaaaaaggtggatttatttggcctggaaatacagatgagaccattcctggacaagaaaaacgtaagccaagattatttccatcattagctctaagtgaaaaaatggctatacttaatttggcgtcaaaacaatcataatattaatttttctgcttaaaatataaaatgaaatttcattttatattttaagccattatctttataatataattctgtataattttatacagaattatattataaagatatattgaaccttaataaaatttattttaaaacactaactagtaagcaaaaatgtataaataaaatattataattgatggtataataataaaaataataatttataaaaataaaaaaaagttattagtattttttattttttaatatagaaagaaagtaaataaatgaaatttttaaaatataagtatttttatgggtcttccttggtttcgtgtacatacagtagtattaaatgacccaggtcgtttaatttctgttcatttaatgcacacagcattagtttctggttgggcaggttcaatggccttttatgaacttgcagtttttgatccatcagatcctgtattaaaccctatgtggcgtcaagggatgtttgtattaccctttatgacacgattaggtgttactcaatcatggggtggttggactattagtggagaaacagcgaataatcctggaatttggagttatgaaggtgtagcagcatctcatattatattatctggattattatttgcagcttcaatttggcattgggtttattgggatttagaacttttccgtgacccacgtacaggaaaccctgctttagatttaccaaaaatttttggtattcatcttttcttatcaggtttagcttgttttggttttggtgcttttcacgtaactggtttatttggtcctggtatttgggtatcagatccttatggtattagtggaagtgttcagcccgtatcaccatcttgggatgctacaggatttgatccttttaatcctggtggagttccggcgcaccatattgcagctggtattcttggtatattagcaggtttgtttcatctttgtgttcgacctccacaacgcctatataatggcttacgaatgggaaacatagaaacagtactttctagtagtatcgcagcagttttttgggcagcttttgttgtttctggaacaatgtggtatggttcttcttctactccagtagaattatatggaccaacgcgttaccaatgggatttagggtttttccaacaagaaattgaacgccgcgtacagagcagtattggtagtggaaaatcagcaacagcagcatggtctgaaataccagaaaaactagtattttatgattatattggaaataatccagcgaaaggtggacttttccgtacaggtgctatgaatagtggtgatggtattgctgtaggttggttaggacacgcagtatttaaagataaacagggtaatcaattatttgttcgacgtatgccgactttctttgaaactttcccagttttacttgttgataataatggtgttgttcgagctgatgtaccattccgtagagcagaatcaaaatatagtattgaacaagtaggtgtttcagttactttttatggtggtgaattagatggtgttactttttctgatcccgctactgttaaaaaatacgcacgtcgtgctcaattaggtgaagtttttgaatttgatagatcaactttacaatctgatggtgttttccgtacaagcccacgtggttggtttacttttgcacatttaatttttgctttatttttctttattggacatatttggcacggcgctcgaactattttccgagatgtttttgcaggtattgatgctgacttagacgaacaaatcgaattcggtgcatttcaaaaacttggtgataaatctacgcctcgacaatcaatataaaataattttaggttgattaaatattaatttgtgtgtttaacataaatttttattatataaaattaaataaacgttttttttacttaagctaaaaaatttaagtaaaaaaaacgtttatttatattaaaaaattaaatatataaataagcagttaatatggaagcattagtttatacgtttttattagtcggtactctaggtattatatttttttcgattttctttagagaacctccacgcgttcctggtaaataatgttggtgttatttaaataaaaaatctattttatgaagattaatattaaaagaattcttttaatattaatcttcatgctcttcaaaaggatctctcaattcttgcgaaggtgggccaaagcctatataaattgaataacctgtaatggttataagtaaacaccacaaaaaaatagtaataaaaatagctgaattttccataatttttttccctaatacattatatattaataataaatacccacaaaatcgaaaaatttcaataaaatttaaactcaatatttaatttgtaaattcacataaaaatatagaaagtaaattaaatacaatttttatttaaaattatggcaactggaactacatctggcagaaaagcttcaaatacacaaaatattcaacctggcaaaataacttctttgggaacactactaaaacctttaaattctgaatatggtaaagtagccccaggatggggtactactgcaataatggggatttttatgggattatttgcagtttttcttgtaattattcttgaaatctacaatagttctgttcttttagaagacattactgtgagttggaaataaaaaataaaaaaaagatttgattttggggatagagagacttgaactctcacgattcaatgaatcaacggattttcagtttttagaagctggactctctctttatccttaaatcaaattaaaatttgtttgcggatagctcccgtcgagtctctgcaccttttgctataaaaataatttttaaagcaaattggctcaggattgtcttttttatttaaagatttccctgaatttgagagcattcactattaaagtttcctctaataggctcaatttatatataaatataaatagtacctttaagtccgttgcgtctaccgattccgccatatccccaataaaaaaattattatttaattgcatatatatatatacaatatagtaataatttttttaattttagtaaaattttaaaattaaatattgcagttttttctagagacgaatacaatattataaaaatataaatatacaaaaattttgttaaatttccgtaataaaatataaaggttcaaactgggtcgatgcccgagtggttaatgggggcggattgtaaatccgctggctttgcctacgctggttcaaatccagctcggcccaaaaataaaaattaatttgctgactgactactttctgtttttacgtaaagaattaaaagaaatgcagtaggaataataataaatagagcagttgcaattaaaccaagaatatttacttccattaaaatatatcctttttatttgttaagtattatatatttaaatccgattcaataaaatttaaataaaaaataattttttaatttatcctttttttattctactctaaaataaaaaaatgataaaaattttaatataattatattattaaaactcgaagtaacggaaagggagggattcgaacccccggtagctttaacactacgtcggttttcaaaaccgatgcattgaaccgctctgccacctttcctaataagtatcaaattatagcggataacgcgattcgaacgcgcgacaagcaccttggcaaggtgccactctaccactgagctatatccgcattaaattgatagaattgaaccctaagattataaccaatatataattattttgttttttatattataattttattataaaaattttataaataaaattcaattattttattttcttgacactttttagtagtattaaatattataaaatcaatgattaataatgtaagtggggtagagcagtctggtagctcgtaaggctcataaccttaaggtcataggttcaaatcctattcccactccttaaactaaatttttcattaaacaattccaaaccagcccccatcgtctagaggcctaggacatttccctttcacggaggaaacggggattcgaattcccctgggggtagacaactaaaaaaaaattaaaatatttaatactaatagttaccatttaatgttgtcttttttcaaataattggaaaaaaatttaaataatatgaattaaattttctattatttaagagtaactatttcaattttaattaaaaaaattactctataattaaaaaaattatttaattaagatttcgttttaatttgaataattatcaaattagtatataaaaaaactttaattttatttatgactcgagtaaaacgtggtaatattgcccataaaagacgaaaagaagtattagatttaacaaaaggttttcgtggttcatcgtctaaattatatagaaccgcccaacaaagaacaataaaagcattaacaaattcttataaagatagaaaaattaaaaaacgtgaatttgttaaaatttgggtttcacgtataaatgctgcagttcgtttatcaggattaaattatagtaactttcaaaatcagcttaaaacctctaaaattcttcttaatcgaaaaatttgcagtcaaatagcacttcaagataaagaatcttttgataaattactagattttattaaaatctagtaatttatcaaaatttaaattataactatttattctaaatataaaaaatgaaatcatttaaaaatactaatagcaaaaatttttatttacaaataaaaaaaaaattaaatttaaatgagtctaattctcgttatactattgattataaaaatacaaaacttttaatgaatttcattagcccacaaggcaaaattttgtctaaaaaaattactggcttaacctcaaaacaacagcgtactgtagcaacagctataaaaagaggacgtatgagtggattactgccatttgttaatcgttatttagtagaaaattaaaaacaaaaaaaatttgatttttattaaaaaaatgacatactataaatgtaaaaagtaataattttgtagaaaaaaaaatttatttaaaattattaaatcacgctttgtaggacttgaacccacggcatcaggttttggaaacctgcgttctaccaactgaactaaaagcgttctcgggatgacaggatttgaacctgcgaccccctgttcccaaaacaggcacgctaccaaactgcgctacatcccgaaacttatattttatttttatgatataaagtaatcttccatttttcaattttaatggattttagtaaaaaactaaaacttatatactaaaaataaataaattttatctatttttttataatataaaatttattttttactttttttattgatcttaatatattttaaaaatagtaatttctaggtattagaatttaaaaaaggttaataaaatattttaaaaattaaaaaaaacaaattattatatgcaaaacttcaaaacttatttatcaactgcaccagttcttgctttagcaagtctaacagttgttgcgggattattaattgaaattaatcgatttttccctgattctttaatttttactttttaggaatttatgccaactattcaacaattagtaagatcagcacgtaagcgtatgtttaaaaaaacaaagtcgccggcgttacaagcttgtccacaaagaagaggtgtatgcactcgagtttatacaaatactccaaaaaaaccaaattccgctttacgaaaagtagcacgtgttcggttatcttcaaaatttgaagttactgcttatatcccaggtattggccacaatttgcaagaacattcagtcgttttagttagaggaggccgtgtaaaagatttacccggtgtccgctatcatattgttcgtggtactttggactcacttggagtaaaaaatcgtaaccaaggtcgttcaaaatatggtgtaaaacgtccaaaataaaaaatttaaaactaaatctattttaatataattttcaatagagtttttttgattctattgaaaattataatttaatctttactaaatatattctttaactatttatgtcacgtcgacgtacagcaaaaaaacgtactgtaatgcctgatcctctttataaaagtagtcttttagaacttttagtacgacaggttatgcgaaacggtaaaaaattattagcatatagaattatgtatgaaagcatgaataaaattgctgaaattacaaaaaaagatccacttgtaatacttgaacaagcaattcgaaacacaacaccacttattgaagtaaaagctcgacgggtagggggctcgacatatcaagttcctattgaagttcttcctgaacggggaactactttagctattcgttggatattaacagcttgtcgtaataatcacgggaaaccaatgtccgttatattaaccaatgagttaattgatgcttctaataaagcaggtaatgctgtgaaaaaaaaagatgaaatccatagaatggcagaagccaataaagcgtttgcaaaacaacgtttttagacttgaaaaaatttgaaggttttattataattatttgttaatcaggattaataatctatttctttaaattgttaaatttttaaaatttgtatacaacataactaaaaaaggacttttttatggcacgcacaaaatttgaacgtaaaaaaccacacgttaatattggtactattggtcatgtggatcatggtaaaacaacattaactgcagcaattactatggcattagctgcacgtgatggtggaaaaggtaaaaaatatgacgatattgattctgcacctgaagaaaaagctcgtggtattactatcaatacagctcatgtagagtatgaaacagaaaatcgccattacgctcatgtagactgccctggacatgcggattatgtaaaaaacatgattactggtgctgctcaaatggatggtgctattcttgttgtatctggtgctgatggccctatgccacaaactaaagaacacattcttttagcaaaacaagtaggtgttcctaatattgtagtatttatcaataaagaagaccaagtagacgatattgaattaattgaattagtagaattagaggttcgtgaaacattacaaagatacgattttcctggtgatgaagtaccgatgcttcctggatctgcacttatggcattatctgcgttaacagaaaatccaaatattaaacctggtgagaacaaatgggttgataaaatttataaattaatggatacggttgattcttatataccaactccaaaacgtaacgtagaaaaaccatttttaatggcaattgaagacgttttttctattactggtcgtggtactgttgctacaggtcgcgtagagcgtggtgttgttaaaatcggggatactgtagaaattattggttttggtagtactaaagtaactactgtaactggtttagaaatgtttcaaaaaacacttgatgaaagtatggcgggggataatgttggtattttacttcgtggtattcaaaaagctgatatccaacgtggaatggttttagcaaaaccaaaaagtattaaaccacatactagttttgaagcacaagtttacgttttaaccaaagacgaaggtggacgtgatacacctttttttaaaggatatcgaccacaattttacgtaagaacaacagacgtaactggtaaaatcgcatctttttctactgacgctggtgagcctcttaaaatggtattacctggcgaccgtattcaaatgacagtagaattaattcaacctattgctattgaacgcaatatgagatttgctattcgtgaaggtggtaaaacagtaggtgctggtgttgtagtaaaaattttacaataaaataaaactcaatatatatttatttttaaatatatattgagttttattgataaaaaaaaatatatatgaacaattttcaaaatattataaaaaagattgaatataaattttcaaaaaaccaattacctgagataaaagtcggcgattttatccgtcttggtatttctattcaagaatctggaaaacaacgtgtacaaccttttgaaggaacagtaattgctctacataaagcaggtttaaataccacagttactgtaagaaaaattttacaaggtattggtgttgagcgcgtatttccgatacatgcttcttgcgttacaagtattcatattttacgtcgatctcaagtatcacgtgcaaaactttattatcttcgtaatcgaataggtaaagcaactcgattaaaagaaaaatttgataaattaccaccaatttgggttgcgaaatcttcttaataaacaaacgcgtgctaagttacattaacaaaattaaaaataaatgacaacacaaaaagaaagtctctattatactgtttctggcgctcggcgatttagtaattatttttggggatctttaatgtttatcggtggaataggatttttagcagtaggaagcttaagtgctttaaacataaatgatcaattatttatatttaaagcacctaatattcaatttattccgcaagggttagttatgtgtttttatggactcataggtttattattaggaatttatatttggttaactattatttggaatttaggtcacgggtataacgaatttaatttaaaaacagatgaggttcgtgtttttaggtggggctttccgggaaataatagacgtattgacttaagatacccgattaaagatgttcaaagtattagagttgaaataaaagaagggattaatacaaaacgggctatttttttaaaattacgaggtaatcgtgaaattcctttaattggggctgggcaaccaatgagtatacaagaaattgaaacacaagctactgatatagctaaattattaaaagtgtctttagaaatttctgaattagcttcttaatataaaattttgatttaataataaaaaaatacaacaattttttgttaaaatattataaaatctattaaaaaaagatgagatatgaagctgtagaacgaattggattaataccaagatccattattcgtactttagataaattaaaaaaacaattattgcctggtgtagaagtattagctattgaagaatatagaatatcgcgctatcaacttattgtatctgttcaatctttattaattttatttcttgttccacctttagtaaacataagtttgaaatttttgctaattagacctattgtagaacattattggaatcgtcccggtaatgagatttttttgaattctgatcaaaaaaagcgtgcattaaaagaatttaattttgctcatgaaattatttattttgattcacttgttgatgatgatttttttgacacaaacaaaaacataggtcaatcattacaaaaaaaaatttttgaaattacacaaacttataatgagcaaagcattagagcaattactaatttaattgcagatttttgcagtattttcagtatatttattatattctcttcgatgaaacctcaaatgattattttgcaatcatttttggcggaatctctctatagttttagtgatactacaaaatcctttttattaattttagggacagatttacttgttggttttcattcaccaagaggttggaatatttttttaaagtggatttttatacattttggcttttctgagagtagtctatttttatcgctatttgtatcaacatttccagtttttttagatacaatttttaaatattgggtctttagatctttaaatagaatatctccttctactgttgctacttaccataatatgctagaataaaatgattaataatgttaaaattagataattttaacattattaatcatttttaattatttattaatagtgtgatagcttgttattgtattagatgatatacaaatagattttattataaacggcctattttagcatttatacgattaatattatttagtataaaaataaacaaatgcaattcttattatttaaggagaatttttaaaattatgatgttagatttattgcaatatccagtaataaaaactccgaaagctacccgtttacttgaaaataatcaatttagttttgatatagataaaaaacttacaaaaccccaaataaaaaagctagttgaagactattttaatattaaagttttggcggtaaatacacaccgaccaccacgaaaattaaaacgttcaaattcttcaccacgctcaaaacgggtaattattacagtaagttcaaatgttaatttattaagctaatatgtatttattataaatttttaatataaaacaaagtatggctattcgtttttttaaaccgtctactccaggaagtcgtcacggttcagtattaaattttgatgagatttcatcaaaaaaacccgaaaaaaaattaactaagggttggtctcggtctcaaggtcgaaataacaaaggtattattacaagtaggcatcgtggtggtggtcataaaagattatatagaaaaatcgattttacaagaaataaaattggggtttctgctacagtaaaaaatattgaatatgatccaaaccgtactgcacgcattgcattagtttcttataacgatggcgaaaaacgctacattatatcccctcttggattaaaaatcggagaaaaattactttcttcacctaatgcctctataactattggtaatactttaccattatctaatattccattagggacttctgttcataacgttgaactccaacccggagctggtggtcaatttgtaagatcagctggttctgtagcacaaatcgtagcaaaagaaggccgctgggttacacttcgtttaccatcaggcgagtctcgattaatttctgaaaaatgctgggctactattggtcgtgttggaaatatcgataattctaatataacattaggaaaagcaggcagaagtcgttggttaagtcgacgcccccacgtccgaggttcagctatgaatccagtagatcacccacatggtggtggtgaaggaaaagcacctattggtcgggctcgtccagtaagtttatggggtaagccagcattaggtgtaaaaacccgtaaacgtaaaaaatttagtaacaaactaattgttaatttctaattttatattcgttttgtgtttttagagaaggtttttaaaaacctttaaatatttgtttgtaaaaaaataaataatattttaaatttatcactaattatatgacacgatcattaaaaaaaattccttttgtagcaaatcatttgtttaaaaaaattgaacgattaaatagtcaaggtaaaaaaaaagtagtaaaaacatggtcccgagcctcaacgattgttccattaatgataggacatacgattgctgtgcataatggccgccaacatattccactttttattacagatcaaatggttgggcataaattaggtgaatttgcccctactcgcacttttaaagggcacgtaaaaaaagataaaaaaacaaaaagataattaatatatgggacaaaaagtacatcctttgggatttcgtcttggtattactcaaaaacataaaaattattggtgtacaaaatctcaaacatcagcactttgggttcaagatgcaagttttattcgaaattatatagaaaaagctttttttggagcaggtattattaatattgaaattcaaagacgtgaaattgaatacccttttataagcattaaaattcatgcagcacgaccaaatatttttttaaatcgtaactctttttctaaaaaaactacaaaatcaaattggtcagaaggtttatcacaattaagagataatttattaaaacatcttaaaaaattttataaagtaagaaacttgccagaccctggaaaaattttttgtacgatttctataaattcaactaataatccagatatacatgcaatggtacttgcagaaaaattagttgatgatttgcaacaacgaaaaccttatcgaaaagctatgagacaagttgttcggaaagcaataaaagctggtgttaagggtattaaagtaaaaatttctggtcgtttaaatggggcagatattgctcgttctgaagatttacgaagtggaccagtaccattacaaacattacgcgctgaaatagattattccgaaaaatcagcaaaaactatttatggccttttaggtattaaaatttgggttttccgcggtgagcgtttaactccattaagtaatctataaagttacaaattttatagtattataaattaataaattctaaattttatataacatatgcttagtcccaaaaaaacaaaatatcgtaaataccatcgtggtcgcatgtctggaaaagccttacgcggtaataaattagtgtttggtgactatggattacaggctttagagtgttcatggatcacatctagacaaattgaagcagctcgacgtgctgtaacacgccaagttcgtcgtggtggtaaattatggattagattatttccagataaacccgtaacaatgagacctgcagagacacgaatgggttctgggaaaggagcgcctgaatactgggttgcggtagtaaaacctggtaaagttctttatgagttaaaaggggttccagagactagtgcccgtacggctttaaaattagcagcttctaaattaccaattaaaacacaaattcttttaaaaaaatcaatttagttttaatttatttttttttataaaaaggttgattttttaaatctatatactttttataaaaaaaaattactgttttcttaaaaaatattttaaaaaaaccaataaataaattattatgattcaaccacaatcttatcttcgagtagcagataatacaggggctcgtgaaataatgtgcattcgagtattaagtggtgctaaacaacaagctgctggtattggggatattattatagctgtagtaaaagatgcggccccaaatatgttaattaaaaaatcagatgttgttcgtgctgttattgtacggacaagaaaaaatgtacgtcgaaaaaacggaacaagtatccggtttgatgaaaatgcggccgttattataaataaagaatcaaatcctcgcggtactcgagtttttgggccagtagcccgagaattacgtgatggtaattttacaaaaattatatcattagcaccagaagttttataaattttattttttttttattatttatttaattcgctattttagtattcttatattctcttttaattaaaatttataaaaaaattaatatggtacaacgacttcaacaatattatcaaaaggaaatagttccccaactttttaaagaatatcaatataaaaacaaacaccaagtaccacatattaaaaaaattataattaatcgtggtctaggtgatgcttctcaaaacgcaaaacttttagaatcttgtaataaagaaatttgcagtataactggacaacaaggtgtaattacacgttcaaaaaaaccaattgcagcttttaaacttcgacaaaaaatgccagtaggtattgttgttacccttcgaggtgaccgtatgtatgcttttttagaccggttaattaatttagcattaccacgtatacgcgattttcaaggagttaatcctaaaagttttgatggtcatggaaactataatttaggtttagaagaacaacttatgtttcctgaaattgattatgataaaattaatcaaattcgaggtatggatatatcaatagtaactacatccacaacagatgggcaggctatgagtttgttacaagcatttggcatgccttttaaagataaatctaaaaaataaaaatcatctaagttgatcgctaaataattatctttaaaccctttttaaatatttattaaaaaaattcaaaaatatgataactgatacaattagtgatatgttgacccgaattcgaaacgcaaatttagtatctaaacctacagtattaattgctaataccaaaataaatcaaaaaatttgcgaaatattacaacaagaaggctttatagctggtttttccgttttagatataaacaaaaacgaattaatcgttagtcttaaatataagaaaacgggtttaatatcaaatggctctgctggtaaaccttgtattacaaatttaaaaagaattagtaaacccggtttacgaatttattcaaattataaagaaattcctaaaattttaggtgggttaggaattattattatttcaacttcaaaaggattaatgacagataaagaagctcgaaactctcaccttggtggtgaattagtttgttctatatggtaaattaaataaatttagttttatttaaattatcctaattttttagcttttttttaatataaaaaatcagtaatacttgttgccttataaaaaaaataatcggaggttaaagtgtatttaaataaaagttcacgtcttgatgctttagagatggaaggtgtgataacccaatgtttatctaatggtctttttagggttaaattaaaagataatggggttttaatattagcacacatttcgggcaaaattcgacaaagatatattcgaatattattaggagatcgggttattgtggaattaagcccatatgatttaaaacgtgggcgtattactcatcgctttcggtcgggaaaaaaaaaataaaaccaattacaatttttaaatttatgaaagttcgtcctggagttcgaaaaatgtgcgaaaaatgtcgtttaattcgtcgtaagggagttttacgtattatttgccaaaacccaaaacacaagcaaaagcaaggttaaagcgttatatcatttagttctgagaaactcaaatgatatactattgtataaaattttgtattacattaaaattattattaataattctatttgataataattttaaattattaaaaaaaatatataaatatgccaaaaaaagttgaaaaaatttcaaaaaaaaaatttaaagaaaaagtaatacggggagttgctcatattcaatcgacttttaataacactatagttacaattacaaatcctaaaggtaatgttttagcttgggcgtcttcaggtacatctggatttaaaggtgctcgaaaaaaaactcctttagctgcaaagcaagctgcggaaaatgtggcacaaatttgcgttagtcaaggtatgaaagaacttattgttaggattaaaggggctggggttggtcgagaagcagctttacggggattacgtgatgctggattaactattactgttattcgtgatattacaccaattccacataatggttgtcgaccgcctaaaaagcgtagaatttaaatataaaatatacatataaatttttacacgctaaaaaccataataactataatttatatgaataaaaaaaaattagaaaaaaaatttatttcgtttgtagaatcaaaaacattagattctgggcaaatgtacgctcggtttcatttaggtctttttttaaaagaccatgcattaagtttttcaaatgccattcgacggaatttaatagcaggtgttccaggtttagttttaacagatataacttttttaggaactcgccacgaatttgatattattccaggagttcacgagactctatttgacattattgaaaatcttaaagaaattgtttttacccatactagcgaaaatatccattgtttggtatctggtcaaaaagaaatggaagcttttttaaaaatacagggaccaaaaatagcgactgcaggtgatataaaatttcccccaaatattagttgtgtcgtaccatctcaacatatagcttcagttagttgggatggggaattatcccttagtttgaaaattgcattagttgatcctaataaatttcaaccatttataaacccgcaagaatttatagatgattataaagtttttaatgtacaacgtttcccaagccctataaaacaaactaatttttttattcaaaaagtaagtacaaagcaagaatttgaatatcttatcttagaaattataacagatggtagtattcatccaaaacaagctttgcaatatagcttatataaacttacaaaattattttttgattttacgcttgttagtttatctctttaaaaaaattaaattttttagagagttagtaaaaaatataaattattctagattagtaaaaataattttttgtatttatgctacaaaaaatttaaggagaattttttaataatgtcatcaattaaacatgaattaatacattcaggtgggagaaaaacagcttccgcttgtgtaaagttaagtcctagtgcaactgaaaatctttttataaatgggaaaccagctgaactttattttcaaaataataaagcattattacataatatatttcaagtatatcaactaatagaaacctcgactaaatataatgcttatatttctgtcaatgggggtggtttaagtgcacaagctcaagctattagattaacattatgtaaagcgtttatcgaacttattccagaattaagagcttcttttaaagcgcaaggttttttaactcgggatgctcgtattaaagaacgacgtaaatatggattaaaaaaagcgcgaaaagccccacaatactcaaaacgttaattttacttagttaattttgaagtttaactttcaaattaactaattgattttatcattataaaaacatataataaataaatatattaaaagctaaaataaaaaatttaaaaattagctctattattcaaaaactcaggagatcagttttatttatgtctacaataactattgagattttagaaaaactaaaaacaattactttattagaagcttcgcaattagtatcacaaattgaagatgcttttggtgtagatgcatctattcaaacaacaagtggaacaagtgcagcttcaacagaaattacaaaacaagaagaagtaatagaagaaaaaactacttttgatattattttagaagaagttccaagtgacaaacgtgtacctattttaaaagtaatacgtaatttaacttctttagatttaaaacaagcaaaagaagctattacagatttaccaaaaacaatcttacaaggtgcgtcaaaagaagaatcagaaacagcaaaacaacaattagaagctgcgggcgggaaaattaaagtatcttaatgtttaaaaatatttattatttataaatattctagttataaataataaatatttttaaacaaatattaaagcttgtaactcagtggatcaagagtacgtgtttccgaagcacgttgtcgcgggttcaattcccgccaagcttaaaaaattgtagctattaaaatcggagaaagagggattcgaaccctcggtatgttttatcatacgacgcgttagcaatgcgttaccttcgaccactcggccatttctcctggtatgtagtatttatcatattattatcagctaataaaaaaataaagatatgtaaaaaaatttagttttttataaaataatgcccccccattgtggggaggagcattaataaagttaatctaatggccgcattgataatacaggctcattatcacgatcaagtcctttttcaaatcctgcagctgctgcacgagcacgtccagcatgccataaatgcccaataaagaaaaagaaacctaaacaaaaatgagaagtagctagccaacttcgtggtgacacgaaatttacagcattgatttctgtagctacaccacctactgaatttaatgatcctaatggagcatgagtcatatattcagcagcacgtcgttcttgccaaggttggatatcattttttaatttatttaaatccaacccgtttggaccacgtaaaggctctaaccatgaaccacggaaatcccaaaaacgcatagtttcaccaccaaaaataatttctccagttggtgatctcattaaatatttaccaagaccagtaggtccttgtgcagacgcaacattagcgcctaaacgttgatctcgtactaagaaagtaaaagcttgtgcttgtgaagcttcaggtccagtaggaccgtaaaattcactagggtatgctgtattattaaaccaagacatacaacaagcaacaatacccattactgaaatagcacctaagctgtaagaaaggtacgcttcaccagaccatacaaaagctctacgtgcccaagcccaaggtttcgttaaaatgtgccaaataccaccaaaaatacatagagtaccaatccaaatgtggccacctataatatcttcaaggttatcaacactaacaatccaaccatcaccaccaaaaggtgattttaaaatataaccaaaaataacacccgggtttacagttgggttagttactaaacgaacatcaccaccacctggagcccatgtatcgtaaataccaccaaaataaagagcttttaatactaaaagccaagctccgatacctagaataactaaatgaatacctaaaatagtagtcattttgtttttatctttccaaacgtatccaaaaaaaggaaaagattcttctaatgtttcaggtccaattaatgcatgatatattcccccaaatcctaatacggcagaagaaattaaatgtaaaactccagatacaaagtacggataagtatctaaaatttcaccacctggaccaacaccataacctaatgtagcaagatggggtaaaagtattaaaccttgctcgtacattggtttttctggtacaaagtgagcaacttcatataaattcattgcccctgcccaaaatacaattaatcctgcgtgtgcaacgtgtgcacctaataatttaccagaaaggttaattaagcgggcattacctgcccaccatgcaaaaccagtagattcttgatcacgtccaccgattaccaaactactattaaagagcgtttccacgtggtaaaacctcctctgggaatactaatttttcatgaggctgatcttgagcagccatccaagcacgaataccttcattcaaaagaatattttttgtataaaaagtttcaaattctgggtcttcagcagcacgaatttcttgtgaaacgaaatcgtatgcacgtaaatttaatgctaagcctactacaccaaaagcactagtccataaaccagttactggtacaaataacataaagaaatgtaaccaacgtttattagaaaacgctacaccgaatatttgtgaccaaaagcgatttgctgttacaaaagaataagtttcttctgcttgagttggattaaacgcacgaaatgtgtttgcaccgtcgccatcttcaaatagagtattttctactgttgcgccatgaattgcacaaagaagcgcagctcctagaacaccagcaacacccatcatatgaaaaggattcaaagtccagttgtggaaaccttggaagaataaaataaaacggaaaatagctgcaacaccaaaactcggtgcaaaaaaccaactagattgacctaatgggtaaattaaaaatacagcaacaaaaactgcaataggtgcagaaaatgcaattgcgttatatgggcgaattttaactgaacgtgcgatttcgaattgacgaagcataaatccaattaaagaaaaagcaccgtgtagtgcaacaaatgtccaaagacctccaagttggcaccaacgagtaaaatcaccttgagcttcgggaccccataaaaataataaagaatgccccatactattagcgggtgtagaaacagcaacagttaaaaagttgcaaccctctaaataagaagtagctaagccatgagtataccaagaacttacaaatgttgttccagttaaccaaccacctaatgctaaatatgcagtagggaataataatagacctgaccagccaataaatacaaaacgatcacgacgaagccagtcatcaacgatatcaaaccaaccacgtttttcttgattttttccaattgctatagtcataacgagactatctccttgtaataatttatgcaaattattaaataatttgcacaaattttgttaaaattaaatatatatttattaaaaatatttttaataaatatttgtttttttgtttacgctataaattagtatagtatgtttttaaattttttcaagttactagattttagtaaatttaattaaaaactaattacaattttaactgatcaccacgacgatattgtaagtacgcggtaacaaacaatcctataattgttactggaactaagccaagaacaatccctgataataatggttctaccatatttaaaatttctccaaacccgataaattaaataattattaataaaaaaataataatttttttatattaatttaatttttactaaactataataacatattactgttattaatgaagctccaattaataaagcgagataactaaaaattgtaatcatttttttaataaaattgatttatgaaagaataaattttttaaattaattaaaaattcatttcagataattgaactttttcgtattgtttcttttttaatacaaaaaatacttgggcaaataaaactaaaataaaaaaaactaataaaccgataattcgagttgggttttgtaaaacaatttctgtttcaccttgcccaaaaccaccgacattcgggttacttgttaatgcttgatctagcttaacttcattaccagtttttacaattaactcgggacctggcggtactgtatctgtaataatatcaccatttgccgtttgaatactaattaaaaatccaccttttttctcaattggttctatactagtgatttttccggcgctagatgcagtataaatagtattattactttttgagccgtctggataaatttgaccacgaccacgatttccaccaaaataaatagggtattttaaatacgatactgatttatttttagtcggatcgggtgataaaataggaaaaacaagttctttatattttttacctggaactggcccaacaactaaaatattaggtttttccgcattatatgatgaaaaatataatttccccattttcgctttaatttcttctggtattctttccggaggtgctaactgaaaattttctggtaaaataagcacagcgcctacatttaaatcaccttttttaccgttccctaaaacttgtttaatttgtttatcgtaaggtatttttgcaactgcctcaaatactgtatttggtaaaacagcttgtggtacttcaatttcgattggcttttgggctaaatgacaattcgcacacacaattcgcccatttgcttcccgagggttgttgtaattttgttgagcaaaaataggataggcattacttggagcactaactagaaaagtaatacccaaaagaaatgttaatttaatacaaaaattaattggtagtttaaatagataaatggaatacttcataaaattgattctatctgttttttaaattaaaaaacataaaaaataaaattttcttctctgcatttttataatttatagatattttaatttcttgttttattatactctttcatagagtaaaaaaaaaatacttttaattgaattaattttgtaaaaaagttatactattagtaattagaaattaagagtttttttatatattaagaactataaaaaatcagaatattaacaattaaaataaaattattctctgatcatattatgatttcaacagatacagatacaactaatttagaacaaataagacccgtttttccttttaccgctattgttggtcaagatgaaatgaaactagctcttattttgaatgtaattgacccaaaaattgggggcgttatgattatgggtgacagaggaacaggaaaatctactactgtacgcgcgctagtcgatttattaccagaaatagagagtatagaagatgatccatttaattcagatccgcatgaccttgaattgatgagtaaagaagttcgagaaaaaatacaaaaaaaagaatcattatctatcattaaaaaaaaaatttcgatggtagatttgccgttaggggctacagaagatcgtgtttgtggtacaatcgatattgaaaaagctttgacacaaggtgttaaagcttttgaaccgggtttattagcaaaagcaaatcgtggtattttatacgtcgatgaagttaatcttttagatgatcatttagtagatgttttattagattctgcagcttctggttggaataccgtggaacgagaaggtatttcaattagtcacccagctcgttttattctcgttggctctggaaatccagaagaaggtgaatgtagaccacaacttttagatagatttgggatgcatgctcaaataggaactgttaaagaaccccatttacgtgtgcaaattgtagaacaacgagctgattttgatgcatcacctttaaaatttagaaatatttataagcaatcacaagaacaactagcaaatcaaataattaaagctagagagttgctaccggaagttcaaattgattatgatttccgtatcaaaatttcgcaaatttgtggagaattggatgtagatggtttacgcggagatttagtaacaaatcgagcaagtaaagctttagctgctttttatggtcatactaacgtgaatgaaaaggatatttttaaagtaattccgctatctttacgtcatcgattaagaaaagacccgttagaatctatagattctggggataaagtacgtgaagcctttaaacgtgtttttgggtataattaaataacttgacaaatctttttattgataagtattaattaataaaaagatttgtcacgggcttatcgtctaatggataggacaggaaccttctaagtttctaatgtaggttcaattcctactaagctcaaattcaattttaaaaaaatttaataattattaataaaaatatgttataataaaattatctgtagcctataaattaaaaactaatttttaaatacatgttaactttaaaaatttttgtatatactgttgtaacattttttgtttcacttttcatttttggatttttatctaatgacccgggcagaagtccagggcaaaaagatattgattaatttttctattttttcaaattcaacatttattaatatataattttttgtattaactagctaaaaactagttaatacaaaaatactatgatttaaaatatgccacggtcacaacgaaacgataattttattgataaatcttttactgtaattgctgatatattattaaaaatattacctacttctaatcgcgaaaaacaagcatttagctactatcgagatggaatgtcagctcagtctgaaggagaatacgcagaagctttgcaaaattattacgaagctttgcgtttagaaacagatgcgtatgaccgaagttatatcttatataatattggattaatccatactagtaatggtgatcacgcgcgcgctttagactattattatcaagcattagaacgaaatcccgcactaccacaagctttaaataatgtggctgtaatttttcattatcggggtgaacaagctatagagataggtcaaatagaaatatctaaattgctatttgataaagctgcggactactggcgtgaagctattagaatagcgccgactaactacattgaagcacaaaattggcttcaaatgactggtagaggttaaattatgatgcattacacataatatagaataaatattctaagtttatggaaaacttagaatatttattctatattttaattaaacttaaagtaataaagcctacttaactcaattggcagagtatcggttttgtaaaccgaaggttatcggttcaactccgatagtaggctattgaaatttcaaaatattaaaaaaaaatagaaatataatgttgtaaatatttctataatttttaatattataaaaacaataaaattaattattaaaaaataaaaattaaatataattaaaaaagcaacataaataattagtaataaaaaaaaattaaatattatgtttaaaaataataataaaataataaaattagaggatatggtacaaagtggaatgcattttgggcattttacttctgaatggaatccgcgaatgaaaccgtttatttatggcgaacgatatgggcggcatattttagatttagtgcaaacatattatcttttaaatgacttattagggtttttagaaaaaagtgctgctcaaggaaaaaaattcttattcgttggcacgaaaaaacaagcagcccctttaattgaaaaaacagctattgcgtgtaatagctattacgttaatcaacgttggctaggtggaatgctaacaaattggaaaacgattcaacaatctctacaacaattacaatcttttagaaaagctgaagaatcaggtgaatgggatttattaaagaaaaaagaaattgcaaaaaagaaacgccaaaaattacgtttagaaaaaaatttagctgggctagaaaatatgaaaaaattgcctgatgttgtaataatcatagggcaatctgaagaattaaatgctgttaaagaatgtcgacaattaggtattactacagtgacccttcttgatagtaactgtgacccttatttagcagattggtatattccagctaatgatgattctgcggcaacggttaaattcttactttctaactttcaagacgcaatactttctggggaaaaaattaataatgagaaccaacaattattaaatgttaaacaaaatataaaaaaatcaagtcgaattaaatcaaaaaaaacataaaaatttttatgttttataaagtaaatgtatagtaaatataagaaagctataattaaaactctttttaataaaagccacttgaatttatatttttatagaggaaatagtatttatgacaaacgttttgtttgatttagcggaagtttctgttggtcaacattggtattggaacttaggaccctattttgttcatggtcaagtactaataacatcatgggttgtattaagtcttattattggaatagcattaatagctaatcaaaatttaaaaactatcccagaaaatttacaaaatctaacggaatatgttactgaatttattagagatttagcaaaaacccaaattggagaaaaagattatataaaatgggttccttttttaggaacaatatttttatttgtttttgtatctaactggtcaggtgctttattaccctggcgtattttagaactcccaaatggggaattagcggctcctacaaatgatattaatactacagttgctttagctcttttaacatcacttgcgtatttttatgcaggtattagtaaaaaaggattctcgtattttaaacgttatatatctccagcggcatttttattaccaattaatattttagaagattttacaaaacctctttctttgagttttcgactttttggtaatattttagctgatgaattagttgtaggtgtattaattactttagtacctttggtagttccaattccaataatgttgcttggtttattcacaagtgccatccaagctttggtttttgctacattagccggggcatatattggtgaatcgttagaagatcaccattaaaaataatttttaatttttttttttattaattaactttttttagtatttaataaaattaattaatttttaaaattgttttttttataaaaaaaatgttaaaataattctaagtaaatcataaatgttttacacaagtaaaaaactttattggaggaaataatcttatggatccacttgttgctgctgctagcgttgttgctgctggtcttgctgttggtcttgctgctgttggtcctggtattggacaaggaactgctgctggttatgcagtagaaggtattgctcgccaaccagaagcagaaggtaaaattagaggtgctttacttttaagttttgcttttatggaatcgttaacaatttatggtctggttgttgctttagctcttttatttgcaaacccttttgtatcataacaaaattaaataaaaaaatttattatgaatgctaactcgctttttattttagcggatcattttagttttaatacaaatataattgaaaccaatgtattaaatttagctgtagtattagctgttgtggttatttacgtcggggacgctctaaaaggccttcttgcaaatagaaaagaaacaattgttaccaattttcaagaagcagatcggcgtgctttacaagctaaagaacgtgtgaaccaagctcaaatacaatttgaagaagcaaaacaaaaagcttccaaaattagaaatcaagcttcaattactatagaaaacgaaaaagaaaaatttaatcgcgaaattacagaagatttaaatagattgaaggtttttcaacaagaaagctataaattagaacaacaaaaagttcaaaatcaaatagctgaaaaattaattgaattatcattaaatcaagttaaaaagaaaataaaattacggttaaattcgtctaatcatagtattttaaataactttcaaattgtactttttactaattataaaaaaaattaattctagcatttttttagattttttattttttaattattagtatcacatttaaaactattttgtgattctagaaaaataattaaaaaataaagtctatttttttaaggataattggcaggaggatgttcatcttattatggtaaaaatcaaaccagatgaaattagtagtattattaaacaacaaatccaacaataccaacaagaaattaaaacagttaatgttggaactgtttttcaagttggggatggaatcgctcgtatctatggtcttgatgatgtaatggctggtgaattacttgagtttcaagacggtactgtgggtattgcattaaacttagaggcaaaaaatgttggggctgttcttatgggagacggtacaaatgtacaagaaggtagttctgtacgtgccacaggaaaaatcgctcagattcctgtaggggaagcttttttaggccgcgtagtgaaccctttagctcgccctattgatgggaaaggtgaaattcaaagtaatacaaacagattaattgaatcctctgctcctggtattatttctcgacgatcagtacatgaaccattacaaactggaattttatctattgattcaatgattcctattggtcgaggacaacgtgaattaattattggggaccgacaaactggtaaaacagctatcggcgtagacactattcttaatcaaaaaggaaaaaacgttgtttgtgtttatgttgcaattggtcaaaaagcttcttctattgctcaagtagtaaatacattacaagaaaaaggtgctcttgaatatacaataattgttgcagctactgctaattcaccagcaacattacaatatttagctccttatactggcgcagctttagctgagttctttatgtataatggacagcatactcttgttatttatgatgatttaacaaaacaagcacaagcataccgcgaaatgtctttattattaagacgacctccgggtcgtgaagcttatccgggagatgttttttatctacattcacgtcttttagaacgagctgctaaacttagtgataagttaggtggtggaagtatgacagcacttccagtagtagaaacacaggaaggtgacgtttcagcttacataccaactaatgttatatctatcactgatggtcaaattttcttatcagcagatatctttaatgctaatgtaagacctgcgattaatgttggaatttctgtttcccgtgttggttctgcagcacaaccaaaagcaatgaaacaagttgctgggaaattaaaattagaattagctcaattcgcagaattagaagctttttctcaatttgcttctgatttagaccaagcgactcaaaatcagttagcacgaggacaacgtttacgggaattattaaaacaaacacaatcttctccattaaatctagaagaccaagtatcaagtatttttgctggtactaatggttatttagatgatatcccagttgatcgtgtatcagactttttaataggtttaagacaatatttagttaataatcaaccaaaatatggtgaaattataaaatctagtaatacttttacctcagaagcagaagaaattttgaaaaatagtttaaaagatttcactgaagagtttttagcatcaagcaaataataaaaatgcattgatatgtcttgtatattaacacatatcaatgcatttttatataattaattatatgagaggcctacttagctcagctggttagagcatccgtctcatacgcggaatgtcactggttcaaatccagtagtaggcacacttataaaagttaattataaatgatgttagtttacaaaaaaatatgtattatttatgaaatcaagtacttgacaaagaaataatatatatatatattatttataaataaattttacgggggctgtagttcaattggctcagagcgccgccctgtcacggcggaggttgcgggttcgaagcccgtcagtcccgtataaaaaacatacagtaaatttaacaaaattagagtaaattatactctaattttgttaaatttaatcataattaattaaggtgcgtttatgttaattataacaaaattagtaattatactgtaataaaaaaaatttttagttcttatattttgaataatactttgaatattaaataaaaagtaatagtttttttttaatgcatccatggcagagtggtcgatcgcaccgcactcataatgcggttctttttaaggcgccgttggttcaaacccaactggatgcaaatatttaattgcctttggtcggactcgaaccgacacgtcaaagacatcagttcctaaaactgacacgtataccatttcgtcacaaaggcttttactttaaattactctatttaaaaaatagagtaatttaaagtgaaagttacaaacttatagagtatctacagtatcaaattcaaatttgatttctttccatacttcacaagctgcagctaattcagggctccatttacaagcagcgcgaataacatcgccaccttcacgagcaaggtcacgaccttcgttacgagcttgtacacatgcttcaagtgctacacggtttgcagcagcaccaggtgcattaccccaagggtgtcctaaagtaccaccaccaaattgtaaacaagcatcatcaccaaaaatttctacaagagctggcatgtgccatacgtgaataccaccagaagctactggcattacacctggtaatgatacccagtcttgagtaaagtaaacaccacgactacgatctttttcgatgtaatcatcacgcattaaatcaacgaaacctaaagtaacttcacgttcaccttctagtttacctacaacagtacctgagtgtaaatggtcacccccagataaacgaagagcttttgctaaaacacggaagtgcataccatgatttttttgacggtcaattacagcgtgcattgcacggtgaatgtgtagtaataaaccctcatcacgacaataatgcgctaaagtagtatttgtagtaaaaccaccagtaaggtaatcgtgcataatgattggtacaccaagatctttagctaattctgcacgttttagtacttcttcatttgtagctgctgttgcatttaaatagtgacctttaatttcaccagtctcagcttgagatttataaatagcttcagcaacaaataagaaacggtctctccaacgcataaaaggttgtgagtttacgttttcatcatcttttgtaaaatcaagaccaccacgtaaacattcgtatacagcacggccgtaatttttagcagaaagacctagttttggtttaattgtacaacctaataatgaacgaccatatttgttaagtttatcacgttcaacttggataccatgtggaggtccttggaacgttttaacatatgctggtggaatacgaagatcttctagacgtaatgcacgaagtgctttaaatccaaaaacgttacctacaattgatgtaaataagtttgttacagagccttcttcaaaaagatcaattggatatgcaacatatgcaatatattgattttcttcgcctgctactggttcaagatcatagcaacgtcctttataacggtctaaactagttaaaccatcagtccaaacagtcgtccaagtacctgttgaagattctgctgcaacagctgcaccacattcttctggtggaacgcctggttgaggagtcatacggaaagctgctaaaatatccgtatcttttgtttggtaatcaggagtataataagttaaacgataatctttaacacctgctttaaaacctgaactggtttttgtttctgtttgtggagccatttttaataaattattattttattttacgattagaaatctacccgaaatattagttaaattttattgtaataaataaaaattttttatttatttttataatagcatataaatattatttatacaaaatattgttataatttcaatatttgaatattgaaattaataccgcattcttcttaatatatatatatattctaatatttttaaaaattaaattttatatattatatattatatcaaatattataaggattaccaaaatgtcaaaaaaaagtatgattgagcgtgaaaaaacacgttttgcgttagtgcaaaaatatttaaaaaaacgtcaagatataaaaagcgcgctaaaacaagcaaactcaatggaagaaaaatttcagttacaaataaaattgcaacaattacctagaaatagtgccccaagtcgattacataatcgctgtaatattactggaagacctaaaggattttatagaaattttaatttatctcgtaatacattacgagaatatgcactaaaaggattattacccggagttaaaaagtcaagttggtaattttttttaattaaaaaaaaatttaattcttttaattttttatttttttagcgggttgccccgctaaaaaaaaagattagagtttaaatactagccattgattgccggagcatcaactactgctaaatctagtgggaaattgtgtgcattacgttcatgcataacttccataccaagattagcacggttaataatatcagcccaagtgttaataacacgaccttgtgaatcaactactgattggttaaagttgaaaccatttaagttaaatgccatagttgaaatacctaaagcagtaaaccaaataccaacaactggccaagcagctaagaagaagtgtaaagaacgagagttattaaaagatgcgtattggaaaattaaacgaccgaaatatccatgagcagctacgatgttgtaagtttcttcttgttgtccgaatttgtaaccaacgttagcagattcgttttcagttgtttcacgaattaaagaagaagttactaatgaaccatgcattgcagaaaataatgaaccaccaaatacaccagcaacaccaagcatatggaatgggtgcattaaaatgttatgttctgcttggaatacgatcataaaattgaaagtaccagaaatacctaatggcataccatcagagaatgaaccttgtccaattggataaataatgaatacagcagtagctgcagcaacaggtgctgaataagcaactgcgatccacggacgcatacctaaacggaaagataattcccattcacgacccatgtatgaacaaattcctaagaaaaagtgacatacgataagttggtaaggtccaccattatataaccattcgtcaagagaagcagcttcccagattgggtaaaaatgtaaaccaattgcgtttgaagttggtactacagcgccagaaattatgttatttccatatagtaatgaacctgatactggttcgcgaataccatcaatatctactggcggagcagcgataaaagcgataataaaaacagtagttgctgttaataatgtagggatcataagaacaccaaaccaaccaacatataagcggttttcagtgcttgttacccactcacaaaaacgagcccaaaagctagctctttcacgtctttctaaaattgcagtcataattaattccttatatttttataaaagggattctctcaaaattaaaattatacaattatgtataaatatttgcattaatttttaatttgttaatatttatattaattaaaattatctgcaaatttattgctttttttttaattaaaaagtaataaatttgcagataatttttctattactttgacagttagtaactaattttttgtttttctaaaaaattaataaaattaaagcagaataaaataacttaataaaattaataaaaaaaatgcctatcggtgtaccaaaagtcccatttcgccttccaggcgagcttgatgctcaatgggttgatttatataatcgattatatagagaacgtgttctttttctgtgtcaagatttggaagatgaattagctaatcagttgattggtattatgttgtatttaaatgcagaagaagaaaccaatgatgtatttctttatattaactctcctggtgggtctgcaatttgtggtatagctgtttttgatgctattaattatataaatgctgaagttactacaatttgtgctggtactgcttcttcaatggcttcttttgtattagctggtggggcaagaggaaatcgaattgcattacctcatgcccgtgtgatgctgcatcaaccagaaggtggaagtaaaggacaggcggcagaagtaatttatgaatctttagaagtagtacggattagacaccaaataggtcgtatttacgctgagcgtactgggcaacccttaaacaaagtatcagctgatttagaccgagacgtttttttatctgcgcaagaagcaaaaaattatggcattgtagataaagttgtggttaatatggcaaatatgtaccctgaacgtaattaaaaattttaaataaaataatatttagtaatttaaatttaattttatatttaatagatttttttcatttaaaaataagaatttttttatgctttaaaaaaagtagtataataaataataagataaaatcagcctaattgcggtaatatattttttaaaaaatctaaattatattattaaattaattaaataagagattttttaattttaaaaattaaaattatgagtaaaatttacgattggtttgaagaacgccttgaaattcaatcaattgctgatgatatttccagtaaatatgtaccaccacacgttaatattttttattgctttggtggaataacatttacttgctttttagttcaagtagctacaggatttgcgatgactttttattatcgaccgacagtagctgaagcttttacttctgttcaatatttaatgacgcaagttaattttggttggttaattcgttctattcatagatggtcagcaagtatgatggttttgatgatgattcttcatatttttcgtgtttatctaactggtggctttaaaaaaccacgcgaattaacttgggtaactggtgtattaatggccgtatgtactgtttcatttggggtaacgggttattctttaccgtgggatcagatcgggtattgggctgttaaaattgtaactggtgttccagatgctattccagtaatagggccaggtgttgttgaacttttacgtgggggtgttgctgttggtcaatccacattaacacgtttttacagtttacatacttttgtattacctctttttacagccgtgtttatgctaatgcattttttaatgattcgcaaacaaggtatatctggaccactttaaaataataactcgcaaaagaaacaattataaaaaagatccaaaatcattatggctgttacaaaaaaaccagatttatcagaccctcaattacgtgctaaattagcaaaaggtatgggccacaactactatggcgaaccggcatggccgaacgatatattttacatgttccctgttgtaatttttgggacttttgctggcgttattggtctagctgtattagacccagcagcaattggcgagccagcaaatccatttgctactccattagaaattcttccagaatggtatttttaccctgtttttcaacttttacgtactgttcctaataaactgttaggtgttcttttaatggctgctgttccggcaggtttaattacagtgccttttattgaaaatattaataaattccaaaatccatttcgccgtcctgttgctacgacagtatttttagttggtactgttgcagcaatttggttaggtattggtgctgctttaccaattgatatctcattaactctagggttattttaatatttattgtaatgtatgttttttgttacttgacaaattattattactaaaagtagtattgtaaatatgatttagtactctgcggtaactagcttgaaattatgtaaggactgaaaaggagcaacattctaagctgataaaaccacgagggttctataggtgggtttactcacctattctaaatctgaacactctttcaaatgattcaaaattattttgaatcatttgaagggcggcatagccaagtggtaaggcaaaggattgcaaatccttcatttcctcagttcaagtctgagtgccgcctatattatatttaactaccaactaaaaaatgacattagttatcgctcttactttttttgtacaagttacgccttatatatatactaattgacaacaaaatattgaaaatatggtttatattaattaacagttactaacaactaattaatttaccattttcttgttttctagataaagaaattaatatttgagccaattttatattttaagtgaacaaaaaattattaatttcgcggtattataaaatttttttttattagttttcaaaatttttaaatctatgaattttaatatatatattgaactaatttctaaaatattatagttagactacgtgatagaaattattaaaaaaaatctttttagtagtaattttttctaatataaaataaagatgaatttaaaaacaaatttaaaaatgtttaatcaaaatgatatttttttaaatcaagagttacctttacgaataagtgatacttctgttaatgatgtattaaaaaatcattctataattattgatgaaactgtaaacttattactcgatttttatataaaaacaaaacaaaaaaaacaaaaaattaatgttttgtcaacattgcctaatttaataaatatacaacaattaagttttaagcaatttttagagattggtttaatatccgcaattgaaagtcaaaaccctttaaaaataaaaaatacactttattcatttgaggttttttatttaagtaaatacttacaatttaaaaaaccagaaaaaaatataacagaaactataaatttaaataaaacttacggatgccctatttatttaccaatattactcaaatctaatagtcaatctaaagctatttttgaatggatctatttagggtttttaccgtttatgacaaaacctgggcattttttaattaatggaattccacgagttgcgttaaatcaattagtacgtactcctggtatttataagttaattgaaaataaacgtacaactaaaggaataaaagcaatcccttacatacgcatagttcctgataaaggtagttggctaaacattagttttgattctaaaaatcgattatggattacaacaaaaatttttagaaaaaaaatatctatgttagtatttttacaagctttaggtattgatattcatactatttttaatactatcggtcattcggaaattttactatcaagtattgttcctcctgtaaaatcattaaatagtgaaagacttacacggcatgatgccattttaattgatgctggtttaatatctcatcctgtaactcaagtagaagcttgcaaatatttatattctcattttatggaatatcgatcacctgcaaacaaacagcggcaacctataactgaaaaaaaagcacttcttttttttcagcaagtagtttggaattcagagaataaatatctaggtatttctggtcgtgatcaatttctaaaaaaattaggaactacaggttctgcttttaatcaaatacaattaacaaaacaagattttattttaattacgcaaacaataattaatattttatacggtgaagaaacaatagatgatatagataatttaaataataaaaaaattagaggttgtggagactttttatatcaagaattagctcgtggacttaatgaatttgagactttacttgataaaaaatttaaaaatttttcattaccgcgtaaaaagaaaaaagtaaaatctggcgttttaaaaaaacaaaaaaaagtaataaaaacaactagttctcacactaaatcctcacttttattaaaaaataagaaaaaactgaaattaaataaaaaaaataaaataacccttgttgctagtttttggcaaagtaatagaactattttatcaaaatatgttacaagagcttggcgaagtttctttttgggaggaactttatcacaatatttagatgaaacaaatcctttagcagaaatcacacataaaagacgtataacattattagggcctgggggggtaaatagtaaacaaactacaataaaaattagaggaattcacccgacttactatgggagactttgcccaatagaaacacctgaaggtcaaaatgcaggattggtgcattcacttacagtttttgggcataaagcttctaatggtactattttaactccttattataaggtatataaaggacaaacccaaaataaacttaatgttatttttttaaacccagaaaaagaatcttcacatgttttagttccttcagatgttctaatttcaaaatggggacgtttgccaaaaatgagccttcccgctcgaaagaactgggattttgattatgccaaattagatcaaattacaacccaatctatttcaatcttacaaatgatttcgttagcaacgagtcttattccgtttttagaacacgatgatgcaaaccgtgctcttatgggatcaaatatgcaacgacaggcagttcctttattaaaacccgaagttgcccttgttaaaactagtttagagccgagagttgtatcagatattaatcatattatacaaacaagagagagtgggtttattacacaagtagtttcaaattcaattcaattatataaaccaaaaactttaaaatatttttttattgatattggagaatttacaagaaacttaaaaaaagtaaatataaaatataatacaatttttattgcaaataatttattatttcctaatgcattaaatttttattatttacatttcccattaaacaaaaatttgttaaagtttcaaaaaaggaataaaaataattttctttcaaattttattaattctaatcaatttacttcttatagtaaaacaaaaaaaaaaaataaaatcagtttaaataatttaaaaaataatttaaacacaaaagatttttttctaagtgcagggaattttttattaattaaagaaaaggtaaatcaaaataagcccaaaccactttttttaaataataaaaggaaaaaaatagactataaacttttccacttaaatttatataaacgcggcaaccaaagcacatgtactcttcaacgaccaattgttgcagaaactgattgggtagaaaaatcaactgttttggcagacggtggagcgagtgataaaggaaaattagcgatagggaaaaatgtttttatagcttacttaccatgggaaggttataattttgaagatgctgttttaataagcgaaaatttagtatctcaagatatatttacatctcttcatcttgattattatcaagtggaggttcagaaaacagcagcagggttagaaacaataacaaacgatatacctttaaattcatcaaaagaaatttctcaaatattgaatttagatgccagaggtattataaaaaaaggaacatgggttaaagaaggggattatttagttggtaaaacgagtaatgtacagttaaagggtatttctgcacaatatgaaaaactctataatgctattatacaacgtgaaaaattaccagttagaaacactagttttcgtgtaccaaaaggagtagaaggccttatagttgatgttgaaatattacctccaaaacaagatgacattttatttttagcgccaaaaaattctattttatgtgtaaaattatctcttttacagcgacgaagaattcaagttggggataaaattgctggtcgtcatggtaataaaggtgttatttcaaaaatattacctgttcaagatatgccttatttaccagatggaactcctattgatgttgttctaaaccctttaggaataccatctcgaatgaatgtaggacaaattttagagtgccttttaggtttggctggaaaataccttaatgagtcttttacagtaaatttatttgatgaaaaatttggaactgaagcttcaagaagttttgtatattcaaaactttatcaagcttcattaaaatcaaaaaattcttggttatttgagcctgaacatcccggaaaaataaaactctttgatggacgtacaggtattatttttcaacagccagtaacagtaggatatacctatatgttaaaactagttcacatggttgatgataaaattcatgcacgggcaacaggaccttattccgctttaactcaacaacctgttcgaggacgagcaagaaatgggggacaacgtttaggtgagatggaagtttgggcgttacaagcgtatggtgctgcttatactttgcaagaactaataactataaaatcggatgatatagatggtagaaatgaagctgttttgcgaattttttataataaacctattgaaatgaagcaacccgaaagtattaaattattattacgggaaattcaagtactttgtattagtttagaaattttcgcaccttcttataatacgaaaaaaacttgtttagtcgatttaaacgatttagatggtaaactagtataatagtttttcatcaatattttagaaaaatttaagtttataatattcttaaaattttgtgctttatgttttaatttttatgtattaaaaacaaagcaaatataaataaaaaatatttgtatgttctttttaaagttatggtaaaaaaaaaaattaatggaattaaaaaagtaaaaattggattaacctcgccacgagaaattcaagaatggggtgaacgttcattacttgatggtactattgttggagaggttagtagttgggaaacagttaattacaaaacattaaaacccgaaatgggagggttgttttgtcagaaaatatttggccctataaaagactacacttgtgcttgtgataaaaaagttaaaattccacaagttaaaatttgtaatatttgcggcgtggagcgtactttatctagagtacgccgttatagatttggacatataaaattaaaacaatcggtagtacatcctttatatgcttcatacaagccctcgccattgggggcttgtatgaattggtcaaataaacgattgcaaagtattatatttgctacagaattttgtcatttatcaccacattttttaaatttttcatcttggtttaatatattaacaaccttaaaaaaaaattctcagaaaagcgaccatcatttaaaattaaatgtaacgtctgataataaaccaaatttagcgtcttcttcaccgaaattatttcgtgaattacgttctactaaatttaacaatactctaaaaaattccttgttgaaaagaaataatgcgataaaaagaaaaaaaatttacaaattaagaacattaccggaagagctttttttatatggtataaattatgatatgacgtgggatcaagtagagcattttcaagtatttattttttatagttggatacagccatctcctaatgaatcaattattccatattatttttttacaaaaaaaattaaaaaccaaaatttaccacaccaaattcgtaaaaaatctaacaaaaacagtaaacaagaattataccaatttcaatcatctccaattcaaacaggtggtagtgttattgaaaaaatattagcgcattacaatccaataaacttaaaaagacaacttgagtttgaatatgaaaaaataaacaatgtgcttaatttaataaaaattcaaatgaattattatttaagtatcaattatgaaaaagaacacagtgatcttcgaaaaaaatggaatcgtttaaaacaattccgaaaaaaatatttaagaagattaggttattttcgaaaaatttatttatataatatgcaaccagcctggatggtacttagttgcttaccagtactaccacctgacttacgcccagttacaaaattaggtggacaaatttttatttctgatattaatagcctttatcgcaaagttttaacacggaacaaacgaattccgcataaaatgcaatttactgtatttgatcctgctttaagtagtagttggaatttatggtgttttaatttacgtttactccaagaagctgtagatagtttattacaaaccggaaatgttgattcaaatcaaaatgaattttcaagtttttcaaaacaaggaaaaaacacaaaagcccttatagactccctaaaaggaaaaaaaggacgttttcgtcagcatttattaggaaaacgtgtcgattattctggtcgttctgttattgttgttggcccggaattaaaaatttatgagtgcggtttaccattagaaatggcaattgaattatttcaaccttatattatccaaaatttaaaaagcaacaatattacaattacaacaacttcagctaaaacttttattgacgaacatcgcccaaaaatttggaatatattaaaaaaaataatgaaaggacaccctatacttttaaatagagctcctacattacatcgtttagggattcaagcttttttcccgaaattaattaatgggaaagctattttattacatccacttgtttgtcctgcatttaatgcggattttgatggagatcaaatggcagttcatataccattgtcgacattagcacgtacagaagcacttaatttgatctgggcaagaaacaatcttttagcaccatcatctggtcaacctttgcttttacctgctcaagatatggtattgggatgttactatttaacatcttcggcttcactaacaaattcaaatttaaatttaaataaaaattctaaaaacttatatttattgaataattttgaagtatttaaaaaacaacttgcacaaataactaaatatcatttttataattttcaagatgtttatcaagcatttgaaaaaggcagtttaagtatgcatacacctatatggttaaattggtctcaaccttttcaaaacttaatattacaaaatgaagctcaagcttctgaattagttttagaacaccagattgatttttttggaaatacaactttagttcgagagaatagatataaatcaacaaccactacaacttcaacttatctctatattcgaacaacaccgggtcgtctttttttttataaattagctttaaatctaaatttttaatgtgtttatgaatcaaaacaataacaaacaatttttttttaaatattaagtttaaaaaagagtaaaattaaaaaaaaatatttcaaaatgaataattctaaatttagtaatttacaatctaaaattaataattcatttttttttaatggcccttttgataaaggaaaacttaaaaaactaataacatgttttttagatgaatatggagaaaagaatactcttgagtttttggaaaaactaaaacatctaggattttctcaagcaacccaagctggtatttcattaggattagatgatttaaaaattccaaatagaaaaggtgagtttttattacaaacaaatattgcactccaaacaacagaatatgaaaacttagctggaaacatcactagtattgaaaaatctcaacgaacaattgatatttggaataccacaagtgaattactaagagaaaatgtaattgaaaattttaagtataaaaaccccttaaattccttatctatgatggctttttcaggggctcggggtaatgtttcgcaagttcgacaattagtaggaatgcgcggattaatggctgatccacaaggggccattgttgaatttccaattcaaagtaattttcgtgaaggtattacacttacagagtatttaatatcttgctacggtgcgcgaaaaggattagttgatacagccttacgtacagcaacttcaggttatcttacacgcaggctagttgatacggtgcaacatattgtagtttctagcgcagattgtggaactggcacaggacttttaattaataatccagataacgaaacacggttaattgggcgggttttattaaaaaaaattaataaaaattttttagacagaaaaaagattaataactattaccctttttttttagatgataaaaaatttgattttaataaaaatgaaacattttttattaaaaaaaatcaaattatatcttcaacaatagcaaaacaaatttacgcaaatcaagataaaatttatataagatcaccattaacttgtcaatcatataaatcaatctgtcaattatgttatggctgggatttagccaaaggtgatttagttaatattggggaagctgttggtgtaattgcagctcaatctattggtgagccgggtacacaactaacgatgagaacgtttcatacaggaggcgttggggtattttccgatgaatcattaaaaacattcaaagcgccctcgtcgggaataataaattttccagaaaatataactggtagctttattagaactcctcatggaaaaattgtatatatgattaaatataatcgtatagatccaacacgaattcttttagaaattaaaacgaaaaaatcaaataaatcgttttttactttatacgaaagtcaattgcctccgggaagtattttacttgttagacaaggacaaaatgttcaaataaatgatattattgctcaaactccccagataaaaacaagtaatcaaaacttaccagaatcgttacacccaatccaatcaaaaatagagggtgaggtgaggtttgaatacatgaaaatttctgtatcgcaacctatttctaaatttaacgtatcttttactgataatatacaacaaaatagttttttatctcaaacagaatctcaatctaaaggattaattaataactacttactaaattcaagtaaaacactaattccaattaaaggtgttgttccgatgacacattctttattagaagttggtagtttttgggtttttcatgctcataaccaaagggaaccatattcgacaaatacctttttacaaataggtgatttaatatcctcacaaagtcctatttttcaagtaaattttcatgttttgtttcaagctaaattaaaacgaatacatgcaaaaattgttatagaacgtcctattttaaatataccaacaaatataatacggtttcacaaaacagcatattcttctacttcttataataaaaacaaatctgtcttcttttggagtaatactatctcgcataaaaccagaaaatttaaatttgtttggtatcctaaaaattggtcaatcaaaagctctagttttatttttatctcaaaaaaatatataaaatttaatggacttcaaaaaaaagtaaaaccaaataaaattttcaaaaaaaatgttattaatttattttactttaaggttttacaagaaaaattaaacaaatctaaatcatataatatttctttaaatcataaattgtcagataacaaattgagttattttggtaatcttttttatctttcttatatttttttatccttagaaaatgatattaacttaaacaaactttttctagcaagtacaaatatagaattatttaaattttttaaaggttataaaaccccatctatttttcttataaataatatttctgatgttttatttaaaccaggattttataaaattttatctaaacctatcaataaattacgttattcttctaaaaacaaaaaacctttaaaatacaaatttaatctttttaaatctaaaaaattaacaaaaaaatataacaattcattaaaatttttagctaattctaataattgtcaaattataattggtcaatttgtttttttgtttttagataaatttcaaattaaatctaccccaaaaaaaccaaaaaatatatttcattatgaaaaaaattggacatttttttcaccctcaaaaacattaaatacatctttttctagttttaataaatcaacaaaaaaatttattctaacaaaaaatgcttttttaacaaatttctcatttgtaaaccaacctgtatctttagaatatctgttattaacgcagattaatgttttacaaaaaaaaaatttaaaccattgtcaatattcacagccttattggtattctaaaaaaaatttattaaatattaagtattcttggaaatcgacttgtcacttaagaaaagaatctttttttaataatataagctttaagcaaatagataaaactttaattttctatacattacaaataccgtctaaattaaataataaattaaattttagttctattaaaaaaataagtttaaataataatattgaaaaaaatttattgtgtatttctattcaaaaattaaatcaaaataattttccttgcaatttaaatttacaaaaacaatggggatctttaatttttaaatctgataaatcgaaattttttgtaaataatacttcgccagttttttcaaaacaaacaacttataaaacttcttataaagaagtttcaaataaactatttataattcaacctgattttaacgttgggtggcattctccaacaaatttgatgaaaattaaattagaacttaaaacacaaaaaaactttaaaggattttatagtggctttgtttctgatttttataaaacaaattcaaaatcaaatttaaaaaatattaatactaaggaaagaaaaaaagctttcaaacgggagagtttttatttaggttcttatatacacttaccaaaagaaaattttgtttttgatcataaaaatttaaattttcaaacgttttctaatgagtgggtactaccaaatataaagttagctgttgggtttaaaacttctacaattagtggagaatttattcgattaaaaaaatcgttaaatcaaacttattggagtagtttaagtaaagatgatattgttacattaaatttaccgagtaaggcgactgaattaactttaagggttggtcaaattttacgatggggtcaaccaatttatcacaattttgtctcgccatttaatggtcaaattataaaaataaatcaaggacagttatcaatccgtcgaggtttacccattttagcttcaaaacgtggaattattcatatatccgataatgatttgattttaaagaacaaacttcttgtaacgttaaaatcacgccgattagagacacaagatattgtacaaggtattccaaaaattgaacaactttttgaagcaagagagacactctcaggggaaaaattaccaagtattcataaaaaattacaactttattttttagatgctttagatatgttttataaaaacagcaatcaggtgttttctgcattaactccacaacaacagaaagtacattattttgaaattgctaataaaatggcagtaattaaaatacaaaactttatagttgaaaatataattgatgcatatttaaaccaaggggtttcagtgtctgaaaaacatgttgaaattgttgttcgagaaatgaccactcgtgtaagaatattgtcaagtggagctactggttttttaccaggagagattattcaatttaaaacagttcaagaaataaataataaattatataatagccaacaaagtccagcattttatgatcctattattttaggtattactaaaagtgtattacattcggaaagttttttattagcagcaagttttcaagaagtgagccgtattttagtacgaagcgcgtgtattaaaaaaactgattttttatcaggattgcatgaaaatgtaattgttggtcaattgattcctgctggggcagttttattttcaaaattaccaaaaaaatatacaatataatttaatattattataaaacatcgtttttgttgcaataaacgatgttttataataatattacaagtataaaataggcttttagctcagttggtagagcggctgccttacaagcagcgggtcatcggttcaaatccggtagggcctaaaatataaatataatttttaaattatattgttttgaaacatttattatattggtataatagtaatataatagaaatatcgttttatttttaatagatctacaaatcaaataaattatggctgcacaatttttaccaagtatattagttccattagttgggcttctttttcctgcaatagctatggcatctgtgtttttatatattgaaaaacaagaaattaattaataaaaattttacgggggaaatattaacaatatttcccccgtaaaatttttattaatctctacaaaaaacaaaaaaaaatgattattatttatttagtatatggaataaatacaaataaaaaaagcaataaataataaaaaatacaaagaggttcaatattatgtcaattttttcatggattgaagacgaaaaaaatttaaagttacttaacgcacctaaatccggccaccgcccgggagatttaagcttatggattcggtgtgaaaactgtggggtcattttatatattaaacatttacaacaaaataagcgagtttgttttggatgtaattaccatttacaaatgaacagcatcgagcgtattgagcgttttattgatgcaggtacttggaggccaatcaatgaaacaatatcgtcttgtgaccctttaaaatttaaagatcaaaaaaaatatagtgaaagattaaaagaatcgcaagaacaaacaggattacaggatgctatacaaacaggaactggctttatagaaggtattcccattgctgttggaattatggattttacttttatgggtggaagtatgggttctgttgttggagaaaaaattactcgcttaatagaatatgcaacagcacaaggacttactttaataatattttgcgcgtctggtggtgcccgtatgcaagaaggcatcttaagtttaatgcaaatggcgaaaatatctgctgcgttaaatgctcaccaaaatactgcaaaacttctttatattccaatattaacttcaccaaccactggtggtgttacagcgagttttgcgatgttaggtgatttaatttttgcagaaccaagagcccttattgggtttgccggccgtagagttattgaacaaacacttcaagagcaattaccaaaagattttcaaacagcagaatatttattacatcacggtttaatagatcttatagtttcaaggttttttataaaacaagcaattgctgaaacaattattttatatcaacaagctccaacaaaagaattagggcttcttgcttttaaagagcgtcatcgtttaacaatttcgcaagaagagcaattacgacgtttagtagagaattcatccaacttaaattttagtggtttaatgaaatcgttttttcatttagttactggtaaaaaagaagaaaaaacaggattattaaaattaaaacctttgccgtttagtaaagcttttaaaaaagttcctaaagttaataagtataaacgtgttaaatttttaattccgaaaactcctaaatctgatataattgatgtgtaatacatattttaatttataccaaaagtattattatttttttgagctttttattttctaagtacttgatttttttgttgttatggagtattttacataacaacaaaaaaatctatgaactattcgtattgtataaacataataatatattattattattgtattaattgtattaatattattatgtttattaaattcatcaaagtctaaaatgcttctatgaactttatggttcaatatcaattaaataatatttaagcctcttaccggatttgaaccgatgactttctacttaccatgcagatactctaccaactgagttaaaaaggcattttatttagaataaagttacttattaaatttctaagaaaggttgcttttatttttttagtatataaatataatattaaataaatttagtattatatatcatttagataaaaacaaaaaacaaattataataaattattaacaaaaaaatttttatgtacacaaatattaatataataattgatattttattttattacaaacctaaatataacagttgaatttatggataaaaaacaatgggaacgttttgaaaatataattaaaacgcgtttttcgcctgaacaaatcttaagattaaatcgaatatcattaaaaaaatatttgattgcaaaaaatgaggctgagatgaaaagaatttgggaattccgtttatctcttcttaattcatcgaaatatagcattcaaacttctcaatcttttcaaaattataaagtattattattattgaaaaattataccaaacacgttggagtattgtgtctttattatttcacaccaggttggtacatattaggttttattcgaacaataaaagctaaaaatcttaggattttaacaacaataaagtgggaattatatgtctataatcatagacttacaatgaacagaaaactcagatcaattgaagtggatcaggggcttattctcagtttatttccttttacgttttcagctatacaatatattgttgttcgatttaagccacaccttcatcctaatgttttagagcacacgttacctatttttagttatcctatacaaactataaaatgggaaacattaatgttatcagatgatgctcaagaaatattagtcaaagagcaaaataaaatgggtgttttcgatgagtatcttttaattcaccgaaaaaacaagttaaaattatttggaaatactcgctggttggattatatattagtaccagaagttgaggcaaataaaagtatacaagaagcatttttagatttagataatctccccaaaaagttagctagtgcaaaagaagtgacttatgagtacccgaatattaaaaattatattcaatttttagattcggaggttccgctatcatataaacaaagcgcgattaataaacgtgagttataccaaactcgagtaaattttaattatttggttcgggcatattatcgaaattttttatatggtgtgaacgaagacttaaccagcctctttaataaattacaaaaaaaagctcaaaaggtaaaaacacggcgcgggccatcaaaaaaatatagcaccggtataaaaaaagtgagttctgttcgagaatttgctagtatagctgatttagaaaaatttgaaaatagatttaaatttactgaagatgttgaagtagctaatttagataaaactaaatctattaaatcccttgaaacagatttgcaggttgatgaattaaatgaggaattagattttgaggatgattatttgaatgatgagtatgaggatttatttgaagagaattttagtctacaatcaaatgagtattatcaaaatcatttttttaaagaagacaattctgaagataattctagcaatgaaggtctttctacagtaaaaaaaagtgttgaaaaaaatactcaagataaagttaacgaaaatacaaaaagtgttaaaaacaaaaatactaagaaagatttttatacactttatgcagaacttggggaattattgtcagaaatttcaattgaagagacaaatatagatattgaaaatagtagtattactaataccaatattgatgaaacttctttaaatgaccaaaatattttattacctgaattacggggtgcaggtaataaacaaaaaggcggtaaaataaaaggattaagcgagaaagaggctgctgaagtaatttcaactcttaatactttttatcgggaagataaaaatttatttagaaattgtgaatttgaagatcatggtttttctataccaataacaccacgtaaaatgtcaggttatgtttacccggatacacctacaaacgaattaatcttattacgtctaagagaatttttattaaaaaatgaaacaaaaacaactcttagagttgatctccctcctaattttgtttttattaaaacgtacccagtaaaatacccagatgctccaaatcctaaaaaccttctcgttgctacagcagctatggatctaaccccagagcaactaaaagcgtataaagaacgtcaaaaagaacgccaaaaagagcaacaaaagggtggtgatcaggatgatcttagtttaattaatcaattagacactaaattttatgtagatcttgatccggaggatcctgaaccagaagttcaacctactgatccacgggctgagaaggttttagaagatgattatagaggtcctgctatacttgtaaatgaaaataatgatatacgtgttatatctaaaattgatgatacaaagccatttatatccaaaacagacggttcagccccaatacttaatgtttctttaaattattatttaggggtattaaataataataaaattttaaaatttattgatacaaaatcatcacaatcaagttctaatatttcacaacctgaaactagtaatagtgtgtcaactgatttagcagtaacggatctagaaaataaaattacagataccaagtctttagacaatatcacgctacacaatccagtgaatgatactcagtcaaatgtagaaagtatgattgatgataaagaaaaatctaataaacagaaagatttttctaaagatgaaattccgtctggggaagaaactaaagattctattttggttgagcctaatgttgtaaaatcttgggtaactaattatcactcacctgataaccctattgtaccaaaaaatcttatgtattctccatataatttaatgaaatggcatgggctacaagcttttgacaaagcattaaatgacgatttgacaaatgttccaattcatcgagctgaatttgaagtccttaacaaagagtatacatacgctatacgtaaaaaaccttataataaacgatggtttgtttttccatttttaccggattattacgaccctgaaggaaaacaaacgaaagagttacctttttcaacaaaatcaaacctttttgttgttgcgttgagtccagaaagttgggaagaccgctatgcatcaagtgacgtagtagcgcctgctattgcaaaagatgccattaaagatatagaacagtttgaaaattatgagtatgaaaaaaaacgatctgttcgtgaattaactggctatgcaataacaaacataccaacaactaaagtttattatccaacaggtaacaataaaccaaaacttaattttgggcttgttaatgaattagattataactttagtccgtttgctgtttctttatttaataaaattgctttagcaacagagaatccacacatagaacaaactctatgtgaagaagaatttggtagaattctttcaccgggtatttataaaactgtttcgaaaaatggggatgcttgggagatagatataagtgtttgggagccattaactacaaactcatggttagttgtttcacaaatcggttttagttatatcttctttatagtattaaaagaaacaatgatgaattacggacgtgaatttttagcatacttacttgagatttttaatacaacaggttttttacctcctatgatgtttgatgaattaaaaatcttactgggggaaaaagagaccggtttccgtgttgcaaaagattttaccaaaggatttaaagatgttgttgatattgcttcattagctgatgaattattagacacacttttatatttacgtggaatgataacaaatcctgctctggcacaacgtgcacaaagtttattattagtaggtcctccgggtacaggaaaaactttattagttcatgcattagctcacgaagcaaaagttcctgttctcacattaacggccaaaggaagtaaagagcctgcagcctttgagcgtttatttacagaagctcataaactatcaccgtgtattgtatttcttgatgaagtagattcaatcgcatctgtacgatctggtatggatccttctgaacatttgatgaaagtcattcgtcaaggtttagatagttcgtctaatttagctagaagatccagaaccgataatgcagttcctgaaatgtcaactattatgggcgatctgcatccacgaattttacaaaataaagaaatgttccacatggtggttaatagagatgttcaaaatcatataattaaaaaaaatgatgatgaatattatagggttgggttacttttaaaattattaacagagttagatggtattgagagtcgtgatggcattgttattatcggtgctacaaatagacttgacgttttagatccagctttactccgaccggggcgttttatacgtaaagtgagattaggtttaccaaataaaaacaaacggttacaactttttaaacattatagttatatgttaggaagtgatgctaatattccatgggattatttagtaaaagtaacatatggttttagtgcggcagatatttcaacaataatgaatgaatctggcttaaaagcaatagctcaagctagccatcatacattagaaactattgaacacggtattgatcgacttactactacttcggttgcaaggggcgttgcaaaagatattaaaaaccctaaagctagaaaagaatttttattttcgactgcccggagtgcttattatcaagcagctaaagctcttgttggaactcttttaaaataccacccaccggtgatagtggttcatctttggtatcgtcactatagcgtgcgttataatcaaatacaacgtactgtacaattagaatggttaaagtatgtttgtcgtggagaactagaacatagaatcattggaacatatgctggtaaagcaggggaatatctttttttacaagatcaaggtgattttatagatatatctgataattcgaatattggggcacaagattggtctattgggcaatcattagttaaacttctcgtagaaaattggtatatgtatacggaaactatgttacttcgagaaccattgccattaaaacgaaattttaactcaatggaacataacgacgttagagaacaatatttatacgaatttgctcaaacgtatgaaaaaaccccaacagcagcgaagttattacacggtaaagccccacaaacaaggtttcctgaaaaatggtggcatttgaaactttatcaaaaatatttaaacggtgaaattcaaaaatggagttcaatttatgttccaaaccccgaagaatggaaatttaatccttactgggtagggccagatcgaacatttcatcaaaataccattgcagcaaatataggtaagtttgaaaaactaaaacatatggcaatgttaactcgtgattataaaatgcattctattataatggaatcttttaatttagcatttttaattgtaactgagtacagagaattacttgatcaacttgcatatgaattgttacataatgaaattttacgtgaacatactatttatgaaattttttctaattttgggtttgattgtgaaaatctaaaagaagacttacggaaggctcctaaaatgaatcctttaccagaagattttaaaattttatatccttcgtggggtttaaattcagacaaacctacaattcgttgggttgatattgctgcaattcttaatccagatagtgtagctgaagaaaataatgatgaagctaacgtaacgactgatgatttgcaaaatactaataaaaataaaggtaatactgagaattcagaaattaatgaaataacggatagtaatagtgacgaattaggtgaagaagatgaggaagatgaggaaatgcaacaggaaaaagttatagatatattggggactttctatagtgacataattaaaccaaacccgtttaattcgaacactaataaggaagatcaagatcttgattcaaatctaactactgaaaattaaaagatttgaattaaaaactcatgtttttaattcaaatcttttagtaaattagaaactagagatctaaaatagttaataatattttgttaagatgctgctaaccggacttgaaccggtatagatttctctgtaactttttgaaagttatgtgtctaccatttcaccatagcagcgatttcagatttgtttttatactattgcaaattattgaatttgcaatagtataaaaacaaattaacttctaatttaattttacaatgatgaacctaatcctacataagatccataaaaaaatgttcctaataaccccaatacaacaactcccccaacagttccaataaaccataatggaatacgaccggttgtgctagtattagacataaaaaaatctccttttttttaaaggaccccaataaagtactaactggggttaatttgtgaattaatacgtcaattttactaaaaaatataagtaataattaataaaataaactaattgaaaatataacttgaaaacaaaactgctaatacaaaaattaataataatccccagtataaactggttctatttaattctacagtttgtttattaggatttggttttgccataaaataatataacctttttcaattttacctaaataatataaatattatttaacgttgaataaattgcatagccgtaatagcacctaaaaagaaaactgtaggtactgctaatgcgtgtatagcaagccaacgtacagtaaaaataggataagtataggattttcttgctgtcatatgataaaaattctaattattctttaaaattagaaatttttaaatttctaatttaaaggtatttgtttaattaacttgagataattgttttacttgatctaaagcgttaaaacgatccgtaatgagtggggtttcttgtcgatcttcagtaaaatactcacttggtcttggactgccaaaaatatcataagcaagacctgtactcacaaataaccacccggcaataaataaagacggaatggtaatactgtgaattacccagtaacgaatactggttaaaacatcagaaaaagggcgttctcctgtagcaccagacatgctataactccttataatttttttactataacaaaaagttttttctttctttttttagtataccaattttttcaaagagcttcaaagttttcaaattgttttaattcatttttatatttggcgaacgacggggtttgaacccgcgagtgatggagtcacagtccattgccttaccacttggctacgcccgccatgtattaattggagcggatagcgggaattgaacccgcacctcttgcttggaaggcaagggcactacctttatgcaatatccgcttctttttttaatatatatatatttgtattaaaaactacatttttaaaaaatcctaaaaatgtttaatactctctactcctcaagtatactaattaatagttgttacgataaaattaattagttaaaaaatttaaaaattttaggaaatcaaagctatgctttcaatttttcaattagtattatttagtttaattttactatcttttttcttagtggttggtgtacctgttgttttagctttaccagatggctggggtgaaaacaaacgtcttgttttttcaggtcttggggtttggttaatacttgtatttgctgtaggtattttaaattcatttgtaatttaatgcaatcttaaacgttacttatttagtaacgtttaagatttttattaattgattttttaaatatataaaggttaaaatatatactaattagggttactaactcaatggtagagtattcggcttttaaccgacaagctccgggttcaaatcccgggtaacccattaaaaatttcttaaaaattttgttttaaaattatataatttttagttaataaagcctaatgaataatgctttttctgtaattaataaatattttaaacaaaaatatttattaaaaaacaatttagtaacgcaaagaccgaagtacctttgtggtatttcagggggacaagattcaatatttttgtttttttggttattacatcttaaaaataaatggaattttaatttaagtattttacattgtcatcatttatggcaacaatctaattttttagcatttcgacaaatttataaattagcttatatttttaaaactccaatatgtattaacctgagtgaaagtgtattttttactgaaactagtgcacgaaattggcgtcaggaagcttataatagaagcctaatttttgaaaatggtgataaatttattttagggcacacagcaactgatcaattagaaacagcactcttgaatcttattcgtgggacaagtccacaaggattttgtagcttaaaacaaagtaaaaagttaataatttcattatatatatatatatttccttcgtatttttttaaattttctccaaaaaaatttaatgcaaaaacagttaaaaataaatgttatctaaaatcaaaattttttagtaaacaagtttttacttcaaaattaaaaaaaaataatataaaaacagttgattttttattttgctacaatttaaaaaaatttaatggttttggttcatcttttaaacttaacgggaattatatatatttttctttttttatttcgtatcagaggcaaaaaaaaaattctttgtataatgtgttaatacgaccattattatttttgcatcgaaatgatataaccgtattatccaaattttatcatattcctattattaatgattttagtaactataatgtagtattttctcgtaataaacttagacatcaaatttttcctaaatttcggtcgttatttcatttaccctttgattacaaattttatcaatatttacaaattttattagatgagcaagattatatggataatatagttataaatttaataaaaaaaaggaaatatggcgaaaatgaaaaatttaaagaattaccgattgctcttcaacgacgttacatacatttcgtattagaaagttatattaaaaaaaaatgtaattattttcaaatagaatatattcaatctattttattatttgattaaataataaagtttttaagtttgccaagaaccagacttgaactggtgacacgaagattttcagtcttccgctctaccgactgagctatctcggctatttttaattgttatagtaatatattattataaatttaaagcttatagaagctattggttcaattagaacaaagttctagtttatttttattaaaaaattatgatattaaaatttatgttagataaagtaatattaattatttcacttttaattctattatttatagtaccgcaaacaacaacaagagaaaatgttatttttaaaaaattttataatagtggttttttttctaatttctcacaagtagaatttactataaatttaataaattgggcattaattttattattttttggttgtacttttttatttagtatgtattagaataataaaatgtctacctgggatggaaggactcgaacctccgagtggcgggatcaaaacccgctgccttaccacttggcgacaccccatactatttttaattataaatatttcttaatatgaaatattagttcattaaaaagaaactaatatttcatattaagaaatatttaacaagaatctcatattattgaaaataaaagatttatttatataatgtggcacctaatcgtacagcaaaaagccctgtaactaatgctaaaaataatgctataaatatttgagaatctgcaagcgacataaattttaataatatttaataaatgctatttactaattttttaagctaaaattattggattttaatattaattaacttataaatttcctttacgactggcaagtaatataataacaagtgggccggccgcaataattaaaaataaacttgttaattgaaaaaatatttctaaattcatgatgtattttttaatttcgtaatttaataaaattttaggtgaagtaaaatataaaatttaaataatgttaaatttgtattagaaaaaagcttatattagtttaaataataatataataattttaaatatttactttaacgaaaacttactgacgcctgccaaacaaacgctaataataaaaaaaatacaggtataactggtaaaacgtttacaatagggtcgaagggagcataagcttcaggtaattttgctaataataacacgggaatcctccaaaataatatattttgagcaattgaattgtatgttcaaaactactattcaattttttacttaatttagtattattatgctagaaaaatatattttttaccaatgtttttaatactttaaatatttaattcaaaaataaaatcattataataaaaatataaaatattaataaaattaaaatattgtataaacataactataataatgtaaaataaaaagtagttgttcttatatacctataagatatatttctttttatagtacttattattttaagtatatactaatttttagtgatttgtaaaaaaaaattatgaaattagcgtattggatgtatgcagggcctgctcatataggtacattaagagtggcgagttcatttaaaaatgttcatgctattatgcacgcgcctttaggcgatgattattttaatgtaatgcgctctatgttagaacgagaacgcgattttacacccgtaaccgcaagtatcgttgatcgtcatgttcttgctcggggttctcaagaaaaagttgtcgaaaatattactcaaaaagaccaacaacaaaaacctgatttaattgtattaacaccaacttgtacttcaagcattttacaagaagacttacaaaattttgtaaatcgtgcatctttagaatctaattcagatgtaattttagctgacgttaatcattatcgcgtgaatgaattacaagcagcagaccggacgcttgaacaaattattagattttcagttgaaaaagcacgcaaaaataatgtattaaatacagaaaaaactattaaaccttctgctaatattcttgggatttttacattaggatttcataatcaacatgattgtcgagaattaaaaagacttttaaatgatttaggaatctcaattaatgaaattgttccagaaggtgggtcgattaaaaatttaaaaaatttgactaaagcgtggtttaatctagttccgtatcgagaagtaggtttaatggcggcaaattatttacaaaacgaatattccatgccttatgttggaataaccccaatgggtatcgtagatacagctaattgtattcgtgaaatttctactattattaaaaaccacaaccctgatatagaatttaatacagaaaaatatattgatcaacaaacaagatttgtatcccaagctgcgtggttttcgcgttctattgattgtcaaaatttaacagggaaaaaagctgtggtatttggtgatgcaacacatgcagctagtatgacaagaatattagcgcgtgagatggggattaatgtttcatgtgctggtacatattgtaaacacgacgctgattggtttcgtgaacaagttcaaggattttgtgatcaagttttaattactgatgatcatactcaagttgcagatatgatttctcgcattgaaccttcagctatttttggtactcaaatggaacgtcatattggaaaacggttagatataccatgtggtgttatttcagcacctgtacatatccaaaatttcccattaggttatagaccgtttttaggttatgagggtacgaatcaaattgctgatttagtttataattcgttcacattaggtatggaagatcatctattagaaatttttggtggtcatgatacaaaagaagctattacaaaatcactttctacagaatctggctgtagttggtcacccgatgggttagcggagcttaaaaaaataccaggttttgttcgtggaaaagttaaacgtaatacggagaaatttgctcgtgaacgaaatattactgaaattacagtagaaataatgtatgcggcgaaagaagttattggtgcatagtaattaaacccgtatgcactatttttttatggaataataaatataaaaatttagcttttattattaaaacatggttttatatttatctatttttttatagagtttaatttttaaaattttaaattagatcaattttaaaaattatttagaaagcaacaataataaatattataatttttttataattaaatatattataaaatagaaatttcaatcaatattatttagttagttgaatttaccctcgagagggaaaggagaatttttcgccatgacaattagccccccagaacgcgaatctaaaaaagttaaaattcttgtagatcaaaatcctgtagaaacgaactttgaaagatgggcaaaacctggtcatttttcacgcacgttagcaaaaggtccaaatacaactacatggatttggaacttacatgcagatgcacatgattttgatacacaaacaagtgatctagaagatatttcgcgaaaagtgtttagtgcacattttggtcaacttggtattatttttatctggttaagtggtatgtattttcacggcgcacgtttttcaaattatgaagcatggttaacagaccctattcatattaaaccaagtgcgcaagttgtatggccaattgtaggccaagaaatgctgaatgctgatgttggtggcggatttcaagggattcaaattacatctggatttttccaactttggcgtgcttcaggtattactagtgagcttcaattatatactacagcgattggtggtcttgtattcgctgcagctatgttttttgcaggttggtttcattaccataaagcagcgcctaaattagaatggtttcaaaacgtagagtctatgctaaatcaccatttagcaggtcttttaggtcttggaagtttagcatgggctgggcaccaaattcacgtgtctcttccaataaacaagcttcttgatgctggtgttgatcccaaagaaataccactcccacatgaatatatttttcatccagaatatcttgcacaattatacccaagttttggcaaaggattagtaccgttttttacacttgattggaatcaatatagcgatttcttaacttttaaaggcggtttaaacccaattactggaagtttatggctaacagatactgcccatcatcatcttgctattgctgttctttttattattgcaggacaccaatatcgtactaattggggtattggacatagtatcaaagaaattctagaagcacatagcggtccatttactgggcaaggtcataaaggtttatatgaaatattaacaacttcttggcatgctcaattagctattaacttagctttatttggttcattatctatcattgttgctcagcatatgtattcaatgccaccttatccatatttggcaactgattatggtactcaattatctattttcacacatcatacatggattggtggattttgtattgtaggtgctggggcacatgctgctatttttatggttcgtgattatgatccttataataattataataatttattagatcgtgttttacgccatagagatgcaataatttctcatttaaattgggtatgtattttcttaggttttcatagttttggattatatatccataatgatactttaagtgctttaggacgtcctcaagatatgttttcagatactgcaatacaactacaacccgtttttgcacaatggattcaaaacattcatgcgacagctccaggtttcactgctccaaatgtattagatcctacaagttttacttggagtaataatattgtagcaattggtgggaaagtagcaatgatgccaattccattaggtacagctgattttttagtgcatcatattcatgcttttactattcacgtaacggttttaattttgttaaaaggtgtactatatgctcgtagttctcgattaatccctgataaatcaaatttagggtttagatttccttgtgacggtccgggtcgtggaggaacatgtcaagtttctgcttgggatcacgtgtttttaggtttattttggatgtataattctttatcaattgctatttttcattttagttggaaaatgcaatcagatgtttggggtactgtaacagcaaacggcgtttctcatattactggtggtaattttgctcaaagtgcgaacactattaatgggtggttacgtgactttttatgggctcagtcatcacaagttattcaatcatacgggtcagcactttctgcttatggacttattttcttaggagcacattttgtttgggcttttagtttaatgtttttatttagtggacgtggttactggcaagaattgatcgaatctattctttgggcacataataaattaaaagtggctccagctattcaacctcgtgctttaagtattacacaaggtcgggctgtgggtgtagctcattatttattaggtggtattgcaaccacatggtcattcttcttagcaagaattttagctgtgggttaataaactttaacaatttagaggtttttgtaacctctaaattgttaaatgagtcgtttttttatttgttaaaatatatgtattagtgcaatctttttaaagattgcctttaataggagaattataaaatggcaacaaaatttccaaaatttagtcaagccttagcacaagatccaactacacgtaggctttggtatggtttagccacagctcatgatttcgaaagtcatgatggtatgactgaagaacgtctttatcaaaaaatatttgcatcacattttggccaattagcgattatatttctttggacttctggaaacctttttcatgtagcttggcaaggaaatttcgagcagtgggttcaagatcctcttcatatccgaccaatagctcatgcaatctgggatccacattttgggcagccggccgtggaagcttttacacgtggcggtgcttcaggtccagtaaatatatctacatctggtgtttatcaatggtggtttactattgggctacgaactaaccaagatttatataatggatctatttttttaattatactttcagcattatttctatttgcaggctggttacatcttcaaccttcttttcagccaacgctttcatggtttaaaaatgcagaatcgcgattaaatcaccatttagcaggtctgtttggaataagttctctagcttgggcaggtcatttaattcatgtggctattcctgaatctcgtgggcaacatgtacgttggaataattttctgactgttttaccacatccggctggattaactcctttttttacaggtaattgggttgtatatgctcaaaacccagatgcagctactcatgtttggaatactaatgaaaacgctgggagtgctattttaacattcttaggagggtttcatcctgaaactcaaagtctttggttaacagatatggcacatcatcatcttgctattgctgttgttttcatattagccggacaccaatatagaacaatttttggtattgggcatagtatcaaagaaattctagaaagtcacactcctccgtcaggaaatttaggtgctggtcataaaggtatttatgatactcttaataattctttacactttcaattagggttagctttagcgagtcttggcacaattacatctttagtagcacaacatatgtattcgttaccaccgtatgcttacttagcgcaagattttactacacaagcatctttatatacacatcatcagtacattgctgggtttttattaacaggtgcatttgcacatggtgctatattttttgttcgtgattatgatccagaagcaaatcgtggcaacgtgttggcacgtattttagatcataaagaagctattatttcacatttaagttgggttagtttatttttaggttttcatacattaggattatatgtacataatgatgtaatgcaagcttttgggactccagaaaagcaaattctaatcgaacctgtttttgctcaatggattcaagcttctcatggtaaaactgtttataattttgactttttattatcatcatcaacaagtgctccaagtattgctggtcaaaatttatggttacctggatggttagaatcaattaataatgaaagtaattcattatttttaaacataggccctggtgatttcttagtgcatcatgcaattgctttaggactacatacaactacattaattgggatcaaaggtgctctagacgcgcgtggttcaaaattaatgccagataaaaaagattttggttatgctttcccttgtgatggtcctggacgtggtggtacttgtgatatttcagcttgggatgctttctatcttgctattttctggatgttaaatactataggttgggttactttttattggcattggaaacatcttggcatttggcaaggtaatgttagtcaatttaatgaatcgtctacttatttaatgggttggcttcgagattatttatggcttaattcttcacaacttattaatggttataatccttttgggatgaatagtctttctgtttgggcgtggatgtttttatttggtcatttagtgtatgcaacaggatttatgttcttaatttcttggcgtggttattggcaagaattaattgagactttagcttgggctcacgaaagaacacctttagctaatctaattcgttggcgcgacaaaccagtagcactttctattgttcaagcacgtttagtgggtttagcacatttttctgttggctatattcttacttatgctgctttcttaattgcttcgacttctggtaaattcggttaaatttttttaattactcttttattaataaaataaaagagtaattattattactgttaaaattttttgcggtgtaaaaagttacgatttttacacttttttatttttatgatataatataaaaaactggttgtatgtaattactatttattacttgtataagtactaatatgattaatttaagattattttttattattaataaaatttaataatttcttattagtagaatttattaataatttatatatatacttatttttaaaaagtatttttaaatttacaaaatttaaaaaattacaaacactacaaaaatcaactaaatctttaaaattatggctgtttctacagaaactaaaaatgttggtcgtattactcaaataataggccctgttttagatattacttttacggcaaataaaatgcctaaaatttataatgctttatctattactagtaaaaataatgaaggtcaagatatttttgtcgtttgcgaagttcagcagttattaggtgatcattgtgttcgcgctatttctatgaacgctacagatggcttaaaacgaggtatggaggttttagatactggtgatgctttaaatgtaccggttggtaagggaactttaggtcggatttttaatgtacttggggaaactgttgataatttaggtccggctaatacttcagatcaactaccaattcaccgttctgctcctgaatttgtagatttagatacgaaactttctatttttgaaacaggtataaaagtagttgatttattagcgccatatagaagaggtggtaaaattggattatttggaggagctggtgttggaaaaacagtattaattatggaattaattaataacatagcaaaagctcatggtggtgtttctgtttttggtggtgtaggtgagcgtacacgtgaaggtaatgatttatatatggaaatgaaagagtctggtgtaattaatgagtctaacatagctgattcaaaagtagcactagtatatggccaaatgaatgaaccgccgggtgcgcgtatgcgagtaggtttaacagctcttacaatggctgagtattttagagatgtaagtggacaagatgttttattgtttattgataatattttccgttttgtacaagcgggttctgaggtgtctgctttattaggtcgtatgccatctgctgttggatatcagcctacattagcgtcagaaatgggtactttacaagagcggatcacatcaacaaaagatggaagtattacttcaattcaagctgtatatgttccggcagatgatttaacggatccagctccagcaactacatttgctcatttagacgctactactgtactttcacgagggttagcttctaaaggaatatatccagcggtggatcctttagattcaacatctacaatgttacaaccttggattgtgggtgatgagcattacaaatgtgcacaaaacgtaaaacaaacattacaacgttataaagaattacaagatattattgcaattttaggtttagatgaattatcacctgatgatcgtttagttgttgcgcgtgctagaaaaattgaacggtttttatctcagcctttttttgtagctgaagtttttactggttctcctggaaaatatgttagtttggctgatactattaaagggtttaatttgatattagctggtgagttagatgatttatcagagcaagctttctatttagtgggtaatattgaagaagcagtagaaaaaggatctacaaaaaaataattttttggttactatagattttttatagtaacctaaaaaatctatagtttatagttatataaatttatacaaaatatttaagtaaatacttgttttttaattataaaaatgagtattattaaaattagggataaactaaaaaattatggtacttcaagtttcagttatgacaccggatggtattttttgggataataaagctgaagaggtaatacttcccacaaatactggccaaatgggagtattagctaatcacgcaccactaattacagcattagatgtcggtgtaacattaattcgtactgataaaaaatggactccattagctgttatgggtggttttgcattagtaaaacaaaatcaaataacaattttagtaaatggagcagaatctgcagatactttacaatcagaaaaagtagaagcttcgtttgaagaagccaaaaatcaattagaaaatgcagaaagcgaaaaacaaagagtagatgctctttttcaatttaagcgcgcaagagctcgatatcaagtaattaaacagttagttaattaatttttttaattaaaaagcattttgttaaacaaatttaaataataaaaattgaatatgtcgcgttatagaggtccacgattgcgtgttatacgccgtttaggtgaattacctggtttttcaaaaaaagtagataaaaaccaggttccaccaggtcaacatggatggaaaaaaaagacaggtgatcaaaaaaaattaaaagaatcacaatacggtattcgtcttaaagaaaaacaaaaattaagatataattatggaattaatgagcgccaacttataaattatgtacgggaagctcgtcgacggaaaggatctactggagaagtattattacaacttttagaaatgcgattagataatatcatttatcgtttaggatttgcgcccactattcctgcagcacgtcaacttataagccacggtcatattagtataaacaagaaaaacattaatattccaagttatacttgcaaaattaatgataatatttcggttttaaaaaattctcaacaattagtaaaaaattatttaaataatgcaggtattgctactgtttcttcttatttaaatctaaataaagaaacattagaagctagtgttaataacatcgtaccacgcgatttaattaaactccaagttaatgaattattagttattgagtattattctagaaaattataatcattatatctttatgcttaaggtgctaagcataaagatataagatcattaaatgcggaaagatgtctgagtggttgaaggtatagatctggaacatctatgtgatgcttttatatcaccgagggttcgaatccctctctttccgtctttttgcgattatgatgaaattggtagacatgcaagcttgaggggtttgtgggtaaacacccatcccggttcaagtccgggtaatcgcaaaaaatatttaatttagcaatattattgacaaataaaaaaatttatatttatactaaaattattattaaatcctcagtagctcagcggtagagcgatcggctgttaaccgattggtcgtaggttcaatccctacctggggagaaaaaattaaaataaaaatttggttttataacttatttaattattatataaataacagcataaaaattagttattgtttaaagaagttataatactataattattaacttcttttcaatttataataattataaatacgttatataataattttgaaattttatatctaaacattttttaaaaggagcctttttatgtctcatactgtaaagatttacgatacatgcattggttgtactcaatgtgttcgtgcgtgcccaactgatgttttggagatggtaccttgggatgggtgtaaagctagtcaaatcgcgtcagcaccgcgaactgaagattgcgtaggttgtaaacgttgtgaatctgcatgcccgactgactttttaagtgttcgtgtatatttaggtcctgaaactactcgtagtatgggattagcttattaataataatatttatgttggagttgaaaaaacccaacataaatattattattaataaagagaggctgattggattgatacttaaacttataaaaagtaatttattttttgtgaaaacgaagagtttgatcctggctcaggataaacgctggcggcatgcttaacacatgcaagttgtacgaaggtattttttctctcgggaaaagatatactgagtggcggacgggtgagtaacacgtaagaacctaccttttggaaagggacaactattggaaacgatagctaataccttatattgctgagaagtgaaaaatgaaaattgccaagagatgggcttgcgcctgattagctagttggtgtggtaaaggcataccaaggcaatgatcagtagctgttctgagaggatgatcagccacactgggactgagacacggcccagactcctacgggaggcagcagtgaggaattttccgcaatgggcgaaagcctgacggagcaatgccgcgtgaaggatgaaggcctatgggttgtaaacttcttttctcagaaaagaattatgacggtatctgaggaataagcatcggctaactctgtgccagcagccgcggtaagacagaggatgcaagcgttatccggaatgattgggcgtaaagcgtctgtaggttgtttaaaaagtattctgtcaaagattagggcttaaccctagataggcagaataaacttttaagctagagtttggtagaggcagagggaattcccggtggagcggtgaaatgcgtagatatcgggaggaacaccaaaggcgaaggcactctgctgggccaatactaacactgagagacgaaagcgaggggagcaaatgggattagataccccagtagtcctcgccgtaaacaatggaaactaggtgttgggtgtataaaaatcattcagtatcgtagctaacgcattaagtttcccgcctggggagtatgctcgcaagagtgaaactcaaaggaattgacgggaacccgcacaattggtggggtacgtggtttaattcgatgcaacgcgaagaaccttaccaggatttgacatgtcacttgtttcttcaacttactactttaattggttttaagcggaaacattaaaaagtgaacacaggtggtgcatggctgtcgtcagctcgtgtcttgagatgttgggttaagtcccgcaacgagcgcaaccctttttttgaattgcttggcgcttttaaacgcttttagagaggaaattcaaaatactgccggtgacaagccggaggaaggtgaggatgacgtcaagtcagcatgccccttatatcctgggcgacacacgtgctacaatggccggaacaaagagaagcgaccccgcgaggacaagctaacctcaaaaatccggtctcagttcggattgcaggctgcaactcgcctgcatgaagttggaatcaatagtaatcgcaggtcagccacactgcggtgaatacgtttccgggttttgcacacaccgcccgtcacaccacggaaattggctacgcccgaagtcattactctaaccatctaatggagggggatgcctaaggcggggctagtgactggggtgaagtcgtaacaaggtagccgtactggaaggtgcggctggatcacctccttataaaggaaactaaatttattttattattcttttatatcatatatatattacctacgtaaaaaaaacgtaggtattatatactcgggctattagctcagttggtgagagcgcacccctgataagggtgaggtcgctggttcaaatccagcatagcccaccaataaaaaaaattataatatttgggaatatagctcagctggtagagcgctgcccttgcaaggcagatgtcagcggttcaagtccgcttatttccaccaaaaatgttaaaaaattttttttacattttagaacatggtcaaatgaattaaagcgtagggcggatacctaggcatctagagacgaagaagggcgtggtaccgacgatacacttcggggagttggaaacaagcattgatccgaagattcccgaatagggcaaccttttatactttttgctgaattcataagcaaaaaagagacaactcagtgaactgaaacatcttattaactgaaggaaaataaagcaaacgcgatttcccgagtagtggcgagcgaaaaggaaacagcctaaaccaattttaaaaattggggttgtgggataaccaaaaaatatttttaaaaatatttttcaagtagttatttaattataaattagacgaagcagctgaatcctgcaccatagatggtgaaagtccagtcgtcaaaaattcaaatttaactatgtgtttttcccaagtagcacgggacacgagaaatcccgtgtgaatcagcgaggaccacctcgtaaggctaaatactcctagatgaccgatagtgaaatagtaccgtgagggaaaggtgaaaagaacccctgaaggggagtgaaatagaacatgaaatcctatgctgacaaacagtgggaggtttttttaaaactgaccgcgtgcctgttgaagaatgagccggcgacttagaaaaagtggcgtggttaaggaaaaattccgaagccttagcgaaagcgagtctgaatagggcgatcaaatattttaatatttacaatttagtcattttttctagacccgaacccgggtgatctaaccatgaccaggatgaaacttgggtgataccaagtgaaggtccgaaccgaccgatgttgaaaaatcggcggatgagttgtggttagcggtgaaataccagtcgaacccggagctagctggttctccccgaaatgcgttgaggcgcagcagtacatctagtctatctaggggtaaagcactgtttcggtgcgggctgtgaaaacggtaccaaatcgtggcaaactctgaatactagaaatgacggtgtagtagtgagactgtgggggataagctccattgtcaagagggaaacagcccagaccaccagctaaggccccaaaatggtaatgtagtgacaaaggaggtgaaaatgcaaacacaaccaggaggttggcttagaagcagccatcctttaaagagtgcgtaatagctcactggtactagcgtttttgcgccgaaaatgtacgggacttaattatctgccgaagctgtgggatatatgaaaataatgtatatataaaaatacaatttatatcggtaggggagcgttctgctttagggtgaagtttaaatgtaagtttagatggaccaagcagaagtgagaatgtcggcttgagtaacgcaaacattggtgagaatccaatgccccgaaaacctaaggattccttcactaggttcgtccatgaagggtgagtcaggacctaaggcgaggccgaacggcgtagtcgatggcaaacaggttaatattcctgtactgttttgtatttgataccaggggacagaagaggtaacagttagccgttattggatttcggtggaaacttgcaaagctgggaaaagaaaaaaaacttcttcctttttaaagctaacgagtgatacgtttgtattttatttataaaatatgaattaatttcttatcatattctcaagaaaagcctgtattatctataaatgcaaaacacctgtaccataaaccgacacaggtaggtaggtagagtataccaaggggcgcgagataactctctctaaggaactcggcaaaatgaccccgtaacttcgggagaaggggtgccaaggggtgatttttcatcttttggccgcagtgaccaggcccaggcgactgtttatcaaaaacacaggtctccgcaaagtcgtaagacaacatatgggggctgacgcctgcccagtgccggaaggttaaagaagtaggttattcttttttaagaaaaagcttgcgactgaagccccggtgaacggcggccgtaactataacggtcctaaggtagcgaaattccttgtcggataagtcccgacccgcacgaaaggcgtaacgatctgggcgctgtctcggagagagactcggtgaaatagacatgtctgtgaagatgcggactacctgcacctggacagaaagaccctatgaagcttgactgtagcctgaaattgaatttgggttttttttgcgcagactaggtgggaggcgttgataattttcttttgggaaaattggagccaacagtgagagaccactctggaaaagctagaattctaatggcgttccttgaagcaggacgcttgacagtttcaggtgggcagtttgactggggcggtcatctcttaaaaggtaacagagatgtgcaaaggttccttcaggctggacggaaatcagccgtagagtataaaggcagaagggagcttgactgtaagacctacaagtcaaacaggggcgaaagccggccttagtgatccgacggtaccgagtggaagggccgtcgctaaacggataaaagttactctagggataacaggctgatcttccccaagagttcacatcgacgggaaggtttggcacctcgatgtcggctcatcgcaacctggggcggtagtacgtcccaagggttgggctgttcgcccatgaaagcggtacgtgagctgggttcagaacgtcgtgagacagttcggtccatatccggtgtaggcgttagagcattgagaggagtcttccatagtacgagaggacctggaagaacatacctctagtataccagttcttgtgccaacaggaaacgctgggtagctatgtatggagaagataaccgctgaaagcatctaagtgggaagctcacctcaagatgagtgctctcttttctaatttagaaatatcggtcacggcaagactagccgtttgataggtattaagtggaataccagtaatgggtgtagctgaaatatactaatagaccgatcgattttgaccagaaaatacaaaaatttattttaaaatacctagtgttcatgcttgtgtggaaccaccttattccatcccgaactaagaagtgaaacgcgcaaggggcgaagatactaaaaggggggccttttgggaaaatagcttaatgctaggtaattaattttaaaaatacaatatttaacttcctaatttaaaagcttctaaaaaaatacctaataaaaaaccacgcttaaagatattaattataattttcatttttttaataatactatttttatgggtttgtttgcttaatacatcaaaaaaggagtagttaaaaaaatttaataattctaatataatattaaaaaaaaataaagaaaaaaaattatatgatattttttttgaatatattcctattaaattgccgaatataaaactacataaaagtaaaaaaaatattgaaattttaaaattataattttgaatattaaaagtttttttttgtaaatttttcattgaaaatattttatgttaatataatatactaaaagataaaactcctcctagtatattaaaatatttgataaaaaactaatttgaattagtcttctcctaaaaaaaaatcttgtattttttgaataacacctttcggaggtacatctaaatcaatgaaatattcttcttttcctattaaccttcgagcagcattttcaaatgcaatacccgacagagataattttttatctaatactagtggttctcccttattagttgaaataattacattagtatcttcaggtattgcacctaataaaggaatacctaatgtttcttggacatccattactgatagcatagtgctgttttgaatcatatccatacgaacacgatttaataataatttagtatcaacaattgtgtttgcttctaatagaccagcaaccctatcagcatcacgaatagcagttatttcaggagttgttacaataatagcttcttgtgctggcgctatagcatttataaaaccaacatcaatacctgctgggcagtcgattaatataaattgataacctaatttttttattgaagaaaccaattgtcgcatatgttgttgtgttacattatatttttggtaatttcgagaaactgctaataatgctaaattcttccatcgcttttctcgtacaagtgcttggtctaatcgacaacgcccttcaataatatccatagctgtaaaagtaatacgattttctaaacctaataataaatctaaatttcgtaatcctatgtccgcatcaattaaagcaacacgataaccaaatctagctatagacattcctaaattagcagtagttgttgtttttcctacacctcctttcccagaagttattactataacccgaggttctggttcatcaatatcttttttagttgagttttcttcggaggttgattctggaatcataggttcttttatttttttttttttt

SEQ ID NO: 49119 - DNA, 381 bp, Auxenochlorella protothecoides
atggattttacttttatgggtggaagtatgggttctgttgttggagaaaaaattactcgcttaatagaatatgcaacagcacaaggacttactttaataatattttgcgcgtctggtggtgcccgtatgcaagaaggcatcttaagtttaatgcaaatggcgaaaatatctgctgcgttaaatgctcaccaaaatactgcaaaacttctttatattccaatattaacttcaccaaccactggtggtgttacagcgagttttgcgatgttaggtgatttaatttttgcagaaccaagagcccttattgggtttgccggccgtagagttattgaacaaacacttcaagagcaattaccaaaagattttcaaacagcagaatat

SEQ ID NO: 49120 - DNA, 381 bp, Prototheca zopfii
atggattttaactatttaggtggtagtatgggatcagtaattggtgaacaaattactcgtttaattgaacacgctacaaaaaataatgttaatttaattattttctgtgcttcaggtggagcgagaatgcaagaaagttcactaagtttaatgcaaatgggtaaagtttcagcagcattaaacatttatcaaaaaaaattaaatcttttatacatttctgtatgtacttctcctacaacaggtggagttactgctagtttcgcaatgttaggagacttaatttttgcagaaccaggagcaattattgcttttgctggaagaagagttgtttcagaaacattaaatgaaacatttccagaaggatatcaaacttctgaatat

SEQ ID NO: 49121 - DNA, 380 bp, Prototheca blaschkaea
atggattttaatttcttaggaggtagtatgggttcagtagtaggtgaacaaattactcgtttaattgaatatgctactaaacaaaatctttatttaatcattttctgtgcttcaggaggtgctagaatgcaagaaggttcattaagtttaatgcaaatgagtaaagtttcaggagctcttcatacatatcaaaaattatcaaatcttttctatatttcagtttgtacttcaccaacaacaggtggtgtttcagcaagttttgcaatgttaggagatattattttagcagagccaggagctgttattgcttttgctggtagaagagtaattgaaaatactattggtgaagaattaccaaaaggttttcaaactagtgaata

SEQ ID NO: 49122 - DNA, 381 bp, Prototheca zopfii
atggattttaattatttaggtggtagtatgggatcagtaattggtgaacaaattactcgtttaattgaacatgctacaaaaaatgatattaatttaattattttttgtgcttcaggtggtgcaagaatgcaagaaagttcattaagtttaatgcaaatgggtaaagtatctgctgcattaaatatttatcaaaaaaaattaaatcttttatatatttctgtatgtacttctcctacaacaggtggagttactgctagttttgcaatgttaggagactttatttttgcggaaccaggagctattatcgcttttgccggaagaagagttgtttcagaaacattaaatgaagaatttccagaaggatatcaaactagtgaatat

SEQ ID NO: 49123 - DNA, 381 bp, Prototheca wickerhamii
atggattttacttttatggggggaagtatgggttcagttgttggggagaaaattactcgcctaattgaacatgcaacagcgcaagggttaactttaatcatattttgcgcatcaggtggtgctcgtatgcaagaaggtattttaagtttaatgcaaatggctaaaatttctggggctttaaatgctcaccaaaatacagcaaaacttctttatattcctatattaacttcaccaactactggcggtgttactgcaagttttgctatgcttggtgatttaatttttgcggagccaaaagcagttattggttttgcaggtcgtcgagtaattgaacaaacacttcaagaacaattaccgaaagatttccaaacagcggaatat

SEQ ID NO: 49124 - DNA, 381 bp, Prototheca stagnora
atggattttaattttatgggaggtagtatgggatcagtagtaggagaaaaacttactcgattaattgaatatgctactaaaaaaagattatatttagtaattatttgtacttcaggtggtgctagaatgcaagaaggtgttttaagtctaatgcaaatggcaaaaatctcagcagctcttcatatttatcaaaacatagctaaacttttatatatttcaatttgtacttcacctacaactgggggaattacagcaagttttgctatgttaggtaatattattttagcagaacctagagctttaattggatttgcaggacgtagagtaattgctttaactcttcgcgaagaattacctcgtggattccaaacaagtgaatat

SEQ ID NO: 49125 - DNA, 381 bp, Prototheca moriformis
atggatttccattttatgggtggtagtatgggttctgttgttggagaaaaattaactcgtttaattgaatatgcaacaattaaaggcctttctttagtaattttttgtgcttctggtggtgctcgtatgcaagaaggtattttaagtttaatgcaaatggctaaaatttctgctgcattaaatcgtcatcaaaatatagcaaaacttttatatatcccagttttaacatcacctactacaggaggagttactgcaagttttgcgatgctaggagatttaatttatgcagaacctcgtgcacttattggttttgctggacgacgagttatttctcaaacacttcaagaacaattaccaaaagattttcaaacagctgaatat

SEQ ID NO: 49126 - DNA, 1629 bp, Auxenochlorella protothecoides
  modified_base (39)..(48): a, c, t, g, unknown or other
  modified_base (736)..(745): a, c, t, g, unknown or other
tttgacatcaccgagttccccaccaagtttgccggccannnnnnnnnncctgccctgagttgggcgtttgacatcaccgagttccccaccaagtttgccggccagatcaagtcctttgacgtggagggcctggtggacaagaagaatgctcggcggtacgacgacgccctttcctatgccatggtcgcatctaagaaggccttgcgtcaggcgggtctggagaaggaggcctgccccgaggggtacgagaagctggacaagacgcgtgtaggcgtgctggtaggctccggcatgggcggcctgaccgtcttccaggacggcgtcaaggccctggtggagaaggggcacaagaagatcacgcccttcttcatcccctacgccatcaccaacatgggcagcgcgctggtgggcatcgaccagggcttcatgggccccaactactccatctccaccgcctgcgccacggccaactatgcatttgtgaacgcggccaaccacatccgcaacggcgacgcggacgtgatggtggcaggcggctccgaggcctccatcgtgcccgtgggcctgggcggctttgtggcctgccgcgcgctgtctacgcgcaactttgagccctggcgcgccagccgaccgtgggacgcgggtcgcgacggctttgtcatgggcgagggcgcgggcgtgctggtgctggagtccctggagcacgcccaggcacgcggcgccaccatcctggccnnnnnnnnnnctgcttgggtcagcgtggccgtgtggcgctccgcgctggtgggcatcgaccagggcttcatgggccccaactactccatctccaccgcctgcgccacggcaaactatgcattcgtgaacgcggccaaccacatccgcaacggcgacgcggacgtgatggtggcgggcggctccgaggcctccatcgtgcccgtgggcctgggcggctttgtggcctgccgcgcgctgtccacgcgcaactttgagccctggcgcgccagccgaccgtgggacgcggggcgcgacggcttcgtcatgggcgagggcgcgggcgtgctggtgctggagtccctggagcacgcccaggcacgcggcgccaccatcctggccgagtacctgggcggcgccttcacctgcgacgcgcaccacatgaccgacccccaccccgagggcctgggcgtgagcacctgcatccggctggccctggccgacgcgggcgtggaccgggacgaggtcaactacatcaacgcgcacgccacctccacgctggtcaactacatcaacgcgcacgccacctccacgctggtgggcgacaaggcggagatcaaggccgtgcgcggcgtgtttggcgacatgcgtggcaccaagatgaacgccaccaagtccatgatcgggcattgcctgggcgcggcgggcgggctggaggccatcgccaccatccaggccatccgcacggggtgggtgcaccccaccatcaaccacgacgaccccatcccggaggtggagggcatcgacatcgtgcccaatgtcaaggcgcggcatgacgtccgcgtcggcatctccaactcctttggcttcggcgggcacaactccgccgtcgccttcgggccctacaaggaggcatga

SEQ ID NO: 49127 - protein, 542 aa, Auxenochlorella protothecoides
  MOD_RES (13)..(16): Any amino acid
  MOD_RES (246)..(249): Any amino acid
FDITEFPTKFAGXXXXPALSWAFDITEFPTKFAGQIKSFDVEGLVDKKNARRYDDALSYAMVASKKALRQAGLEKEACPEGYEKLDKTRVGVLVGSGMGGLTVFQDGVKALVEKGHKKITPFFIPYAITNMGSALVGIDQGFMGPNYSISTACATANYAFVNAANHIRNGDADVMVAGGSEASIVPVGLGGFVACRALSTRNFEPWRASRPWDAGRDGFVMGEGAGVLVLESLEHAQARGATILAXXXXAWVSVAVWRSALVGIDQGFMGPNYSISTACATANYAFVNAANHIRNGDADVMVAGGSEASIVPVGLGGFVACRALSTRNFEPWRASRPWDAGRDGFVMGEGAGVLVLESLEHAQARGATILAEYLGGAFTCDAHHMTDPHPEGLGVSTCIRLALADAGVDRDEVNYINAHATSTLVNYINAHATSTLVGDKAEIKAVRGVFGDMRGTKMNATKSMIGHCLGAAGGLEAIATIQAIRTGWVHPTINHDDPIPEVEGIDIVPNVKARHDVRVGISNSFGFGGHNSAVAFGPYKEA

SEQ ID NO: 49128 - DNA, 765 bp, Auxenochlorella protothecoides
atgaccgtcctaaccgctcctcccgctccctggttaagcgcgccgcgggcgagcctggcggaggcggtggtggactactctgtccgccccgagcctgcccaggagttttggacctccctagaaccctgcaagatggtggagaacaagcgcgtcttcctggaggagcaccggatccgcggtaacgaggcaggcccctcccagcacgtgaccattgccgcggtggccaacatcttgcaggaggctgcgggcaaccacgcggtggcgatgtggggccgcagcagccagggcttcgccaccgacccagagctggtggagcggggcctgatcttcgtcatgacgcgcatgcagatccagatgcaccgctacccgcgctggggcgacctggtccaggtggagacctggttccaggccgcgggcaagctgggcgcgcagcgcgagtggctcctgcgcgacaagctgaccggcgaggtgttgggcgccgccacctccacctgggtcatgatcaacatgcgcacgcgccgtccctgccgcatgccggagctggtgcggtggaagatccgcggtaacgaggcaggcccctcccagcacgtgaccattgccgcggtggccaacatcctgcaggaggctgcgggcaaccacgcggtggcgatgtggggccgcagcagccagggctttgccaccgacccggagctggtggagcggggcctgatcttcgtcatgacgcgcatgcagatccagatgcaccgctacccgcgctggggcgac

SEQ ID NO: 49129 - protein, 255 aa, Auxenochlorella protothecoides
MTVLTAPPAPWLSAPRASLAEAVVDYSVRPEPAQEFWTSLEPCKMVENKRVFLEEHRIRGNEAGPSQHVTIAAVANILQEAAGNHAVAMWGRSSQGFATDPELVERGLIFVMTRMQIQMHRYPRWGDLVQVETWFQAAGKLGAQREWLLRDKLTGEVLGAATSTWVMINMRTRRPCRMPELVRWKIRGNEAGPSQHVTIAAVANILQEAAGNHAVAMWGRSSQGFATDPELVERGLIFVMTRMQIQMHRYPRWGD

SEQ ID NO: 49130 - DNA, 910 bp, Auxenochlorella protothecoides
cgtgcgcgtggacgagctggccgcgctgcgcgcgcggctgaacgccgacctggccaaggccgacggcggcaagctgtccgtcaacgactttgtggtgaaggcctccgcgctggcgctgcgccgcttccctgcggtcaacgccagctggcacgcggactacatccggcagtaccacgatgtcgacatctccattgcggtgcagaccccggcgggcctcatggttcccatcgtgcgggatgccgacgccaagggcctggcagccattgcggccgacgtgaggcggctggcgggcaaggccaaggagggcaagctgcggccagaggagttcacgggcgggacctttaccatctcaaacctgggcatgtacggcgtcagccagttctccgccatcatcaacccgccccaggcctgcatcttggcggtgggcgcggccgagccgcgcgtcgtgcgcggcgctgcgggcgggttcgaggaggcgcagttcctccaggccacgctctcctgcgaccaccgcgtcgtggacggcgcgctgggcgcgcagtggctgcaggccttcaaggggtacctggagaaccccgcgtccatgctgctctgagcacagcagcgggtgtctggctgggcttgccgccctgcaccccgtacgttgccatgaaattcagaatacgagcaatcatgcatagaagccgggaagctggggacaggatgggcacaaggaggcctgcaagccacctggagttgctgtgagccgggcgccagatgtttgtttgagtgggactccggtccggttttagcatgcccggaaacttgacagagctcggatgacaactctcagcgcgagattgtctgagataccattgacatatgtgaccataggccggcatggatttatttccgtgagtatcgccccagg

SEQ ID NO: 49131 - DNA, 870 bp, Auxenochlorella protothecoides
caccgtggcggccgacgtggcggctgcggtgcccaccaccgaggcggcggcggtgcgccaggccgtgcccgagcagcgcggcacgggcggcgacgccgcagcaggcaggatccccgccgctggagccggcacaaccgccggtgcaggaggcggcaccacgactgtgccgctgcgcggcttccgcaaggccatggtgaagagcatggcggcggcgggggcggtgccccacttccatttctgcgaagaggtgcagatggatgcgctggttgccctccgtgccctgctccgcactgaggccgtgctggggggcgccaagctcacgtatatgccgttcttcatcaaggcatgctgggagttgggggcggcggcgctggcgcttgagcagttccccctggtcaattccagcctgtcccccgaccaggcctccatcctgcagcacggcgccaagaatattggcattgcggtggccaccgcccacggcctggccgttcccaacatcaagaatgtcgagagcaagtccatcgtggaaattgcggccgagctggcccgtctgcaggccgccgcggccgccaaccagctgcggcccgaggacatcaggggcggcacgttcacgctgtccaacatcggcatggtgggcggcacctacgccacccccttggtgaacccgcccgaggtggccatcatggctctgggcaagatgcaaagcgtgccgcgctttgcccccgacgggcgcagcgtggtgccccagtccattctgaacatctcgctgggggccgatcaccgggtggtggatggcgccatgctggcaggcttcgcccaggcctggcggcggtacgttgagatccctggcaagctgctgctggagatgcg

SEQ ID NO: 49132 - DNA, 910 bp, Auxenochlorella protothecoides; identical to SEQ ID NO: 49130

SEQ ID NO: 49133 - protein, 198 aa, Auxenochlorella protothecoides
  MOD_RES (198)..(198): Any amino acid
VRVDELAALRARLNADLAKADGGKLSVNDFVVKASALALRRFPAVNASWHADYIRQYHDVDISIAVQTPAGLMVPIVRDADAKGLAAIAADVRRLAGKAKEGKLRPEEFTGGTFTISNLGMYGVSQFSAIINPPQACILAVGAAEPRVVRGAAGGFEEAQFLQATLSCDHRVVDGALGAQWLQAFKGYLENPASMLLX

SEQ ID NO: 49134 - protein, 290 aa, Auxenochlorella protothecoides
  MOD_RES (290)..(290): Any amino acid
TVAADVAAAVPTTEAAAVRQAVPEQRGTGGDAAAGRIPAAGAGTTAGAGGGTTTVPLRGFRKAMVKSMAAAGAVPHFHFCEEVQMDALVALRALLRTEAVLGGAKLTYMPFFIKACWELGAAALALEQFPLVNSSLSPDQASILQHGAKNIGIAVATAHGLAVPNIKNVESKSIVEIAAELARLQAAAAANQLRPEDIRGGTFTLSNIGMVGGTYATPLVNPPEVAIMALGKMQSVPRFAPDGRSVVPQSILNISLGADHRVVDGAMLAGFAQAWRRYVEIPGKLLLEMX

SEQ ID NO: 49135 - DNA, 1434 bp, Auxenochlorella protothecoides
cttaaattcaaggtgttccaagcgctaggcaatgggcagttggagtccctcgcctccggactgtgcgagcgcatcggcgacactgccaactctaggatgaaggccaagacggcggagggcgggagtgtcaccctgcaggagggcttcaacgaccaccaggacgccctggggctggtatctcgcttcctggcagacaccttttcctccagctttacccgcagcgtgcacagcgtgggccaccgtgtggtgcatggcctggacatcagcgccccggtcctcatcgacgatggggtgaaggccgtgatcaagaaggctatcagcctggccccgcttcacaaccccgccggcctccagggtatcgaggctgcaatggccaccttccccgcggccccccacgtcgccgtgtttgacaccgccttccaccaaaccatggcccccgctgcctacatgtatgccctgcccaaggagctgtacgatgagcaagcggtcaggaggtatggtttccacggcagctcctacaagtacctggtcccacgggcagccaagacgctgggcaagcccgtggagagcctgaatgccatcatttgccatctaggggccgggagcagcatgtgtgccgtgcgcggcggccagtcagtggacaccaccatgggcctgactccgctggagggcctggtcatgggcacccgctgcggcgacattgaccctgccattgtgacgtatctgttgggccaaggccactccggggcggaggtggatgcgctgctgaacaagcggagtgggttcctgggcctgaccgggcactccgacctgcgcgctgtcatcgacggcgctgcagccggcagcgcccccgaccggattgcgctggacgtgtggcggcaccgcatccgcaagtacattggcgcctacgcgctccagatgggcggccccctggatgccctgatcttctccgccggcataggggagaacagctccatcctgcgcgccttcctgctggaggggctggagtggtatggcatcgcgctggacgaagaaagtaataaggcggccgtggacggggtggcgggcaacatcacggcgccgggggcaaaggtgcaggtgctggtgattcccacggacgaggagctgtccattgcggagcaggccatagaggtcgtggaccgcacctgacctgggttggacgtgctgcagggaccccgctcaacggtgcaggagcatctggctgtcaggttttccgtccctggcaccgtcctctgccctgcagactctcggcactggcacgacaggggctcacgaggtttcgaccttttaggtctgctgccctgatgatggacaggaaggggccacaccatgccctggcgcaccagcctgcctgctctgcgctctgccatgccatggagttttgaagctgcccatgtgcgacgtaccatagcc

SEQ ID NO: 49136 - protein, 358 aa, Auxenochlorella protothecoides
  MOD_RES (358)..(358): Any amino acid
MKAKTAEGGSVTLQEGFNDHQDALGLVSRFLADTFSSSFTRSVHSVGHRVVHGLDISAPVLIDDGVKAVIKKAISLAPLHNPAGLQGIEAAMATFPAAPHVAVFDTAFHQTMAPAAYMYALPKELYDEQAVRRYGFHGSSYKYLVPRAAKTLGKPVESLNAIICHLGAGSSMCAVRGGQSVDTTMGLTPLEGLVMGTRCGDIDPAIVTYLLGQGHSGAEVDALLNKRSGFLGLTGHSDLRAVIDGAAAGSAPDRIALDVWRHRIRKYIGAYALQMGGPLDALIFSAGIGENSSILRAFLLEGLEWYGIALDEESNKAAVDGVAGNITAPGAKVQVLVIPTDEELSIAEQAIEVVDRTX

SEQ ID NO: 49137 - DNA, 1314 bp, Auxenochlorella protothecoides
tgctatggcgccgtgctgctttgttacaggaatcaagactgaaacccatgcccagccctggccgcctctgatgtggatggcatgcctcttcttgatgagcaccccgcaaagtgagattgcttgccagggcctgcctgtgccgagtcctcacactccctcctcatggcttcgccacccaggatgaagcacgccatgggtttgaaagacccctctgagagcatgtatggcgtgacagaggaggaggcaaagcgcctgttgaccctgggaagattcgatgagctcatggacaggattttcgtcaaataccaggcaatgaagaaggccaaggacgtgatcctgctggagggcgccaccgtgcgcgggctgctgggcaaccacaacgagctgaacgccaagattgccgccgagctggacacctccatcctcatgatcatggacctgaatcgcgacaacccgggcaccgcctccgagatcgcaagccgcgcgctgcgccacaggcgtgagctgcaggccgagcgcgcctcggtcctgggcctgctgctgaacaaggtccccctcgccgcccacgccgacatcgtgtcgggcgtcgccgccgagctggcggactccggcctgacctttgcgggcggcatcccctacgaccgcatcatcggcaccgcgagggtgaacgagtttgcaaacgcactgggcgccaagcagatctacggccgtccagagctcatcgactctgacgtgacggggatcatggtggcggcccaatcggtgcacggcttcctggacaagctggaggcgatccgcgcgcagcgcgaagctgagggccagaccttcttccgccccctggtgctgaccaccaaggaccgccaggacctggtgctgggcctggcggcggccagcctgtccggcgcctgcccgcccctgggcggcctggtgctgtgcgatggtggggcgtgcgccatcacccccccggtccatgccatcatggcacggctgggccccgacacgctgccggtgctggaggtgccgcacggcgcgttcgagaccgcgcggcgcatggcgcgcgtgaacccgggcatcctgcccacctcggtgcgcaaggtgcgcgaggctcgcgctctgttcgggcggcacgtggacgttgacgccgtggcctcgggtatggcggtgcaccgcgagccgcgcctgacgcccaagcgcttcgtctggcagatcgaagagctgtgtcgcgccgcgccgcagcgcatcgtgctgcccgaggcgcacgaccaccgcgtgctcagcgctgcggcggaggtcgcggcgcgcggcatcgcgcgc

SEQ ID NO: 49138 - protein, 365 aa, Auxenochlorella protothecoides
MYGVTEEEAKRLLTLGRFDELMDRIFVKYQAMKKAKDVILLEGATVRGLLGNHNELNAKIAAELDTSILMIMDLNRDNPGTASEIASRALRHRRELQAERASVLGLLLNKVPLAAHADIVSGVAAELADSGLTFAGGIPYDRIIGTARVNEFANALGAKQIYGRPELIDSDVTGIMVAAQSVHGFLDKLEAIRAQREAEGQTFFRPLVLTTKDRQDLVLGLAAASLSGACPPLGGLVLCDGGACAITPPVHAIMARLGPDTLPVLEVPHGAFETARRMARVNPGILPTSVRKVREARALFGRHVDVDAVASGMAVHREPRLTPKRFVWQIEELCRAAPQRIVLPEAHDHRVLSAAAEVAARGIAR

SEQ ID NO: 49139 - DNA, 901 bp, Auxenochlorella protothecoides
cggcccggcccccgcctggcggtggcccgcaccccatccccccacccccgctccgtggccgcgggcgccggggttcgcttcgccggctccggctcctccacccccgccggggtgctgagcaacgccgatctggagcgccttgtggacacaaacgacgagtggatcgtgtcccgcaccggcatccggcgccggcacatcctggcccagggcgagtcgctggccgatcacgccctgctggcggcccagcgtgccctggcggccgcgggcgtccccgccgcggacgtggacctggtcctgctggccacctcctcccctgacgacggcttcggcagcgcctgcgcagtccaggcacggctgggcgcgggcaacgccgccgccttcgacctcaccgccgcctgctccggcttcgtcatgggcgtggtcaccgccgcacagttcctgcgcacgggggcataccgcaacgtgctggtcatcggcgccgacgcgctgtcgcgctacatcgactggcgcgaccggggtacctgcatcctgtttggcgacggcgcgggtgccgtgctcctgcaggcggggggggagggggagcgcgacaacctcctcgggcacgacctgagatcagacggcaacgggcagcggcacctgcactccaggttcctgggcgccggggacaaggcgctgaacgacgacaccgcctcctcccaccccgcctttgccaacatcgccatgaacggcagcgaagtgttcaagtttgcggtgcgcgccgtgcccaagacggtggaggccgccctgggcgtggcgcagctggaggtcaaggacctcgattggctggtgctgcaccaggccaaccagcgcatcctgaccgccgccgcagaccggctgggggtgccggcgggtgagccggcgg

SEQ ID NO: 49140 - protein, 300 aa, Auxenochlorella protothecoides
RPGPRLAVARTPSPHPRSVAAGAGVRFAGSGSSTPAGVLSNADLERLVDTNDEWIVSRTGIRRRHILAQGESLADHALLAAQRALAAAGVPAADVDLVLLATSSPDDGFGSACAVQARLGAGNAAAFDLTAACSGFVMGVVTAAQFLRTGAYRNVLVIGADALSRYIDWRDRGTCILFGDGAGAVLLQAGGEGERDNLLGHDLRSDGNGQRHLHSRFLGAGDKALNDDTASSHPAFANIAMNGSEVFKFAVRAVPKTVEAALGVAQLEVKDLDWLVLHQANQRILTAAADRLGVPAGEPA

SEQ ID NO: 49141 - DNA, 1210 bp, Auxenochlorella protothecoides
atgttcactgcacgggcattcagggcgcccaagctgccaaccatgcctcatgtccgcgcggcggcgacccaggccgtcgatgcccccgccaagaccgctcagcaagaactggagggtggcgtgacggtggtcaccggctcctcccgcggcatcggccgcgccatcgcgctacgacttggtgccgcgggtgggcgcgtggtggtcaactatgccgcctccagcgccgcggcggaggatgtggcgcaccagatcgagggtctaggcgggtcggccattgtggtcaagggcgacctcgccaaggcggctgacgcgcaggccctgatccaggccgccgtatcggagtggggcaccatcgatgcgctggtcaacaacgcgggcatcacaagggacacgctgatgctgcgcatgaagccggagcagtggcaggcggtgatcgacgtgaacctgtcgggcgtgttctacgccacgcaggccgccacgaaggtcatggccaagaagcggaagggcaggatcgtcaacatctcctctgtggtggggctgactgggaacgcggggcaggtgaactacgccgccgccaaggcgggcctcatcggcatgacgcgctccgtggcccgggagtttgcggggcggggtctgctggtcaacgccatcgcgcccgggttcatcgagtcggagatgacgggcgtgctgtcctccgaggttgaggccgccatcctcgccaagatccccctggcccccatcacgcccgccgccatcaggctggagacacgccaggcactcgaggcgcacaccgcctcccgccggaaggaagaggctgctgcagtgaaggccgaggcagagtgggcatcacagccgtccaaagttggaaggccgcccctcacccagcttccctggtccgccagcaccaccacctacaacctcaccccagagatggaggcagccatgcgccggatgtacagcaccaggaactccgaggtgaatcgcgccgagtgcctcaggcggacagcccagtcggccaaggcagagcaggaggagaaactcttggcgttggagcactacaaggcagaggatgcctactggaaccgcggggccgccagcgagcggtgggtgtcgccggcccagcgcgtgagacaccacggccccgcacccgccgccggcgcggagagcgaggtgcagcgtgcggcgcgtgcggcgcgggaccgcggggccg

SEQ ID NO: 49142 - protein, 403 aa, Auxenochlorella protothecoides
MFTARAFRAPKLPTMPHVRAAATQAVDAPAKTAQQELEGGVTVVTGSSRGIGRAIALRLGAAGGRVVVNYAASSAAAEDVAHQIEGLGGSAIVVKGDLAKAADAQALIQAAVSEWGTIDALVNNAGITRDTLMLRMKPEQWQAVIDVNLSGVFYATQAATKVMAKKRKGRIVNISSVVGLTGNAGQVNYAAAKAGLIGMTRSVAREFAGRGLLVNAIAPGFIESEMTGVLSSEVEAAILAKIPLAPITPAAIRLETRQALEAHTASRRKEEAAAVKAEAEWASQPSKVGRPPLTQLPWSASTTTYNLTPEMEAAMRRMYSTRNSEVNRAECLRRTAQSAKAEQEEKLLALEHYKAEDAYWNRGAASERWVSPAQRVRHHGPAPAAGAESEVQRAARAARDRGA

SEQ ID NO: 49143 - DNA, 1472 bp, Auxenochlorella protothecoides
ctttgcatgctcagggaccgatcaagctcgctggacaatccatccgatcgatggcggggtgtccctatcacacgaggatgggcgagatgacgtcgcagctggagcggcttgtgcactcccccgccggggctgccctggtggtggtctccgtcgcgctcacactgctggccatggtggcctcttccctgcgcacacttgggggcctgtatcggcatttcatccgaggaggacggaatttgaggcagtatggcgagtgggccgtggtcactggggccaccgacggcatcggcaaggcatacgcagaggccctggcgaagcagcgtctacgcctggtactgatctcgaggaccgcctcccggctggaggaggaggccaaggcgatcacggacaagtttggcgtggaggtgcgggtcgtcgccgcagacctcacctccaccgatcccgccgtcttctcccgcatccaggaggccctcaagcccctggacgtcggcatccttgtgaacaacgcgggcatgtcctacccccaccccgagtacatgcacgttgtgggcgacgaggacatcaagaacattgtgaatttgaatgttctgtccctctccaagctctgccgcatcgtcctggggggcatgaaggagcgcggccgcggcctcatcgtcaacgtgggaagcggcgcagccaccgccatcccctcggggcccctcctcgcagtgtacaccgcttccaaggcgtacgtggatgctctcagtcggtcgctggaccacgaataccgcgagttcggcgtgcgcgtgcagaaccaggcgcccctctttgtcgccaccaagatgtccaagatcaggcgagcagaggggtgtgctgggcgagcccgcatcgacgcgcccacgccagaggtctgggcggcggccgcggtgcgagccatgggctacgagacagtcttcttcccctactggttccacgcgctgcaggcggccgccgtgaagctgctgcccgccagcctggtgcagtaccaggtgatgcagatccaccgcagcctgcgccgcgcggcgtaccgcaagaaatccaaggcggcggcggagctgctccgcgctcggagcgggaacgaggcgggcgaggcccccgcgcccaccgccaacggggtcaagaaggacgactgagagagatggatgtgatgactctcatcgctgccatgagagggtgatggcgcgcctcgcatggctacgcaggcgcgcacgcccctctcctgagacatgcatggccagaccgaccaccgcgcgggcagctgcccttggtatgtcctggatctagtggcatgataacggtgtgcaccagggcgcaacatgcattcctgtgatgggaaacctgataccctccaccccaccccccgatcaattcagacccgcctccgttccttctgcaaacacaccgtgctcctcttagctgccctgctgctcccctcgcctgtacactcttgccct

SEQ ID NO: 49144 - protein, 366 aa, Auxenochlorella protothecoides
MAGCPYHTRMGEMTSQLERLVHSPAGAALVVVSVALTLLAMVASSLRTLGGLYRHFIRGGRNLRQYGEWAVVTGATDGIGKAYAEALAKQRLRLVLISRTASRLEEEAKAITDKFGVEVRVVAADLTSTDPAVFSRIQEALKPLDVGILVNNAGMSYPHPEYMHVVGDEDIKNIVNLNVLSLSKLCRIVLGGMKERGRGLIVNVGSGAATAIPSGPLLAVYTASKAYVDALSRSLDHEYREFGVRVQNQAPLFVATKMSKIRRAEGCAGRARIDAPTPEVWAAAAVRAMGYETVFFPYWFHALQAAAVKLLPASLVQYQVMQIHRSLRRAAYRKKSKAAAELLRARSGNEAGEAPAPTANGVKKDD

SEQ ID NO: 49145 - DNA, 1571 bp, Auxenochlorella protothecoides
  modified_base (66)..(75): a, c, t, g, unknown or other
caaccatattgcaaggccgcgggattgacattattacaactcctggcactctgcccaattgatcannnnnnnnnngcaccgatatgtcctttaaactcgctgatgccacggtggccgatctgaagcgcggcattgccgacagccgtcccgagctgtatacggcgcggcagcggctcaccactgtcgcagagaagggaaagaagggcaccgtcctggaagatggaaagaagctagcggagtacgggctgaccaatggggacaccgtcgtcttcaaggaccttgggccgcagatcgcgtaccgcgctgtgttcttctgggagtactttgggccgctggtggtctactccctcttcttcttcttcccctacctgttttacaatcgcaccaggcaagccttccagggacccagggatgccacggtggccgatctgaagcgcggcattgccgacagccgtcccgagctgtacacggcgcggcagcggctcaccactgtcgccgagaagggaaagaagggcaccgtcctggaagatggaaagaagctagcggagtacgggctgaccaatggggacaccgtcgtcttcaaggaccttgggccgcagatcgcgtaccgcgctgtgttcttctgggagtactttgggccgctggtggtctactccctcttcttcttcttcccctacctgttttacaaccgcaccaggcaagccatccggggccccagggagacgttcctggtgcacagcatcccggaggagcatggctttgcccagaaggccgcactcaccttctgggttgcgcactacgccaagcgcatcgcagagacgttcctggtgcacaggtgccacttgatcctggcagacctccgatcccccggacgtggcgggtactccatcccacgtgggttcctgtttgattacataacctgcgccaactacaccgctgaaatctggtcgtggctgttcttctccctcgccacccagagcctgccggcgctcgtcttcaccctggctggagcagggcagatggcggtgtgggcggcgggcaagcaccagaggctgaggaaggcccagctcgaggcccggcgtgccctgagtgcacacatccgttctcgctttctcggcggctttgcggccgtgtatgtggtcatcctggcctacgccgcctgggtggcacgcgccccgcccgccacatacacataccggcagcacctcacgtgtgtggcgcctgccatgtatgccccgcccgcggcctggcttctctaccgcctcctgagcgcgatactccaagccctggactcctactctgcacggaaagtggctctcctggactccaagctgcggaaaatggtcgcggaactcaagcctcagccggcggcggggcccaaggtcgtaccggccctcacgcaactctggacacgcgccgccgacaggctcatagcggacgacccggtggcgctgcgcctgctgcaggaagcgcaacgcgaggccgccgagctgcgcgccgcgctcgtggcgtcggagacggagacgctgcgcctccaggcccagaatcggcacctgctcacggaattgggg

SEQ ID NO: 49146 - protein, 496 aa, Auxenochlorella protothecoides
MSFKLADATVADLKRGIADSRPELYTARQRLTTVAEKGKKGTVLEDGKKLAEYGLTNGDTVVFKDLGPQIAYRAVFFWEYFGPLVVYSLFFFFPYLFYNRTRQAFQGPRDATVADLKRGIADSRPELYTARQRLTTVAEKGKKGTVLEDGKKLAEYGLTNGDTVVFKDLGPQIAYRAVFFWEYFGPLVVYSLFFFFPYLFYNRTRQAIRGPRETFLVHSIPEEHGFAQKAALTFWVAHYAKRIAETFLVHRCHLILADLRSPGRGGYSIPRGFLFDYITCANYTAEIWSWLFFSLATQSLPALVFTLAGAGQMAVWAAGKHQRLRKAQLEARRALSAHIRSRFLGGFAAVYVVILAYAAWVARAPPATYTYRQHLTCVAPAMYAPPAAWLLYRLLSAILQALDSYSARKVALLDSKLRKMVAELKPQPAAGPKVVPALTQLWTRAADRLIADDPVALRLLQEAQREAAELRAALVASETETLRLQAQNRHLLTELG

SEQ ID NO: 49147 - DNA, 381 bp, Auxenochlorella protothecoides; identical to SEQ ID NO: 49125

SEQ ID NO: 49148 - protein, 1376 aa, Auxenochlorella protothecoides
MGDTEPHVAPTPRHTKFNPAQLDLSLYPPLDQQCIVLTQESDSPGTGAVRRNARHPDTLVDSLPDPDGHVKTAYELLELSIAKYGQRDYLGTRSVDAQGTPGAYTWQTYAGVGQARLEIGAGLRHLGVARGAAVGLYSANCAEWVLVDAALHAHACVGVPLYDTLGADVVAYILGHAELAAVACSAAVLPALLETLPASPTVRLVVVYAQPPGFSPPAPPPGSHARVVSLEEVRGAGRAHPRPPEPPAPADTALISYTSGTTGRPKGVVITHANMISQVAASVCAALPLLVASQAMERHVSYLPLAHIYERMTYAMCTYLGGGLGFFRGDPQTLLDDIQALRPTYFPSVPRLWNRIHAKVMAQVAASSAVKRAIFWAAYGYKRRRMAEGDMTGGRWAPFLNRLVFNKIKAVVGGEVKVMISGAAALSQDVFEFLRVVFDCVVVEGYGTTETTAAATVTTPGDPVVGHVGPPLPSCEIRLADVPELGYTSADLPDPRGEICVRGNIVFKEYYKDPETTRETIDAQGWLHTGDIGTWLPGERLKVIDRKKNIFKLSQGEYVAPEKIEGLYTHSPYVAQVFVHGDALRSRIVGVVVPDQEALLPWAESNGLEPDLGQLCKEERVKALILQSMLEEGRAAKLNGFEQVVDITLTPNPFSVEAGTMTPTFKPKRPQLRAAFSGAIADMVLAGHLPPGHEATSEQATLTTSPTLALDMSTFPPLDAQCVVLPEKLNAPGPWTVRRNANFPEALIDSFDGEESHVRTCYDLLEHSVVKYPDSPYLGTRSVDARGAPGPYAWLSYSQVGEARTQIGSGLAHLGVRPGSNVGLFSTNCADWVLVDAALHAYACVSVPLYDTLGADVVQFVNNHAELSAVACSAATLPALLETLPASPTVAVVVVYAAPAGFRMPATPPGSAARLVSLDRLRALGMKHPSPHVPPSPADTALINYTSGTTGMPKGVVLTHANIVASIAGQIRSTAVLATIDATERHISYLPLAHIFERVTYMSVTHRGGAIGFFRGDPQTLLDDIQALRPTYFPSVPRLWNRIYDRIMAQVAASSPVKRRLFETAYAYKKRHMAAGDMTGGPWAGFWNRLVFNKIKQAVGGEVRMMVSGASALSPEVFEFMRIVFDCVVIEGYGMTETTSGATISIPGDPVIGHVGIPTPACEVKLADVPEMGYTNADLPRPRGEICVRGPLRFKEYYKDPENTRETIDEEGWLHTGDIGTWLPGERLKIIDRKKNIFKLSQGEYVAPEKIENIYVRSPYVAQVFVHGDSLRSCIVGVVVPDPEVLLPWAKQRGLPQDLATLCEDEQVKAMIQKSLSEEARVAKLKGFEQVADIVLTPVPFSVETGTMTPTFKLKRPQLREAYAPALEAMYARLPM

SEQ ID NO: 49149 - DNA, 1678 bp, Auxenochlorella protothecoides
  modified_base (1218)..(1314): a, c, t, g, unknown or other
cggtccttgcaccgactcgcgacatagccaggctctgccttccacgccggcccccagtaccaccaccagggtcacaccatgatctgatcgacgccagacgcgctgcatggtggaagccatgtccgtggaggagcagctgctgaggcagggcggggtcgcgagccaatcccactccggcccctgggagggtcggtacggcaggttcacacccgtccagctccggctgacggcccagggcgacatcgagatcatcagcaaggcctccccgcagccctgcccccggtactgcctgcccttcatccgggcccctcctggccagatccgcggcctggacgcgatcggggccagcgcagagggcaggacactgaccatctggcacacactcccaccgccgaagcggtccggcagccaggcgaggcgcaggcggcgcaggctcgccctcacactgcaagatgagcaggggtgcgtggatgcggccctcgccatccgggccgctgtgtctgcagccgcccccaggcggctgctggtcgtcatcaaccccgtcagcgggcgcggcaggggccaggccctcttcaacaaggaggtccagcccctattggaggctgccgggatccaggcccgcgtggtgtgcacgacttccaagggccacgccaccgagctggtcacggggcagcggcccgaccagattgacgccatcgctgttgtcggtggtgacggcacagtgttcgaggtgctgcagggcatgctgaaccggcctgactgggaagccgcgcggcagctgcccctggtccagatccccgctggctccggcaacggcctggccgcctccacaggcctgtgggacgtgacgactgcggtgcacgcgctggtgaagggatgcacgtcgcccatggacgtgtcttcggtgctgcagccccctgcacgccgcgtcttctccttcctctccctgacctacggcatgatccccaacctggacatcggcacggaccacttacgctggatgggcagcccgcgctttgtgctgggcgccatccaccagatcatgaagcagggcgcctaccccgcgcgagtctcctttgtggatgtgcggcacggcgtggtccagggggcagggcacgtggaggaggggacaaacggcgcgggccccccaatgcggcacatcggcgccttccagcgcctgccagacggctgcagtggcattgcctccctgggcctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcgggggaggtccagttcttcgcggcctgcaacattccctggctggacaccaattttcacgtcgcgccgggcacgctgctgcacgacgggcacctcacgctgctgtacacgctggggaggatgggcaggctcaacggcctctgcttcatgtcggcaatggacagcgggcagcacatggatcgcctcaccctcgaacggcccatcgcctttgtgctggagccgcgggcgtccgatacgtggatcgtggtagatggggaggaaatggcgcacaggctgacctttgtggaggtccaccccagcctctgccgagtcatcgtctgcccacgggaccctgaggcgggcgaagatgtggaggccagggag

SEQ ID NO: 49150 - protein, 524 aa, Auxenochlorella protothecoides
  MOD_RES (371)..(403): Any amino acid
MVEAMSVEEQLLRQGGVASQSHSGPWEGRYGRFTPVQLRLTAQGDIEIISKASPQPCPRYCLPFIRAPPGQIRGLDAIGASAEGRTLTIWHTLPPPKRSGSQARRRRRRLALTLQDEQGCVDAALAIRAAVSAAAPRRLLVVINPVSGRGRGQALFNKEVQPLLEAAGIQARVVCTTSKGHATELVTGQRPDQIDAIAVVGGDGTVFEVLQGMLNRPDWEAARQLPLVQIPAGSGNGLAASTGLWDVTTAVHALVKGCTSPMDVSSVLQPPARRVFSFLSLTYGMIPNLDIGTDHLRWMGSPRFVLGAIHQIMKQGAYPARVSFVDVRHGVVQGAGHVEEGTNGAGPPMRHIGAFQRLPDGCSGIASLGLXXXXXXXXXXXXXXXXXXXXXXXXXXXXXXXXXAGEVQFFAACNIPWLDTNFHVAPGTLLHDGHLTLLYTLGRMGRLNGLCFMSAMDSGQHMDRLTLERPIAFVLEPRASDTWIVVDGEEMAHRLTFVEVHPSLCRVIVCPRDPEAGEDVEARE

SEQ ID NO: 49151 - DNA, 1694 bp, Auxenochlorella protothecoides
ccccccccctcccttgatagcaagaagacggtgaccctgacgctgtgggggccgacggctgagggcctgggcgccgagctggaaagcagagccgctcagcaccccgtcctctctgtctccgcctgccgcgtgtcggccttcaacggtgtgtcggtgtcgaccctgcaccgcagcgtcctgagcgtggaccccgctgggcctgaggccgacgctctgcgggcctggtgggcgggcgagggcagcgcggcgcccaccacccacgtcggagagggcctgagcggcgcagcggggcgtagcggtgcccaggccgcctccaacgccaggttgtccctggccgacatccgcgaacaggggcccacctccgctggggtcaagccggtgttcagctccgccaccgccacggtggccagcatcaacccggaccagagcctgtactacgctgccaaccccgagaacaatcgcaaggtcgtggagcagggccccggccagtggtactgcgagtacagcggcaccaccctgcccagcatggtcaggcggtacatcctgcaggccaaggtggtggatgagagcggggagtgctttgtgcaggtgttcaatgaccaggcgcaggagctgctgggcatgtctgccgacgacctggccgccctcaaggacgccgagccatcgcgcttcctggccacgctcaaggccgccagctggaaggactgggccctgcgggtcaaggccagtgcacaggagtacaacggtgagcagcggcagcggtttgcgctggcggagatcaagcccctggacttcgcggcggagagcaggaggatgctcaccatcgccgtggcgctgcagcgattccacagcatccccgcccccgggccgcggaccaccaacactcctttcaaacgtatacatgagtggctggacatcacagagggcttcaccttcaaggacgcccaggtgcaagtggtgaaacaagctgagtttgaggcctttgaccttgcggacctgcgccgccgggtgcaacaggtggagagggcatgcgccgccgtcggctcgcccaccgtgctggctcacaacgacctgctggccgggaacgtgatggtctccgacgctttcctggctgccgggaccgtggctggcgagtccaccgctgcctcgcccgtgtccaccacctcggcccgcaacgacatgaccttcatcgactttgagtatgtggattgggcgccacgcggctacgactggggcaaccacttcaatgagtacgctggctttgacggcgactacacccagtaccccagcgacgaggaggccggcgcctttctgcgcgcctacctggcggcggaggccggcgtcgccccggcagagatctcggcggacgcggtggcggacgccgtggcggaggccaacctgtatgccctggccagccaccagtactggggtgcatggtgcttcctgcaggcccagtggagcctgctggactttgactacctcgagtacgcgcgggtgcggtgggccgagtgcgccgcgcgcagtgaggccttcctggcagccgccgcgcagcgctttcccgtccaggagggcgcctgaggtgctgggaggcatgtgcgcgaggcgcttcaggcattgagatgccaaggacaccaacattttctaagccttgcggctcgctggcctcgagataccctcctttatctatgctgctg

SEQ ID NO: 49152 - protein, 525 aa, Auxenochlorella protothecoides
PPPSLDSKKTVTLTLWGPTAEGLGAELESRAAQHPVLSVSACRVSAFNGVSVSTLHRSVLSVDPAGPEADALRAWWAGEGSAAPTTHVGEGLSGAAGRSGAQAASNARLSLADIREQGPTSAGVKPVFSSATATVASINPDQSLYYAANPENNRKVVEQGPGQWYCEYSGTTLPSMVRRYILQAKVVDESGECFVQVFNDQAQELLGMSADDLAALKDAEPSRFLATLKAASWKDWALRVKASAQEYNGEQRQRFALAEIKPLDFAAESRRMLTIAVALQRFHSIPAPGPRTTNTPFKRIHEWLDITEGFTFKDAQVQVVKQAEFEAFDLADLRRRVQQVERACAAVGSPTVLAHNDLLAGNVMVSDAFLAAGTVAGESTAASPVSTTSARNDMTFIDFEYVDWAPRGYDWGNHFNEYAGFDGDYTQYPSDEEAGAFLRAYLAAEAGVAPAEISADAVADAVAEANLYALASHQYWGAWCFLQAQWSLLDFDYLEYARVRWAECAARSEAFLAAAAQRFPVQEGA

SEQ ID NO: 49153 - DNA, 1001 bp, Auxenochlorella protothecoides
  modified_base (505)..(514): a, c, t, g, unknown or other
acctcggtggaccgcgacgacttgcccgacggcggcgccgaccactttgcgcagaccgtgcgcagcatcaaggccctccgccccgacatcctggtcgagtgcctcaccccagacttccggggcgacctcggcgccgtgcgccacctggcacgctcggggctggacgtctttgcgcacaacatcgagacggtggcctcgctgcagcggcgcgtgcgagatccgcgcgccggctacttccagtccctggacgtgctgcgggctgcgagaagggagggcgtgcacaccaaatcctccatcatgctgggcctgggggaggcggacgaggaggtcgtggacaccatgctggacctgagggacgcgggtcggcgcgtgcgagatccgcgcgccggctacttccagtccctggacgtgctgcgggctgcgaggagggagggcgtgcacaccaaatcctccatcatgctgggcctgggggaggcggacgaggaggtcgtggacaccatgctgnnnnnnnnnnggtgcgcgaatttgcggaaatttggcgaggaggaggtcgggttccggcggaaatttggcgaggaggaggtcgggttccggtacgttgcctccgggccgctggtgcggtcctcgtaccgcgcgggcgagttctacgtggcggccatgctgcgccaggaccgggcaaacagcgcggccgccgtcaagctgcagggggtggacctcgtggcgcccgacttctgagatgctgcagctcactgatgcgtggaacacgtgactcatgtgtggcgacctgccacgcgcgccctctgacccctgccgcaatgcatgtgtctgtggaatcttctgttcttacacaacgtctggcgcgaggggtgtttgcggccgcagtcgcggcatgtgtctcgtcgacgcactcccgagtgatggaggagggcggcagtcacgctgcatggggctcgacatcgtgcaggcaggccgcgcggcacctgggacctctctccatccgg

SEQ ID NO: 49154 - protein, 244 aa, Auxenochlorella protothecoides
  MOD_RES (169)..(172): Any amino acid
TSVDRDDLPDGGADHFAQTVRSIKALRPDILVECLTPDFRGDLGAVRHLARSGLDVFAHNIETVASLQRRVRDPRAGYFQSLDVLRAARREGVHTKSSIMLGLGEADEEVVDTMLDLRDAGRRVRDPRAGYFQSLDVLRAARREGVHTKSSIMLGLGEADEEVVDTMLXXXXCANLRKFGEEEVGFRRKFGEEEVGFRYVASGPLVRSSYRAGEFYVAAMLRQDRANSAAAVKLQGVDLVAPDF

SEQ ID NO: 49155 - DNA, 354 bp, Auxenochlorella protothecoides
gtcttatgacgccggtgttacccacagggtcaggcggagagccattttccggagattgaggcccagaccgggcagaacttcgtcgtgatggacacctacggcaagaagcacaccttccggtttcgcttctggatcaacaatgcctcccgcatgtatctgctggagaacacccaggacgtcctgaaccggtatgccatgcaggcaggcgatgtcctcatcttctccaggagccccgagggccagtactgcgtgcagagcgtctactcctcctactggtcgggctactccctcccgccccgccgcgacggcgtgttccgggccgtccccaacgcctctgggcacgagaccgggaag

SEQ ID NO: 49156 - protein, 89 aa, Auxenochlorella protothecoides
MDTYGKKHTFRFRFWINNASRMYLLENTQDVLNRYAMQAGDVLIFSRSPEGQYCVQSVYSSYWSGYSLPPRRDGVFRAVPNASGHETGK

SEQ ID NO: 49157 - DNA, 1104 bp, Auxenochlorella protothecoides
  modified_base (521)..(530): a, c, t, g, unknown or other
atggtgagcaggttgatgacccagctacggaacgaggacctgaccaacctgcagcgcaacaacatcctgaagcagatcatggcgacccacaccaccctcttctacaaagctctgatcgagaacatcgaggagctggcccccattgtgtacacccccaccatcggcgaggcctgccagcgatggagcaccctcttccgcgagcccctgggcatgtacatctcggccttccgccaccgcggtcgctttgacgaggtgctgggcaactggccaaacaagaatgtccagatcatcgtcgtgacagacggctcccgcatcctgggcctgggggacctggggaccaacggcatcggcatcagcatcggcaagatcgcgctgtacgttgcggcggtgggcttccacccggagcactctttgcccatcgttctggacatgggctgcaatcggaaagaactgcgcgaggacgggctgtacctgggcgaacgccgcgagcgcctggagggcgaggagtactacgctgccannnnnnnnnnccctcttccgcgagcccctgggcatgtgctgggcaactggccgaacaagaatgtccagatcatcgtcgtgacagacggctcccgcatcctgggcctgggggacctggggaccaatggcatcggcatcagcatcggcaagatcgcgctgtacgttgcggcggtgggcttccacccggagcactccttgcccatcgttctggacatgggctgcaatcggaaagaactgcgcgaggacgggctgtacctgggcgaacgccgcgagcgcctggagggcgaggagtactacgctgccgtcgacgagttctgcgccgcggtcaagcggcgctggccgcacgcgctgctccagttcgaggactttgagacgagcaaggccttcaagatcctggaggcgcagcgcagcgccatgctctgcttcaacgacgacatccagggcacgggggcggtggtcacctcggggttcatcaatggcatgaagtaccagggcacgcgcctgcgcgacgcgcgcgtcgtcttctacggcgccggctcctccgccgtgggcgtggccaagagcatcgtcacctacatgcacaag

SEQ ID NO: 49158 - protein, 368 aa, Auxenochlorella protothecoides
  MOD_RES (174)..(177): Any amino acid
MVSRLMTQLRNEDLTNLQRNNILKQIMATHTTLFYKALIENIEELAPIVYTPTIGEACQRWSTLFREPLGMYISAFRHRGRFDEVLGNWPNKNVQIIVVTDGSRILGLGDLGTNGIGISIGKIALYVAAVGFHPEHSLPIVLDMGCNRKELREDGLYLGERRERLEGEEYYAAXXXXPLPRAPGHVLGNWPNKNVQIIVVTDGSRILGLGDLGTNGIGISIGKIALYVAAVGFHPEHSLPIVLDMGCNRKELREDGLYLGERRERLEGEEYYAAVDEFCAAVKRRWPHALLQFEDFETSKAFKILEAQRSAMLCFNDDIQGTGAVVTSGFINGMKYQGTRLRDARVVFYGAGSSAVGVAKSIVTYMHK

SEQ ID NO: 49159 - DNA, 763 bp, Auxenochlorella protothecoides
atgtcgagcgatctggacgcccgcttcaagaaggccgtgtggctgatccggaatgggcctcccaggcccggcaccaccaacgacaccaagttggcgtactacgcccacttcaagcaggccacggagggggatgtgaggggcgaccaaccctgggccgtccagttcgaggccagggccaagtacgacgcctgggccaaactgaagggcatgagcggcgacgaggccaaagccaagtacattgcgctgctggaggaaggtgagctggatggtgccagggcgggtcggaacgaccggctggacctctggccctttgtttgtgcctacgtcgcgtggagtggatatgtgctctggcgcctggtcaccatcgggaccgaagggttttacctcattcagcttgctacatatgccctcctggccatacacgccgtgaccttcctgtccggggtctggagcgtcggcagccaggctcgcctgcgcttccggccggcggggtccatctcgcaggccacgcatgtgctggtcgtgccgcatgcatttgtggggacacgggacattgtccccctggagcaaaaggccgatgcggctcgcctgcgcttccggccggcggggtccatctcgcaggccacgcatgtgctggtcgtgccgcatgcgtttgtggggacacgggacattgtccccctggagcaaaaggccgatgcggccggcgtgccgcgctacgctttctccttccgcaagctgcgcttcgtgcacagcgcagacaccg

SEQ ID NO: 49160 - protein, 254 aa, Auxenochlorella protothecoides
MSSDLDARFKKAVWLIRNGPPRPGTTNDTKLAYYAHFKQATEGDVRGDQPWAVQFEARAKYDAWAKLKGMSGDEAKAKYIALLEEGELDGARAGRNDRLDLWPFVCAYVAWSGYVLWRLVTIGTEGFYLIQLATYALLAIHAVTFLSGVWSVGSQARLRFRPAGSISQATHVLVVPHAFVGTRDIVPLEQKADAARLRFRPAGSISQATHVLVVPHAFVGTRDIVPLEQKADAAGVPRYAFSFRKLRFVHSADT

SEQ ID NO: 49161 - DNA, 1555 bp, Auxenochlorella protothecoides
  modified_base (311)..(320): a, c, t, g, unknown or other
accatacggctcaggcgacgcggctggcgtcgtctgtcgtccgggtcaatgaatgggagcgcggacaccgcatcccctaaactgtcgcgcaggacatcgaacgcgggcgctgccgccgaggtgctgtctggaagtagggctctgcatggctggttgggccctgtacccacctgggctgatcaggcatggtccatgacacagccccttgccttcaaccccccaacacacctccatgcaggctgagaaccggttcaagtcctttcgggtgcgcaccatctccaccatcgtgctcatcggcaccttcatcggtnnnnnnnnnnccccagaggagataaagacatcgaatgcgggcgcagccgccgaggctgagaaccggttcaagtcctttcgagtgcgcaccatctccaccatcgtgctcatcggcaccttcatcggcatcattgctgccggccatgttcccctcatgtttatgatcctaggcatccagtttctcatggtcagggaagtgttcgcgctggcccgggtcaggcagcaggagaagaaggtgccaggtttcagagcacagcaatggttcatcaagaagaacctgaccatcgagctcacctcctcagcgcgcactgccgcaatgtttggctggctcctccgccaccacaccatcatgtccttctcgctctacacagccggcttcgtgctctttgtgctgacgctgaagaagggcatgtacacctaccagtttgggcagtacgcttggacgcacatgattctcatgaccatcttcttcccttcctccttcttcgtgtccaacatctttgaagggctcatctggttcctgctgccggccgccctgaccatcttcttcccttcctccttcttcgtgtccaacatcttcgaagggctcatctggttcctgctgccggccgccctggtcatcatcaatgacattgcagcctatctagctggcacgactgtggcgtcctggtacctggcaggctttctgtctcgctttgactggttcgtctgtcctcgcacgacgctgctccccgcggaggcctccgacgcgctcatgaccctgttcgaccggctggaccctgggtggcaggcgctggcgcgcggcgcctccctcacgtgcctgcccatgcagctgcacgcagtggtgctggcaacctttgcctcgctcatcgcgccgtttggcggcttcttcgcctccggcttcaagcgcggcttcaagatcaaggactttggcgacagcatccccggccacggcggcatgaccgaccgcatggactgccaggtggtcatggccgtcttctcctacgtctacttcacctcctacgtcgcgcccacggggcccagcgtcggctccgtcctctccgccgcagtccggctcacgcccctggagcagctggacctcttcagccgcatggccaatgtgctggtgggtgccaaggtcctgcccgccgccatcggggagacgatcgccacgcatgcgcggcgaaggctgccacccgcgcagtcgacctgaggaggctgtggcttgctctgtttgcttgagggg

SEQ ID NO: 49162 - protein, 429 aa, Auxenochlorella protothecoides
  MOD_RES (27)..(30): Any amino acid
MQAENRFKSFRVRTISTIVLIGTFIGXXXXPEEIKTSNAGAAAEAENRFKSFRVRTISTIVLIGTFIGIIAAGHVPLMFMILGIQFLMVREVFALARVRQQEKKVPGFRAQQWFIKKNLTIELTSSARTAAMFGWLLRHHTIMSFSLYTAGFVLFVLTLKKGMYTYQFGQYAWTHMILMTIFFPSSFFVSNIFEGLIWFLLPAALTIFFPSSFFVSNIFEGLIWFLLPAALVIINDIAAYLAGTTVASWYLAGFLSRFDWFVCPRTTLLPAEASDALMTLFDRLDPGWQALARGASLTCLPMQLHAVVLATFASLIAPFGGFFASGFKRGFKIKDFGDSIPGHGGMTDRMDCQVVMAVFSYVYFTSYVAPTGPSVGSVLSAAVRLTPLEQLDLFSRMANVLVGAKVLPAAIGETIATHARRRLPPAQST

SEQ ID NO: 49163 - DNA, 1123 bp, Auxenochlorella protothecoides
ctcatgggagagcttgtcgcggcctgccagtacctggatcgcaagcacccctccgcacgcgtcatcattgtgactgggtcaggctccaaggcgttcgccgctggcgccgacatcaaggagatgtccagcgtcacatacagcgaggcgtacaacaagggcctgctggacggctgggagaccttgcgcaccatccgcaagcccatcattgccgcagtgaacggctttgccctgggcggcggttgcgagctggccatgctggccgacatcatcattgccgcagactcagcatcttttggccagccggagatcaacctcgggctcatgggagagcttgtcgcggcctgccaatacctggatcgcaagcacccctccgcacgcgtcatcattgtgactgggtcaggctccaaggcgttcgccgccggcgccgacatcaaggagatgtccagcgtcacatacagcgaggcgtacaacaagggcctgctggacggctgggagaccctgcgtaccatccgcaagcccatcattgccgcagtgaacggctttgccctgggcggaggttgcgagctggccatgctggctgacatcatcattgccgcagactcagcatcttttggccaggtggatgtcggcccggagatcaacctcggggtcctgccgggaatggggggcacccagcgtttgacccgggccgtgggcaagagccgggccatggagctcgtgttgaccggggaccggctgagtgcggcagaggcggtctccctggggctggccagccgggccgtgcctgccgcggagctaatggaaaccacgcagaagctggcgaggcgcatcgcagcggccagcctgcctgtggccgcaaaggccaaggagtgtgtgaaccaggcgtacgaaatgacgctcgcagagggcgtaagatttgagaagcgggaattctggagctgctttgccttggcagaccagaaggagggcatggcggcgttcatcgagaagcgcaccccggtctttggcgactcttgaatgcgacccggacctcattggaaggacatctagagtggtcctgagcccagtttgacggcccatgctgtgctggcaaagccgcatcgaatgaactaactttgacacc

SEQ ID NO: 49164 - protein, 338 aa, Auxenochlorella protothecoides
LMGELVAACQYLDRKHPSARVIIVTGSGSKAFAAGADIKEMSSVTYSEAYNKGLLDGWETLRTIRKPIIAAVNGFALGGGCELAMLADIIIAADSASFGQPEINLGLMGELVAACQYLDRKHPSARVIIVTGSGSKAFAAGADIKEMSSVTYSEAYNKGLLDGWETLRTIRKPIIAAVNGFALGGGCELAMLADIIIAADSASFGQVDVGPEINLGVLPGMGGTQRLTRAVGKSRAMELVLTGDRLSAAEAVSLGLASRAVPAAELMETTQKLARRIAAASLPVAAKAKECVNQAYEMTLAEGVRFEKREFWSCFALADQKEGMAAFIEKRTPVFGDS

SEQ ID NO: 49165 - DNA, 1348 bp, Auxenochlorella protothecoides
ggcgtccttcgacgccaacgagctggcagtgtacatgcaggggggccagagcgttctggaccgcaatgtcaaggccatccagatgctcaagcagttcccctggggcgacaagtccaagcgccccttcctcacccgcaccgaagagtatgtgcagggcctggaggcctccgtgaccatctggaagatggccaacgagggcaagatcaccaatgaggaggccatggccatgcgcaagcagctcaactggcccgcaggcctagagctccacctggggatgttcatcccgtccctgctggcgcacgggaccaaggagcaacaggaggcgtggctcccccccagcctgcgcctggagatggtgggcacctacgcccagacggagctggggcacggcacctttgtgcgcgggctggagacggtggcggtgtttgaccctgactccgacgagtttgtggtgcattcccccaccctcacctccaccaagtggtggccggggggcctgggcaagacggccacgcacgtcatcctcatggcgcgcctgatctcgcgcggcaaggaccatggcgtccactccttcgtggtccagatccgggacatggcccggcacacgccgctcccgggcacggccacgcacgtcatcctcatggcgcgcctgatctcgcgcggcaaggaccacggcgtccactccttcgtggtccagatccgggacatggctgggcacacgccgctcccgggcgtgacggtgggcgacatcggccccaagatgggctacaacggcgtggacaacggcttcctgcgcttcgaccacctccgcatcccgcgctccgcgctgctggcgcgctttgcccgcctggagcgtgatggcacctacgtgcccccgcccccggccaacgccaaggccagctacgcgaccatggtcttcgtgcgcgccgacatcgtgaagaacgccggcgacttcctgggccgcgcggtgaccatcgccacgcggtacacggcggtgcgccgccagacggcccccggacccggcgcccgcgagctgcaggtgctggactacgacaaccgtgatggcacctacgtgcccccgccctcggccaacgccaaggccagctacgcgaccatggtcttcgtgcgcgccgacatcgtgaagaacgccggcgactttctgggccgcgcggtgaccatcgccacgcggtacacggcggtgcgccgccagacggctcccggacccggcgcccgcgagctgcaggtgctggactacgacaacgtgcagcaagtgctgctgccgctgctggcgcgcgcctacgcgctgtccttcatgggccgcgccatgttcgggcagtacaaggcgttc

SEQ ID NO: 49166 - protein, 449 aa, Auxenochlorella protothecoides
ASFDANELAVYMQGGQSVLDRNVKAIQMLKQFPWGDKSKRPFLTRTEEYVQGLEASVTIWKMANEGKITNEEAMAMRKQLNWPAGLELHLGMFIPSLLAHGTKEQQEAWLPPSLRLEMVGTYAQTELGHGTFVRGLETVAVFDPDSDEFVVHSPTLTSTKWWPGGLGKTATHVILMARLISRGKDHGVHSFVVQIRDMARHTPLPGTATHVILMARLISRGKDHGVHSFVVQIRDMAGHTPLPGVTVGDIGPKMGYNGVDNGFLRFDHLRIPRSALLARFARLERDGTYVPPPPANAKASYATMVFVRADIVKNAGDFLGRAVTIATRYTAVRRQTAPGPGARELQVLDYDNRDGTYVPPPSANAKASYATMVFVRADIVKNAGDFLGRAVTIATRYTAVRRQTAPGPGARELQVLDYDNVQQVLLPLLARAYALSFMGRAMFGQYKAF

SEQ ID NO: 49167 - DNA, 1270 bp, Auxenochlorella protothecoides
cggggacatgccgcagtgcatgccacaatgggccccttcaacaactgaccaccactatgacccatattccctgcagcggccaccagagcttcagcacaaacaagcagctgaacgacgtggtcggcctgatagtgcactcctccatcggcgtcccctaccatggctggcgcatctcgcaccggacccaccacaacaaccatggccatgtggagaacgacgagtcgtggtaccctccctcggagacggtgttcgactccctgagcttcacagggaagctgggccgatttgtgttccccatctccctgctggcgtaccccttttacctcctcgcccggtccccgggaaaagagggctcgcactacagccccgagaccgaccttttcacccctcgtgaagccccaatgctctacttcctgccctacattgtctccgtcatgtggctggacctcgtgacttacctccaccaccacggtccctcaaaccccgaggaggagatgccctggtaccgtggcgaggagtggagctacatgcgcggcggcctgtccaccatcgaccgcgactacggcatcttcaacaagatccaccatgacattgggacgcacgttgtgcaccacctcttcccccagatcccgcactacaacctggtcaaggccaccgaggcggtgaagccggttctggggcagtactaccgcaaggtggagccctcccccggcccgctgccggtgcacctgctggagccgctgctgcgctccatgagcaaggaccactacgtcgacgacagcggcgacatcgtcttctacaagacctccgaggagctgcagcacccgctgcgcacgctgtggcgcaagctgacgggcggccgccgctccgtcgcctgagggttcctgatgcctgtcggcggcctcatgcggagcgcctggaaggctgtggcatgggcacccgagcgtcaaccatgggtcgctgccgccgtggcccttgggatcgcgctggggcaagccccgtggggcacccaaggcagggagaaggcccatactcacccccccctttacgcctgcaactgtacacttgaatctgggcgtcttgcactgcaccttgagactcagactgcaatccccttggtccctgggcgcgcctggcatttgctccctgcccaggcccccttgcattccctgctgggtgtcttctagctcaataagccccccataaaacagcaagctcccgcttggggatgctagcgtgcatgtccttgtacaatcacgattcccagcgg

SEQ ID NO: 49168 - protein, 273 aa, Auxenochlorella protothecoides
MTHIPCSGHQSFSTNKQLNDVVGLIVHSSIGVPYHGWRISHRTHHNNHGHVENDESWYPPSETVFDSLSFTGKLGRFVFPISLLAYPFYLLARSPGKEGSHYSPETDLFTPREAPMLYFLPYIVSVMWLDLVTYLHHHGPSNPEEEMPWYRGEEWSYMRGGLSTIDRDYGIFNKIHHDIGTHVVHHLFPQIPHYNLVKATEAVKPVLGQYYRKVEPSPGPLPVHLLEPLLRSMSKDHYVDDSGDIVFYKTSEELQHPLRTLWRKLTGGRRSVA

SEQ ID NO: 49169 - DNA, 1488 bp, Auxenochlorella protothecoides
  modified_base (799)..(808): a, c, t, g, unknown or other
ccacatcatgccgctgctggagatcgtgcgctccgacgtcacctccccccaggtgatcctggacacgctggactacgggtcgcgcatcaagaagacgcccgtggtggtgggcaactgcacagggtttgcggtcaaccgcgtcttcttcccatactccatggccgcggccatgctggtggactcggggctggacccgtaccgcgtggatgccgccgaccgcatcatcggcgcgcacttcttctcccccgcccacatcatgccgctgctggagatcgtgcgctccgacgtcacctccccccaggtgatcctggacacgctggactacggatcgcgcatccagaagacgcccgtggtggtgggcaactgcacggggtttgcggtcaaccgcgtcttcttcccttactccatggccgcggccatgctggtggactcggggctggacccgtaccgcgtggatgccgccgtcgccgcctttggcatgcccatggggcccttccgcctcggagacctcgtcggcttggacgtcagcctgttcgtgggcaagtcctacctggaggccttcccggagcgcatctaccgctccgccctggtcccgctgctcaacgaggcggggcgcctgggcgagaaggccaagaaggggtggtacgtgtttgacgacaagcgcaaggcgcgccccgaccctgccctggcagagatcgtcctcaagtcgcgcaagaggtcggggctgtctgggaatgccgcttttgcggccaagctgagcgaccaggacatcgccgagttcgtcttcttcccgtccacnnnnnnnnnnaaggccaagaaggggtggtacgtgtttgacgacaagcgcaaggcgcgccccgaccctgccctggcagagatcgtcctcgagtcgcgcaagaggtcggggctgtctgggaatgccgcttttgcggccaagctgagcgaccaggacatcgccgagtttgtcttcttcccggtcatcaatgaggcatgccgtgtcgtcgcagaaggcatcgtggacaagcccgcggatctggacgtcgccaccgtcatgtccatgggcttcccagcctaccggggcggagttgtcttttacggcgacatcgtcggcgcagactacgtcgtgcgtcgcctgaagcagtgggcaacgcagtacaaggcacaggctggcttcttcgagccgtgcgagtacctgctggcggctgccaagtcgggccgcaagctgtcggcgggcaacgccacgcagtccaagatctgagcggagttcttcacgcactgcctgccgcccagatgcaggcacccctgccaaatgttcccactccagtagctgtgaccaccaacacccctcacaaccatcctcttttgcgccctttttccagccttgcgcttggatgctcgcagtgggtcgggatgctcctgccaggcatggccctgagctctgctgccactgccccccctgcccgcatggtccagagttttgtagttcgt

SEQ ID NO: 49170 - protein, 418 aa, Auxenochlorella protothecoides
  MOD_RES (266)..(269): Any amino acid
HIMPLLEIVRSDVTSPQVILDTLDYGSRIKKTPVVVGNCTGFAVNRVFFPYSMAAAMLVDSGLDPYRVDAADRIIGAHFFSPAHIMPLLEIVRSDVTSPQVILDTLDYGSRIQKTPVVVGNCTGFAVNRVFFPYSMAAAMLVDSGLDPYRVDAAVAAFGMPMGPFRLGDLVGLDVSLFVGKSYLEAFPERIYRSALVPLLNEAGRLGEKAKKGWYVFDDKRKARPDPALAEIVLKSRKRSGLSGNAAFAAKLSDQDIAEFVFFPSXXXXKAKKGWYVFDDKRKARPDPALAEIVLESRKRSGLSGNAAFAAKLSDQDIAEFVFFPVINEACRVVAEGIVDKPADLDVATVMSMGFPAYRGGVVFYGDIVGADYVVRRLKQWATQYKAQAGFFEPCEYLLAAAKSGRKLSAGNATQSKI

SEQ ID NO: 49171 - DNA, 934 bp, Auxenochlorella protothecoides
cttcgtgcatggccacggcgcgcacggcctgttcgagctcttgcagatcgaggtaggcggatgagaagggtttttgaccaacaggcgcgtttgcccgtgcccgctcgccaagatccttgccgacgcgtgtctcaggcgtggatcagcccataccgatgtgtcctcgtgcccgtacctgatgctgcaggaactggggcaacctcccctgtatgggggctgggtccagaagttcaatgaggcaggcatcagcgtcgtgaccctggacaatcagggctgtggccgctcagatggtgccaggaacctccggtactttgtggagtccttccaggactacgtgaacgacgtcctgctcctgcgccggacgctgggcgaggtggacgtgcccggcttccgtgacctcccggtcttcctctctggcatctccatgggcggctgcgtggcgctccatgccgcgctcgaggaccaaaccctgttccggggtctcgtgcttctggcccccatgctgtcgctgcagcgcgtctcccgccgcggcctgaatccctacatgcgccccgtggcggcgctgctcagccgcatcgtgccctgggcggccatcgtggcaacggaccgcaacaagctcaaccccgtcctgcaggaccagtgggactcggacccgctggtggcgcacatcaacacccgcgtgcgaaacgccaatgagtacctgcgctgcaccgagtctatcatggggcggctgggggaggtgacgctgccattcatcgtggcgcactcggagaatgactccatgtgcgacccggacggctccaaggcgctgtaccgcgaggcgcgggccaccgacaaaaccatccgcctggtccagcagaagacgtggccgcagggcgccgcggtggctgccacgcgcgccgagaggcagagcgggcaccgccgccgcggcgcg

SEQ ID NO: 49172 - protein, 252 aa, Auxenochlorella protothecoides
MLQELGQPPLYGGWVQKFNEAGISVVTLDNQGCGRSDGARNLRYFVESFQDYVNDVLLLRRTLGEVDVPGFRDLPVFLSGISMGGCVALHAALEDQTLFRGLVLLAPMLSLQRVSRRGLNPYMRPVAALLSRIVPWAAIVATDRNKLNPVLQDQWDSDPLVAHINTRVRNANEYLRCTESIMGRLGEVTLPFIVAHSENDSMCDPDGSKALYREARATDKTIRLVQQKTWPQGAAVAATRAERQSGHRRRGA

SEQ ID NO: 49173 - DNA, 1083 bp, Auxenochlorella protothecoides
cgtagacacggcgctgtcgctctacgacctccattcgtttgagatgctgtgggaggaggagatggacaccaaatgcctgattggctggaacgacgacaccatggtcatctccttccgcggcaccgccagcatggcaaacgtcgcctcggacctcaaggtctggcgcaagatctggcccaagaacatcagcaccaagcggtgctggaagctgggcggcgtcccgcgcgtgcactccggcttctaccatgcctacaccgccaacggcttcaacttccagttgatgaagcgtctgaagtcgttgctcatccgcctgtccaaggacaacccggggaagcgggtgcgggtgtacgtcacgggccactcgctgggcggcgcgctggccacgctgtgcgcctacgacgtcatgacgcactgccagatgaaccatgccgagcactacgaggtgtcgtgctacacctttggcgcgccacgcacgggcaaccacgcctttgccaagctcttcgccggcgtcgtgccggacacgtggcacatcatcaacagcgacgacacggtgacgcgctctggcaagttcttcttcctgtacaagcgcgggggccaccgcgcgatgatcaacccgcggggggacctgctggtgcggccgccatacgtcgagcagtttgtccatcgcatgcctggaaccggcagcctgcgcgaccactacctgacgtcctaccagcgtagcatgatggcggtgctggccgcccagtttggccgcaagtcgattatgggcacgcgggcggtgctggagaaagctggcctcacctgggcagactttgagcggctggagagggaggggctcagcgccgggctacgcagcacgtctggcctggtcgattgctcctgcggcaatgtggtgcgtggaggggcaggagggtcccggtgaacagccagatcccgaatcctccttttccttcagaggtggtggtgggtcccctggcggacatggagttgcctcatcccattcgcgtcgatgcctgggcatctccgtgacattccctgcctctgcaaccaacctcccaccccacctccaaccccctcccctcc

SEQ ID NO: 49174 - protein, 306 aa, Auxenochlorella protothecoides
VDTALSLYDLHSFEMLWEEEMDTKCLIGWNDDTMVISFRGTASMANVASDLKVWRKIWPKNISTKRCWKLGGVPRVHSGFYHAYTANGFNFQLMKRLKSLLIRLSKDNPGKRVRVYVTGHSLGGALATLCAYDVMTHCQMNHAEHYEVSCYTFGAPRTGNHAFAKLFAGVVPDTWHIINSDDTVTRSGKFFFLYKRGGHRAMINPRGDLLVRPPYVEQFVHRMPGTGSLRDHYLTSYQRSMMAVLAAQFGRKSIMGTRAVLEKAGLTWADFERLEREGLSAGLRSTSGLVDCSCGNVVRGGAGGSR

SEQ ID NO: 49175 - DNA, 1509 bp, Auxenochlorella protothecoides
  modified_base (1092)..(1101): a, c, t, g, unknown or other
acccccgattcgccggtgtcgatagagcatggcctgagcctgtaccctgacctgcaacatcacgagctcctgctggagcccgccaccgacacacgtgtgctgctggtctggggccgctccaccctggtcgtcgccttccgggggaccgtcaccaggaagaacgtcctgaccgacctggaggcttggtcgacgccacacctcccgagcaggaagaatgcctacggccgcacgctccgcgtgcactccggtttctaccgggcgtggcgcaccgccgacctcggcgaccgcctcgtctctcgcctggcacagctgctggagggctgcccccacggcgccaggccgcgagcgctgttcacaggccacagcctgggcggcgccctggcggtgctggcctccatcgaattcgtgcgacgtgcgccgcagtacgcggcgggggtgtcggtgtacacctttggctccccacgcgtcggcaacggcccctttgccacggagcaccgggcagccgtgcccgactgctggagcgtgatcaacaaccaggaccccatcccgcgcatccccaagggctggttccacggcgcggggcaccgcgtggtggtcacgccgcgcggcgacctcatcatcaagcccagcacgctggagctgtcggtcatcttcaagtctggcggcgtagcggcgcaccaccgcctccccaactactccctgtccctcttcagcctctttcgcgcccagtttgacgccgccaagaagatggagggcggcgcgctgggagtcaccatcctggcgggccggctggacgtggggcagaccctggtgctgcgctacgcggggctgagggagatcatggacgccagtgagcggcgcatgcccatgcccgtggaggtctaccagctgcgcaaggccaggaaacgggcgatcgcgcgcgtggaggagcgggcaatcagcggcacctccacgactttctcacaagatgactccgtcatcagcgagcagaccgccctcgagctggtcaagcaggcgggggccatgggggaggaggatgtgctgggtgacacctcggtggtccgggacctgggcggcaagcggatcaaggcnnnnnnnnnnatcatcagcgagcagaccgccctcgagctggccaagcaggcgggggccgtgggggaggaggatgtgctgggtgacacctcggtggtccgggacctgggcggcaagcgggtgctgggcacccaggagtagcaggcggagaaatccagtgccctaggtccaagctgcgctccactcccccgctgacggccatcaacttttcctcggtcgcaatgacagcggctgccttgaccaaaccctgtggggccgatgaagacccctgtaccgatgtgtatactgtgacttgcacatatgtatcgatctggagcgtcggcggcctgcagctgttgctctgttgcctctttttcttgtggcgaaccccacatctgacgctctaggtttgcgagccatatttccctaactcagagtctt

SEQ ID NO: 49176 - protein, 410 aa, Auxenochlorella protothecoides
  MOD_RES (364)..(367): Any amino acid
  MOD_RES (410)..(410): Any amino acid
TPDSPVSIEHGLSLYPDLQHHELLLEPATDTRVLLVWGRSTLVVAFRGTVTRKNVLTDLEAWSTPHLPSRKNAYGRTLRVHSGFYRAWRTADLGDRLVSRLAQLLEGCPHGARPRALFTGHSLGGALAVLASIEFVRRAPQYAAGVSVYTFGSPRVGNGPFATEHRAAVPDCWSVINNQDPIPRIPKGWFHGAGHRVVVTPRGDLIIKPSTLELSVIFKSGGVAAHHRLPNYSLSLFSLFRAQFDAAKKMEGGALGVTILAGRLDVGQTLVLRYAGLREIMDASERRMPMPVEVYQLRKARKRAIARVEERAISGTSTTFSQDDSVISEQTALELVKQAGAMGEEDVLGDTSVVRDLGGKRIKXXXXIISEQTALELAKQAGAVGEEDVLGDTSVVRDLGGKRVLGTQEX

SEQ ID NO: 49177 - DNA, 1656 bp, Auxenochlorella protothecoides
cactcattccctccatatagacattcgaaacccagatcgcaatggttcgcaagctggtcgtcgccgtagacgactcggcggtcagcaagagcaccctccagtgggcggcagaaaagctgctgcgacccgatgacgagctgcacatcatctccgttgcggacgtgaagctggccacccttgtgacgtgtgtgggcggcgctgctgacaccgggcgccacatcgtcgactactcgcgacggcaggatgccgatgtggtgctcatggggtcccgcggcatgggcagcctgagacgtgccatgctgggcctgctgggcttgggcagcgtgtcaagctatgccatagaagacctcctggcgtccaagatcggcatcattcccacggacaccagccccgcctttgtgtgctgcctccatgaccgtgtggccgtgcaggccatgtttgacatcgccggcctctcggccctgatggctggcgtggatgggcccctgctctgcaccacggtgcctggccgggaggacccaggcggcgaggagcaggctcccgaccttgcggaactggccgaccgctactgcgctgcaggggtggggtttgtggtggccgaggagggtcagcgctggggtgccctgaagaagctgggcttcgtgcccgaggccagcgcccgcagctacgagatcgccaccaacatctacagcacagcgaaaagctacgtgccagccagcctgcagccccgcatcgagaaggtcgaggagactgtgacgaacgccagcgccccgtacgtgaccaaggcccaggacaagggcgccgagctgctcaaggccgcggacgagcgggttgacaaggccatcggccaggccagccaggtgtacgccaacaactctgcctttgtggccgccaccgtggaccgccagaaggcctaccacgcccagaacctggagtcgtacaaggccgcacgcgagcactacctcaaggtagtggagcagggcgtggactacctgaagcgcgagggcctgggcggcgccacgcgcgccgcagtggacgaggtgtcggcgcggctggccgacgcgcgtgccgtccccggcctggttctcacccggctgcaggagtcggtggaccgcctgctgcgcctcgcccccgtgcaccgcgcagtggagggcctcaagcccggcgtggacgcagcctactcgcgctacgcggccctgcacgacggcgtcgtctcctccccccagtacaagcgcgcactggccgcggggcagaacgtgctggcacgggcccaggccacgcagctgtacgcgcggtcgcgctccgcgctctacccctacgtcgcgccctacgcggagcccgccgcgcagcgcctgcagccctactacctgcgcgtcgtggagcacctcgcgcccaaggacgcctgaacagcaggggagcgagcgggggagcgagcggagggagggggctgttggcagcgtgctcggtgtgagccagagttggggcacccaagtgggcggccggctggcaggcgtgggcagacgcagtcgatatgatggggcccttcctacacgagggccttgcttcatctctgagaaacccccagacccaccaacccctcagtgtcaagctcattttcgctgcccaagacaatagatatccctgattcgtccatag

SEQ ID NO: 49178 - protein, 454 aa, Auxenochlorella protothecoides
MVRKLVVAVDDSAVSKSTLQWAAEKLLRPDDELHIISVADVKLATLVTCVGGAADTGRHIVDYSRRQDADVVLMGSRGMGSLRRAMLGLLGLGSVSSYAIEDLLASKIGIIPTDTSPAFVCCLHDRVAVQAMFDIAGLSALMAGVDGPLLCTTVPGREDPGGEEQAPDLAELADRYCAAGVGFVVAEEGQRWGALKKLGFVPEASARSYEIATNIYSTAKSYVPASLQPRIEKVEETVTNASAPYVTKAQDKGAELLKAADERVDKAIGQASQVYANNSAFVAATVDRQKAYHAQNLESYKAAREHYLKVVEQGVDYLKREGLGGATRAAVDEVSARLADARAVPGLVLTRLQESVDRLLRLAPVHRAVEGLKPGVDAAYSRYAALHDGVVSSPQYKRALAAGQNVLARAQATQLYARSRSALYPYVAPYAEPAAQRLQPYYLRVVEHLAPKDA

SEQ ID NO: 49179 - DNA, 1085 bp, Auxenochlorella protothecoides
  modified_base (123)..(200): a, c, t, g, unknown or other
  modified_base (948)..(957): a, c, t, g, unknown or other
attacaacatcgaggtgagaacctcgatctgtgcgaccctgtactgaagggcgaattgtccttgcatgacgcgcaacctgggataatccctgcgatccatagccgtgcccgctcgaacgctgnnnnnnnnnnnnnnnnnnnnnnnnnnnnnnnnnnnnnnnnnnnnnnnnnnnnnnnnnnnnnnnnnnnnnnnnnnnnnnctcccccaggcgtccccaaaacacccccaagcgtggtgtgtggggagacccccacccctgccccccaggagtcgggcggcatggacgccaaggttgtcgcacacgacagcggttcgacttccaccgccagcggaggcgctgggcccaaggaccccctccgcccagcggtgcaggcgtcctggatgctctcaggcgacaccgccacccagtacgggaagagtgcggacgcacccctgcccgggctggggtcccagccggaggcctccgtgggcttccaagccagggtccaccagggcatgggggagctcccggggccctcctccaccgcgaacatcccggtcctccccgacattgcccggctgaaggacagtaggagggacatccctctcacctgccaggtgctggggtgtgggcagagcctggtgggccacgccgattactaccagcgctatcgggtgtgcaagccgcacctcaagggccccgccctgatcgtggagggcctcccgcagcgcttctgccagcagtgtggcaggtttcacccgctggatgcctttgatggggacaaaaggaactgccgggcgcggttggagcagcacaactcccggcgccgcaaggtgttcaccacgactcaggccagccggaggcctgctgggaagcgggaggagcccctgcactccgctggccccaccagtggcgactgggcgggggacgcccagctcgccagctcggccccctcccaagcaggccnnnnnnnnnnggtgttcaccacgactcaggccagccggaggcctgctgggaagcgggaggagcccctgcactccgctggccccaccagcggcgactgggcgggggacgcccacctcgccagctcggccccctcccaag

SEQ ID NO: 49180 - protein, 268 aa, Auxenochlorella protothecoides
  MOD_RES (223)..(226): Any amino acid
MDAKVVAHDSGSTSTASGGAGPKDPLRPAVQASWMLSGDTATQYGKSADAPLPGLGSQPEASVGFQARVHQGMGELPGPSSTANIPVLPDIARLKDSRRDIPLTCQVLGCGQSLVGHADYYQRYRVCKPHLKGPALIVEGLPQRFCQQCGRFHPLDAFDGDKRNCRARLEQHNSRRRKVFTTTQASRRPAGKREEPLHSAGPTSGDWAGDAQLASSAPSQAGXXXXVFTTTQASRRPAGKREEPLHSAGPTSGDWAGDAHLASSAPSQ

SEQ ID NO: 49181 - DNA, 1231 bp, Auxenochlorella protothecoides
ccccgccctccgcctggcgcttcttccagcccttccggggcggggcctggtttgtggcgacccaggccctgggctgggccctcttctcggcgggcctcaccctcatgctgtacctcatcgcccaaggcgcagcgggtgtgatggagggcgcccggcgctacacctggacggcgggcgccatcatggtcaccgcccagctggtcctggccagctccctggtcttcttccaggggccgcagcgtaccatgcagctggtcaggcaaatcagcatatccctgggcgaggaggcgcgcccccgcaatttgcgtcagcgccttgaaaatgtggcgaccatcatcatcctgtacattccgatgcacgtgacatctgcggccatggctgcatacttcttcttcctgccacctcacattgctgtcaccttgctgattgccacgctcttcgtttactacaccgtcaccagcctgggaggcgcgcccgaggtatcagggcgccgggagtggcctgccttccaggactggtttggccggcagctggaggaggtgctgcctgcctggctggggtcgctggaggtggtccgggagggggcctcccagccgctggacccagagaaacgctatgtctttggctttgccgcgcacggcctctaccccctgggggccggctacctcccagtgctcccctccttccggcgcctcctccctggcatccgccccgtcaccctcaccgcctcggtcgtcttcgtgctgcccgtgctgcgtgacatcctggcctggctggggctgagggtggtcacacgccgctctttcttgcgtgccctgcgcgagcggggctctgtcctgctcgtccccggcggccaggccgagctggtgcacacccaccgcatcttcaccgcccgcgagtactgcgtgtaccgcagccacaagggcttcgtgagggtggcgcagcaggcacaggccagcctggtcccactcctggtgctgggcgagatcgactccctgcgcaaccttatcagcgccccggccatgctgcagtggacctacaagcgcctgggcttccccgtgccgtacctcatcgtggggcggtggggcctgacgccctttcctcagcccacgggactcagattcatcatcggggagcccatccccccggtcgagctggggccgggggaggagcccacccaggagcaggtggacgctgtgcatacggcgttctacgacgccatgcaagcgct

SEQ ID NO: 49182 - protein, 409 aa, Auxenochlorella protothecoides
PPSAWRFFQPFRGGAWFVATQALGWALFSAGLTLMLYLIAQGAAGVMEGARRYTWTAGAIMVTAQLVLASSLVFFQGPQRTMQLVRQISISLGEEARPRNLRQRLENVATIIILYIPMHVTSAAMAAYFFFLPPHIAVTLLIATLFVYYTVTSLGGAPEVSGRREWPAFQDWFGRQLEEVLPAWLGSLEVVREGASQPLDPEKRYVFGFAAHGLYPLGAGYLPVLPSFRRLLPGIRPVTLTASVVFVLPVLRDILAWLGLRVVTRRSFLRALRERGSVLLVPGGQAELVHTHRIFTAREYCVYRSHKGFVRVAQQAQASLVPLLVLGEIDSLRNLISAPAMLQWTYKRLGFPVPYLIVGRWGLTPFPQPTGLRFIIGEPIPPVELGPGEEPTQEQVDAVHTAFYDAMQA

SEQ ID NO: 49183 - DNA, 1011 bp, Auxenochlorella protothecoides
gcagctggtggttccccgtgtctgagctcaaggcactgccccacgccaatgcctcttacacctacgtggacggggacggcaccgtgcccaccgagtccgcgatggccgacggcttcgatgctgtagaaagggtgggcctggtgggggcgcaccgcccgctcatctccatgcagagcgcctgggaccagatcatgacctggatacgggcgggcggggagccagcgggaggggcgagactgcaagccgcggatgccaagtgggagaatcagacagcagacctcgcctccctcccagccctgctgagctcgtgccatccccgccacaccagggcccacctcctggacagcgccctggccgtgctttccttgacgcagtctccgcgcagccaggtggcgcgagccgcgctgagcaccctcgaggtcctggtgaaagcccactgctccaagctcgataggctgctggagaccatgctgcccgtcctcctacccctggcattccccgtcgggcgcgccgggttccttgcggcagccgccagggcagtgctgagcgcggcggcgcaggcggcgcaggcggcgccgatgatgaacgccctgctgtccgccctggcaggcgccaaggtggctgccgcccgcgcgtacctcgcacgtctctgctgcgagctgcagcgccgacacgggtccgcgctggcccacgacaccctcctgctgcagaggacggcgcaggctgcgctgcagctgcaacgggatgcacactccgagcagagggcagcggggaaggccatgctgcaaggggtgtatcaggcagtgggtgaccaggcaggcttcatggccatgctcaagcagtggggcctggtcttcgccggcttcctcatcgtcctctacttctcggccggcgccgtggacaagctcgtggctcgggcccagaggcgttccctgggtctgtgtgaggagtgtggcggcgtgtacctgcccgagacctgccccatgggcaaggcctgcccctgcctgcccc

SEQ ID NO: 49184 - protein, 336 aa, Auxenochlorella protothecoides
SWWFPVSELKALPHANASYTYVDGDGTVPTESAMADGFDAVERVGLVGAHRPLISMQSAWDQIMTWIRAGGEPAGGARLQAADAKWENQTADLASLPALLSSCHPRHTRAHLLDSALAVLSLTQSPRSQVARAALSTLEVLVKAHCSKLDRLLETMLPVLLPLAFPVGRAGFLAAAARAVLSAAAQAAQAAPMMNALLSALAGAKVAAARAYLARLCCELQRRHGSALAHDTLLLQRTAQAALQLQRDAHSEQRAAGKAMLQGVYQAVGDQAGFMAMLKQWGLVFAGFLIVLYFSAGAVDKLVARAQRRSLGLCEECGGVYLPETCPMGKACPCLP

SEQ ID NO: 49185 - DNA, 1419 bp, Auxenochlorella protothecoides
gagcgtgtcaaggccctgaagaaggagcatggcagcaagatcctgggtcaagtcaccgtggagcaggccatcggcggcatgcgcggcattccgatcctgggtcaagtcaccgtggagcaggccatcggcggcatgcgcggcattccgtgcatgttgtgggagacctccctcctggatgcggacgagggcatccgcttccgcggctacaccatccccgagctgcaggagaagcttcccggcgccgcccccggcggcgagcccctgcccgagggcctgctctggctgctgctcaccggcgaggtgcccaccccggcccaggtgtcctcagtgacagaggagctgcgctcccgctccgccctgcccaaccacgtcaaggcgctgctgggctcgctgccggcgggcacgcaccccatgacgcagctggcgcaggcggtgctgggcctgcagtccggcagcaagtttgcggcggcctacgacgcgggcctgcacaagagccggtactgggagccggtgctggaggacagcctggacctgatcgccaagctgccggagatcgcggccatcatctaccgcaacaccctggacctgatcgccaagctgccggagatcgcggccatcatctaccgcaacgcgtatgcggggggcgagctgatcgcccccgatccggccctggactgggccgccaacctgagcgccatgatggggttccgggagcacggcgcgctggagctgatgcgcctgtaccagacaatccacacagaccacgagggcggcaacgtgtcagcccacgccacgcacctggtcggctccgcgctctccgacccctacctggccttcgccgcgggcatgacggggctggcgggcccgctgcacggcctggccaaccaggaggtgctgcgctggatccagcacgtgacgcgcgagatcggggagagccccagcaaggagcagctcagggagtttgtctgggccacgctcaagggcggcaaggtggtgcccggcttcggccacgccgtgctgcgccgcaccgacccgcgctacacctgccagcgagtgtttgcgcagaagcacctgcccgactaccccatgttcaagctggtcagcgacctgtacgaggtggtgcccgacatcctcaccgccacgggcaaggtgaagaacccctggcccaacgtggacgcgcactcaggcgtcctgctccagtactacggcatcacccaggagagcttctacaccgtgctctttggcgtgtcgcgcgccatgggggtgctggcgcagggcgtctggtcccgcgcgctgggcctgcccattgagcggcccaagagcctcaccgtggatgccatgctggaccgcgtcaaggggcagtgaggcaggagctcgaaggtgccgaggccgcggcgggtgccgaggccgggtggccaa

SEQ ID NO: 49186 - protein, 454 aa, Auxenochlorella protothecoides
ERVKALKKEHGSKILGQVTVEQAIGGMRGIPILGQVTVEQAIGGMRGIPCMLWETSLLDADEGIRFRGYTIPELQEKLPGAAPGGEPLPEGLLWLLLTGEVPTPAQVSSVTEELRSRSALPNHVKALLGSLPAGTHPMTQLAQAVLGLQSGSKFAAAYDAGLHKSRYWEPVLEDSLDLIAKLPEIAAIIYRNTLDLIAKLPEIAAIIYRNAYAGGELIAPDPALDWAANLSAMMGFREHGALELMRLYQTIHTDHEGGNVSAHATHLVGSALSDPYLAFAAGMTGLAGPLHGLANQEVLRWIQHVTREIGESPSKEQLREFVWATLKGGKVVPGFGHAVLRRTDPRYTCQRVFAQKHLPDYPMFKLVSDLYEVVPDILTATGKVKNPWPNVDAHSGVLLQYYGITQESFYTVLFGVSRAMGVLAQGVWSRALGLPIERPKSLTVDAMLDRVKGQ

SEQ ID NO: 49187 - DNA, 387 bp, Auxenochlorella protothecoides
ggtgcttgcggatatggaagcatttccaaggatgcctacccctacttctccgtggctgccttctcaccttccaaccactactaccagtctgacgccctgaaggcctgcggccagtgcttccagattcagtgcgaggagggccgtaacggcaagactggcgtgtgcaagactgatgcccagggcgaacccctgtccatcctggtcatgatctccgacgtctgccccgagtgcgaggccaaccacatcgacgttcagtccctggcctttggcaagctcgccgaccagggcctgggcaacatcgacgtgcgttaccgccgcgtcgagtgcgccgtgcccgagaacatgaaggtgtctgtcatgaactacgacggcgccggccagtggctg

SEQ ID NO: 49188 - protein, 129 aa, Auxenochlorella protothecoides
GACGYGSISKDAYPYFSVAAFSPSNHYYQSDALKACGQCFQIQCEEGRNGKTGVCKTDAQGEPLSILVMISDVCPECEANHIDVQSLAFGKLADQGLGNIDVRYRRVECAVPENMKVSVMNYDGAGQWL

SEQ ID NO: 49189 - DNA, 707 bp, Auxenochlorella protothecoides
  modified_base (62)..(212): a, c, t, g, unknown or other
gctattgtttttaatcgctccactttcttcccaacagatactcctcgtgggcgacagcagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggacccaaggacatgggagcgatgcagcgtgtggacttcaaggcaaaggttgtggagttgaatggagagaagatcaagctgtccatctgggacacggccggccaagaacgtttcaggacgctgaccagctcatactacaggggcgcccagggaatcatcttggtgtacgatgtgactcgaagggagacatttgagagtctggaggaggtctggctgcgggaggtcgacatgtatgccacggtggaggatgcggtgaagatggtggtcgccaacaagacggacttggaggaggagcgccaggtcagcagaaaggacggcattaactttgcacggaagcacggcgcgctcttggtggagaccagtgccaagggcaacattgcagtggatcaggctttcgaggagctggtgctgaagatcttggagacgccaaccctgctcgcagggacgagttccaactttgggctgaagcccaaggccgcccagcagcagcgggc

SEQ ID NO: 49190 - protein, 157 aa, Auxenochlorella protothecoides
MQRVDFKAKVVELNGEKIKLSIWDTAGQERFRTLTSSYYRGAQGIILVYDVTRRETFESLEEVWLREVDMYATVEDAVKMVVANKTDLEEERQVSRKDGINFARKHGALLVETSAKGNIAVDQAFEELVLKILETPTLLAGTSSNFGLKPKAAQQQR

SEQ ID NO: 49191 - DNA, 332 bp, Auxenochlorella protothecoides
gtttcctggatgtatgaggttcggtgggtggaggcgagaatggtggccatcgcgtccagatggggggtactcatccgcttgcgtcgacctgggtgcacggaggtgggcccggggtggaaagggccaccaatctggcagcagggttacatgtgggggtgcggggtgagtggatatgcatgggaccagggacacatctgtgcccaggccccagtcagtctgtcagggactccaagagcaatgcagtgcgcatcaagcatcggcaatctgggccctgcgggtgcagcgtggatgcactggccatgcccaggcgccgcgggagggggggggggggg

SEQ ID NO: 49192 - DNA, 750 bp, Auxenochlorella protothecoides
atccgaccaatagctcatgcaatctgggatccacattttgggcagccggccgtggaagcttttacacgtggcggtgcttcaggtccagtaaatatatctacatctggtgtttatcaatggtggtttactattgggctacgaactaaccaagatttatataatggatctatttttttaattatactttcagcattatttctatttgcaggctggttacatcttcaaccttcttttcagccaacgctttcatggtttaaaaatgcagaatcgcgattaaatcaccatttagcaggtctgtttggaataagttctctagcttgggcaggtcatttaattcatgtggctattcctgaatctcgtgggcaacatgtacgttggaataattttctgactgttttaccacatccggctggattaactcctttttttacaggtaattgggttgtatatgctcaaaacccagatgcagctactcatgtttggaatactaatgaaaacgctgggagtgctattttaacattcttaggagggtttcatcctgaaactcaaagtctttggttaacagatatggcacatcatcatcttgctattgctgttgttttcatattagccggacaccaatatagaacaatttttggtattgggcatagtatcaaagaaattctagaaagtcacactcctccgtcaggaaatttaggtgctggtcataaaggtatttatgatactcttaataattctttacactttcaa

SEQ ID NO: 49193 - DNA, 750 bp, Auxenochlorella protothecoides
ttagggttagctttagcgagtcttggcacaattacatctttagtagcacaacatatgtattcgttaccaccgtatgcttacttagcgcaagattttactacacaagcatctttatatacacatcatcagtacattgctgggtttttattaacaggtgcatttgcacatggtgctatattttttgttcgtgattatgatccagaagcaaatcgtggcaacgtgttggcacgtattttagatcataaagaagctattatttcacatttaagttgggttagtttatttttaggttttcatacattaggattatatgtacataatgatgtaatgcaagcttttgggactccagaaaagcaaattctaatcgaacctgtttttgctcaatggattcaagcttctcatggtaaaactgtttataattttgactttttattatcatcatcaacaagtgctccaagtattgctggtcaaaatttatggttacctggatggttagaatcaattaataatgaaagtaattcattatttttaaacataggccctggtgatttcttagtgcatcatgcaattgctttaggactacatacaactacattaattgggatcaaaggtgctctagacgcgcgtggttcaaaattaatgccagataaaaaagattttggttatgctttcccttgtgatggtcctggacgtggtggtacttgtgatatttcagcttgggatgctttctatcttgctattttctggatg

SEQ ID NO: 49194 - DNA, 137 bp, Auxenochlorella protothecoides
taacaatatttcccccgtaaaatttttattaatctctacaaaaaacaaaaaaaaatgattattatttatttagtatatggaataaatacaaataaaaaaagcaataaataataaaaaatacaaagaggttcaatatt

SEQ ID NO: 49195 - DNA, 139 bp, Auxenochlorella protothecoides
aatacatattttaatttataccaaaagtattattatttttttgagctttttattttctaagtacttgatttttttgttgttatggagtattttacataacaacaaaaaaatctatgaactattcgtattgtataaacat

SEQ ID NO: 49196 - DNA, 1224 bp, Artificial Sequence
  Description of Artificial Sequence: Synthetic polynucleotide
atggtagtagctgctgctgcttcatcagctttttttccagtaccagctccacgaccaactccaaaaccaggtaaatttggtaattggccatcatcattatcacaaccatttaaaccaaaatcaaatccaaatggtcgatttcaagtaaaagctaatgtatcaccacatccaaaagctaatggttcagctgtatcattaaaatcaggttcattaaatactttagaagatccaccatcatcaccaccaccacgaacttttttaaatcaattaccagattggtcacgattacgaactgctattactactgtatttgtagctgctgaaaaacaatttactcgattagatcgaaaatcaaaacgaccagatatgttagtagattggtttggttcagaaactattgtacaagatggtttagtatttcgagaacgattttcaattcgatcatatgaaattggtgctgatcgaactgcttcaattgaaactttaatgaatcatttacaagatacttcattaaatcattgtaaatcagtaggtttattaaatgatggttttggtcgaactccagaaatgtgtactcgagatttaatttgggtattaactaaaatgcaaattgtagtaaatcgatatccaacttggggtgatactgtagaaattaattcatggttttcacaatcaggtaaaattggtatgggtcgagaatggttaatttcagattgtaatactggtgaaattttagtacgagctacttcagcttgggctatgatgaatcaaaaaactcgacgattttcaaaattaccatgtgaagtacgacaagaaattgctccacattttgtagatgctccaccagtaattgaagataatgatcgaaaattacataaatttgatgtaaaaactggtgattcaatttgtaaaggtttaactccaggttggaatgattttgatgtaaatcaacatgtatcaaatgtaaaatatattggttggattttagaatcaatgccaactgaagtattagaaactcaagaattatgttcattaactttagaatatcgacgagaatgtggtcgagaatcagtagtagaatcagtaacttcaatgaatccatcaaaagtaggtgatcgatcacaatatcaacatttattacgattagaagatggtgctgatattatgaaaggtcgaactgaatggcgaccaaaaaatgctggtactaatcgagctatttcaact
